United States Patent 12,553,090 (MOLECULAR PREDICTORS OF PATIENT RESPONSE TO RADIOTHERAPY TREATMENT) - sequence listing, part 4

SEQ ID NO: 131 - DNA, 187076 bp, Homo Sapiens
tacttttggaaaaaaactttattaaacactcaagagtatacttctcaaaatcacagaagagcctccaaatacaagtgttagaaggaaaaaaaaaaacaacaaaaagctaaaagccaatcagaaacagtttgggtgtggaggactggcggggggggacagggactgcacatgggaaggagccacttttgtattccataatttcatcttgttgtgctagaatgcatgctttttttcctccaaatgaggaattcatttcaaataggaatttcttttattctcctggaactgaaatgcttagtactatccctaacaacaaccatgggatttttgaagttatcccaaattcaatgcaaagcacttttatgtatcttccagttgtagattggaatagcaaaagtgaatgctatgaccaaaatttttgccctcctaaataaagacgtttccttctagagagcaaatctatcataaaatgtcaaaactagaagagaataaaatgaaaggaaaaaacctagaaaaatatcctaaaatatcaaatgcagtcatttctaaatataagccataattatagctttacctattgttcttattgttcctatgctgcttctacaatgttacatcaactatacttagctttactctcccaaaatcttggtgatgaagccttctgagtgtgctttccaatgtgccagaaccagaagggcattccaaggcttccccacatttcctccatttacggagacagctgtttcactaacttgcagcacttgtaaatgctttgaaagctgatcacatattatattcttgacttaatactttggtaagcctggatatctatctttctataaacctcacctaatctttgatgttactataaccttatctttgatttaacccatacacatttactcatcataatcttgatttaaactcatgctacgaaactgtagcacaaaagacatttctctttagtgtttcaggaaaatcagctcatggaatgctgccaaccaaagtatagtagattctttaaacaatgtaatgctttctatctgcagactcccacagacctcacatccagggctcccatccttcccaggttctgccaaggatgttggggtctgttgcctggtccatcaggcacttcacttgagtctcttctgaaagcccactctctggttcttgggcacgaatgttgtgatctttgcttcctcgtgccacagccacatagtctctgaaggcaggggccttctcatgacccaggagtagctcatcactggaaaaaaaacaaacacagaaaacacaaagcatgtgtcattgtcctttgttgcctgcatccctagtgatcctatccaaacacattccccacgtcatcactcacagagtattttctgtggcttataaccttgaagtcaaagactggatttgtaggaaaacagaacatgaattatgctgctcaagtttttgtgtgaatgtatgccttcacttctcctgagtgaattcctaggattcacctaggagtggcattgatgggtccaatggtaactctatgtttaactttgtgaagaactgccactttcccacagcagctgcaccttttcccactcccaccagcagagtatgaggagtccaccttctctacatcctcaacacttgttagattcctttttttttaattaaaaaaagagaaagttttaaaaatttttggtagagacagggtcttgctatgttgcccaggctagacttgaactcccgggctctagttatcctcctgccttggcctcccaaagtgctgggattacaggtgtgagccactgcattagccccattttaaaattatagtcatctggcaaggcgtggtggctcgcctgaggtcaggagttcaagaccagcctggccaacatggcgaaaccccatttctactaaaaatacaaaaattaccaggcgtggtagcatgaacctataattccagctactcaggaggctcggacaggaggatcgcttgaacccaggaggtgggggttgcagtgagtccatatcgtgccattgcactccagcctgggtgacagagcaagactttgtctcaaaaataaataaataaataaataaataaattaattaattaatagccatcctagcaggtgtgaggtagtatctcacttggatttccctgatgactagtgacgttgagcatttttgcatgccgcttattggccatttgtatattttcattaaagaaatgtcagttcaagtcttttgaccatttttttttttttttttttttttttgagacagggtcttgctctgtcacccaggccggagtgcaatggcgtgatctcggctcactgcaacctctgcctcctgggttcaagtgattctcctgcctcagcctccctagtagctgggattacaggtgtgagccactgcgcccagccctgaccatttttaattgggttatctatctacctattattaggcaataagagtttttttaatgtattctagatacaagtcccatatcagatacatgacttgcaaatattttatcccatttggaaggctgaaacaccttcttgatagcactctgtgaagcacaaaattgtttaattttgatgaagtccaatgtatatatttgtttcttgcttgtgctttcagtgtcatacctaaaaaatggcaagtatcacaacaaaatccaaggtcaggatgatttactcctattccttttttttttttttttctgaggcagagtctcactttgtcgcctaggctggagtacagtggtgccatcttggctcactgcaacctccgcctccccaggttcaagtcattctcctccctcagcctccctagcagctgggattacaggtgcgcaccaccatgcccagctaatttttgtatttttagtagagatggggtttcaccttgatggccagggtggtctcgaactcctgacctcaagtgatccactagccttggcctcccaaagtgttgaggcgtgagccaccacgcccagctgatttactcctatttctaagtgttttatagttttgactcttacacttagctctctgatccattctgaattaatttttccacatggtgtgaaacaaggacctaacttcattcttttgccagcgctatttgttggaaaggtcactgaatggtcttggcacccttgtcaaaaataagttgacaatagattgccactattacttaattctaaagtccaacttttttcattcctatgaatcatctccataaatttctatttgctttagacctcaacaagagaaaactttaaggctaacctaaaagccaacccaaattgaattctcatctaacaagcccacacagtgcttttcatacctaggtactatattcatcagggtcaaacgccctaaaaaggacaaaagcaaatttaaaacctaagtctcctcatgcatgtaacaatattctggcaactgtctaagagtgcaccttctgtttctccaattggcgccactgttccagggactgagtttaaacctgaagacagtgcaggggtcacatacgtcagagttgcaggccttgccctggctttggggaagtcagcctctctaagccctgctttcctcctcaatgaaagcagagaagtcatgctaacagagtgtcaagagctcagcactttgtatatatgttggctcctcgagaaacagtagcatgtcggtagtccgttagttttttccacatataaaaatcttaccaagtaatgactgctggattggcacctgctaactttctcttagcgtaacatattttctgtcgggggtaccaatttttttcagcaacatttatttcttgaatccatgaccctccttttttcagcattttctgttcaaaattctagaagaaaagaacatgattttcccggctgatcataatggtatatacaatcatgcccaaacagattaaatctagtaatgatcttaaagtaaacaaacatctataaccaggagcagccttgctttctacagctacaaagctgttcatacagactccatggcacacacatcacgagacgaggggcctcagcagtccccttatttctccaaataaaggttttgcctgttaatttttttttttttgaggcggagtttcactcttgtcacccaggctggagtgcagtggcgtgatctcggctcactgcaacctctgcctcctggtttcaagccattctcctgcctcagcctcccaaggagctgggattacaggtgtgcgttaccacgcccagctaatttctgtatttttagtagagacagggttttaccatgttggccaggctggtctccaactcctgacctcaggtgatcctcccgtctctgcctcccaaagttttgggattataggtgtgagccactgggcccagcctcttaactggttttcaagcagacaatcctaaatactaactttgagaaatgctgtacaaaataatgtaaatattttcatcaacatgactcaatgcacttccatcatacacgagagataccagcttgatcacggggacactgtcacaaaagtgaaaagtgcacatgaaacaaaacctactttccaatcaaaggagggctccttgacaaacacatccatggtgttggtgagcaggccagggtctgagcggaaggcccggagtgcgtgtaccatgatgctgtacataaggcccgtttctttcattggtaacatcagattgataaactggcgagttagccgaaaaggcatcaactcagggactggcagaaactaaacaagaaaaaaggcaaggagcagaatatgtaagccagaactctcaaagtaccgagcacaaatggcagcatcctcacatagttactgttcacatttagtaaaaatacagactctgcttcccttgaaatcagctacacagatgtgagttcctatgctcgagagtaaccccctcggcttgagttatccctcaatgcaaaacccacgtgcacaggacacagggccgcagagattgagaaggatgatccaaaacattcagaggttaaccagagaaaagatctgtatcacatttttgaccagacatttttattacggggcttcctaaaactttcttagagtcttcctttgatctgcgaacacatttaattaccggctctgatgatatcactgatcaccatgacttctgtgacctgactgaatgaggctgaactaagtgattatccctttctgcattcaatgaccatgacaaaacgaatctaactaatatgttgtttttccttaaaaactgtctatttctggaggttgttgaaagtcctatgatgactctcgccttgcccaggatcacgagagcacagcaagtgcacctgtgtagcggatccaaacgcatgcccaaagtcgatcccgatcacgccgccagtctccatggccaccataaagttgttcagatgtctgtctccaatcccgaggatccagtggctgatgcatatcagagcgtgagagctggcgaagtgggagcggagcgccaggaaagcctcagggcttgtactcatcctcacgaaggcccgcctacaaaagagacacagctgtgcggctgctgtgatcccactaagggtgagggcagaagggtacttactttaagagatcagcaggcactttactttctcgttttctaaaagacgtgactgtttcagtacgattagcgcccctatgatttaataatagaaacatctaattagaaaaaatttctctgacttaaaatttaaattttaaaactttttgtttatattgagactcaaatatcgaataatcttgatgatctctctgaggcaaagctaagaatcaaaagaaaacatgcaatttgcagaagaatgaactaactaatacaaagaaaaatcaaaaccaaacttacttatacattagcatgtaagctccaacatcatgttttcctgacatttttgtcagccaatctttatattcacacggcggtgccctgggatcactaatgagtgagaaaaggggaattggaattaggaagattttagcattatgtgatttcaaaggcaaagatcaccaagaattcattgaaaaatagcaaagaggcaggaaaaaataataagacttttaaccatattcaatattaacattgaacccacattactctggatcttgaatttcaatataccattattcattcttaattactcctaaagaaatccaagctattgcctatgaaaaattcaggtacaaaaccatcagatccaacaaatttcccactgacatagagaggaataagatgaactaaacataactgtttattaaccaggcatgcaattctgaaactttgacctagaaagaaccatagcaagagggcgacagcaccacaggcggctgctggaagcctcaggccatgtcactaccatagccaaaaagcccgcacagttttgctaaagatggattatgtctgtttttatctttatttagaccacttccacatctttttcttttgtttttttgagatgggagtctagctctgtcgccaggctggagtgcagtggtgcgatcttggcccactgcaacctctgcctcatggattcaagtgattctcctgcttcagcttcctgagtagctgggattacaggcaaatgccaccatgctcagctaatttctgtatttttagtagagacggggtttcaccacgttggccaggctggtctcgaatgcctgacctcgtgatccgcccgcctcggcctcccaaagtgctgggattacaggtgtgagccaccacgcctggcctctttttcttttgttttgttttgtcttttttttttttttttttttgagacagagtcttactctgtcgcccaggctggagtgcattggtgcaatctcggcttgctacaacctctacctcctgggttcaagcaattctcatgcctcagcctcctaagtggctgggattacaggcgcccgccactacacccagctaatttttctattttcagtagagacagggttttgccatgttgaccagactggtctcgaattcctgacctcaggcgatccgcccaccttggcctcccaaagtgctgggattacaggcgtgagctactgcgcccagccagtgccacatctttctttatatttccaataggtagatatacacacaatccatagtaagtatgagaaaatattttgtttttcttttttcttccaataaggcttctgcactcctatgagaaaatattttcttaaatgacaatggatgtttaagtgaacttgaaaagctgttttcagtgtttcctaggaaaaaggcagtacctgggcaatgggaaacaatgtgatacacgtatgtttaagtacttttgtgtggaaagctttaacaagttttcccgataaaatctaaagacagaacagtttcacgtgtgacttagcaattcaatcacttcaggtgaaatcttttctgagttgctattaaagttagctttaaaagtagtccactccatcttaaaattctctcctcctagtttaaactgagatgaaaattcttaggttataaaactgtaggccgggcgcagtggctcaggcctgtaatcccagtactttaggaggccaatgggggcggatcacgaggtcaagagatcaagatcatcctggccaacatagtgaaatcccatccctactaaaaatacaaaaattagctgggcatggtggtgcacgcctgtaatctcagctactcggaaggctgaggcaggagaattgctggaacccgggaagcggagaccacagtgagccgagatcacgccactgcactccagcctggtgatagagagagactctgtctcaaaaaaacaaaacactgtaacatgctgaattaagaaaaaaaacagcaaggatttaaataatgggtattggaagtgccctgtaaaaaggcagttggaaattattttcataattccattatgtaaggtgctttcaactctcctggtacctatgttaatcctgtgcggttccacgctaccattccatcccacaaatgcaggcaggtaccacaggaaaggcgacacctgcttggcacctgcattgtcaggcagagcctcagtgccagggccagatctgcaatttgtgagactccaggaagcgtgctcatcagttgccctgtcttccagggaaagtagaaacaattctaagcaaaggactcaaatgtctggaactaaaagttggtgaacactgccctgtagagtaattatcacctgggaatatgagtttgataagaatatgtttgatattttcagaaatctttcctgactgaagggaacactgctcctatttaaaaacttttaaaaaagaatcagagaacatcaaagagaaagaagccctgaagctgttcctttatcctacagcttgtcacccaaacctgtcaactttggttgtcaaaatctgtcaaccctcaaaatgtttctcatgttgtccttgtttttctttacaaaaacaaaaaggaaataaaaaaaaccttgtggttaaaatgtacatgttaattgtagaaaacttggaaaatagagaaaaggatacagaaaaataaaaaagcatccacatcatgacctagaattactagtaatcccagctaccccactttacaggctaagtgacacaggacaggttacttgacctttctgggcctcagcttcctcatctgtatagcagtgataataatacttaccttgcaggttgttggtgagaagtaaattggttcatacacgttaaaaattgagaacagtacctagcccacagaaaatgttttactacatgttatctgataattttattattatttatttccttcaacaatttttcttccccccacccaaagttaataaatattttgtattacggtaaaatatctgcaactactggttagcagccagcactccatttggtttattgacccagccagcagactgcggggcaggcagtgtgggctctcgagcgcgcctgtcacggccccgacctgccactggagaagtgaggggaggcgactgctgggggagcagggcgtgtggccgcccttacctcaggtaagccgccttctcctcttgggacatggtgttcaaaagaaggtccttcaaggtaacagtattttcaagccactcaattaatcctaacctgaaagggagaataaaaggttaacgagtaaacccaaactgctctttcttcactagaaaaacagtcccgtggacgccaagcaatatgcagcagcctactggctgggagcagcctggcagttacctggaggtcatgggcacaacgctataggtcctcagctgcagggccctctggctgcaggcggagtcttgggccaggatcccattcatgacctggaagagctgctccacgcgctggtcctgccgcaggtcctcgccacccttcaccaggaaagggtgttccctctcgtcatggccacggatgatgatgcgcttgggccttcgcagagacgccatgactgtcaccttcaaaaatcagaatgtcatctcagggcacaggctagccacgtgtcaaactcagagggaaaagccagagtggctgtgagcattcctccgtggggccgccctctgaagacagtgccaaagagcagagcgcccaggccagcaacgaatttctgctacctgcttgtgcctgactgctgtgcccgcagaaatgttgtattcctgattataaatacttgcttatgaatgtggatatctttagcaagcagcaacagccaacatgcaaactttctacagtagtaagctaatgctacacatattttatagtggatactcacacacagcttactctttgagtttatgatatcttaaatagaactgttgttcaaacactggagacataatatattaagaaacccagggccgggagcagtggcttacgcctgtaatcccagcactttggaaggatggggcaggtagatcacttgagctcaggagttcgagaccagtctggccaacatggtcaaaccttgtctctactaaaaatacaaaaattagccaggcatggtggcgcacacctgtatcccagctactagggaggctgagacatggagaatcgcccgaacccagggtgtggaggttgcaacgagctgagaatgggccactgcactccagcctggctgacagaatgagactcttgtctcaaaaaaaaaaaagaaaaaaaaaaaaaaagcccgggcatagtggctcacacctgtaatcccagcactttgcggaggcggaggtggatggatcatgaggtcaggagttcaagaccagcctagccaacatggtgaaaccctgtctctactaaaaattcaaaaaacagagctgggcgtgatggcgtgcgcctgtaatcccagctactcgggaggctgaggcaggagaatcgtttgaacccgggaggcagaggttgcagtgagccgagaccgtcccattgcactccagcccaggcaacagggcaagactccgtctcaaaaaaaaaaagaggaattcagtaaatatgctaaacttgatatatctgtgatcaacatgggccgttgtctcatatactaaaggcaaacagatcattctcatctgaagaacgttcatcaggacagggactgggtcacacaccctcacacctacccgctcatcaaacccggcgattcgcacgtggtactctggcaatggctttcccctaccgtcatactgacctaaaacaaaccagaaccttgcttaggaacagcttgttagacaaccgcctgtattttaaaacatgcctcttgatctactttttaaaaagccaatctaacatgataaaaccttttactgaaaagttttcacttaaagggaactgactttaaaaaaaatgttatttctcggccgggcacagtggctcacgcctgtaatcccagcactttgggaggccaaggcgagcagatcatgaggtcaggagacagagaccatcctggcttacatggtgaagccccgtctctactaaaaatacaaaaaattggccgggtgtggtggtgggcgcctatagtcccagctactcgggaggctgaggcaggagaatggcgtgaactcgggaggcagagcttgcagtgagccgagactgcgtcactgcactccagcctgggtgacacagcaagactccatcgcaaaaaaaaaaaaaaagttatttctcattttgactgattatggaagttagcactctattctaatagcatggacaaatcctaagtagaaaaaatgatgcattgactagaacactgcatattctcaaggccaatcaagctgcatatgacaaggctgacatttaaatgtttttcttgaaatgaaccatatgcaactgcatagtcattattaataacaaagaaaagtgtttctccaaatatgttttttcttatacccactgaaatgagaatatgaacaaccagattaaaactttttttcctctggcaaattcggggtgaggaaaatggaatgtacacaggtttcctctgaaaaagtcacgccttgaaatctggccaatttgctgtgcatctctatccttaatattatgatcttttttcctgcaggtcagtgacttatcattaacttgtcacttttttttttttttaaaaacttgtcactttaaatggaactgtgtacacatcccaggaagtaatctgcctctatacctgtatatttctgaagaaaagttattcaggagcatagcatgaatacattcagaggaaatctatgattgctgtttaccattattaccaaatgaaaatctgaacttttgtcagaatcagaaatataagaactataatctcattaaacatttagtaatgtgtgctcattcataattatggattttcctaatgatgaaaaattcggtgaattttaaaattctttaaaaaaagaaataactgtcaatatcccagtatcactattccagaaaccacgagttcttattacagtgctgtgctcctgacagtacagttttgtcacccctggaggttaactcaccgggaatctccagctcatttctcaggaactccactttgaagtcgctcatccagggtgaacattctttcagattcccagggggctttgagtctttgttcatttttaaaagtagcatgttggtaatgtcgttgaagtcactgagcttcattctcagtagtttagaacctcctttcccaaaatgtttatcaaattcttttccaaaagtctgaaattagtaagaatttactataaagactgatgtttagtttggactttggaaaaggctctaagcttataagtgtaatgaatggagtgctcaatggtatatgtttcttctctgcttttaagatgtatagttttggttgggcatggtggctcatgcctgtaatcccagcactttgggagtccaagatagtaggattacttgagccaaggagtttgagaccaacccgggcaacatagcaagaccccaactctacaaaaaataaaaacattagctgggtgtgatggcacatgcctgtagttccatctactcaggaggctgaagtgggaggatcgctattgagcccaggagtctgaagtgacagtgaactatgatgatgccactgcactccagcctgggtatccgagtgagaccgtgtctctaaaaaaaaaaaaaattatagttttgctttccttgaatatttcaatactctaaaacatccagtctgccttttgtttcttgtgttccattataagtgacacggttaatgcctgtaatcccagcactttgggaggccgaggcaggtggatcacttgagctcaggagttcgagacaagcctggccaacattgtgaaaccctgtacccacttaaaatacaaaaaattagtcgggtgtggtggctcatgcctgtaatcccagctactcgggaggctgaggcaggagaatcacttgaacccgggaggcggaggttgcagtgagccgagatcgcgccactgcactccagcctgggtgatagagtgagactccacctcaaataaataaataaatgacatggttgaccaggcgcggtggctcatgcctgtaatcccagcactttgggaggctgaggtgggtggatcacgaggtcaggagctcaagaccagcctggccaatatggtgaaaccccatctctactaaaaataaaaaaaattagccaagcgcggtggcactcgcctgtagtcccagctactcaggaggcggaggcagaataattgcttgaatccgggaggcggaggttgcagtgagccgagatcatgccaccgcactccagcctgggcgacagatcgagactcagtctcaaaaacaaaaaacaaaaacatggttagtagtgacttttagttataaatcctaataagggctttaaaaacttggcgaagtcatttaacctctgtgcactcattgtctagttagtggtctacatcattatgatgacacaaataactaggaacaaagttaaaaacaacaaaataaaggaagtagttcaatagaaataaatggctcataatttctgataccagctgaagagaaaaatttaagaatgctactttctttattaagagtctttcaagctattattttgggtaataaaccagaaaaaatattatttaatcttttttttttttttttttttttttgagacagagtcttgctctgtcacccaggctagagtgcggtggtgcgatctcggctcactgcaacctctgcctcctgggttcaagtgattctcttgcctcaccctcctgagtagctgggactacaggtgcacaccaccgtgcctggctaatttttgtatttttagtaaagatgggtttcaccatgttggccagactggtctcgaactcctgacccagtgatccgcccgcctcgcgctcccaaagtgctgggattacaggtgtgagccaccatgcccagcagatatgtttatttctaaaagcaattattataagtactctaccttagaatatagtaattatctctttgcattagcttctactcagatatttacttgaattataaatctgatatcaaataaaaaataaatctcaagagcattactagcagttactcaacagttgtcaagatttacctgatcatctctaattagaaatgtttttaccaaatttgtaactaatgtcacaacataaatctggtgtaaatcaaacgtgctctattttaagacaatccactataggaaaattgacatatataaaacagatttcttctttgatctgtaagtggatgaaaaatgtagaaaacaattttcaattcttagaaagattagctatttccaaacataatcagcatcatcctatctgaaagacataatgcccttaaggatcctctaaagtgatatttgaggcacttcgctttggtagattattctttgaacgaatgcaagttatttttgatttggtacaaggtggaaaagttctggatagattttctaaggtactagaaataaaactccaaacacatctcctgcctgaaaggaacaagggaggcctttctgcaccctgcaggcttgggcaggatcaggtgctgctgcaggggtaagaactgtgctccccatggacagccctgcagggaagtctcagggcttccagcaacaaagtggccatgaattccgacacaacgtgcacactggctgaggtagcagtgtgctgggggcaggctaggctggaggctatgtggaggccctgctgctaatgggtatgggtttcttttttctggtgatgaaaatgtactaaaattgatatggtgatgatttcatgactctgtgaatatatgtaaaactactgcattgtatgctttaaatggatgacttaaggaccatgtgaattatatagtaacaaagcagttatttaaaaaggataaagctcttcctttgccctatacatggtggaacttgagaactctggcaacaagagttccaagacttatctatgcccttaaatttcttgaggtttaatgaataaaagtaattttgacaaaaactagaaagaaaagtcagtatgacccatgctaaacagagagattgtaaagtaagctgttttaggtgagagaggaagaacattcgactcttctggagatccctgcgtggggagggttgggaaaggctctaaaggagaaatgatgctgacgccaagcccaagggcaagtctccagatggaggagggagagaaggagccaagcaggctgcaaaggtgtagcaactgggctgactgcagtctacttgctccatcattctcatcaaatgatggtgtgtttcccttccaactccagcaccctctgaaagatctcacacttaccacacttgtcctaggcacagctcttggtgagcagttttgtcacataacccctttgtatttggggactggatctgtcttctccatgtatctcctgagcacccagaactgtgccccgaactaagtgcttgaaaatacttatcagcttatttaacacacaaatattttcttggcccaatattcaagccatttgaagaattggaaatcccaatctatatgtaactttcagatctaaaaatctgagcatgaacaacgtgtaatgaaactctgaggttttacctactgactcacctgctaccagccgacctaaaaatgttatcaatgtgtcacagaaagcatgagacctaaagcattcaacagacattttaaatgcagaactgttaaattaatgattacatttaatacaaatattattacatttaataatgtaactattgactgtcacaacgactctgctatcaaaatagcaggctgtgccagtccatacctgaataaacttccttctaaaggcccccaggcctggagcctttgggtcacccaaggctgcatacattctttcatacattttttcaatgttttttttatttacaggggtttttgctagttcagctcttacatcattgctccaatcctgtcaggggaaaaaaaaagtaagaaaaaaatcaagctagattgcaattaagttttacccaacttatatgttttatgtgccagaagccgttctatcattaccttaaagagcagttcaggattagagagctgatctaaggcattaataaaatcttgaatcactcctccttgatccaacttacttttaatcctatttaaaaaaatttacaaagtttaggcaatcaaatatcttccaaaaatcaatatatattttatataccatacatatataagttatatattatacatatataaaataatgtatgttatatataactaagtataatttatacatatcatatatatataaccaactacatagtaatttaaaattccacccaatgttaaatgaagcaagaagcatctattctatcaagagatgaggttcttaaaaaagaattaataccgatcctactcaaactattccaaaacacaagggaggagggaatacgtccaaactcattctacaaggccagtattatcctgataccaaaaccaggtaaagacgtatcaaataaaaggaaaactacaggccaatatccctgatgaacattaatgcaaaaatcctcaacaaaatacttgcaaaccaaattcaacagcacattaaaaagattattcatcatgaccaagtgggacctattctagagatgcaaggatagatcaaatcaatcaaggatagatcaaatacacaaatcaatcatatctacacaacagaataaaggacaaaaaccactgatcattttaacggatgttgaaaaagcatttgataaaattcaacatcccttcatgataaaaaaaactctcaaaaaattaggtatagaaggaacatatctcaacacaataaaagccatgtacaacacactcacagctagtgtcatactgaacactgaaaaactgaaaacctttctctaagatcttgaacatgttaaggatgcccactgttattccacatactactgggagtcttagctagagcaagctgacaagagaaagaaataaagggtatctatattagaaaggaagaagtcaaattatccttgcttgcagatgatacgatcttatatttggaggcacctaaagactccaccacaaaaccatcagaactgataaattcagtaaagctgcagatacaaaaatcaacatacaaaaatcagtagcatttctatatgccaacagtgaacaatctgaaacagaaatcatagaagtaattctatttacaatagccacaaataaaagaaaatacttaggaataaacttcgccaaagaaatgaaagatctctacaatgaaaactgtaaaacatggatgaaagaaattgaagaggactcaaagaaatgcaaagttacttcatgttcatggatgggaagaatcaatactgttaaatctgtccacactacccaaagcaatctacagagtcaacacaatccttatcaaaataccaatgacattcttcacagacataggaaaaataatcctaaaatttgtatggaaccacaaaagacccagagcaaaaagccaaagccaccctgagcaaaaagaataaaactggcacaatcacattatctaacttcaaattatattacagagctatagtaacccaaacagcatgacactggcataaacacagacacataagccaatggaacagaatagagaacccagaaataaattcacacacctgcagtgaatccattttttcacaaatgtgccaagaacatacatcagggaaaggacagtctccaataaatggtcctgggaaaactgggtatccatatgcagaataatgaaactagacccctatctctcaccacatacaaaaatcaaatccaaatagattaaagacttaaacctaagatctcaaccaataaaactacaaaaacaaaaacaaaaacaggaaactctccaggacactggtctgggcacaaagatttcttcagtaataccccacaggcacatgcaaccaaatttaaaatggacaaacaggaggatcacatcaagtcaaaaagcttctgcacagcaaaggaaacaataaagtgaagggacaacccacagaatgggagaaaacatttgcaaactacccatctgacaaggaattaataagcaaaatatggccgggcgcagtggctcatgtctgtaatcccagcactatgggaggccaaggtgggcagatcacgaggtcaggcgttcgagaccagcctggccaacatggtgaaaccctgtccctactaaaaatacaaaaattagcggggcatggtggcgcctgcctgtaatcccagctactcaggaggctgaggcaggagaatcgcttgaacccgggaggcgcaggttgcagtgagcagagattgcgccactgcactctaccctgggcaacagagcaatacaccgcctcaaaaacaaacaaacaaaaaacaaccaaaatacataacaagctcaaacaactcaacaggaaaaaaaaatccaatctcattttaaaatggggcaaaggatctgaatagacatttctcaaaagaaaacatacaaatggtaaacaggtatataaaaacatgctcaacatcaatgaacatcagagaaatgcaaatcaaaaccacaacgaggtatcatctcacccccagcaataacgaatgctggtaaggatgtagagagaggaacccttgtatactattggtgggaatgtaaactcatacaaccactatgaagaacactatggagattcctaaaaaaactacaactagaagtaccatataatccagaaatcccactactggatatatacccaaaagaaaggatatcagtatgatatctgcactcccatgtttattgcagcactattcacaacggccaaaatttggaagcaacctaagtgtccatcaacagacaaatgaatgaagaaaatgcagtacatacatgcaatagagtactatttagccataaaaaagaatgagatcctgtcacttgaaacaacatggatggaactgaaggacattatgtgaaataagtcaggcacagaaaaacttcacatgttcttactcatttgtggaagctaaaaattaaaacaactgaactcgtggggaggggaggtggaaagcggggatggttaatgggcacaaaaatatagttaggaaaaacaggatctagtatttagtggcacaacagggtgaccacagtaaaatttttttttttttttttttgttgagacagagttttgctctgtcacccaggctggagtgcagtggcttgatctcggctcactgcaagctccgcctcccgggttcacgccattctcctgcctcagcctcccaagtagctgggactataggcacctgccaccatgcccggctaattttttgtatttttagtagagatggggtttcaccgcattagccaggatggtctcgatctcctgacctcctgatccgcccacttcagcctcccaaagtgctgggattacaggcgtgagccaccgcacccggcctgactacagtaaatttttattgtacatttaaaaataactaaaagagtataactggaatgtttataacacaaagaaatgataaatccttgaagtgatggatactccacttaccctgatgtgattgttacacactgtatgcctgtatcaaaatatcccatgtaccccataaacatagacacctactatgtacccataaaaattaaaaattaaaataaaaaaagagctgctcttagataaaagcaaatcttgcaactgatgttgacgttttgacgtatataacgcgatatatagtttctgaagttacattatgaaagaaaaggtcactttttaaaaaacaggttctcactatgatgtccaggttggactgcagtggcaactcacaagttcagtcatagctcactgcagccttgaattcctgtactcaagcaattctcccacctcagcctcctaagtagttggaagtacagtcacgcaccaccatgcttagcttatttttattttactattttagagatgagatctcactatgttgccaaggctggtcatgaactcttggcctcaagcgattcttccacctcggcctcccaagtagttggtattataggcacagaccatcatgcccagcaaggtcactttcttgacacactgtctctcacatctttttctcttctttcatttttcaagacaatagctgtctgttcagagaaacagtatggtgggcagggcctcagtagggcaggggtgtgttcacagataagccacccattaactgcaacagaagctgggcctcagctgggcatggtggctcacgcctgtaatcctagcactttgggaggccaaggtgggcggatcacctgaggtcacctgaggtcaggagttcgagaccagcctggccaaggtggcaaaaccctgtcgctactaaaaatacaaaaattagctgggcatggtggcacacgcttgtaatcccagctactcaggaggctgaggcagggagaactgcttaaacctgggaggtggaggttgcagccgagattgcactgcactaggtgacagcacaatactctgtctcaaaaaaaaaataaaaaataaagaaataaaaataaaaataaattaatttaaaaaaactaaaaaaaaaaaaaaaaaaaaagatgccagcgcttttcttcatcttgttgaaatcaatacattcaaaataatgaggcagatctgctcataattaaaaacaaacaaaaaaccccaaaacctcatgatggagaatgtcactacaacactacacagtttgtgtacaaagcatccttgaaatagttgcgcactactgctcactcatcatcggtctcaactcataaatccgtttaagagtggacaggatgacacttgaggccatctactgagtcctaattaaaaggaagagtcgttctgtgtattttaaattacaggacaatttcaggagctgatttcaaaaatcatctcatctagtctatcccaagcaatcatgaccatatgagcagaatgttttgttagcagtgtaagatgaaagtatttaaaggagatacatcctataacaagtaacatacccagaatagatatattcaacaaagcgacggctaagattattcttcaatgacaactctaattaatttgaaaacaaatgtagtgtccacgtgtgtgctttaaccacatttttataacctatagtatttgatcaacctattccttctgtaatattacctaccttgccacaaactccttattcttatgaccagtagaagtatccttgaaggaatagctttcgctgcttatgatgaagggataaacaatagcctgcgggtagttatcagtgatttcttccacagagtgctgaacagcaacggcttggtctttgtccagtaaggccaccatgtggctgatccagctgatgaactgccagcagggaacggaagagatctaaaacagagagctgaaacttaatgctgagtaaaacatctcacatcatctgttataaaagtaacatatgtccaaaataaagaaaactcagaagtataaaaacgcaagtacaaaacaagtcttccatcccctagctctcttctgctgcggcaaccactggactctcccaggcactttctgtgcaggagaacagtcttttgttgcaagaatggaatcacacgagacagctgctgctggttgttcttagacagatgtatagaaaaatcttctacttcattcctcctggcggctatgtagtattccatgttgtttactgctctataatgaatatttcaattttttatcacaggtaatgctgcagtagacatccctgtacacataactttatttatttatttatttttttgagatggggtctcgctctgtcgccaggctggagtgcagtggcatgatcttggctcactgcaacctccgcctcctgggtttaagcaatcttcctgcctcagacttctgagtagctgggactacaggtgcgccaccatgcccagctaattttcgtatttttagtagagatgggggtttcaccatgttggccaggatggtctcaatctcttgacctcgtgacctgcccacatcggcctcccaaagtgctgggactataggcgtgagccaccgtgcctggccaactcttttttttttttttttcttgagacagagtctcattgtcacccaggctggagtgcagtggtgtgatctcggctcactgcaagctccgcctcccaggtttacgccattctcctacttcagcctcccgagtagctgggactacaggcgcctgccaccacgcctggctaattttttgtatttttagtagagatggggtttcaccatgtaagccaggatggtctcaatctcgtgacctcgtgatcggcccacctcgacctcccaaagggctgggattacaggcgtgagccaccgcacccggcctttttttttttttttttcttttgagatggagtctcactgtatcgctcaggctggagtgctgtggcgtgatctcagctcactgcaacctttgctttctgggttttagcaattctttctacctcagccttccgagtagctgggattacaaacactcgtcaccatacccagctaatttttgtacttttagtagagacaagtttcgccacgttggccagactggtcttgaactcctgacctcaggtgatccacccgcttcggcctcccaaagtgctgggattacaggcatgagccaccgcgcctggtcccctgtacacgtaactctttgtgctatatacctgtaggataaattcctagaactaaaattacagtgtcaactttaaaaattgtaataaacattggtatggaatttttttttttttttatgagacaagagtctcactgtgtcgcccaggctggagtgcagtggcgccatctcggctcactgcaacctccgcctcctgggttcaagtgattctcctgcctcagcctcccgagtagctgggactacaggcatgtgccatcatgcccagctaatttttgtatttttagtagagacagggttccactgtgttagccaggatggtctcaatctcctgacctcatgatccgcccacctcggcctcccaaagtgctgggattacaggcatgagccacggtaaagaatttttcaaattttcatttctgaaagtattagactgactactttctaaagtctttaccaacactgcacataatcatcttttaaaatcactgtcgagccgagatcacgccactgcactccagcctgggtgacagcgagactccgtcaccaaaaaaataaaaaataaataaataaataaaaataaaatcactgtcaatctgagaagtgaaaaacacctaatttaaattttcaacttacattattagtgaggctgtatgttccatgtttatttgccttacatcctttaatcacgcatgcatttcctcccaccattttctactggtctattgtgaccatttattttgtagattgccgaagtcagctttttgtttcttatatgtgttgcaaacgtttttcttcatttttttttttgttgttgttgttttttttgagacagagtcttgctctgtcgtctaggctagagtgcagtggcgccacctcggctcactgcaacctccacctcctgggttcaagtgattttcctgcctcagcctcccgagtagctgggtttacaggtgctcgccaccacgcccggctaatttttgtttctttagtagggtttcaccgtgttggccaggctggtctcgaactgctgacctcgtgatctgcccaccttggcctcccaaagtggtgagattacaggcgtgagccactgcacctggctttttatttttttaactttgtatacggtattttctttttctgtatagaagtcaaactattttccttcatggattctggtttttgtctcttcattccaagaccatttaaaaaaatgtgttcacattttcctctgatacttttaaggtgtctttctgaagataaaacctgatgtgtctgcaatgctagagtgaggcttgagtatgggcaagcttcctgagtgcacgtgtgagctgaggacagcatggcgtgtgaggaaggatcagtccacacagctcatgtaagctcacgagagaggctactggcttcactgcacgtgtctactgggtgttttgacaacgtggagtgaatacttcatgtcctcacaaattcaaatgctgtttttatcatgtataaatattatattggaaaaaaataaaatcataatgaagttatttgctcacttatcttgaagaaaaacacatacatgttgcacttctgaatttaccttaacctgtttaatacctactgagaaagtctactattcagaatgcagaaaaaggtggaaggagtggttagggccctaaaagtcaaactgggtccccgcagcccagagatcaacattatttaaaaactcaccatgcaaagctaatagagaacgaaccatgtaaccctttttgaactattacattttcaactcaaagcttggccctatcttccagttacacgtctataaatgtcaactacgaagcctttcagaggccctacactttgcaaatgaagtcagtggaaccctcctgcacacagacagagcccaaaggacaggagtgcagctggcagtgcagcccttggtggggccaaggggcaggtcacatggaagggtgcgggttcctcccatgtccatacgctgacccctcactcatgctcccagacccctctggacaccgtgctgctggcagatgctgtgctcctgggaggtgggatgcaagctgaaccttgctcactccctttgggctaaatgacaggtgagcactgggcacagcaaatgtgactggccacagcctcatctgcaggggcaacaagtttcccacacaagatcccgttaccatcccacacaccccgtctccatctctctggatccttgttcagacacagtgtttttatcaacacccacagaggaaaatgggtaaatgcgaaaactcgtttttgcagctttaaattacctatgtcctcagaatgtagcagaattcacagctggctgggaaaagctataatacatgcactgcacacactaacgcgtttgaatataaataagcgtatctttaagttctgtaaagttccttaccgccaagtagaataaagacaccaacctcttttgtcatgaggctcaaagtctcctctggataccgttctataatctgaagtaatctaggaaacttcaatctggcttcattggaatttaattttaaagctttcaacattttctccaccacaagtgctggatacgcctgcagttctgcagaatcaataactatcaaggacaccaaagaagaaagcaatggtcaatgtatcccaatatccataaactatgatgttaaatgctaacactttccctttttggcttgtattttgtagtgtcattgttctcttcttaactaccactttacaccaacaaacaccaggtacagttttgtatctatcctggagccaaatccttccattagagtgcccattctgcatgaagcacagtttgaatcctgggctgggaacataaggggcaactggtggttattgaatttattccaggagcatgaagcaggccacacgagccagtaatattgaagctgcaagcaaaatatcaaagtagaaattaaacaaatggaaacagaggaccacttgactccatttaaatgtaggtcatgttgcttagagaggccattgtctctctcttttttttttttgagatggagtctcgctctgtcacccaggctggtgtgcagtagtggatatcggctcactgcaacctctgcctcctgggttcaagcaattctcctgccccagcctcctgagtagctgggactacaggcatgggccaccacgcccagctaatttttttgtattcttagtagagttggggtttcaccacgttggccaggctggtcttgaactcctggcctcaagtgatccactgcacccggctgccattgtctcttaaaaagacagtaggattttcaaaatatttgtaatttgaaaacaaacaaagaggagaccaaaggtatgtacaaaattcataagactttatgctgacataatggaacactagctttttaattttcaattcacctgatgcattctcttcctccttgcgcagctgttggtcacagaaatctgccagcgtcatgtaagcatcaatcaccccagctgcaggcccacagctccaggagggaggctgggcctcctcctcagccgcctgcacagcctcagagaggtgctggaatgctctctggtacagacccgcgatcacctggaattcacagagacctaaacccatgagcatgactgaagctttctcaaagaactctgctttccatttgtgactcatgacacataaatggatcaacagctccaaaataacactgaagctatggaactggaaaaacaagagtccaccctggctgtgaaggagcaagcaattccagcaagatcctcagcaggtaacaactggccaaacaaaaatgcaagcccagcgcgggccagatggtgcacaagcaacacagagctgggtctggtcagtggagtgcgtggctgtcgggaatataagagggagatggaagtcggctcctgcactcagtgtcctgcacagatgctagtagcatcatggaaggagaagacaaggccccacaactgaggtgaggcaggacatagtgaatgagacggaagcaggtaactattgaaaaaaacaaaataatcggcaagaagctaagcaaagcaggcactaaataaaaatgcagaaaaggctgatttgttccataagctggtgggacgtctgaatggtgatgggtggggaaatttaattaacaaaagtcataaaagaacggtctacagttcttttaattcaaaaaaatttaaaattcatgatttttaatattaaaaaatttgtgtcattcaaataaataggaagcacggagtatgtcaattttccacataagaaaattggctgtgcgtgccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaatcaaacaccacatgttctcactcataggtgggaactgaacaatgagaacacatggacacaggaaggggaacatcatactctggggactgttgtggggtggggggaagggggagggatagcattaggagatatacctaatgctaaatgatgagttaatgggtgcagcacaccagcatggcacatgtatacatatgtaactaacctgcacattgtgcacatgtaccctaaaacttaaagtataataataatttagaaaataaataaataaaaacaaatacataaataaaaagaaaattggctgtgcataactgtcaaatatattttaaaaacacaaagcaacatccttattattactttcctgtagcctgaacactgcacattgaagacatacacagcacactagcgtaaaacattcctccagtattaccttctctgaatcctctgaactggatccagaaagctctaagattcttctagccttgtcctcctcgatttcagcaaggcaggctggctcactgctgagagcattcgctatgatcctgtaagttgtacccaagagaatgttctggtcacggaaagccagaatatttttgcttaagtagcttgacacgttgttctcatctgttggattaaaaaaacaaaacaaaacaaaattttgtatgtgtgtgtggaattaaaaagaagaaattcattgtctatagaagttttcttttcttttgtttttgggatagggtctcgctctgttacccaggctggagtgcaacgacacgattttggctcactgcaacccctgcctaccaggctcaagcgatcctcccacctcaacctcccaattagctgggactacaggcttgcaccaccatgcccggctattttttgtatttttggtagagatggggtttcgccatgttgcccacgctggtctcgaactcctgagctctagcaatctgcccaccttggcctcccaaagcactgagattacaagtgtgagccaacatgcttggcctaaaagttgttttctattaagaaattaataaaaataaatgttgaaagtataagaaactgacttcaaatactgactagggaatttcttgaactcacatattaatgaaaaatgttctttgttagaagtaactgtatcaaagcccacagaggctaagcaattgaaactttatgaattaactttttattcaagcatcatcattctgcaatttttcaaagcacctaattctgttataaaaaataggaaatgggtactaatgtgtttgtacatatattaataatccagagtagatctttaaattggcactgtggcccatagctaatgaagcaacaggcactgctacatttaaagttctagttctgctttgactgtgtggttctgggcaagtaactgaaccagcgctggctaagtctgcagtgtccagaggtgcgataacagtgttgaaactaggaggcctgatcaaccacatgccctccttgcccatgatgtgacagttctctgccaaagttatctcacatacaggatcacaactactggccctgcttatcatgcaaggctgttatgaactacaaccatactctgtgtaattattattatatgggtatatggatactaatattaacatcagcaaactcctcctcttcccctcaaaaaagcccatataattatttagcaatcataaggataattttcttcttcttcttctttttttagaaacagggtctcactacactgcccaggccagaatacagtggctactcacacaggcacaatcatggctcactgcagcctcgaactcctgatctcaagccatcctcccgcctcagactccccagtagctgggactatgggtgcgtgccaccacatccaactaggatgatcttctgctcttgggatcagtgtacaaagagtgcttctcctctagacacctttattgaggctgatgcttaagagctggtctgggaaccagctggatcatgcctgatcagaatgctagcacacaccctcagacacagggcaacagagcgggggaccaaacccaaacctgtacaagaaagctttcttcctttaatgtagtcttaaagactaaactattttgggaggaaatggcttttttttttttttttttgagagacggagttttgctgttgtcatccaggctggagtgcagtggcgcgattttggctcgctgcaacctccgcctcccaggttcattctcctgcctcagcctccagagcagcttcgaagacaggcgcctgccaccacgcccggctagtttttgtaatttttttttttctttttgagatggagtctttctctgtcgtccagggtggagtgcagtggcgtgatctcagttcactgcaagctctacctcccgggttcacaccattctcctgcctcagcctcccgagtagctgggactacaggcgcccaccaccatgcctggttaatttttttgtattttcagtggagacggggtttcactgtgttagccaggatggtctcgatctcctgacctcatgatctgcctgcctcagcctcccaaagtgctgggattacaggcgtgagccaccatgcccagcctagtttttgtatttttagtagagatggggtttcatcacgttggccaggatgttctcgatctcctgacctcgtgatccacccacctcggtcgcccaaattgctcggattacaggcgtgagccactgcgcccaggctgaaatggcttttcatgtttgtttacatcttatatgcaaacacaaagttttcaaaataattaaactatcattctctggctcactttgctatattccctgaaattactgcaaagatttacctcccaaatgtcagatgatgcagcacaaagaagaggaagatacacaagacaatataacacagccctttaagatataagtggataaaagcggtcaacttacccaacaaagagactgttttcagcacagtgagcacctgctcagagcagccctgggaccggctccggcagtggctcaggcggcagtagctctgcacccagctcaccagccaatcgtctctggtttttgactctttatgcagctccttcagtagtttcatagcaagtgagaaattgttctgtatgaatacaataaaaagagagaaggtggtatgatgatacacaagtgacagaagtttctaattggcctgcttccccctttgcacgacacaatccaccttagagtagcgaatccatttctttagcttcaattatgtctctaaatttatcactgggatataattcatatttaaagagtacaattcaggccaggtttagtggctcaggcctgtaatcccagcattttggaaggccaaagagggaggattacctgagtctaggaatttgaaaccagactaggcaacatggtaagaccccgtctctaaaaaatttaaaaaattagccagcaccatggcacgtgcctatagtcccagctactctggacactaaggtagtaggatcacttgaacctgggaggttgaggctgcagtgagctgctgtgtactccagcctgggcaacagagcaagtctccaaaaaaaaaaaaaaattccagggggtgtggcagggtgggtacaattcagtattttttagtatatttacaaagctgtacaaccaccacccctaattccagaacattttcactaccccaaaaagaaattcactgtctgttcagagtcactacccagccattggcaacaataaattcccttcctgtctctatggatttgcctacaccagacattctgtaacaatggtatcagaaaataagtggtgattttgtgtctcgcatcttttacttagcatgatgttttctaggttcatgcatgttgcagcacctgtcagcacttctttcctccttatggctgaataatactccattgcacggacatgccacttttttttttttttttttttgagatggagtttcactcttattgcccaggctggagtgcaatggcacaatctcggctcactgcaacctgtgcctcctgggttcaaacaattctcctgcctcagtctcccaagtacctgggattacaagtgtgtgctaccacatctggctaatttttgtatttttagtagagatggagtttcgccatgttggccagactgatctcaaactcctgacgtcaagtgatccacccgccttggcctctcaaagtgctggaattacaggcctgagccactgcacccggctggacatgccacatcttatttgggttgtttccacctttccagctattttgaataatgctcctgtgaacatttgtgtatgaatttccatgtgagcttaagcttttgtttctcatgggtctgggagtggaattgtcgggtcatatggtacctctgttcaactgttttgttttgttttgtttttgaggcaaagttttgctcttgtcaccaggctggagcacagtggcacaatcttggctctctgcaacctccacctcccaggttcaagcgattctcctgcctcagcctcccgagtagctgggattacaggcatgtgccaccacatccggctaatttttgtatttttagtagagacggggtttcaccgtgttggtcaggctggtctcgaacccctgacctcaggtgatccacctgtctcggcctcccaaagtgctgggattacaagcgtgagccatcgcgcccggcctcaacatttttttttttttaagtatagtcaagtgaagcatcagaagtggagaatcaacaaagaaatcttaaatgtttgtgatcaattagttgcaaaaaccactgcacttggactagcctctacgtttaactttttgaggaaatgccagactgttttccacagcagatgcaccattttacattcccaccagcagtgcagaagggttccagtttcccccatcttctccaagctttgttatctgtgtatttgcttccagccatcccagtgggtgtgaagcggtctctccttgtggatttgatttgcatttccctcaagcctagggatactgagcatctttgcatgagctggttggccatttgcctatcttctttggataaatgtctattcaaacacttcatgcccatttcttaattgggttgtttgactctttgttgttcagttgtgaagcattctttatgaattctggatactagacccttatcagatatgtgatcaggaaatagtttctcccattacatgagttgtctttatacattcttcagcttctcaggtaaggcacgacagttttaattctgaatacaattgacccattttttatttagttgcttatatggatgtctttttaaatctacacctctaattctctctcaagcttcaaaagacattttcatcagactttggtcttcctaattactgccatttcaaccgcccaggctagaaatccgagttgtttctagccagacactctcatcactcctgtcacctcaggttctcctggatctccttacagagcacctctcttgccctgctcactcccaccccactcccctagtgtggagcttcctggtctttctctgcctttgctttccccagagctgtcaatctcccacacagcttacaactagccagcatgcatggaaccttcaatggcctcctgatcccggtaaggatgcagtctcccgccctctgcaaacccagtgccatcccatgtccaaatccttccatgcccataaagcctaccctaaatcacatcccccttccccagacacctccctgtccaaggcagaagctcttctcttccctgcgccctccaggctttgctgacatctctcttctttgcccaccagtgctgttgtcatcatgtgtgcagcccccactcttactagacagtaacaatggcagggaacatgtctttcccctcatcatgccagacagtttcctaactacactgggtcctctccccatgaccccaactccctcaccactaagtccttcagttcagatcgccccttctggccacaccctgcttttctctcatccagttcctgctctgcctgcctctaattggattttctgttatttgcaatataaaaattcttacttgatattacactcatccaaagaaaaatctataaatgagcatttaaagctacaaaaaagaagtattatttctactagaatatcatcctttgccttgcaatagcaattgatagagggtcattaacatagcaagcttctgtagtatgtttaaagattatatacatttaaatagattacatgcaatttttaagcaatgtatacttaatatcaagaaggggtcctagtattaaatgataattcctacaaagtaaacctaaaaataatttgtaactaactggtaaggattcattttgttaacgatcaaacttgacattaggtttatctgcttttcaagtaacagctaacaatcattttgaaatgattaacaggaatataataaactctagaggctttctggagagttttgaataagtgctccttcaagtttcctttttctctgagacaggctctcattctgttgcccaagctggtctctaatttctgggctcaagtgatccgcctgccttggcctctcaaaatgctgagattacaggtgtgagccactgcacccggccaagtttacttataaagagagaaaaaaaataacacctaccaattattttaaggttcagactctaaagaaaagctaaaattagagaaaagctaatttagcaaaatcctgtgacacagcagggaggacagacacgagtacccacctgcttccgggcactgtctatcatcttcattttcatggaaaacttgcaactcctgatcagggagctgatatcttcttcctgctcttgcacttccatcctgtcactggggtctccatcttgatccacattcatactattatcttctggaagaggggtaagcttctcctctattttgctgagaaagaaacatctacacaaagaaaaatgagacaatgtcacagactcaggaataggaagctgctggatagcaattacaggcagaaattctaaaccttagtaaatgtttgttcttttttttttgagatggagtctcactctgttgcccaggctggagtgcagtggcaccatctaggctcacggcatgctctgcctcccgggttcacgtcattctcctgcctcagcctcctgagtagctgggactacaggcgcctgccactacacccggctaattttttgtatttttagtagagacggggtttcactgtgttagccaggatggtctcgatctcctgatctcgttatctggccaccttggcctcccaaagtgctaggattacaggcgtgagccaccgcacccggcctacttattttttttttgagatggagtctcattctgtcgcccaggatggagtgcagtggcacgatctcgacttactgcaacctccaccttctgggttcaagcgattctcctgcctcagcctcctgagtagctgggactacaggcgtgcactaccacacccagataatttttgtatttttagtagagacggggtttcaccatgttggccaggctggtcttgaactcctgaccctcaggtgatccttgggtcacctgccttgggctcccaaagtgctgggattacaggagtgagctatcatgtctggcctaaattttatcttttgatgaatgggtaacataccctgtgttgagccattttgctccttatatgtcccaacttaaggtgataaatacataacagtaaacagtttaaaatcactgaaaattttcttttttatttttttgagacagggtcttgctctgttgcccatgttggagtgtagtggtgcaatcacagctcactgcagcctcgacctcctaagctcacacaatcctcttccctcagcctcccaaatagccggggttggttacaggtgcgtgctaccgcatcaagctaagttttacacttttttgtagaaacggaggcttgctatgttgccaggctggtctcgagctcctgggctcaaggaatccttctaaaggctgggattacagatatgagccaccatgcccagccatgaaaatttaaaagagaagtctaggttgctattaaattattattattttagagacaggcctcactatattgcccagcctgtagtgcagtagttattcacagatgtaatcatagcacactacagccttgaattcctgggctcaagcaatcctcctgcctcagcctcccaagaagctgaaacaataggcgtgtgccaccatgcccaacttcaaaattctttttatttgaatcataatttacatgtatgattctgtccaagtaattttatttctattaatattagtaacactgacaaagggccctaatatacaaagctcatccctgatcaaccatcaagtaaatttctgttgtttttccaggaactcatttccaatttcttagaaacagtatggccagggagttcgagaacaccctgggcaacatagtgatacctcatctcgacaaaaaatgtaaaaattagctgggcatggtggcgtgagcctgtattcccagctactcaggaagatcgcctgagctcaggaatttgaggctgcagtgagctatgactgcaccactgcactccagcctgggtggcacagcaagaccctgtgcgtggaaggaaagaaagaaaggaaagaagaaaaggaaaggaaaaagaggaaaaaaggagaggaaaggagaggggaggggagtgcaggggagtagaggggaagggagggtatgggagggagggggaggggaggggagaaggaaacactgcaggaagataaaccatcatgcttcacatctctttttcctttttcctctttttttgttactcccaagatacaacccttgctggccatttcctgttctcaccacactgctctgggctcctcatccccacaccaaccacagtgctggctcattccctaaagctaccactgattttaagctttcactgtttttaatcataaaaataaatacaagtgggtactggattaacatttcaataaataatgaatgactggatccataaatgtctcctaccagtgtgaataaagtgcctgggatctcaggaaagggaggtgggaacgtccacagaatgagacagacttccttgggctgtgaagggtgcatgcaattttaggagtggagttgacaagggagtcccagacagagggaacaaattaaacaaaggcagagaagagttacactgcgtgacatgttctcacatcaaatcagggagaataaaccaagaagagaaccatcttttctaaaaacaagagtctggatccggtatggcactgtgagccccttgtggcctatcctctgctgacaacaactagaaactggataaaatacaactccccaagaactctgagtgaataaaagatggcagactgtatgtatgcgcagggaaatcaaaactgggaaggtctgctattgggatgagcttcctgtttcctctctgtcttactctcttttgcccctgtggagtgtggtggcaatgtgactgagatccttaagacaagcctgctgcattctacccaggggaacaggaaaaggagtccaggcagacaggggctacagggagaatcctggaggggagagaaccagagaaaaatcctctagttctgcacatgaacccaccaggctcaggctgccctgaagtgtgcatgtgcagacagactcaaaacagcacaggtttggacaggaactgaggtttcaaccaacaaaaggaaagacagagcctactatctaaacagatcaccagctacagaattataagccagcatctacacaagagaatccagtagtcccccttatcttacctgcagttttgctttccctggcttcagttactggagatatagtgcaataagatattttgagagagacagaccacactcacataacgtttattatagtatactgtttgaattattctactttattattgttattgctgttactcttactgcctaagagtacaaatttacaaattaagctttatcatatgtgtgtatgtataggtaaaaacagtatacataaggtttggtattatccatggtttcaggattccactggggatctttgaactcctacagataagaagcgactactatattcacaagttacattcaaaaattaactgataaaaagaatcaggagaatgtatccatctcaacagaaaacagatgccaactctatgctgacccatatgctggaatgatcatacaaggaccttaaagcagctatgttaactatgctccaggaggtcaagaaaaacacacatgcaataaatgaaaaggtgcgcatctcagtagaaaaagagaaaatattttttaataaaccaaatggaaagtttacaactggaaaatacaatacctaagataaaacagtcactagacagacttactagaagaacaagtaagacaaaagaaaataacagtaagattgaagacaaatcaatagaaatgatctaatctgatgaataaacaacaaaaaaagacaataaaaatgaacagagtcagggacctatggaacaatgtcaaaaggcacgatgtatgtgtaactgcattcccacaaagagaccaagagaaatttggacaaaaagcatttgaagaaacacaatgactgaaaactccccaaatctggtgacaaaaaggtacagattcaagaaggtaagtgaacttcagatgggataaattcaaagagaaccaggcctagacacatcataatcaaactgctgataaccaatgataaagaaaaaaaatcttgaatgcagccagaaaaatatgacacattacatgtgggccacaacgatgggaataacgaggacattatcttcagagacacagcagccaaaagatactacaaggggcagggagaatctacccagattatacattctgagaaagtgtccttcaggaatgacagagaaataaagatatcttcagagaaggaaaaaactaacaagagttcatcacaagtagacctgcattacaagaactgctaaacgaagatttttaggctaaaggaaaatgacacaagagaaaaacttgggtcttaggaataaatgatgagtacagtgtggtaagtataataaagaacacatacttatgttctaaagaatatgtgaggaaaaccacatatgttctttagaatatgtatgactgttgaaagtacagtgttatctagtggtgttttcattatatgttacttcacagataaacacacatgaaatccatccacacacacatcaacatatcattacttcataatgataaaaggagtattttggcagggcatggtggttcacgcctgtaatcccagcactttggaaggctgaggtgggtggatcacctaaggtcaggagttcgagaccagcctgaccaacatggcgaaaccctgtctctactaaaaaatacaaaattagctgggcgtggtggcacatgcctgtaaacccggctactcgggaggctgaggcaggagaatggcttgaacctgggtgatgcaggttgcagtgagccaagatcatgccactgcactccagcctgggcaactagagcaaaattccatcacaaaaaaaaagtatttccaccgtggcatgtgtatacctatgtaacaaacctgcacattctgcacatgtatcccagaacttaatgtataataaaaataatttcattaggaagacagcagttatccatatgtatgtacctaataacagaatcaaaatacagtacgtaaaaatacacagaagtaaaggcagaaacagacaattctacaatcataggagattttgacatccttttctcagcagtgatggaactacacaaacaagcagtaaagacatggaagatctgaaaagtatccctgactaccttgatctcattgaaatttataaaacctgatacccaggaactgcagaatatacaaaaattttcaagtttacataggtatttactaaaatagaccatatgttggcacataaaagaagtctcaataaaatttaaaaggatcaaaatcatacagagggtgttttctgaccacagtggaatttagaaatcactaagatagccagaaaacccaggtatttggaaattaaaacacttaaatatttaatggatcaagtcacatgagagttagaaaaatacgttgaactgaatgacataccaaaatgtgcagaatgcagctaaagcagtactttacagggacacaaataactttaaatgcttatattaggaggaagaaaaggtataaaatcaacagtttccacctaaagaaactagaaaaagaaaagcaaatataaggtaagaggaaaagaaaaaaatagtaaagacgatactagaaatcaattaaatagaaaacagacaaataataaagaaaattaacaaagtaaaaaactgatcctttgaaaaagcaaaactgacacaaacctttacccagatgaatcaagtgttaaaaaagagaacacaaataaccaatatctggaatgaaaaagggggttccctccacagacactacaaataataaaaaggatgagaataatgtgaacattataccaataatttgatgactttgatgaaatggacaaatttactttaaaaaacaaataaagaaggcagaaatttaaaaagaaaatggacaaagtgattgaaaaatacaatttaacaaaaatgacacaaaaatagaattttatatttatttatttatttatttatttatttatttatttattttgagacagaatcttgctctgtctcccaggctggaatgcaatggcacgatctctgctcactgcaacctccacctcctgggttcaagtgattctcctacctcagcctcctgagtagctgggactacaggtgcccaccaccacattcagctaatttttgtatttttagtagaggcagggcttcaccatattggccaggctggtctccaactcctgacctcaaatgatccacccacctcggcctcctaaagtgctgggattacaggtgtaagccaccatgcccagccagaaatagaaagtttaaattctctatcagtattgactaaggaaattatatacattatcaaaaatcttccccaagggaaaacccatgcccaaataggataggtttcactggtaaatcctatcaaatattcaagtatgaaataatgaggatcttatataatttttttttttcctttggagacggagttttgctcttgttgcccaggctggagtgcaatggtacgatcttgcctcaccgcaacctctgcctcccgggttcaagcgattctcctgcctcagcctccgagtagctaggattacaggcatgtgccaccatgctcggctaattttatatttttagtagagacaggttttgtccatgtttgtcaggctggtcttgaactcctgacctcaggtgatccgcccaccttggcctcccaaagtgctggaattagaggcataagccaccacgcctggccataaactttttttaaaatagagaagggaacatgccttactcatcttatgaggccatgataaccctaataccaaaacctgatgaagatattacaaaaaagaaaattacacaccaatatcccacttggatgtagatgctaaaatccttaagggatcatcatgaccgtattgggtttaccctaagaatgcaagattggcttcatatttaaaaagcatcaaagctaatacttcataaacacaataaaggagaaaaacaatatgattaagctgttgcagaaaaagtgtttgataaaattcgacattcattcatgataaaacaaaactctcagaaaacctggaatagaagggaatttcctcaatctgataaaaggcatttacaaaaaaattattttttaaagctgagtgagtgaactatcttctctaacatcaggaataaaactaagatgctcattttagcacgtatattcaagattgtacttgaggtcctcatggttttaacaaagcaggaaaatgaaataaatggcataaagttcagaaagaaagaaaggtggctctatcggcagatgatatgatagaaaatcccagagaacctgcaaaacaagaactaaaactaccatgttagcaaagatacaaagttaatatataaaaagcaattacattagcagcaaataattggaaaataatacaattttaaaaataaatccatctataacagtgccaaaaaacataaaatacttaggaataaatcacaaaagacatccaagatctccatactgaaaaaatacaaatcactgaaattaaagatatctaaattaacagagatatgccatattaatgaactcgataactctatattgttaagatagcaactccccaaattaaactatagtcaatacagtcccaatcaaaatctcagcagtttttctttatacaaattgacaagcagattctaaaatgtaaatagaaatgcagatcaactaaaataaagtagttttcataaagaaagttgagccaggtgccatggttcatgcctgtaatcccagcacactgggaggctgaggtgggcgtgttgcttgagcccaggagttacataccatcctgggcaacatagtgaaaccctgtctccacaaaaaaagacaaaaaaattagccaggcatggtggcgcacgcctgtggtcccagctacttgagaggctgaagtgggaggactgcttaaacctgggaggctgagactgcaatgagccattatcgggtgacagagtaagaccctgtctcaaaaaaaagaaaagttcgagaactcatcctgtctgacttcaaaacgtactataaagtgatataaatgaaggcagtttgctattgtgaaaaaaacacaaagcaagggctacaatagagcatccagaaatagacccacacatatgtggtcaattgagtttcaaaaaaattgccaaggtgactcaattatgaaagacttttgaacaaatgcggctagatagatatctatatggaaaaagtaaacacctacccctacctcacgccatttacaaaaattttcttccagtgcatcagagacctcaatgtaagacctaaaaccataacatttctaaaagaaaacagtagaagacaggtaagatgagcctgatttgttagcttaaaggggagcctgttggccaaatctgagataattgaacacaaaataaataaggacagtataggttatatcccactaaataaaatttgaatccctgagtctttattgataatctttaaaaagtaaataagtaagtaaacagaaggaagggtgcctgcttacaataagatgtagactaatataaatgaatggtagagttggaaattataattttgcaaccattattgtcaacactggtttgggccaggagtcatccacaaatgtgaaatacagagggataagtcttaggagaagcaggacatttgtatgtctcaaagcagctcctacatttatttgttagttgcaaaagaaaagcaaaaaaatggcattatacagtggagagaccaaacaatcaaaattattatcaccaggctgggcatggtaagtaatgcctgtaatcccattactttgggaggccaaggctcacttgaggatcacttgaggtcaggagttcaagaccagcttggccaacatggtgaaaccccatctctactaaaaatacaaaatttagccgggcatggtagtgcgtgcctgtaatcccagctacttggggggttgaggcaggagaatcgcttgaacctgggaggcggaggttgcagtgagctgagattgtgccaccgcactccagcctgggcaaaaagactgcatcaaaaaaaaaaaaattatcaccagtaaaaggcagatggacactgtgccccacgtgtgatttgctagcctgagaagtattctggccagagacagatcacctgagtcccaccatgaggaaacgtaagacaaacccaaacagaggaacattcctcaaaagtggcagtattaggacacacaaagcctttcaggggactaaaaagacacatcagataaatagagtccatcattctgtactgatcttgttgtagaggtagagaaaatgccacaaaggacattactgggacaattaacaaaactgaaattgggctgtagaggaaaaatgaaagcaccaaggttcatcactgaacagtagttacataaagaaaaattctttttcttaagaaatgaacactgatctataacgaggcaaaggtatgtatccagcttacgctcacaaccggttcagaaaataaataatatgtagggtctggtagaaaagaaaaaaatacaaatactaacatggaaaaatgtttaaaatgttatttaaaaaatcagtgaatctgggttaaagaacccaggagagtactacttttcttgcaacttttccacaagaactcatctcaaaataaaaagtttaaaaaaaaaaaaaaagtagtagtggaggaaataatgggagaccatgacacttggggtcagagtccttaagtcctatttcctacacacatttgtgtgccataaacctctctgattttattacatggttagtacctgccctatggattccacaggttagttacaggatggagaagatgaggacatgaacatgacctgagacctgggaaagtgacacatgactgtgtaatggagttgggaggtaggaggcaagaatgtcaaaaatcctagttataaaaaataggataataaaaatcattatgtagtcgtcttctttgttgtcatctaactacttaacattccgttgtgagagaagcaaatgcacactgaccctgtctcccttcctggaggtgcaggttcaggatcagccaccagcacctcccgacagcagcgtccccacagggcaagcgggaaagaggacactgcagacacggagagctctatcggaactacttacatgggaaacaggaaggatggaaaacagctgtgctaggctcaaatcccacatttctctaaaccatggtttggaagaaaaaccattccaacaatttcaaaaaacaatccacatttgactgaaagggaccacgtcttaccgatttgtgatgatgtcatcccagatgttcattgggtccattttagcatctggatatctgtttgtccaggtgttcagaagtctcttaaggggaacttgagatgataaattgcctaaaaatagtattagagggtgactatacacacagctcaattataagatcaaatgacaaaggtcattatcagtaaatagaaaattcaaacttcctgcccaaattacaaaaaagtcctttcttttacaaaaggaacacaaagttaccatactaaatttaatatattctgacatttaaactcaattgcttaaggacagagaataaagatggagaaataaacatgcacaaattctttttacatttattacaggtctacagtccatctgtaatatcaaaatctaaaaagcactgataactaaaaagattttcatggggttgaagcaaattttcttggcaaaaaaaatctgatcttcattggtatagggctacttagtctttgtttatggcatcaatgtgaatattcataacttaagctgtagagttacagaatactgccctagcccctggcatgtacacaggtaatatttctagtgtccaaaacattctggcctcaaaggtctcagcaaagagattcataataatcttcacaaaactgaaaattcacattgttaatgtgtttttctttctgttgggggaaaacagcagtcaggaacacaagattagatgagacagtcctgggttcaaaattaaaatctttcacttattagcttaggcaagtcattcaatctctataagcctctaaaaaatgaggagaaaaaaatccatctcataaagttgttataaagactaggtaatattggccaggcacggtggctcatgcctgtaccccagcactttgggaggccgaggcgggcggatcacgaggtcaggagatcgagaccatcctggctaacatggtgaaaccccatctctactaaaaatacaaaaaattagccaggcatggtggcgggagcctatagtcccagctacttgggaggctgaggcaggagaatggcatgaacccgggaggcagagcttgcagtgagccgagatcccgccactgcactccagcctgcgaaacagagtgagactccgtctcaaaaaaaaaaaaaaaaaaaaaaaagactaggtaatattgataaagagattaacatagctcctgaaagtagaatgcacttaataaatgatacgtcattaatatgattaatatgtacttgaaaaataattttccaaaattaaaatagaaaataactaggtagacataaatatcagtttttatcagtattctgaaagcatcttttgtaattaattttaattatttaggacaaaaatgaaattcagattaacaaacaaaacattttacctttgcaaagatgtactcttccccttagactcttgggtggcctcccataggcactgggataaaacccactcatcagcgatacaaaggccttcctgatgtgggccctgctgcccgcagccttcctgccctcccttcaagccagggcacccagagccctcagcgtgcacctcaggggcaccacagctttccgtctgcaagcccctgcctcttccccactgctcaggaccctcctccaggagtcctgcaccctctcaggccagggtgggccccaccatccttgtgggcaggtatcctctggagtcaccccgctactccaaaagcttcattaaggtaagcaacatgttttctttcactttgcagccctgatgcctagaactctgcctgaccattttaaacatttatttcaatgatctgaaaataggtatttgtagaggaaattcgatggagtttccaacccatacattaagaaacatgcactttcactaagcagaaaataatttagatgctaaaactcttccacaattagaaatgaaaaaaaaagaccgatgaaaaaaattaccttgtttgcttataaagctgatgaactcctgaatttctgttaaagcctgtacagactgcaatttggtgagtctactttggtgtaagaggacatcaatactagaataattcttaaaaaaaaaaaaaaaaaaaaagggcatttacaaatgccatgttataaatcaatcaagctgtgactttaagtttttaacagtactctaaattatgaaatgtagcaattattctataaatatgcctcagaatggttaataattagatcacagacagttaacaaatagtttaaattttaaaaaaaaatttaaggtttcaataacattttggctcaatgaaatcaataaaactgacatcaccaggctatcactgcctcgacttgccaccaagttttaacaatcctaacatcctataatgtaaaactgctgactacagaagccaattctttttttgataaacttcctcaagagtgctaatcaacttcaacacattaaataaaaatgaaaacaatgaatgaatatgcttctatgctaaatgtcactaacctatactaaatgttattaataaactttatacaagacattcacttacaaacaaacaactgtcaggaaaagattcgcagaaaagcaaaaaggaaagaaagagtggcagcaaacaatcaggaaagatcaacccctgctcttctctacaaagcaaccaaacttccattccgctaccccaaatagaaaagtctactcttggtcaggagcgttggctcacgtctgtaatcccagcactttgggagactgaggcaggtgaatcacctgacgtcaggagttcaagaccagcctggccaacatggttaaacctcgtctctactaaaaatactaaaattagccgagggcctgtaatcccagctacccgggaggctgaggcaggagaatcacttgaaccagattgcgccattgcactccactgtctaggcgacaaaagagaaacttggtctcaaaaaacaaacaaacaaacaaaaaaacaccctactctcaagtgttctttaagagtatgagaaaggtaacaaaaaggaaaaaaaatgaaacctttctaaaatagaaaaaaaagatttaaaaaggcattaagataaaggacagaatgaacagcattattggaagaacagaaagaaggaaataggtggtatgaaaatagtacttgaaaatttttgttgatttttttcatgagtttactgagttttaaaaatatcctaaaaatagtatatttcagatagatccacattataatatatatatacactatatatatacaagcatatatatataatatatagtattacctgcataaaactctgaatgccattttgaatgtaatatttggctctgtcaacatcatcttgcaggaggtaaagcagactcagctcttgactgtaatgaagctctagaatcgccttctggagctccccgtgcatagctttgtcaataaatgtcagcagggactggtcagcctctccctggagcagcagcttcagcttgctgcggatcatgtaaggtagatatgtttcctaaggaacataaaaatatacttgtaactacagaaggccaatttgagtatgtctaattattttatttctattatattctttgctatactttcacaggtcaagatttaaagtcaaagcgatgatgtttgatgtctgaaacagtaaacctccaatttttaaaacaaattcatctaaaatagcttgttttgtaaccacaaaatatataggaacacgttctacaaaaaatgggaactacttttggctggaagatgatttggatgttacgtacaaactgaggaatttacaagcacagtcaggataggtatggtgtggagaaaagcggagagcctcttgtcacaggagctgggaggcctgtgtttagccagtgatccggggcgacttcttgtaatataagagacaacaggaaatatgctcctatgtagtcatactaggaatgttaatatttattttaaaatgcattgcattcactttgaaaagatgattagctaaaagtgataagagatttaacaatactatggggtttgtaggtggactcaggtcatgcaattccctagtgcttcacaagtactacctgtttttgaaatgttttaaacaattttgttaagtagaaaacacctatctaaaataattatttcaatcacttaaaataattttacccacctgataaaatggttcactccagattttatttaggtctggggggttctcactgtctatactggctgtagaacagtattcaagtgatttccactcagcaaggtggttgtaacagtcaagggatgcaagttcccaaaaatccttctcggcttctgtgggctcaccatctacccagtcttgtttattgagagcctagtggagaaaagttaataaaattattttacaaagttggaaagaataccaatgagaacacgtaaaaaggaggaatgtaacaatcacactaaaaacaatccttttcagatttacggaaaggagagagaaaagagaagctattcagagtaacactgaatggaagaaaaaccaaaaggaatcctacagtactaaatgaatagaaaaacccagctgggcacgctggctcacgcctgtgatcccaccactgtgggaggctaacgcacatggatcacctgagcccaggagtttgagactagcctaggcaacatggcctacaaaaaacgcaaaaactctctacaaaaaacacaaaaactagctaggtacgatggcaagcacctgcagtcccagctacttgggaggctgaggtgagaagatcacttgggcccaggaggttgaggctgcagtaagctgagattgtgtcactgcactgcagcctgggtgaccctgttttaagagagaaaaaaaaaaaaaagccacaaaaatcctaactaggaggaagccatttctctgagaaacttaccaatgaaaccaattactaagactgaagactttcaatcacaataacttgatttacatctctactgggggttatttaccacgtaacaagttcttagaataaaattagaatacaggacatttgtagaaaattgcagaggattttaaaacctgggctgctcggctgggagcggtggctcaagcctgtaatcccagcactttgggaggccgaggcgggcggatcacaaggtcaggagatcgagaccatcctggctaacacggtgaaaccccatctctactaaaaatacaaaaaattagccgggcgtggtggcgggcacctgtagtcccagctactcgggaggctgaggcaggagaatggcgtgaacccggaaggcagagcttgcagtgagcccagattgcgccactgcactccagcgtgggcgacagagtgagactctcaaaaacaaacaaacaaacaaaacctggactgctcattgaagagtctcacaggtcacagaccctgaatttcaacacctacacttgaatagccactgacggaatgtacaaaactgaacttatattcatcttcccaaattcttctttacctctgatgtaatttgaatatgtgtccccacctaaacctcatgttgaaatgtaatcctcaatgtcagaggtggggcctggtgagaggtgtttggatcaatggggggcagatccctcatgaatgaagtgggccattcccttggtgatgagtgatcctagcactttgggaggcccaggcatgatggcttgagctcaggagttcccaaccagcctgggcaacatagtgacacctcatctctacaaaaaaatttcaaaaattagccaggcatgttggtgcatgcctgaagtcccagctactcaggtggctgaggtgggaggaccgccggagcctgggagccatgatagtgccactgcactccagcctgggtgacagaatgagactctgcctctaaataaataaaagtatatggcaccccctccccaactgtctctcttttgctactgcctttcaccatgtgaaatgcctactcctgcttcgccttctaccaatgcataaaagcttcccaaggcctcccctgaagccaagcagaaggcagcaccatacttcctgtgcagcccgtggaaccgtgaaccaattaaacctcttttctttataaattgcccagtgtcaggtatttctctacagaaatgcaagaacagcctaatacaatttctttataatttttttttttaactaactgaaagaaaacaacctattcaaacagaaactgtgtaagagcagagaaataatatacagtttcatagtatggtaggccctaacttaagtgaacaacctataaggaaaccaattttcttcctcatcaacattgtaacgaaaagacattgaaccaacaaggatctgctgtacctcgttttgcttaaagtcatagttcagcagaaaacaaaagtgttgaagtaaatgtcatattttgccagagatcaattttacctcatcatactgcttagcagcttcagaataatcacttctggcttctgctaataatgcactctgagtgatttgctttgttcctatctcactggtaaaaatcccacggaggacgtcgtattctccaattgatctatacagcctacaaaacaaatcaaaaaggccaaatcaatgaacactccagtattttaaaagtatttattctaatgaaatgatagtaaatcaagttgccacacattatattaacaagagacataaagtgttactttaattttgctaaaaatataaaatttaagaaactatgaagttgcccttaggttttataactttaatcatacataagccagaaattattcagatgtgcatttaaagtggaatctgggacgggcgtggcggctcacctgaggtcaggagttcagatcagcctggccaacatggtgaaaccccgtctctactaaaaatacaaaaaattagctgggcatggtggcgcatgcctgtagtcccagctacttgggaggctgaggcagagaactgcttgaacccaggaggtggaggttgcagtgaaccaatcaccctactgcactccagcctgggcaacagcaagactccgcctcaaaaaaaaaaaaaaaaaaaaaaaaaggtggaatctgaaaatatcaaaggttcacagtgtataagatgtgtcattacataaggttctccagtattaatccattataatatctacaggcgaaccatttggaatccttgtctagctccaaaaaacccagaagcaaaagaaaaaataatcctgactactgatgccatgtttaatccatgttctatggaccatctcaatttgttggagcattcattcatctctttaccttaacaaaattctggcttgaccctttcaatcaagcttcccagtccatgatattctcaaagtgtttatggggtttgttcccttcctccaggaaatttctttccatcttgcagtctcaacccaaatgttatttcttcctaaaccagccagccaaggactgctccctccttagttctcctgctgttcagttcccttctgggtactaagcctcttgcatttacatcaaaagagccctacaggttctctcctagagcttatgaattctgaattcaataaaatctagtagatgcagctctcttattgccctgattacagaatgttaggggtaataaatcagcagtaaaggtgggtgggtaggtaggtgatggagcagcagctcatggccccagagtcagggaagagggagagctacattctgcatagactcaggaaagagatcacctacatacccctatactggttccattgtccctggattatgttcactataacatggttagaacaatggccatgacatatcaaaaaaaaggctaaggccgggtgtggtggctcatggctgcaatcccagcactttgggaggccggggcgggcggatcctggctaacacggtgaaaccccatctctactaaaaatacaaaaattagctgggcgtggtggcaggtgcctgtaatcccagctacttgggaggctgaggcaggagaatcgcttgaacccgggaggtggaggttgcagtgagccaagattgtgccactgcactccaactggcgacagagcaagactgtctcaaaaaaaaaaaaaaaaaaaaaaaaaaaaagctaaactatgttcacaatgctctgcaaggaatgcaaaaatatcacaaaagtatgagaatgtacttaatacagttagaaaaaaatgtttaaagtttaggcccttaaaagttgtttgcttcacttacttagcaaatacacattatgtatgtttaccactcctggaaatagtaaacatacaaggtgtcacttcctgttcacttacacatctgaagcaacaggagaaaacggttcctaggtaaaatcagcatagctcagaggccctctctgaatggccctggcattttatcttgtctctctcagtgctcaccacctcctacttcaattatgatttatttatgtgtaaagtacatacatttcctactagattgctagttttgtgagtctgtgatcaatgtctaatccaatttcatgtctctttggtgcctggcacagcacttgtacactcagtgctcaatcaggacagacatgaattaactacaaaacagcacgaagcacaaggatcccctcccttacttttactatcttttctcttaaaacctaaagctctaaaaatctgcactacaaaatgaagttcaagttaaatttcaatcttaacctaacaacctcctcagaattaggctttcatatgatgagatcacagagaagggaagaatcagacataatggaaaatggtataactagaaaatggaatctgtttatcccaaataaactaactgatttaaactctttctaaaatcttgagtcctgctgaaaatactaaatcttcctccattcagtgtagtgaagcaggaaataacataaaatattaggaactatgattcacagctacactttacaagaaactaaacttggtgaataatactgagtccaaaaaatcatatactgaaagaaatcagcaggtttaaataacgttctctttccttgagcaagacattacttgttgtggcaactgttcttgcctttgagaatggtactcagcctgaaagacttttcttttaaatttcacattagtgttactatcaactttattagctcattttctgccaaatgaagccaagtgttttccgtattgctttggtcaaatccagtgtgctcccaagagcacctgacctcacacttacttagcaagctccacccatctgaggacatcaggagggaggcgggccttcccacggactcgcttggcaggcagctcagcaggcagcaggcggagcagagcctcctctagcaggcggatgcccacgggctgctgtaggctggccaggcaaccagcgctaacagccgctgggtcgaggctcagcagggctgcgtgctgacagctaatgtcctgtgaaaccacacatacaaccagctgtttagcttgtggtacttggaccatgtcttcacaaggagtaacatactttactaaacataaaaggtacccatgtgggtagtgatatcaccagaagtttctctgtgtaatgctattaacacattttccaacaatattcaatttgctcaaaggaggaaatgaccttttaattttacgcttccattccagggatcaatttaaagcaagaaaagcacctatcaaaatatgaagatcacacacacacacacacacacacacacacacacacacacacacacacgtaaattagaaaccaataaaaaacggagctaatgtataaagaaatttatactgacagtttctcgttccatcaaaaagaataaaacaaaaaactaagtatttcatttcagaaaagtattaaccaattcgtttgtaaaccaatactaccgataaacaatattgaagaatataaattagtaattacttcagaaaaggtcactagatacaaaaatactaaaatgaatcaaaaagattttctactagggaattttatataatccatactttgaatggcacagaaaacatttcttacatgaaaaataatcttctgacaaacatatttaagtagtaactgaatattaaattagattttctgctcaggctgtgttgccttggaaaggacttctctgaccactgcatctaggcaaacacaccctaccccatcaagaggcacctgcttacctgcttcattactatcttacactgctttaacacttccctattactcaagtactatgacacttaactactacctaatgtccctttctacatctccctgtgggttgcctattacccatctattaatgggaatgtaaggtcgggaggaaaggaatttttgcctcttcatcaatgtggcccagccacctagaataaagccaggcgggtactcagtcaacatcttttgacagtagtcaggaagcagaaagaatttggtgaaatactacataaggaaagacaactaaataaatgaagggtttcatcaaaaacactgaagggactggcttattacaaaataaaacgtaacatgtttgatttctggttattctgtcacatatcggtttttctggggggaaaaaataaattacatctactcatttgggaagtggtaacccaaatagtacatcttactctgttaaacaccaggttatcaagagtctcaacacgggaaacatagtgatgatggaaaggccatgtgaagccacagcaaacaatgtatatttgatgaagtgtgtgcagactttacctgaatacaagagacaaagggtggaaagaaagagaaggtggtattaagaaaacgattgaagtcttgaagcaacttttgagtgatgttgtttttttcagacagtgtcttaaatttatccatctctttcaaaattccagaaaacaagctgctaaagagctgttttgcaattattgggtccctctgtaaaaaattcaaaacaaagacaaattaggatctgaagcaaaaatgctataaatcaccaatactatcagagcttggaaaatacaaactgttgcaaacacatctattatacctctcaattctatttggaaagacttagcaggcattgacaaggggagcatttggaatttaaccaaatgtatctgtttgatgtatgttatggaaacatggacttttggcccagagagatacatttaaaagctggcttaatcaatacataatgacatagcttctctcctgagttaagtctgggtctccaatctttaaatgggggctaccagaacacatcacattgggctgcggggaagattagcccagataaagtgcagccagtgcttagtgcagcacttcataaaatctcagagaaagattaaatgtttaggtatttttctcctatcagcaccatggtaaagcttaaaataactgatgagcttaaataaaatgccagtgttaattttcaaggtcccaccacctgaccactttaaactattgaaaccatcaaaggcttcttctgagcatcagctcccgcaaatagcacactacctaatcatttacagccctaaccctcgcacacttcatggccacagtatactccctttatttattcatgctgtgacatcagcgccaacaacagttcctggcatatagtgtctatttttgctaaatggaggcatgaaagcatgataaataaagtttaaaaattactttgtgtaatcttctagggatcttccctgttaataagttttctatcatattataattgacaggtcaattctgttaatatctttttgttaattttgctacacgtttgcctctgaaggaggtgagacttgtgctgctttttgggatcatgttcttttttcatgtctaagacctattttaattatgtttacaatataatgataatccatttttgatgttttatgaacaaattacattattaaatgaatgttcttaaatcaagtgtgatttttgcatattgttgaaaagaacattaaaagcaatggtttacacttaagttactatagccaaaaattaaatacttgaaaagtttactgtgaaattctactgatttaagattatacttaatatttaaaaaataaatctaatcatcaaatgcaaaaaattactttgataaaagctatgtatgactaaaacatacaaatttgatttattccttattgtttattttaagtaatatatttatcttgttataagaagttctagtgattactatataaaattttagaaaatatggctaaatcaaaagcacaatcccgtttacaacagccacagaaagaataaaatacctaggaatacacttaaccaagaaggtgaaagatctttacaaggagaactaaaaaacactgccgaaagaaatcataaaagaatgacacaaataaagggaaacacattccatattcacggattagaagcatcaatatcgttaaaatggccattctgctcaaggcaatctacagaatcaatgctaattctatcaaactaccaacatcatttatcacagaactagaaaaaactattctaaaattcatatggaaccaaaaaagagcccgtatagccaaagcaatcctaagcaaaaagaacaaaactagaagcaccgcactacccaacttcaaacaatactataaggctgcagtaaccaaaaagcatggtactggtacaaaaacagacacacagaccaatggaacagaatagagcacccagaaaatgtggtttaggaaaaaagaaaataagtatcgcccataattataccataaagagataagtcactggcatgtgtcttttactggtgtgtacacttttacacctgtttggtaacctgctgtttttatgtaacacgtggtagacaggtttccatgtctacaatccactgattcctgagtgctaggtacaaattccttcatttatgctccctttgttcagacaaatgcagtggtaatcctgataaataacgataaataacgtcttcagcactgatgatctcagagtctccgcatgtgtaaagaagtcatggaactaggaaatggcagagccaggacttggagcaaggtctttataccaagtccaccgttgaggacaaaccaacacctcatctatgttgcaggacagcctcagccatgtttcctcacataggcaaacccctgaactggaaacagattttaacctgtcaacagaaaacgcagcggcaaaaactgacctgggccacggcctgtaacggggtgatgaggctgctgtgcttgatctgaatgtcaggaaggtctccgtgccggtagcttctgtacagaacgacctgggcatcctgcttcatttttaactcactcttgatttcctataagcaccagaaccaaagaagaagatgagcattctcattgaaggaaactagtcgtgcatgagctatgaggctgccaggatcccctgaaccatgagggcgaagtggtgggaactgatgctcgcagaggctcagtcgccgtactttaccgtctagggcaaacactgcatccaaaataaaatcactacacaacaagcagtggaaaggctttaaacattccctataatcagaatatttataaaatcggaaaatttgatttagaagtatttaaaaaccggctggagagctgcatctctggaaagtctcactgagaacgaggccggcagccggtccccacttccgccccaaggtcctgccctccggctgcctctgctcccaggcagctgcagagcccaaagctcccctccgagggggcaaaacagtgccccgggggcgcagcccgggaggcctcaggctccacaagcatggctgggcggcagggcttggggagggggccggcacagcgccccacttccagggcttcacacccagatgtggatggagccgctcctgtggcggcggcggctggcgctgaactggagcaccgcgagggatttttcttaacgatccgtcctacccccttcttacaaatgcatcctaatgacccatttctaggcggaatggacgccgcggctacggagtctccacgccacgggaaggccctcctggccacctgtcctcggggcaccgtgggtcccagcccccagctgccctcccgccgcattggtccctgaagcgagggccagtgaagtcctgccagggcgcgggccttgaggtaggcctgggatcagccggctgatcccaggccggccacacttccacccgcggagagaactgggcgcactcctggacccccaccagagcgccatgagggctgcatccctgtgggggagccccaggaggctggtttggagcagtcccgcaacctggtttgcaggtgacattggaggcagtgtctggcaggaagcctgttcacttcgtctgtatcctgtgacagaaactgcatcgttctgatcaaattcttgacaagatacaaaccttctctcgtttttgctcagcaacgccttttctggcatacatcaaactgagcttctcctggtccctcataaaccgtctgcgcagtcgtagtaggtccgtccggccggccgcacctggagagggaaagcaggcccagttactccccgccgcccagacacttggctctgctggttcattttcacctcgggtttcctcaaagacaaaacctacaggtgccgcagaggcagcgaccgggagcaggagtgcaggggccacagctgcaactggaactgctcagcagtggattcagcaggcatgagcgctgaacgggccaggcccctccagagggaggcccagggagggcacgcagccaccttctgaacccccgcccaactcgcctggcagtgctttgcctctggctaactgaactagagaggagctgcctcggaggcttcaacacctggtgcagaccagcctccctcgggactgtggcaacctgaccagggacaggtgaccgcaacactcctaacccgtatgattccaaatgcctgtttagtaccccaccaggagacaccagccttaacctccaaatcacgacaggttctaaggaaagtttcaaatatgaacaacacaagccaaagtaagcaacaaggaaagagcaactgttaaaagcagatcatgcaggaaaaaatttcaaaacatgatcatttatcagaaagagaagagtaggaactgaagaaatgttcagagcatgaaaaaaagctcatggaaactgaaacgtgtcataacttaaaagcacaggttgaaagataaggttgaagggatttcccagaaaagaggaaaaggaaaaaatatgacacctcagaaggacactcacgcaggtgagatatctaagcactaggactccaaaaagagaaaacagcaaactgagatgaagaactcaacaaaatcacctgtgatgatgctccagaactggaaggtgagagtcagcggcctggaagctcccgccatatgcccagaaaaacagactgaaacggatctacgcccaaggacacttgtgcgcaatgtcagaacactggtttaaaagagaagatcccgagagcatccacagagaaaagacccacgttctcacaaagcatccccaaggaggatggcaccaggcctggcgcccgcagccctgcaaagcagggagtccaggggccccacgtatggagctccacagcagcactcccgccagaccaccaagccatcagatcccagagaaagctccctgctgctgaccccattctcagcacccaggtggctccacctgaacaaccgccaccagcactccttcaactcacagcacatgccaaaaggtgggccacactgacctctccaggttccatttagagaactgtgtgtgggccacaggtttgtgactgaaaagtatgagagagtggtggagtaaagcaagttttgttgcctgtgtttcagttcctacgattagataagaaggcagggagctttgcttctaagttcttctaagtttacttccacagagctgagcttccctgctggcgctcccccagggttctgtcatgggccctttcctctctgcacatgtccttcctctgggcccttgttccctcccagagcctcacttctttctcacaaaaagctgcttccagcctctcggcacccgtctagttctggtcatctgttagccaagaccaggtcctggtgcctgcctccagtccccatcactccacttctgccccacacaaacctcagagaagggcattcagtccccgtgccttcctctgctcggtgcgttacaaggctgcttcctaaagctgaagttcgacatacacccccacacccacaagactgtcctcacagcaccctttgccgttactctagcatgccccgaagcgtcccttcacctggactgcagaatcgatctgagcctacccaccctgacacttctccatccctgtccttttcatcctttcccttcctgcacccccagctccaaggctcctctcaaatgctcttcctccacccagtctttttggacgctctcctcattctccacctgtattaagccctctagccctagaccatgcttgctaattccacctcttgttacaatcacccctttataaatgcctcacccactcttactgctccagaagatcactcaacaatggatcgagtataacttactgaaggattcttctggaactcccagaaaacaatttcttcagcatggtgagtgcctaggcaacattaactgaattttaaagggcttgattacgaatgagaaggaaacatggatacagtcagaaatgtccccagacctgagctctgcagtaatttagtggggaagctattttaagcacactcagcaacccagcttacctttcactttgttatccacctcgtcccctggaaggcccagcctttttttcccaaaatcaggccccactgacttcaagggtgctctctgtaacctttcactcctcttgtgggcaaacagcaaggagtcagatgagggactggtgtggtcgaccagcgggtcagtgctgctcccggtcagccaatcaaatgagcttcttccatctgtgacatgcaatcagagaggtcaggcactcagcatcacccagctctgtgcacggggcaggaccacctgccaggacacacctggtggcaccctaggcctccgtgctcaactccaaccctgggcagaggctctgtcaggtcccagggtatgccccaaggaaaaccaggtacgtgcgcctcagtgcccctggaccgcagtgtccccatttgtaaagtaagaaacacgccacttgctcccaccacaggaataacactttgttatctactgaaaggtgctaagaacccctgacttttttttttttttttttttttgagacggagtctcgctctgtggcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggccgcccaaagtgctgggattacaggcgtgagccacagcgcccggccccctgacttctaatattagtgtcacagaatttcaattgtgattattcatattagtcccacttccagaaccaacaaaatgtgcaaaaaaattacacaaaggagaaacgttaaagagtttatataaaaggattaagatatgttactctacaatttgtactttgctcatcaaaggaagcagttaaaccatctgagaaagaacagtttaataactataaatctagtaaatgaatttggtttacctctactctgctttggtgataagatgtcttaaatttgctacactatgtttttctgtaccaaaccaaaaccaaaacatacatatactgaaactttccctgatctttctggtcagaaataatccatttcttttttagaaaaattgtagcaaaacaggctgggcgtggtggctcacaaggtcaggatatctagaccatctggccaatgtggtgaaatcccatctctactaaaatacaaaaatttagccaggcgaggtggtgcgcgcctgtagttccagctactcaggaggctgaggcagaggaatcgcttgaacccaggaggcagaggttgcagtgagccaagatcgtgccactcactccagctccagcctggtgacagagcaggactctgtctcaaaaaaaaaaaaaaaaaaaaaaaaaaaaaggaaaatatacataaaatttaccatttcaatcattcttaggtgcacagttcaatggcattaaggacatttacgctgctgtacaaccatcaacatcttccatgtccagagttgctttttggtttttttttttgagacagggccttgctcttttgcccaaggcagggtgcagtggcgtgatcacagatcactgcagccttgaacttctgggctcgagccattccccgcctcagcttcccccgtagctgggactaactacaggcgtgcgccaccatgcccagctaatttgtaaaattgttttgtagagatggagtctttccatgttgcccaggctggtgcggaactcctgggctcaactgatcctcctgccccagctggaataacaggaatgagtcactgcaccctgcctccacagcacttttcctcttgcaaaactgaaattctgtacccattaaactataaatccccattcctcctccccagaccctggcacctggcactctactttctgtttccatgagtttgactgttataggaaccccctcttttgaatgacatcttccttgggttcttaacgctttttgctattatcccttacttctctcacaaaagcccaacactgttgtgacagaagctgcccacagaggtcagggtgctgtatacatggccagcgggcagggtcactgttacctgcagtctgtgtcagtgtgaagtcatgctgctgctgggtggcccttatctgccctgccactggccagcgagctgagagggacccttcctgggtacgggtctggagagtgccctgggaggcctgggtctccacaaacatcggagtgagaacagtacttcggaaacgccaatcagaatcaatggtatattcctgtacataagaaagtttcaaatgaaataaagtttcaaatgaaataatgctccttttttaggaacactgatatatttctatttaaaatctaatggtaccatcagcatatttgtaccataacttcatatgcagctgaagaagaaccttctctaatttaaaagttttaactgatttgccaactagaaaaactagttaactatcgagtgagaaaacccagctttcttaatgtttgcataaaaaggtttgatatcatgctcagcaccacaacccaaatgcaatgagtcaagcgacccagcttgtccacatacacacgtgccactgggacagatcctgagcttgtgagtgggacaggaggggccctaccccaggagctccctgcaacctgcccatcatcccactgtttaggctgctgcgagacaggacaagctcagcatccactgtggattgggaggaatgaggggagggaaagcaatggcgatcctgacaagggaaatctagtggaggccaagagggtgaggccagtggacctccaggtggctgaagcagaggcacgagccttccctttccttttcagaaaggaatgtgtattctgagaaggcaaagagccagtcaaagctattaaaaatgttcatgaacaggaaaagcctataatattcactactatgagagagaagaccacattacctgaaattcgcattctgacagaggatgctcgaacatggggtttggataatctgggctcatgctggtcatttcgagcagaaaatttgttgctaaacttaaaaagtgcacttctatcttaggagaatataaggaatttagtgccagcaaccggtccaaggtatttgaaggtaacctagtttcatggctccagaaatttcgaataattaatctgaaaagcaaagagaaaaaagtatattgcttagacaatggcaaatgggaaagaatgtgctgtacagggtgtcctgtggagaaggcacagctcttcacccacatgaagcttaacagagagggaaaccaccttcaactatatcaaaaatatagtctgagttatgaaacatatccactgaaggaagagaatattacaaaaaatgtagcatattttttatgccacagaggggaggggagaaactgggtgattttattctcttatctctattctctgggaagttttcaacgatgagtacataatattaactatttgaaacaaaaaaaaaaaatttaagaaattacacaaaatccttcactgccttgccaaaacaatccattataaaaattactgccataaaatactcaaaacatatattaattaaataccaaattaggggtcaggtgcagtggctcaggcgtgtaatcccagcactttgggaggctgaggtgggtggatcacctgacttcaggagttcaagaccagcctgaccaacatggtgaaaccccgtctctactaaaaatacaaaaattagctgggcatggtggcacccacctgtagtcccagctactcgggaggctgaggcaggagaatcgcttgaacctaggaggcggaggttgcaatgagctgaaatcatgctactgcactccagcctgggtgacagagtgagactccatctcaaaaaaataaaataaaataaatgtatgtatgtagttggtgcacatacatacatacataccaaattaggtcttataatttatgaatgcatatgaaatccaaatacaattttaagaagctcaatgaatttaaaattatagcagaatggaaaaataagtaatatacagaaacatataaaaagtatatggcttcttatattgaggctgggtgcagtgctcacacttaaaatcccggcactttggcaaaccaagtcaggaggattgaggccaggcattgaagcctaacttgggtaacatagcaagaccctatctttacaaaaaataaaaaatcagccaagcctgttggcgttatgcctgtagtcccagctactcaggaggctgagggaggaggatcatacgaacccaggagtcagaggctacagtgagctacagttacactactgcactccagcctgggtgccagagcaagacctcatctctaaaaaacataataataataaaaagtttacccctcttcttatataatcagtatttggtaagaaacacatataactgacttactcaggacaggcattttagagggtaacaatcatcattcacactttcatatataactaatattacagtttcctctcatttctaaagtttcaaacactttattttcaacattaatacttacagcatgatctcaactatgtgtgttaaatgggaaacagaagaattgtcattacagactttcttttcattttgaaacactttaactcactgccctaccatacagcatttggtccatatgactttttcaagagtgttatttttaagttgtcaggattgtaaagccttactcttcataatgtgctttaaaatactcttttactaaatattgtgaaatgcagaaagcagagaaaatgctaatactgcaaatacatttctaaaactcctgaaaaatactctatgctacctttgaaagcaatacccttaacatttaattgtcccagcccagttattcacgtactgaagtccagggttctcatcgatcaatccttgaatcagcacatcttttgccaacttaaatatttcctgggagtcattatctgtctcactttctggatctctgcttgagaaaacagcaaaatgtcacaacattaatgctctcttctggcccttttgttcaactacagtaacaccatctagaattcaattttaaaaggcttgttttcccattagactttagatctccaaatcacagcttgccccactcatgggtgtgtgcacaagccttgagaacccatccttgctcccagcaggagctgagtggaacaggaggatgggcccacaggaggcccagcggtcctgtgacgctcagctgtggtggtgtggtagtgcccggtggtcctggcagagttcatctccttagtctttgcaagatcttaaaaggacaactatgaaaataggttttataagcacaacaccacactttttcactctgattttttcacacacatatgtgaaatgagtttttaaaaggatacaattagatataccaaaatacatgttttaattattaatcatatggtaaaaaaaaatgtgttattatgttccagattgctaaggggacccaaatgatccctaaaatgttaatgttgcccaggcaacaaggtgaaaccccgtctccacaaaaaataaacaaaattagccaggtatggtggtgcacacccatagacccagctacgcaaaaggctgagatggaaggatcaactgagcccaggaggaggttgagactgcagtgacctgtgtttgtgcccctgtactccagcctcgtcgacagagcaagaccttatctcaaaaaagtaacaaaataaaatagtcaatgtatagcttacctgtaattatcatgaatccacatgagaatattatacatttgttccctacatgttgtagaaggatgggaaacgaattccacaacggggttcagaagttctcggagttctactggttttaactttggcatcatcttataaattatgtccaaacatactttttgtctttcatcatctctatgggagagattttaaaaacacacaaatttagctatttttattattgcactttcaaagtatgacaggcaactttttcttctttgtttcaaaattagttataatagataacgctacacttatataaaacttatattcttaaaatgatcatggactagattatcaaatataagacaaattacttcatgtgctaccctacactggatcctgaaatagaaaaaggatattagaaggaaattggtgaaatggaagtaaagtctagtttggtaaatagtaatgttctaatgttaatttcttacttttgacaaatgtaccaagattatgtaagggggaaagttgggtaaagggtgtatatggaaattatgtgtactatctttcaacttttctgtaaatgcaaaattacttcaatataaaaagtttatttttagaaaaacctaataatggcaaagtattttttaaaaggacttcaagagctacctggcatggtgtatagtgaagtacaatctgagctctaaatgaggcaaatatctatttccttattttgactccttatagcacccagctgaatgcttcatacagtagatactcagtgaatgtaaggatattaggacagtgacatacattttttgttactgacacaatgcatgtttattgctgtgtaaaaatatttacataggagggggacaagatggctgaatagacatagccaggagggcctctcccaccaaaacagagcaaaatgagtaaaccaacatgcttcgaagacatctttggaaagaaagcactgagcatcaatagagaggcaacacagacactgaggctgaagagggaggaagctgggaagcctgcacagtctccgggtgccaggacctggccctaatcaggtcctaaggaaggggtgagtggagtgactatatggggcaatccacgctcgccgtggagctctgggatactagccacaagagatcccacaaccccaaagacatttgaattggtagggaactgtcagagagaaggcacaggcagagcaccagcctatgtggagcccagcaggtctcactcagtgtggagcagctccagcaaatgcaaccccaggcacccatgcccccaggttctcaccttgctctgagtcactctatcccctgctgaatgctgggctgggaaagagcagggctgtccttcctgtgggtctggggagaggctgatctacacgcctatctgtcaacttcccaggcactcccaaccccagctgctcccacaagagcatacacacagcatagcctccattacccagcctgagtgctttgccagtggccttggagcacttcggcaaccccagcacagtgcttgattccaaggggacagaggacaaagctgtgggcctggtctcagccccccagggtctaagcacatcgttcaggaatacagagctgagatctgtggccagaacttaagctctgcttagaacactgagtagagtgagacgtgggtttgtgttccagcatgagtgctgggtaagtccccttccacaaggctggtctgggaagggtgaggcctgtttgccagctttgcatctgcctgagggaccctgtggcctgaaacacctaacagcccagtgatctgggcgcagaaagcatggcataaaactggctggtcaggctagctacaagggcagacaccagcagacttggtcaagggaacgtgaactgggcagtccccacaactgtgtgctgggcaaaaaaccccaggctgtgggcacctcaccagctgcacaaccacgacaacatcaccctgccctgagatcccccacccttgacctactataccaacagaccacccagagacataccccacaaccctctctgactttgccaagcacagaggaccagtgggcctctggaatgctgcaggtctcctggtgacctaaccttcagctcaggctactgctaagggatggggagtgcagcccaccagggccccccttggggttcaggaaatgtgggtatggtgccagtgattggaaggggctcctctaaggcctgggaatgaacttggtgagggggtcatctcccttcccctacccccagcacagagcactgtgctgaacgcactgtaatctaagagtctatctgctagcccttatccttaagcaccatatactggatcatagtctgaattatatcactaaaaaaaattcttctagtatccatcacctgtgaaacccaatgcaggaacctagagagatcctatacaggagagatcctatacagagcctcaggagagcctatacagagcctcagccagctgagaacacccagaaagggagccagttgactatactcagcatacaccacagtcaaaccctcaaggaaaatgatgaataagaaaacaaaaggtcccatccaagcagaagcaactccaaaaagataaaggaacaccagccctctcagatgagaaagaatttgtgcaaacactctggcaattcaaagtatcttctcacctccaaacaactgtcctaacctctcagcaatggtttgcagacagattgaaatggctgaaatgacagaaatagaattcagaatccggatggcgagaaagctcaagatccaggagaaggctgaaattcaatccaagaaatccagtaaaatgattcaagagtcaaaaggcaacatagccattttaagaatgaacaagccaggcgtggtggatcacacctgtaatccccaccactttgggaagctgaggcaggtagattgcttcagttggggagtttgagaccagcctgggcaacatgatgaaaccccatctctgcaaaaatataaatcattagctgggcatggtggtgcatgcctgtggtcccagctcctcaggagactgagatgggaggatcacctgagcttgagaggtcgaggctgcagcagtaagtcacggccacaaccactgcacttcggcctgggttacacagcaagaccctgtcgaaaacaaaacaaaggaaaagaaaagaaaaggaaccaaactgaacttccggttttgaaagattcactacaggaatttcataatacagttggaaacattaacaaaagaatagaccaagctaaggaaagaatctcagagcttgaagaccagtccttcaaatcaacccagtcagaaaaaaataaagaaaaaagaatttttaaataaaatctctaaaaaataatggattatgtaaaaatccattatatgtaaaaagaaccaaacctatgacttattggaattcctgaaagagacaacttggaaaatatatttgaggatatagtccatgaaaatgttccctatctcactagaggtaggtgggcatgcaaattcaagaaattcatagaacccctgtgacatactatacaagaccatccccaagacacatagttatcagattttccaaggtcgatgtgaaagaaaaaattttaaaggcagctagaaataagggtcagctcacatactgagagaaccccatcaggctaccagcgggcctctcagcagaaaccttaaaaaccagaagagactggggcctattttcagcatccttgaagaaaacaaattccaaccaagaatttaatatcctgccaaactaagtttcataaggaaagaaaaaataaagtccttttcagacaaggaaacattaagggaatttgttactattagacctgtcttgtaagaggtccttaagggagtgctaaacatgaaacagaagaacaatacctgctaccacaaaaacatacttaagtacatagcccacagatactataaagcaactacacagttaagtctacaaaacaaccaggtaacaacacgacaacaggatcaaaacctcacatatcaatataaaccttgaatgtaaatggtctaaaggcccctcttaaaagccacgcagtggcaagttggatttaaaaaaataaaactcaactatcttctctcttcaagagacccatctcacatgtaacaacacccacaggctcaaagtaaaaggatggagaaagatctatcacaaaaacagaaaatgaaaaagtgcagcagtcactattcttttatcagataaaataactttaaaccaacaatagttaaaaaggacaaaaaaggacattacataatgccaaagggttcaattcaataagaagacttaactatactacatatataagtacctaactttggagcacccagattcataaaataagttcttttagatctatgaagagacttacacaggcactcaataatagtgggaaactaacactctactgacagtgttagatagatcaggaaggcagaaaactaacaaattctggacttaaactcaacacttgaacaatcggacccaatacatctacagcatactccacctaatataccagaatatacattcttctcatctgcacatggaacatactctaagatcaaccacatgctcagccataaagcaagcctcaataaattaaaaaaaaattcaaaatcataccaagcacacactcagaccacagtacaataaaaatagaaatcaataccaagacctctcaaaaccatacaattacataaaaattaaacaacctactcctaaatgactattgagaaaacaacaaaattaaggcaagaatcaaaaaatttttttcaattaaggaaaacagggacactaaatgcctacatcaaaatgctggaaagacctcaaatcaataatcaaacatcgcatataaactagaaaaataagaacaaaccaagtccgggtgcagaggctgatgcctgtacccactttgggaggttgaggcaggaggatcatttgaggtcaggagtttgagaccagcctgaccaacatagtgaaaccctgtctctacttaaaatacaaaaaaattagccaggcgtggtggtgtgcacctctagtcccagctactcaggaaagaggctgaggcaaaagaatagcttgaacccgggaggtggaggttgcagtgagccgagatcgctaccactgcactccagcctgggcaacacggtgagactccaccttaaaaccaaccaaaacaaaacaaaccaaccctaaagacagcagaagaaaagaaataaccaaaatccagagtggaattgaatgaaattgtgatccaaaaatctacacaaagattcaacaaaaccaaaagttgattatttgaaagaataaacgagatagaccacaagctagatcaatagagggagacagagacagacagacagaagatctaaataagcacaataagaaatgacaaagataacatcatacctgatcccacagcaatacaaaagatcctcagagactattgtgaacactctacgtaagcaaattaggaaacctagaggaaatagatacattcctggaaacatacaacctcccaagattgaaccagaaattaaaaacaaacaaacaaacaaacaaacaaaaacctgaacagaccaatcaggagctcctaaattaaatcaataatgaaaaaaacttaccaagcaaaaaaaaaaaaagcagaaaacaaaaaacccagggcagatggattcacagctgaattctaccagacatacaaagaattggtacgaatcctactgaaactatttcacaaaaccaaggaggaaggactcctccctgactcattctctgaagccagcatcatcctgataccaaaatctggcaggacacaatgaaaaaagaaaacgtcaggccaaatccctgatgaacacagatgaaaaaatcctcaacgaaatactagcaaattgaatccaacaacacaactaaaagtcaatgcgtgacaatcaagtgtgctttattcctagaatgcgaggttggttcaacatacacaaatcaataatgtgattcaccacataaacagaattaaaaacaaaagccatatgatcatttcaataaatggagaaaaagctttcaataaaatccaacattctgggccaggtgcagtggctcacgcctataatcctagcactttgggaagctgagatggatggatcatttgaggtcaggagttcgagaccagcctggtcaacatgataaaaccctgtctctactaaaaatacaaaaattagccaggcatggtggcatgtgcctgtaatcccacttactcaggaggctgaggcaggagaatcgcttaaacctgggaggcagaggttgcagtgagctgaggtcacgccactgcactccagcctgggtaacagagggagactctgcctcaaaaaaaaaaaaaaaagaaaaagaaaaaaatccaacatccttgcatgataaaaaccctcaacaaaccaggcatcaaaggaatattcctcaaaataataacaatcatctatgacaaacccacagcctacatgatactgaatgatggtaaaaactggaagcattccccttgaaaactggaaaagacaaggatgcccactctcatcactcctattcaacacagtactcaaagtcctacacagaacaatcaagcaagagaaagaaataaaacatattcaaataggaaaagaagaaatcaaactattcctcttctctgatggtatgattctatacccagaaaaccctaaagactctgacaaaacgttcctagaactgataaatgacttgagtaaagttctaggatacaaaatcaatgtacaaaaatcagtaacatttctatacaccaataacattacagctgagatccaaatcaagaatgtaagcctatttacaatagcaaagaaaagaataaaacacctaagaatacagctaaccaaggaggtgaaagatctctacaaggaggactataaaacactgctgaaagaaatcagagatgatacaaataaatgaaaaaacggattagaagaatcaatattgttagaatagccattctgcccaaagcaatctacagattcaatgctattcctatcaaactacctatgtcacttttcacagaattggaaaaaactattctaaaattcatatgaaaccaaaaaagagcccgaatagccaaaacaattctaagcaaaaagaacaaagccagaacatcgtattacccaacttcactatactacagggatacaataatcaaaacagcatggtactggtcgggggaaaaaacaaaatacaaaaaaacacagacacacagaccaatagaacagaatggagaacccagaaataaagccgaaccatctgatctttgacaaagtcaacaaaaataagctgtggggaaaagatgcctcattcaataaatggtgctaactggctaaccatatgcaaaagaatgaaactagagccctgcctatcaccacataaaaaaattaagatggattacagacttcaatgtaagacttcaaattacaaaaatactagaagaaaatctaggaaatacccttctcaatatcagccttagcaaagaatttatgactaagttctaaaaagaaactgcaacaaaaacaaaaattgaccagcaggacctagttaaattaaagagattctgtgcagcaagagatactatcaagagggtaaacagacaacctatagaatgggagaaaatattcaaaatagtcacaaactatgcacctaacgaaggtctaatatccagaatccataaaaaacttaattcaacaagtaaaaagtgaccccattaaaaaatgagcaaaagacatggatacttctcaaaagacataaaagcggccaacaaatatatatatatatatatatataaaagtcatcatcacaaatcatcagagaaatgcaaatgagataccatctcacaccagtcagaatggttttcttaaaaagttaaaaatctggcagatattggcaaggctgcagagaaaaaggaacacttatacatggttggtgggaatgtaaattagttcagccactgtggaaagcagtttggagacttctcaaggaagtgagagttgaactatcatttgatccagcaatcccattactgggtatatacgcaaaggaaaataaatctttctaccaaaaagacacatgcacccatatgttcactacagcaccatttacaacagctaagacatggaatcaacccaggtgcccatcaatggtggactggataaagaaaatggtacatatataccatggaatattaggcagccataaaaaagaatgaaatgtcctttgcagcaacatggatgcagctggaggccactgtcctaagtgaactagtacagaaacagaaaagcaaatactgcatgtacttactcatatgtgggagctaaacactgagtacacatagacataaagtcaggaacaacagacactggggaacagaagaaggggaagggaggatatgaggcaagagttgaaaaactaactactaggtactatggtcactacctgagtgacagattcatctgtacaccaaacctcagcattacgcaatataccttcgtaacaaacctgcacttgtacttccttattcaaaaataaaagttgaaaaaaatgaaaaaaaaaaaaaaggtatatggactaatagactaagactggaaaagagtacagggacagggaaataatataatgtaagtgatcagcagctttctcttttaacatatacttttatgttatgttgcaattttgaaaataaatgaacaatttaaacacattaacagaagctctcacctggcaaaataggtacagaactcaaaagcatacattttaaatctgaagagagccaaggtaaccccataggccacctccttcatttatggatgaaaaacacgccctgggatgtggctccccaagatgccaggccaagggagcagagagcaggcccacctcagcagatatcctattcttatggtgccttcaccttttcttcagagattccaacttcacaaatgtgtatatcatggaaacccacaggttcttcttgagttggagacgtcttaataaattaacgctttatgagccagtgggacccaagagcagggctagtgttcactcacctatgtctcatgacttgaacgaagtccttgctctttaactggaagtacagctctgtcattccctccacacgacaaagtaccacctccagacagagtgttttcaacactccatgaaattttggcagcagaaagaacacagcattcatgaacctggcggggaagggaactggtgagaggagggccgaggaccctcctgccccgaaaggatccctggacagcccatacctgtctgcaagaggagggaagctcttggtcactttgttcaagcacacaataaacttgtcctccatagtattctgatgttgcttcaattgtttcgcaaccagttcacacagagactcctccagtatctgaaaaattaagtttattttcaaatacacaaaagtggaaatgtaggttaagcattgaaagcaaagtttatcttgagtatttaagtgagcccaacaaaggtgctcaatgttgtcacctacaaggtagatgatgggacagtaggtgctggggatgtctgctggtctacactgaccatcgcacacccttaggctctggatccttgagttcctacacctcggtgagccagtccacatcactgtgctctgtgctgagcacccaggtgtctggctcgtgtagatgtcagatcaatgaagatcagtgtttcctactgacaccaaaacacttggtaggaccagtaagtcctttgagaagctaagctaaatggctaaatattgtttgagacatattttatggtgttcagatttctgataaaaaatattcacatggactagaattttcaagcaattctattcacacagcagtccccatcactgtactgtctgctcatgtcctgcctcttttcaccaagtgttgctacctgttatatattcatctgtgtaccatctgtctcccctccccaaatgccagctccccaagggcagggacatgacctgtcctgttccctactgcatccctagaaccaggaagtcctcaaatgtcctccacacagagaagtactcagtagagtccactggcaggaagcaacggaaaacactgctgtccttcctggctcacctccttcctcacaaacatcagaaagaggggtaggcaacgtttcaaaggcacacagaccgaacagtttttcaatgcaaactcaacacagactgagcgcctcaaatctgaaaatccagaatcctccaaaatgcaaaacgttttgagcctcagcatgacactcaacaaaacgttcactggagcatttgaattttgaatttttgaattagggatgctcaaacagaaactatcatgaaaatattgcaaaaccagaaaatggaaacactcctggtcccaagcattttggaatagagataccgaatctgtagtatgaggctatttttaaattatcttaaggaaaacccttaacacaaaaccacaaatttcaacggcctgaaccccatatagaatacacatagtattaccctaccaattaatcagatgtctttttattaaaagtatttaatacgacaacacaatgaaatgatcacaatctagcaagtaaagaaagcaagttataaaacagtatgaataacagagaccaagaacagtggagctgtgtgccacaggtgctgagggacattgcgtgggaagagtgcgagcctctcttactgacttctttttattttttttgagatggagtctcactctgtcgcccaggctggagtgcagtggtgtgatctcagctcactccaacctctgcctcccaggttcaagggattctcctgcttcagcctcccgagtagctgggattatgggagtgtgccaccatgcccagctaatttttgtattttttgtggaggcagggtttcactatgttggccaggctggtcttgaactcctgacctcaagtgatctgcctgccttggcctcccaaagtgccgggattataggcatgagccacagcacccggcctcttaccaacttctttatgtttactctgctttccaaatttctacgataaatccgtatcacttttatattcagaaaaaaatacgtaaaacagaagtgttttttattcttaagttgaaatttaagtcatgagagattaaacctggggatctgctgtaacctgctccatttatggtggaaatgaaacatattatgtagatttaaacctcatatttagggatgttagaatcatcttgtaaaaaagttctactgaattttaaaaatctgtttatttacaaaaatagctgataatccctaaaatgaattacaagtaatatttgatcttcccaaaggggtcatcttaattttattttaaatccaaacaaatccatacttggtgacatggacaagggtccaatcacagcactgggcccactggtgcctgctcaggaccacctggcttctcctgagcctctcctcatccagcccaacagtgactatggcctggactctactctgtcctttctttcaggagagtaactgagctggggttgcaaactggagaatcatgaacataaaggcagtctacataaagccatgaggctggacgaggcgggcaggggagcagtgagtgaggccaaagccgagctgtggaggtgttcagggaaatgcagctgacgaaagggagagggggctgccacaggaggaggacgggagccaagagtgtcctcagggtgtgaccagctgggccacccagacaggctctgcagcagcaagatccccagggatccacagagcaccttatcccagtgatgaacctgaaacccaccaccctgcttgggcaacatggcgaaaccttgtttctacaaaaaatacaaaaattagccaagcatggtggcatatgcctgtagtcccagctactcgggaggctaaggtgggaggatggcttgagcccaggagtgcaaggctgcagtgtgctatgattacaccactgcactccagcccaggtgacagagcaagaacccagctctaaaaagactttaaaacaataaagaacatgttacttcttcattcagtcctcttatctgaacagcgcactgcacttaaacgttcagttaggctcatctcacagtcctgtccagtgggcaaggcagcagtactgagagggtcgcctgggagatccctgcccctgttcaacagctacaccaaaaactgcaaggggaggaatggactgggggaggacagcagctatctaccaggacaatttcctccacaaggaaatcctgagaccaagttcatagtaataaaagctggttaaatactctcatcctgattttacattaccaagtcggttgctgatctctccacgttcaccaagtttccaaggtgtttaaaaatcatgtgccctctctaaaaaactgagtattatatttgctatattatagtaagaaacagtaaaattttaataaatgcagatgcccattttgtttctaataccatacaagaaataaacatataagtatcaagggtcataacaaatcaaaacagagtaagaggtatttattgaaaattgtgtagcacactcacgttttttctctccataacatatcgaagtataagtcctagaacttctgctgcagcggcatacacttctttatatcttacaaaggacatattattcaccaaagcctggaagtatctacaataaacacagaaaagacatatgcatcaaataaaccattctgttgttccacaaatataaatgacaattttccttctcatgtcatattgacagcctaagttgaggaaatctaaatatagaatgtgatgcaaattccatgcacaaatgcacacatcagcatgtacgtaagggtgcccgatgtcataaccagaaaagcatagggcagtctgctgtcccatcatgcagaaccgctgcagctggaccatcccacaaggctgaacagacagaaaggtgcagtgacagaaagagctactatccaagatcacgggacactgactccctttcaaaacccacctactatagcaggacaaggacaataaaatgagaaagagcatactcccagtgccgtctgtgtgaggaggcttcccagggagccacccattcactgtcagcactcaggggactctgcaaggttatcccagtgtagaagccaaagccccagccagtgactgtctaaaaggagccgagttcccactgaggctgccgcgaagctggctgcctcagccctgaggtcatgtgtcatctctggcaccagtaactggtccgacggtgctggggggccaacacggaggaccaaacagagagagtgattgggcagggcaggcggaaacccagggagtggccaggaatcaacactgacttcacaaccctcaggagcaggacaaagatgtcctgctccttttatgatgtcccggaaccatctttctgaggcctcttgtcttgacatgtcacacccagctgccctagctcccaggcgggatggtgcagcccagcgtctaccagccctcaccgtcagagagcccagaacaaagccttccgaggggcctgcattacttttggggataaatgttcagaatatcagtttagaaaataagaaatacttaacacctctcaccttccagcatggatatgaaaaaatcacactgttttaaacacctacatttctcatttgccccaaacatttcttccaaaaaaatctaaatccatcttcctaaatttaggcagacaagaatttttttggtatagatgcggtcttgctatgctgtccaggctggtcttgaactcctggactcaagcaatcctcctgccttggcctctcaaacgtgttagaattacaggcatgagccaccgtgcctggcccagaaacatttgtagcatgggtctggtccttaaaattatcaaaactgcaccatactgaagtctgtcaatccagtttgggtagacgtgacctaaaaaataatcaagcaaacacgtactcgctactctggatgccacactgtgggtcatagggaggcaggtcattggccatcacgatgcctagcaattgaatccctactgagttgtctttagaattaggatctttaccggaaaacttttcaaatattaacctgaaacataagcacaaaggagaaaattgagactgttgcataatcaagtaagaagcaggaagacaaatacagaattttatttttttgagacagagtctgactctcgcccaggctggagtgcagtggcgtgactgagacggagtcttggagtctcgctttgtcgcccaggctggagtgcagttggcatgatctcggcttgctgcaagctctgccccctgggttcacgccattctcctgcctcagcctcccaagcagctgggactacagacgcccgccaccacacctggctaattttttgtatttttttagtagagacggggtttcactgtgttagccaggatggtctcgatctcctgacctcgtaatccgcccgcctcggcctcccaaagagccgggattaaggcgtgagccaccgtgcccggccaaatacagaattttctaaagctaatcttcagggtaagaaatgctttttctttatttctgtttcttccccaggtctagctttgactttacagaaatgctttctttttcttttcccatatccaatatccctgcttgctaatacctcctgttcacatccaggttcctccagctttgtaacactggcaattttatcgccctcgtattttaattatttgcctaaattctcccttagttgatagcaaaactttttggaagttttagcttgcctcaggctacaaaaaaaggaattacgcacaaatcctacctacctcccaccaccctctaccccatgggccaacggaaggtagtgcccctccccagcgtggggacatcagaggcaagctgaggcggagggcagggccactggagggtgcgagacacgcatctggtgccacactctggaggctgtggttttattagtaacaataaattattttcttcctcctatcatttcatgtaattaaatttcactgtaatcatcatttacgacacactacattttaacctaaatttctaaacaatactgcaaaaaccagtaaacatacctataagggatggataaacaatccttccagcactcgacaagggtctttataatttcaaggttgtgtctaaacacagctctttttggatgaaagacatgtttcattaggaaattaagcaatcgatttgctaacacttcatctttagggaccccctgaaaaggtacagaaattctgtattaatatgcggcattccattctggaaagcattttttaactcaagttcatttataaaagaaatctggcattttacaggagtccggctcctgttgaaagccctgtgatttttcagaaacaggtaacaacaaaggctgacctggcaagaggaccaggcaccgccggcgctgcaatctcagagttgccgtccagggtgcaggctgctagccaccatgccccatgcatgcacctctgccttcctccctggagcctccatgcctaggactctttatctgaggccctggacaggggtcgcctgcagggcaggggagcagcatgaaggtgctttccccactccgactcagtatccagtgctttctgactcagctcttccctataaaactgcagagcctcctgttcagggcctctcaatggtgagacggcccttgtctgtgctaatccatctggctgctgagcagtgcaccactctaggggcaaacagaacaaggggagtctccctccagtgttagcctctcactcccatgactccagagtgagtaaaagcttcacggcaacctttctggcttgctgttgctttattcagctacctcgagcccggcagttccactctcttgagttcagctgagccactgacagctacatcaatctctttcaacggacccttgttaaactgaacccctcttaattttttcattttattaagcagaaaacaaagtatttcattacactaagacaaagaaatctaaatttggttaactgtgaaacaaatgagataggtacatccagagacaagcgtgtgagaaagctccacgtatttttttgtggtgggggggtggtggtggagctgggggaacgtagtctcactctgtcgcccaggctggagctacagtagtgccatttcagctcaccacaacctccgcctcccgggtttaagcaattctcctgcctcagcctcccgaatagctaggattatagacatgcagcaccatgtccagttaatttttgcatttttttagtacagataaggtttcaccatgttggccaggctggtctcaaactcctgaccttaagtgatctgcctgccttggtctcccaaagtgctgggattacaggtgtgagccatcatgcctagccccgcatgtgtatattatatttaatacagactgttcttaccatctcctcacatgaaaacgtttgtatgctgtcagtgtccacagttttaaatgagtaggcaaagcaccaacacacacacacatgtctacactggtgggtactgcatttgcctcaacataacatggtgttatcatctggcagctactgctttagccctaatcttgccattgctggtattagtcaatactctgggagtagagaagatggcacaaatgccaaaatccagggacttcaaggcaggagtcctcagagcctcccattcagggttggttgaaattcagtttacacatagttttaataaatttgcaatctcatttctaaggcaagtaaaggcagcaaacaaaacaaaacaaacacctgacagcttcataataaaagcaaggtcagacgaattaccaaaggcaaaggaaacaaaacaaaaccaaagcaggctgaggccatttggtttaggagcacaccagcaatgtagcaacaaatgctgaaaaccatagcacagtcagtgagagggacctgaattatgtgtcataggctctataggctattggcaaaggataatatattaacataaaagatgcatcaatccttactgttggagtggccaagcctgtccatgaaagaatagtggccactatctcaaccaccatgtagtgaattccttctcctccattgttttcagaagcagccagctgcagcaaggggctaagccagtgcttcgcgtaagggcgaaagacctacaagaggatgtaaaagtcaaacatcaaagaatggtcttaaattgccaaaatattaatacaagactgtatcttccatcagctaaaattttatactatgactggacctaaagccaaaagcgaggtaagcacgttaaagtgaaggcattagtgtgggccctaatcaaatatgactggtgtccttattaaaagaggaaatcaggacacagagacagatacaagggggaagatgaggtgaagacacagggagaatgcctgtgacacaccacatagtgcttgaggctgccggatgctaggagtagcctggaccaggctctctcatagctctcgaaggaaccaaccctgccagcagcttgatctcaggccacggctgtctgagtccccccagtatggcaccctgagaccatgtgcccagggtgtgaagaatcaagtgagccccgaggaaagaaggtgctgctgcagccctagagcagcctgtcagggatgtcctgacagactcgccatgtctgcagagctgcccagaatgaccttctacggagccaagtggatggtgtcaccccaccacttagtgcccttagtggttccctggtgctcaatgaatgagcccaaccctctgcatagctctggatggcctggcctggctctggtccagaccacactcccacagcccaggcagtcagtgcagacctgcttggctcacccagggaccacccgtgctatgctactccttccctgcctagtgcaaactctcactgcacttcaccacgtctagctcaaaggcctttccaaaatggactccaagatgctcctacctcacgaactcagcaattgcctaagagtccgctgtttttcatatagagttaacaggaatattttctcccccgctccaccccccgcttttttttttcctactataaggaaagaacgttggcagccgtaagaaagcagctacatgtactttatacaaagaccacttctaactcacgagaggtgaatttacatatgttaaaaacgataaaagaatggtgatgaacaagtagataaatattgggtggctaatcagagaacaaaaatgtcatgctctgcccctttatattttccttttttgtgtgtgtttttaagtatattcatagaattgcaattgattcattcatagaattgaataaacagacttacagaatctattcaaagaataaagaaataatcaattacttacctcttctgtattaataacaagcttggctaagaagagacggatatttaatggtactattggatttcccagtttgccatggaggaatttcatccaagaaggaagatctcttggcactgaatcctaaaataaaacattcaaaattaccttaaaacgtggaataaaataatgatacattttgatattatgggaaaacaaggacaaagtaagacatgaacaaaaaaaaatcacatttatttgataagcagtttggttttgttttcaatattaaatgttcattctcagtatgacaccaatgaatatagtattaacaggtaagatgagtgggaaaagcacctcttctccttgaggcgggcccaggcttctgtgcatgtgcttgaccagggccgtcaggggcgccatgcactcatgccgattgagctcgtccatctccagctccagcacatcatcatgcaccgtggggtcccgctgctcctgcgaaagggagggcccaggagagcagagggtacagttaacattcagtggacaaggcagtggatgtgggaggctctttctggggcaacagcatataacaaacacttaggtaataatgataatctggtaataatatcaaatacactcactgtacaattaacagataagaaggatttcatgtcttccttgcatcccaagtacatagtccccgtcccgtctgcccagtcattccacagggtggctcctgaggtcagatgtctctgttacactgacccctgacccccatctatggtcactcctcagggtggctcctcaggtcagatgtctctgctatgtgaccccctgaaccgtctgtatggtgactccccgggagtgcacctcaggtcagagcatctttgctatgttgacctctgacctcctactgtgctgatgatatctgactgctgagtctacagaataaaaggctaggaattagatcttggaaaattctccaaattaactctatactccgagggttgtcaatggacagagaactggcttcctgtagtaacagcaaggcatagctgtgaccccctttcttcacaaacatcgacaatattcttttagtatgtgaaatgtgatcacccgtctccgaaaacgaccagtggcaggtctagggtcttgggagctgtatgaatagctctgaactccggttgagaaatcaaattgactcatttcctcactcagggtactgtctgccaaatatgacagggaagacatataggaaggaccatctgaaatataaaaaaggagaaaattacatgtattcaaacataattagtaagaaatgtatttctctaaattcaaatgatatgaaaattaaagcacattttaatctaaggttttcatcaagccagtgattattaacctattatccagattaagaaagcaaaaaagaaatggggaaaagacctcattttctttttgttgttatcaagcagttattctgtcatagacaaggaaattgttatactggtccaattttgcatatgattaacacattttctttgcatttaaaattttgatgatgtacattttgcccattaagtctaacaaaaatgtgggaagaaataccactgaaaagcagctaatccaaaacacctaagagatttagaaaactggtccaaattttattctcatatcaagaaatgatgataaagctataaggaaaaattaagcaaaaaacaaaaacaaggagcatatagagggatagtggactaattttaaatagggaggccaggaagagtctacttcaggggttgacattaaacaaaatgtcatgaggtatgctaatacctggggttgagggtattagaggaaactgcaagtgcacacgacctagggcaaaagcaggcctggcgcctacaaggcacaggcaagagccatatgctggagtgagcagtaagaagggctgcaggggagggagtcggcaggtcaggggccttgagcagctctgtcctgccggagatgggaacccacagtgaggctgggcacagaagagtggctcgaaaggacttgtattctaatgtagacttctgaatgtatctaaacaacatacaaacacaatccatatgcaaacaataagacaccaagctaattttgtatttttaaaaaagtgtaacatatctgaaccccgtctggccactctgagacctttctatgcagctaagtttagctaagtacatttctttcaaaatataattccatttgccacttaaaatactttttcaaagtcaatttcaatgttttagggtacttaaagtattttctatttacataaaaaatactttactcctctatttgtcttagaacaaaacaaaacaaaataacccatcgatttgaatcctttctcatgattttgaaaacatcctacctgaatccccatttgctgcttctctggcttctttcctaatttcaatgtactttttctttctttccataggaacctattgggaagaacaaataaacaatgtaaaacattttataataatagtgatactttttctgttttagtagcaatctggcaaaaaaaaaattataaatttttaaacaaaacaaaacaaatttaaaagcactcaaaaataacctcaaaaagagactagtgagtgtcccttaaggaaagcccttcctgcagattcccacagaactcggcccaggcacttaacctccatctcagctctggtacagctcactgcgtacagtgtgtaccaaactcttatgcctggactgctgataaattctatttatctctgaacctcaatttattcaaatctagttatgatatatcatagtgcttgtaattgttgtaaaatatagaagtaacatacagcatgtgtctacacgcttaataaactggtgctaattttgttgttttttagttctttgaacatatgcctagaaaacaatcctagtcttgttcagaagaagtacaaggcaggatcagcattcacatgtagtggtgaagcactaagacatggtagaggtcagcagctgtgtggggaaagtgcacgccatggtggatgagctcagctctctgcccaccttcccatttccaatgggtgctgaaggcagcaaccaccacattctcaccaactgcccaactgctgaggctggcatgtcaatctgagcttggctaaaacaaaccttgtcccatctgccagagcaagtcttccagttaacccatgacttttccatgatcctgccacgttgcccaagcaaggccactgtaaggatctcaacttctttgactggagcaattcacttagaaaacaacttctgggatatgtcctaacacttccttttactggcaccgtctttcctacacatgtcaagagatgaaatcaagttctgacaaattttgtagttgcctgagattgtatctgaagctacaattgccagattttatagaaaccacatgaaaccaccagtttttgttgaaagccgacttgaatattggcaacttaacgtgtttgacataatatggttttctttgtgagcacttgataagttttttttaacattgaaaatttcactcacctcaacttctacaggaaaattatagcggcgcttcaggtcgatcagattttcaaaaataagcaagttctgtgaatacaaagaatcatataaaaatagctgaatggtgaagatcctcataatcgatgttactttagaattaatgctatgtaatagctcatggaaaagcactccagctttaaatatacctatgcagaattaaacgaaccacatctttaatataagatggtataaattatctgtaagtttgactgatataatctaacttttgaactcctacaataacaatagtgcacaccgtaggagtggcctaccttttctggtttttcactaaacagaaaaccttggtaaaattttaactcattgaagacacagcagatgacagatatggcgcagttgtatgctgcacaatggtaaagtcttctcctctccagcagctgattctctcctgccatgttctctgtaaatgcatcgtagcacaatctgcagagagatccatgtgacaaatcaattcacacaacatggcaatcactgctcaagcccaacaatgccagacaacaggacctaatgccattcagcctttctcgagggtcaggcttgtgccaggcagagtattaggcactgggaatatgaaaaggaacatgtcatccatctcacagcaaaggcagcatatatacatggatcttgcaacacagtggtcagtgacgcaacggcatcaagtgcagtaagtaaagagagggaaggaagcaaggaggacagacaacagcctagtcatgactgaacggtgacatcattcactgatgaggtaagacagcaccaagtaagaggagggtaataatgaatttgtttggtgatgcaaaatgtgatacggcaaaagtctgtgttcaatatttactaggaggagaactccattaaaagacaagttttagagaaaatacatttgattacttttgtattgtttagaatgcctgttaaaaaatatttactatgcctttaatttcaaatctcagaaaaaataaaatactctaaatcttttgttactgaaaatcacagcactaaaaatatatcaagctattcaaggggaaaaacagtaggaaaagaacagtaaaaggaaaaagttttattatttgtaaaatattagtacaagataaaacaactgttatccaatacaccctaaattaacgccctaattaaagttcacctaagtggtttataagaagaaaactataaaagctcagtatctaaataaaatatttattcacactatatacatacataaaaatatatgtacccaaagcattgataaataaaatagaatccaaaattaagtaaaatcttacttaatcaatgtctttgtaagttcatttccttctgtaatacacgagccatggaaaacttgattaatttttgattccttagcatgaacatcatctttgggaaggcgagaatacatcacgtctagaatcttatagtagcccatcttcttggtgatttgagtatcaaaggtagattcatttagcttcaaaaaggtaaaaaataattatctttggtcttattaaacatgaaatacatcttatagaatatatcaaatttaatacttaatatcctttagacagacagaattttaacagtcaaaaatgctaaatcacttcaataagaaagcatgcaattgtccaggtctagaacacgaatataagcattgatatgttacactggtgaagcaggaaataatgtgtgacatccaaatagtgagccaagggtagaaaatgtttgcacaaaatcttactgaagacatgggaacaacaggtgaaaatccaaaattctcagctattttgaagtctgcattaacaatgcagcatctgggtattcatagtatttcccaacaggattccgagggaggctgagtgatacatcctgccctcgccccacaaaaagtatccaaaagatgccctcatccctgaaacctacctcctcatgtggcaaaaaaggactttgtagacaaaatttagttaagggccttgtgatgaggagattattttggattgtacaggtgggtaggccataaatgaaatcacaggcaaccttgtaagaaggatgtgtagggagattagatagacaggaaatggaaatgtgaccagggaggaagagaccagggtgaaaccagcacaagccaagcaatgctggcagcccctaggaccgccaggaacagctcttccctgagttcccagagtgagcgtggccctgacaacactgtgatgtcagcccagtgaaactgattctggacttctggcctccagaagtgtaagagaatatccaaatttgcgttaagttgttacagaagccacaggaaataaaggcagatcccatgtagccacagactgttatgtggcacactccttgaacagcagaggccatgtgactgagcacacagcagtgtctaggcacaccagtcaagtaggctgctcacttcttattactgatttaaggcgtatgatacctttgtaaacctggacttcaacacatcaatggcatccaccacaattgtgctgaagaattctctcaaagcatccaggctacagtgccacagcagagtgaggagggagcggtccacaaaggactggcgtgtgaaacttaggcgggggtcatccttcctgaacatttcatacacgctttccagaaggcctacttgtgtgacacatgaacccctaagaaaacaagataaaattatatgaacatccctgctttgaagaggaactttatgagtgcctactacataacaggcaaagtaaacaccagtgattacaaattacaaaaataactttaaggactatatatatgcaaaatccacaaaacacaaaaagcatttgcacatgaaccatactacttttatccactccccaaaatcttcaaatcaaacatgggcattaaaaagaagaatgtttcatttactttcaaatctggtcttgcttaaagaacatctggaaggctctagaagaatctcaagcctaaaaaatagacacatttctaggatataaaactcagaagttggctgggcgtggtggctcacgcctgtaatcccagcactttgggaggccgaggctggcagatcatgaggtcaggagatcgagaccaccctggccaatatggtgaaaccctgtctctactaagaatacaaaaattagctgggcgtggtggtgtgcgcctctagtcccagctactctggaggctgaggcaggagaaacacttgaacatgggaggcagagggtgcagtgagccgtcgcaccactgcactccagcctggcaacagagtgagactccgtctcaaaaaaaaaaaaaaaattcagaagttatgattttaaaattctagtttctccctaccagtgaaccaccattgctatttcccaaacagaaatatacctgtctatctggtcctttattttctcacctgaaaataatatatttgaataatcacctataaagttttgtctataaatctataaattaagaatgcagagttagtatcttcatctgtaaaaataagagggttaagactaaatggccattaaaattctgatgctatgaagttagataaccaggtcaaaaatactagattcagaaagtaactcagtcataaaaagactataggacactactagatgccatacaggatttgcaaagtttatttgggtactataatggactgaatgtttaagactccccaaattcctatgttgaaaccctgatccccggtgtgattgtattaggaggtaaggctgttgggaggtgatcagtgcccttatataagaggtcccagaggccgggtgcagtggctcatgcctgtaatcccagcacttcgggaggccgaggcgggtggatcacctgaggtcaggagtttgagaccagcctggccaacatggcgaaaccccgtctctactaaaaatacaaaaattagccaggcatggtggcaaatgcctgtaaacccagctactcaggaggctgaggcaggagaattgcttgaacccagaaggcagaggttgcagtgagctgagatcacaccattgtactcctgcctgggcaacaatagagaaactccgtcgcaaaaaaaaaaaaaaaaaaaaaaagaggccctagagagttctttgccccttctaccatggatgactcagagagaaggtgctgcctataaagcaggcaagcgggctgtcattagacactccatcaactggcagcacgttcttggacttcccagcctccagaaccatgagaaatacttttctgttgttttataggccacccactctgtgctattctgctatagcagcctgaaaggaataacacaggcaccatcctaggctcattttctcttgaggagctttccactagcaagcacagtagagatgcacataaaacatctgactcttacctaaaaagctaagatagtaaggagaagcaaaataaaaagagcaaagacctaatgttaaaaatgggcccacagatgatttactgaaaaatgcaaattaaatatataaaaatatgcctgactttactcataataaaagaaaaattaaggtaacaaagggaaaccctttctcacctataaattggaaaaaatctgaatgtttcacaatgttggccagacagtagtgaaacagatacactagtatattacaaataagggaggaatgcaaataatacagccccaaaagaagcaatacagacatacctggcaaaattacaaatgtacttaccttttcatctgcatttaggaatctaccccaaagatacacgggcaaatacaagatgatataaacacaaggctattcacaacagcattattattattattttaaaatattttttgtaatgatggggttctgctacgttgctcaggctggtctcaaactcctgggctcaagtgatcctcctgcctcagcctcccaaagcactgggattacaggtgtaagccactgcatctggcttccctgtggcattatgtttaacagcaaaagattgaacccagaagtccattggcaaagggctactttaaaatactatgatatttctttgcaatgaagaattaaacactaattttttaagacaaagaatgaggaagatttctatatgctgatagggcgagatctgtacaagacacaagtggaagagataggaaggtgatggggcaaaagaggaacaagagaagggcccgagatggaaggaagatcctctgaattgcagctcattatatagctttgattttagtcatgtaaatatcatacatgttcaaaatgaaaattgagtcaaaagaaaaaacaaaatttctaaaatttgaaagttaaataagcactactaattggtgtaataaccacacatcaagaaaaaactacatcaaatgattttggaacacaaaatttgactgtatatccttagatggcatgtactaagaaaattatagctaaaatgaaaaatttaaacttcatctagctgtcattattctatgtaatcatactggtattgttatttttgaaagtattttgtgcatattgtaaagccattgagtaattatagactatcactggaaacattagaaaggaaaagagaacaagatgcacagcgtaaaggaataagaaaagaagttacattaaaatcctgtaaaacagaaaaaagaataagaaaaaaattttaatagtaaaaaatttagttgccttttatttatttttgtttattttttcaggctctctggccttgttcccaatctcaggaggaagcatgcactccttcactattacatattttgttggctattggtttttcatagacagcctttgtcagttttatcacaaatggatgttgtagtttgtcaaaagtcttcctgcatctactgaaattataatgagttttcttcctttattctattatatggtatctaagactaactgattcccagagagaaaagcaacctttcattcttacaataaacaccaataggttatggcgtataatgttttgtgggtgttgctgaatagcttaatgtatctttaaaaatttttgtgtttatattcatgaaggatacttactggtctatagttttcttgtgctgtctttctcttatgttggtcttgttactcgcctcacaaaaggagttgggaagtattccttcctcctctatatcctgaagggtttatgaactactggtacaatttctttttaaatattttaattccgggtatggcggctcacacttgtaatcccagcaatttggaggctgagaaagaaggatcatctgagcttatgagttcaagaccagcccaggcaatttaggaagaacctctctacgtttaaaaaaaaaaaaagaaagaagaaaaaaggctgggcgtgatagcatgcctgtagttccagctactaggcaggctgaaggaagaccacttgagcccagaagtcaaggctgcagtgagccatgatcatgccactgccctccagtatgggcaatagagcaagaccttatctcaaaaataataaatgaatgaatgaatgataaaattcaatggaaggagtggaccaagaaggctaaatagaagcctccagtgattgtctcccccgcagaacgccaaaatgaacaactatctgtataaaaaagcactttcataagaaccaaaaatcaggtgagtgatcattgtacctggttttaacttcgtattaaggaaagaggcactgaagaaactaagaaagatagtcttcaatcagctacaccactccttcctcatcccccagcagcaattgcacgcaggacacagaagctgtgcacttgggggaggaaaagcacagtgacggggcactttgcattggaactcagcgatgtcctgtcacagcagaaaccaacccagggcagaatttagccagcactcactgggagaacatttagaccagccctaatcagaagcaaactgtccatcccagtggtcagaaactacattctggcaagccctgccaccatgggctaaagtgccttggggtcccaaacaaacttgaaaagcaactaagatgacaacaattgcaattcttgggcaagtcctcgtgctgggctgggctcagaacaagtggacttggggggcacataacctgagataccagctgtggccactatgggagtgcttggccatgcctccccaaacccaagtagtacagcttgcagtaataaaagtgattcctttcttctgcttgaggacaggaaggggagagtaaagaggactttgtcttgcaactgggataccagctcagccacagcagaacagggcaccagggagaatcctgagtccctcactccaggtcctggctcccagacgacatttttagacacactctgggccagaagggaacctgctgccttgaagggaagggctcagtctgatgggattcatcacctactgactaaagagcctttgggtgacgaattatcagtgctaaccaggtagtacttgccgtgggccttggttaagacccagggccacgctggcttcgagtgtgacccagcacattcccagttgtggtggccacagggagaaaccatttctgcttgagagaaggagaagtaagagtaaaggagacttgcataatgtttcatgccttgcaacatgggcaccagcttggccacagaggggcaacatcccaagcgggcttctgaggtccccagttctaggccttggctcttaggatttctggacctgccctgggccagaggggagcccactaccctgaagggagaaactcaggactggcagcattcaccacaagctgactacagagcccttgagccttgagtgaaaatcagcagtagccaggcagtcctcactgcaggcctggggcaatggtgaccacaggcagagacttctttattttaggaaaggagagggaagaatgaaaaggactttgttttgcagcttggctgccagctcaactgcagtggaatagagcaccaggtaaattcctacagttcccaactctaggcctggctcatagatggcatctcttgacccacctggagccagggagaaatcactgtcttgaaggaaagaacacaagactggctagatttgcctcctgctgattgtacagccactgggccttgaatgaacacaggcagtagccaggcagtggtcactgaaggccttcagtgagacccagtgctgtgctgtgctgtgcttcaggtctgacctcatgcagtcccaatggtggtggctacagaggtgctcatattaccgttcccccagctacaggtaatcagcacagacagagagactccatttgtttgagaaaagtaagtaaaggaaacaagagtctctgcctggtaatccagggaattttccaagattgtaccaagaccactaaggtggtacctctataagtctgtaagaaccacagtgctactgggtttggggtgcctcctacagcagattaggacttagggtggcccctaaagcagacatggcttcagtgaccaaagacttagatcatacccccaagtacctacaaatacctggaaagtcttcccaagaaggaagtatataaacaagcccagaagactacaataaatacctaaaatctttaatgccctgatatcaatgaacatccacaaccatcaaaaccagccaagaaaacatgacttcaccaaatcaactaaataatgcaccaacaccaatccaagagagacagagatatgtcacctttcagacagagaattcaaaatagctgttttgaggaaggccaacaaaattcaacataatacagaaaaggaatccagaatcttatcagataaattaaacaaagagattgaaaaaattaaaaagaatcaagcagaaattatcaatctgaaaaatgcagatgacatactgaagaatgcactggagtctcttaaaagcaggactgattaagcagaagaaagaattaatgaacatgtaggcaggctatttgaaaatacacagaggggacaaaagaaaacagaataaaaaacaatgaagcatacctacaagatctagaaaagagcctcaaaagggcaaatcaaagacttactggtcttaaagaaaaggtagcgggagacaggggtagaaagttttttcaaagggataataacagagaactttccaaacctattgagaaagatagcaatattcaagtataagaaggttatagagcaccaagcagatttaacccaaataaaactacctcaaggcatttaacaagcaatcacccagaagtcaagaataaagaaaggatcccaagagaagcaaggggaaagaaacaagtaacatacaaaggagtgccaatacatttggtagcagacttatgggtggaaactttacaggcgaagacagagtggtatgacatattgaagatgttgaaggaaaaacattttttcctagaacagtatatccaataaaaatatccttcaagcatgaagactttcccagaaaacataagctaaaggattttatcaataccacaagataaatgctacaagaaatgataaaaggagttttttttgttgttgttgtttttgtttttttaagatggagtttcgctcttcttgcccaggctggagtgcagtggcacgatcttagctcactgcgacctccacctccagggttcaagcgattctcctgcctcagccttctgagtagctgagattacaggcacccgccaccacgcctggcttatttttagtagagacagggtttcatcatgttgaccaggttggtctcaaactcctgacctcaggagatccaccagcctcggcctcccaaagtgctgggattacaggcgtgagccaccacgcctggccaggagttctttaatatgaaagaaaaggacattaatgagcaataagaaatcacctgaagtataaaactcactaataagtacaaagaaaaccatagaatattgtaacactgtaattgtggtatgtaaactacttatattttgagtagaaagactaaaaagataaatttatcaaaaataataacttttccagatatagacagtgtaataaggtataacttgaaacagcaaaacgtttaaaaagcggaagatgagattaaagtgtataatttttattagttttttctcttgctcatgtgtttgtttatccaatcagtgttccgctgtcagcagtttaaaatgagttatatcatttgcaagcctcacggtaacctcaaatcaaaaataacatacaacaaacacacaaaaataaaaagctagaaattaaaacatatgacccgagaaaataaccttcactaaaaggaagacaggaagggaagcaaggaggaaagaccacaaaatgaccagaaaacaaataacaaatggtagaagtccacacttatcaacaacaacattgaatgtaaatggattgaactgtccaataaaaataaagtggctaaactgatataaaaaagtaaaaaaaaaaaaaaaaaaaatgatctgttgcctgcaagaaacacacttcacctataaacatccacacagattgaaaataaagggatgaaaaaagatatttcatgccaatggaaaccaaaacagagcaggagtagctgtacttacatcagacaaaatagatttcaagacaaaaagtataaaaagggatttttgaagtcattatataatgattaaggggtcaattcagcaagaggatataacaattgtaaatatatatgcaccggtcactgcagcactcagatatataaatcaaatattagagctaaaggggtgagacagaccataatgcaacaacagctgaagacttcaacaccccgccttcaggattggacagatcttccaaacagaaaatcagtcaacaaagaaacatcatactcaatcagcactacagactaaatgaaccttacagatgtttacagaacatctgactcaatggctgcagaaaacacattaccctgataggcacatggatcattctcaaggatagagcatatgttaggccacaaaacaagtcttaatacattccaaaaaactgaaataatgtggacaaaggatataaattgtacagccagtatggagaacagcatggaggttgctgaaaaaactaaaaatagaacttccatatgatccagcaatctcactgttaggtatacacacagcctgggtgacacagcaagactccatctcaaaaaaaaaaaaaaaaaaaaaaaaataggccaagcgagttggctcaagcctgtaatcccagcactttgggaggccaaagcgggtggatcacctgaggtctggagttcaagataagcctggccaacatggtgaaaacccatctctactaaacatacaaaaaaaatgagctgggcaaggtggcactcatctgtaaccccagctactcgggagggaagctgagacagaagaattacttgcacctgggaggcagaggttgcagtgagccgagatcatgccactgcactccagcctgggtgaagaaaggaaatcagtatatcgaagaggtacttgcactcccatgtttactgcagcactgttcacaacagccaaaacttggaagcaacgtatgtgtccatcaacagacaaatggataaagaaaatatacacagtggagtactatccagccatcaaaaaggaatgagatactgtcatttggaaaaacgtgaatggaactggaaatcagtatcttatgtgaaataagtaaggcacagaaagacaatctttgcgcgttctcacttacttgtggcatccaaaaatcattaaaacaattgaactcatggagatagagaatagaaagacggttaccagaggctggaaagggtaagagggagggggaaatggggatagttaatgggtacaaaaacatggttagatagaataaataagatctagtatttgatggcagaatagggtgattacagtcaatggtattttgctattttttttttttttttttttgagacggagtctcgctcagtcacctgcctcccgggttcacgtcattctcctgcctcagcctcccgggtagctgggactacaggcgcccaccaccacgcccggctaattttttttttttgtatttttagtagagacagggtttcaccttgttagccaggatggtctcgatctcctgaccttatgatctgcccgccttggcctcccaaagtgctgggattacaggcatgagccactgcgcctagccaatattttacatttttaaataattaagagtataactggattatttctcatgcaaagaagggataaatgaggtgatgaatacttcagtcaccctgacctgattacacattatacacctgtatcaaagtgtgattattacacattatacacatgtatcaaaatatctcatgtaccccataaatatatgcacctatgtaccaacaaaaacaaaaatatattacatatctgggccgagcactgtggctcacgcctgtaatcctaacactttgggcggctgaggcgggaggattgcctgagctcaggactttgagaccagcctgggcaacacggcgaaaccctgtgtctactaaaaatacaaagaattacccaagtgtggtggtgtgtgcctgtagtctcagctactcagcaggctgaggcacaagaatcacttgaactcaggaggcagagactgctgtgagccactgcactacagcatgggagacaaagtgagactcttttgacaaaattcactagtagctatctggaggccaggcacagtggctcgtgactgtaatcccagcactttggaaggccgaggcaggcagatcgcttgagcccaggagttcaagaccagcctgggcaatatggcaaaaccctgtgtgtatataaaaaatacaaaactagctggtgtggtggtacatgcctgtagtcccagctactcacgaggctgaagtgggaggattgcctgaacccaggaggaggtcaaggctgcagtgagccttgaccactgcactccagcctggataacagagtgtgaccttgcatccaaaaaaacaaaaaagctatgtaggtctgggatttccttcacagaaagatttttaattattaattcaatttgattacttgttgggggtgtattcacacattttatttcttcttgagtcagttttggtaatttacgactttctatgaatttgcccattttgcttaagttgctgaatttgctggcctaatatttttcgtaatattcgcttataatcttcttacagtttctgagaggtcagtggtaatatccacctcttttcattcttagttttgacaaactgtggttcttcctttatttttggctagcctagctaatggtttgtcaactcctttagctttgattgtgaaaacaaatactgatttttctccaccatttttctgtttcctattcccttcctttgtattaccttggtttagtttttttctttttctagattttaaggtaaaaagttcagattactaatttaaatctttcctattttcaaacacaggaattaaaagatacaaatttccctctgaacacctatttagttgcatcacatttggataagctttattcttattttattcagatcaaaatgctatctgacttcctttgtaatttcttatttcacccaagggctatttagaaatatattatttacaaacattttcagattcccaaaatttccttgtgttgttgaattctaatttaacttcactttggacagagaacatgctttgtatgatttcaatcttttaaaatttatcaagacttgtttttatggtctagtatatagtctgtcctaaagaatgctgcaggtatgctccaaaagaatgtgttctgctgccgtgcagaattctgttttatagttggttaattatgatatttttaaaaatatcagtagaaaggaatgaactatgtcatggatgaacatcaaaaatattacgctgaacaaagaagccaggaataagagatcacatattgtatgattccacttatataaaatgtccagagaaggcagatttataaagacagaaagtagattagtgtttgcgtggagctaggatcagcaatggcagtcaactgtaaatggtcctgtggggtcttactggggaataaaaatgttatatggtgctggttgcatactcaataaactacctaaaaatcatggaactatatacttacagtgggtgaagtttatgatctgtaaaatacaactcaagacaaatttacatggatatttacaaattcaatatagataaatgccaattttaaaaattcattggaagtttactatgaggagtagccatggcatcaaacccttacttcaaaaatcaataatcggggccaggcgggatggctcacatctgtaatcccagcacttagggaggccgaggcaagcagatcatttgaggtcaggagttcggaaccagcctggccaacatggtgagaccccgtctctactaaaaatacaaaaattagccagtgtgttggcgtgtgcctgtaatcccagctactcgggaggctgacgcaggagaatcatttgaacccagaagacagaggctgcaatgagccaagatcatgccaccgcactccagcctgggttacagagccagactctgtctcaaaaaaaaaaaaaaatcaacaatcagatatgtcctatccttcccactgtatttttgctaaaatactaaattgcatttttggtaaccaaacaatccgagtgatgagaccttcattacactgtaattccaggcactaaatttagaaggaataaaagaatcagaaaaatggccatttgcaactcttaatgaaataagtgattcagggcaatcatcataaatagagctaaaccatgaggaaaatacaatcatgcacatggctagtcaatcctagcatcactaaaagcaggatcaccagacattatgcacctcctaatgccgtgaataagaagtataaagtatcaactattagtcttgccaaaatttcaacctgaatctaactgtgcttttagacataactttccatttacagaaaatccaagggctagaggaagaagttcaatgaaagcaaaagaatcagataaatccagaatataagacattatacaggacaagtgtccaagtatctccaaaaacaaaataaataatagaggagactgttttaaatgcagactgaagagacataacagtgaaatgccatgtatgaaccttgtttggaccaaatttcaaataagccaacactgtcatcttgtttgagactactgaggaaatctgactatggaattactgataatttcgttcagttgataatggtactatggctattcaagaaaactgctttaagagacatatacagaaggatttaagaggtgaaacgacatggtgtcacagatttgctttaaattacaatagcagtagcaaaaaagaaaaatgataaaaggccaagatgaagcttggaaaatgctgaactttgttcaatctggggccttatttatactcttcctctagctttgtgtatgtttgaaaattataataataaaagttttgttttaaagacaaaaaactaaaataaagtttagtagcaagaatataattgccactcagctttttttttggaacagagaggataatttcccacaaaactgaaatgcgtatggttcctgagatcccaggccagaatgacttaccttctggcaatcctcctgaaactggattgaaataattcttccatgacatgctgctgttcccgacaaagaacttctgtcatcaattccaacaacatagggctttgagataattccaatgcatctagaaactagaaaaaatacatcaacatcattaaaattttgttgggttttacttttgcttcaatagttaaattatatactaaaaatataaaaagtttcttatataataaaaaatataacatacagaaaaatacaccagaatttcacagacttaacaaataccagtatttctgtcatttttacaaatattgttgagtggctggtatatatcaatgttcactatatactgagcctagattctttctaggtttttttttaggttttttttttttttttttggagacacagtcttgctctgttgcccaggctggagtgcagtgacacgatctcggctcactgcaaactccgcctcccaggtttcacgccattatcctgcctcagccttccgagtagctgggactacaggcgcccgccaccacgcctggctaattgtttgtatttttagtagagacggggtttcaccgtgttagccaggatggtctcgatctcctgacctggtgatctgccctcctcggccacccaaagtgctgggattacaggcgtgagccactgtacctagcccctattctttttaggttttgcagatgctactcttctctgcatctcaggttctgagagtacatggagacgtgccttcaacaggcccccctccttcaccatgccagggactctcgcccttactctgattctggtaatgtgcatcttttccacaccgtcctcgctacagaggggatatcccaggccgctcccccgatgttctcatcttgactctccccttctccatctcagtttctgttctgctttctaggagatacccttaattttatcttcagaatagaacaagtatgttttatttaaattttgcttctgcatatttaatttccaaggatccttatcctatctcatggacataataccttctttcatctctgaaactgttgtgtgcagtttccactgcacttcagcctagacgacagagcaagactctgtctcaaaacaaaagaaaacaaaacaaaacaaaaaacaccaatgtatttcatgtctatgtccagacttgagtcctatccccgggatatctcatgtatacacaaacattccaaaatccgaaacacttctggttccaagcatttcagataagggatgctcaacctatcatattagggataatcacgaaatgcttctcaaataatcgctactctattaaattttagaaactggaaattattggtaatattctatttcttagcttcttttggtattactcttcataacttacatatattttacacattccattttacacataaaatatttcacaattaaaaatgggagaaaaaaacaaattccagtggattcacatatactcctgtcactgctttccaagtgaattaaatgaattctcaggccacacacacataaataaatgggacatggtgctgattcagtatgtgcttcctcttctacaaataatgaccctagtaaaaatgtactgtacaagctttgtgtagaaagaacattttgaataacctattgggtggtttacaacttctctgattgtggatattttactcacctcttttcatcaagatatgtaacaagaaaaaaaaaacagtgttttaattttacttgatactactagaaactaacctttttcatgcagtccacataattattgaaccgcggagttcctggaggaaattccctggactgcatggggaagtgagcaacgatgagctgctccagaacacgtctaagttcctccagactgcctccagtgaggctggtgaagaatggaagaagagtgacagcttggccctgtggagcaagacagacataagaaactgcacgaattatggcttatatatcctacagaataaataaaattactgtaagacattgcaaataaagcattatgtggaatcaatgaatggcttcaccataatttctaaattatattaaaaaccaacatgaatacaattctatacctcagcttttttttttttttttttttttttgagacagagtctcactctgtcacccaggctggagagcagtggcatgatcttagtaggctcactgcaacctccgcctcccgggttcaagtgattctccctgcctcagcctccagagtagctgggattacaggcgcctgccactatgcctggctaattcttttcatatttttcatagagacggggttttgccatgttggccaggctggtctcaaactcctgccctcaggagattcacctgccttggcctcccaaaatgttgcgattacaggcgtgagccaccgcacccagcctatacctcagctttgactcttacccaggctagttggttgacgccagctatggacacataaataaatgggacatggtgctgattcggtatgtgcttcctcttctacaaataatgaacctagtaaaaatgtactgtacaagctttgtgtagaaagaacattttgaataacctaaggaggagtttacaactacacattgcagaactacagaagaacttcatactgagcttaacaagaactaggagttgactcctgttctccctcgcatggcagaaaattccaagactgtctatggagaaatgggaaacttgattaatcacacagcagaaaattccaaagaattatcccctttatccagtaaaaaggtcccttgaattaaggccacttttcagtagggtttaaaatctaattgttctaggactttaaaattagtaacccttaaaatgacagtatttattaattcttgaccctaaaaatcaccaaaaatttttatattattttaatagaaaaatgactgagtaataaagtcattatagcacaaaaagccaatttaaataatatgtatgcaaacacaaatgttaattcatccaaatatgataatcttatactttaaaagaaatgttctaggccgggtgtggtggctcacacctgtaaccccagcactttgggaggccgaggcaggcagatcacttgaagtcaggagtttgagaccagcctggccactatggtgaaatatactaaaaataaaaacattagccaggcctggtggcgcacacctgtgatcccagctacttgggaggctgaggcacaagaatcacttgaacccaagaggcggaggttgcagtgagccatgattgtgccactgtacttcagcctgggtgacagagcgagactgtctaaaaaaaaaaaaaaaaaagaaagcaagaaagcaagaaagcaagaaagcaagcaagcaagcaagaaagaaagaaatgttctcatgtcttggagaggcacactgaactgaagcagatacaggtcagataacacacccggcctgcttggccttccttgcctgctgacgggtgggttgaccgcacaggtgaaacaaacacacccacacaggatggttatcgagactggctaataagtacgggggattactgtgctagtctccctacatttgaacacgtttgaaattttccataataaaaaataaaaaacatcacaaataaaaaatacgaaaacagaagagaatgtaatccaaaaaaataaatatttcactgtttacctttaaatgtagatccagctttgtgtcagcaagtagactaatatatgttgtaaagacttcagggaatgaaccatgacttgtattaaaagatacagatgaatcaatctaaaggaaggaaaagaaaaacaggacacatttgtatattacatctctatttcctttagcccattgctcaaatgtttaaattccagaaatgaattgttaatttaattttgggcttcaataatattttcacaatcttattgtaaaacattgtaatactatctgttaggacaatacatgcaaaggtactttaaaaagatatagcataagaaatagtaagtctaataaataatggaaaaagtttaaaaaggtaaatataagcaaccatcctgtcaaaatattttcttatttgtcaaaccaatgagcttttggagcaacctccatcaaattttaaagacacaagttacagagttcagaagaataaacatgactgctttttaaaggaattgaatacctgtaaaatttttgccagtaaggccagcactgccattttagtttcgagaggggaatctttggcccaccatgaatcacacttcttccagtgttgcagaattgtagtcgcaagtttcagtccttggtgtttctggtttgctcgctccctgaagctctggtctaacatgccgttcaaaacggcactcacctgagacaatttcgttgtgagtgaagaaaaattcttaattttgagaatgacagaaaacaaaatttacctttatttcaaagctattcttggaaaataaataagctatttctataatagatgtttatctacttcaaaactcctcgagtttgatttgaggtacactttaaccatagtttttccacaaagtacagggtggccttagctatgtcatcaggctcatccagcttctcctggctttcctagtctgcgcagtctaggaaaaaggagtcagctctcttctgtcaccaccaccaccactgtacatgcatgcacaagcacacacaggtgtacacgcacaagcacacaaatatgcacatatgcacaaatgcacacttcctatcccaccaccactgtacatgcatgcacaagcacacagatgtacacacataagcaaacatgcacccaagcacatacttccggtcccaccaccaccatacaggcacacactagcacacacaggtgtacacacacaagcaaacatgcacacacgcaaacgcacacttcttgttcaactaccatcatacatgcacacccacattttctgtctcaccaccactcctgcaacagagtgacaggctaattttggtcagattaacatgcactattcctgtcattctgactatgcaaacatttttcacagatgttccaagtagaaacaatgcttttccctttttgcacattttgtactctctgaagctaaccttgtttgctttcattgctcttttcaatgtgtctgtcattaattcgtcatcaaactctcccaagttatgaaattgctgcaagccctctaagcctatcaggtctatctgccccatttctgtggcaactcagctcttgatctgcaatgctggtgctggacctggtgctgggccatccacgcctctgtgcggggccgacatactgtatccagcaccttcccctgtcttggctcactgcctgatcactctctacccagcagcatcgtgatgagagtgcacagggacctcttggggatctggcatgtctaaaacatctgtattccactctcacataatggataatccagctggattcagaactctaggctgaagatttctcttatgaactatggaagaaatctggttcaagtcttgcaatgtccacactgccgctgagaagacatatgtcattcaatttctagatcctttcacacataactgctttttctccagtggaaacctgagaatcttttattgtagtgaaaccccacggttctgaattctcaagaaatgtgctccacgtggagctgtttctgtgcaccatgctggacactccatggccctcttctacctggaaactcaaagcctttgcttctgggctcctctggagctgtgtcctcagcaaatgccactcctgacccctgccctccggagccaaggccctgctgctcaacctcatgcatgaatccctagtctcctcctcttttctctcgtgttttctgttttgtctttcactctactctctgtgagagttactcaagtttaccttccaaactcatttcatttttaatttctgatgcctatgcttaattcccaagagccttttttgttctctgatgttcattctccatagcaattcttatttcacagttttgtctctcatctttcagttttttttctccagcttacatttccatctcactgaacaggccttgccacagttgcctgtgtcccgctacgccctctggcgtccctttcctcaggtgcctgagcccctgggctgccggctcacaggtatcacctgcctggaagcgctgtgcagcgtgcagggctcgctggtggggaggatcactgtcactgacccagctggctatgatgcctgcatctttattttctcttagggcttgtcaggatattctggtgccctgccaagggcagatgctgaactgaaagtattcagagggaaagggcagacagcctgaaagtctagaatttaggtaggttagtacttaactttcctcttttcctgatggtatccacatattcagccatgccagagcccccagtctggaggtctctatcctctccagggagtcactgcctcctgccttctcctcaagtggggaggatcagacccccagcagcagagacaggaggctgccctgcaggggagagctggcctttgcccaatcctctcttctcagcctctgctcacccctgctcgcatgtctgccctgctggggctcagcacgtgtggaccccaacttccgaaggctgcatcacctcgctgctatctcaaactctgcatgcagtctgccacacctgtccttttgatttacaactcttgtcactcttggaagtccttttctctgtgtcctttgagattgtagaggtgttttaaaaatctcattctgttactttagaggaatttagggaaggaatagaggtcaaaggcgtatgttttttctatcatttccatcagaggtcatagtttaagaaatcagaatgttaaatctgagtgtcatctactacgattttatttctaattttaaagaatacaaattcctactgcaatctaccacaaaagattcccctacaacagaaaagcactgtttgcaataaaagctcaacttaggacatcatgtactctcccttaaaatggtcatatcaacagttaacagtttctgtccacagaacaagttaaatttcaaaatcccagaggtttagcaaacgaaagtcaactatatattaaatactgatctccagggagaaagggggacacagcaggaacatgccagaaatgataactcagcatcgaggccacaagagaactctgagaacagagaggtctaccggggtgcagagacctgcctgcagctggtatgaatgcaaagccagctctgggccccaggacgggtttgtaagctccaaagccacatcttggcaaatgtcaataccctgcatagctgtgccttataatatttaggcttagaaatttgcaaagcataagggaatagaaaaaacaatcaatgttttaacatccaataacactcattagctatttcttacttttttaagacagagtctcgcttcattactcaggctggagtgcagtgggcatgatctcagctcactgcaacctccgcctctcaggttcaagaaattctcctgcctcagcctcctgagtagctgggattacaggcacacaccaccatgcctggctaattttttgtatttttagtagaaacaaggttttgccatgttcgccaggctgggcttgaattcctgacctctgatgatccgctcacctccacctcccaaagtgctgggattacaggcatgagccaccatgcctggcctaatattcattaactattgataaggggtatgttttgggtttttctgagtttgttaaaagcaagagctttcaaccttataggaaaaagtcttgtcatactttaatgaaatatttcaggaatatggcaacccttttataaggattatataagaaaatattgaccgggtgcagtggctcacgcctgtaatcccagcacttcgggaggccaaactgggcggatcacgaggtcaggagttcaagaccagcctggccaacatagtgaaactccgtctctactaaaaatacaaaaaattagctaggtgtggtggcgggtgcctgtaatcccagctactcgggaggctgaggcaggagaatcgcttcaatctgggatgcagaggttgcagtcagcagagatcgtgccactgcactccagcctgggcgaaagtgcaagactctgtctcaaacaaacaaacaaacaaaaaaaacagtttatttaaagggaaactttgttaccattttggtattatccactgaagactgcatgagctccaatacagcaagatccagatttttcaataattccgtgttgatcgtttctgagaacaagctatagaaatactccccatgggagaagtggatgacgctgccctgtgagctgcccaaggacgccgtggacagcaccgctgggttcaggagaagactcacaaggcgctcacactgggaaaaagaaaggagaagtaccataactggggcacatctttgcatggcacagaaagacccttgggcaactgataactttgaaattggaaaatgacacaggtctaaaaagagcctgatatgtgaagcctggattcaagctgaaattgtatatatttcaactagcctccattttctaggtttcattttgggaaagaaatcttccttgacccatatttcttccaaatgtccaaaagtcttgttgttgtgttttattttttgagacagggtctcgctctgttgcccaggctggagtacagtggcacgatctcggctcactgcaaacctccacctcctaggttcaagcaattctccggcctcagcacccccgagtatctggaattacaagtgcgttctaccacacctggctaatttttgtatttttagtagagacagcatttcaccatgtagttcaggctggtctcgaactcctgacctcaagcaattcacccgccttggcctctcaaagtgctaggattacaggcaataagtcaccctgcccagccttgttgttttttaaagacagggtgtcactctgttgcccaggctggagtgcagtggcatgatcatgactcactacagccttgacttcctgggctcaagcgatcttcccacctcagcctcttgtgtagctgggactacaagcatgtgccaccatacctggctaattttttaaatttttttgtagaaacagggtctcgctatgttgtccaggatggtctcaaactcctgggctcaagccatctgcctaccccagtgttgttgctttgaggatagtctattaagggtgagtatttttagacaatttaaatatgtaattgtttacattaatcggacaaaggggtgaaaaaggggtttctgctacagaagaaagaaagttgggatggagtgaacacagagggctggctgcagatttcagctacagcagggactatttaaggccagccctgcatggttcaaagagccatgagaatatttttttggagactctggttcctctgggattatccttcagaggccctcccaatcatccatgtgaaggaccaccaaggagaggagaagaggccacatgtcaacatgactcagcttcatagtcacaaaacgttctctagctaattccttttggaaacaaagtgggatagacaaaacctctatttaaaaagaatgttgttctattccgttctttttttttttaactattgagaaaataatcttttagaaagttggctcatgcaaatcatacaatacttgtccagctaaaaccttactacccaaattccacagtttctagagacacctgcaagtgacatatgtatttctattattaggggagtgcagcatgcagaggcgtttttcctaccagtcctccaaaagcaaaggctaactccagaagtccgctggccagctgcttacaactgaggtctagagaaggcagacactgtctctcatctccaggggcaatgcctttataaaccagggaaagaagttctgtgccaacagaatgatgcaaatctgtggactaaaaggaagccaacactgaaatgcctagcaaaaagatatttcttagaaaaaaacaacttcactcctctcattaaataaaaaacccacttcagatagcactgacaactaccttccaatattcagaaaaattttaattcaactttgcttttgttgttcttgctattgtgagacagggtcttgctctgtcgcccaggctggagtgcagtgacacaatcgtggctcactgcattctcaggcttccaagctcaagcaatcctcccacctcagcctcctgagtagctgggactacgggtccgcggcacccactcctggacaatgtttttttttgttgttgttgttttttaattgtttgtagagatgaattcctgccatgttgcctgggtcggtctcaaacttctggcctcaagcaatcctcctatctgagcctcccaaagtgctgggattacaagtatgagccactgtatctggctcaaccttgctttctatgctagattcttcatttgtgttgtcttgccacaaaggcacaacagcagttcctaaagtttttcagaaagctgctctgtaaatacctaaatgtcctttattttactttcattttatatttataaatttttacatttgctttcatatttatattgatatatcatagatatacagatacataatatctacatgtcttgagcaagtatttctataattcccatttcagcatgctcaatacataaaggacttttaagaaataatataaataaatacactaattatcatactaaagctaaaataaatgtaaaaacaataagttatagttacctgagacggtaatatattatgcagaagcccagctctgtgaagctgtttacaggcagacacaacagcagccagcctgctcctgtccacttgcgcgtcagggccatacaagttgacggcacaaagctcctcaatgctggccatgtgacaaaacagtaaattaggtgagctctgatctcgttaaattatcaagatacactgaaaaaaatgtttgcactgttatgaagcaaacagaggcaacatctaacaggatccacacgcactaagctagcatggagatcaaacatggcgctaaccatgtctgaagtttgcttaagtttggtacagggaaggcactagttaaatgtgttttctaaacaactattgaggtcactggcagcaaacatcccactgatataagccttccctgaggaagcaggagcagctgcaggagcacggcaacatactagggcctgaaattccaggacaacatgtccccgattgtgacccaagtacccacctctgtgctgttattttctctctcagatgggtctctaggatatctttgtatggggacatctttagagctttcatcagattcacacaaacatcaggaagatgagccataacctggacgtctccgatgttgaaacctatgcttgcgggctcacacagcgtctgcaccaggactctcatcaggtgtgtattacacaagtccttcttcaggagctgtaacagattgtttgataaaaacacttcgtcagccagcacttctattttcaccaaagtgcagggcccacaaggttgggaacttctgcctgactaagggagaggtgggcagagtttctctgtaaaacgggggcacagtaaacacttgaggtttgtgggctagacagtctctgcttcaactccttacgcgtctgataagaaagcagcacagacaacaggtggacagaggcgcacagccatgctcctatttagctttatctacggagcaggcagcaggtgaggttgtgtccatggacagggtttccccgcccctgactcaggacactgctgcatcccagggcctggcgtgccacaggcacctggcagagattccctgaatgaactgactggagtttgtttatacaataagcctcatggatacatctataaatatttgcgagtgtgtgtttcctaaggtagatgtttgatcatagcataaaatacagcatccaataaaacaattagaaaaaactattttatattttattcacacagtgaaactctgaaggacatgcaaagtttcatgattttcaatagatcattcatcatgatgactgtagttaataacgatgcattgtaattttgcaaattgctaagaaaatagattgaaaagttcccatcagaaaaaatgttacatatatgaggtaacagatacgttaattagcttgatttagccataccacaaggcagagcatatcaaaacatcatgctgtataccataaatacagtttttgtcaactaaaacaaattgacaaattgattttgacatataacttctgacaatgcaaagttttagaaaagccaaaacctagccttctcttcctggttcttcctgaagtcaggaaaagctgggttgagaggatgaaatataataataataataataataataataatgataaatttttattaaaagccaaaaccccttctaacagaaacctttgaagtagttttccagtaccaaaaactgacctcaaattaacagagcagcctaccttccatccttccggggaggtgtttagcagagtcgtggtaaactccataatccggaccacaacggtgcatttgctgtagttgtacctttctccctcttgtgggcttgttctgttacctgctgccccagtgccaaagcacttttctgctgctataatgtcatgcatggcaatgctttctaagaagaaagccactgctttcaaaagtgaagactgggcttcagtacctagaagcaattatattaaagtattaatatatgcttcctttcaactccactaagattaacataaaattgcttctgtaagtataggcatggtatacgttcagcaaaaattcaaaatttttcaaaagaaacaaacagcttaataatagctgaataaagtggcatttattttttctcatatcaaaggacacattgatggaaagtcaggtctttattcccaaacattacatgtgagaagataaattaatatgctcattttaaagggcaatttggcaattcgtaccaagtttttaaaaatatgcatgccaatttctatcaaatgtttaaaaactcattatgctttgatccagcactgaaattttaacctaatgaaatgactgcagaattgaagagatgtggttgtaagaatcttctttttagcactgttatcaataatgaatgttattaataatgaaaaaataaaaaatcctgtccttcaaaggacagagacaaattatggagcagtcttcaagcaggtgtggacaggcaccagtcatcttatggaatcaactttcagatcaatcctcaaacgggctttgtcataaaactcgtttgtctgaaaacaccctggagcttgttctcctttcccatctcaggttgttcatcaggactctcctgcttaatgaaagacagacccaccctcacctctctccagtctaactgtagtttattactccaaggtgcacagccctttagagtgccaagggacaatttaaaatacttgtacactgttgaaagagtaaaggcaacaattgagtaggaaagcctttttgtaagtctcatggtttctaattctttgtttccaacataatttaaggaaagtcaatccaaactgtcaactgacctcgttaaaaataattttgataacatgtattttgatgtattccaagaactgagataacttatattaagaattattctcagccgggcgcggtggctcacacctgtaatcccagcactttgggaggccgaggcaggcggatcacgaggtcaggagatcgagaccatcctggctaacacagtgaaaccccgtctctactaaaaatacaaaaaattagctgggcgtggtggcgggcacctgtagtcccagctactagggaggctgaggcaggagaatggcatgatcccgggaggatgagcttgcagtgagccaagatcgcgccactgcactccagcctgggcgacggagactccatttcaaaaaagaaaaaaactaattattctcaaaaaccaaatatccttgaatccaatagaatattggattgtaagacacactgcaaccatggatctgttaaatatgggaaaatgtacattttagaataaaccaaatatggcacttatttatgtgaacaagttttttttgttttggttttattttctgagacggtgtcacccaggctggagtgctctggtgcgatctcagctcactgcaacctccgcctccggggttcaaacaattcttgtgcctcagcctcccgagtagctgggattaacagggacctgccaccatgcctgactaatttttgtatttttggtagatacgggatttcgccatgttggccagactggtttcgaactcctcacctcaggtgatgtgcccatctcggcctcccaaattgctgggattacaggtgtgagccaccgcgtccggccatgaacaagtttttttaatactaaaatctatacgtacaaaaataaaattccaaccgcataattttacattttatgtgtaataattaccaaaatttttattatatttgttgttgtggcagtaaaaaatgtaatgtgcactaataacaaatataatagtaacacagaagaaaattttttttgagacacggtctcactctatcgcccaggctagagtacagtggcacaatcacggctcactgtagcctcaaccttccaggctcaagcgatcctcccacctcagactccccagtagctgggatcacagatgtgcatcaccacgcctgactaactttagtattttttgtacagatagtgtctcgccgtgttgcccaggctggtctcaacctcctgggctcaagtggtcctcctgcctcggcttcccaaagtgctgggattacaggagagagcctctgcacccagccaaggaatctttaaatatgtacatcttttcattaaaaagacgtagatagggatatagtaaaatcttaagcaaaaaaaacttaatactttaggataaaatcatttgaagggtaggaaatgagaatatgaattaagggactctgcaaaatttccaataaagcagctatattttaaagccaatgatgctgtacataaaactgctacagtattcattgttcatggaatacgttttttttaagtaatattaacagttttgtgtatttaaaatgtcaacatttacaatacaccagaaagtgtaactttttcaattatataaagctatgagaacactgtatttgtcaactttgaagtgtgaagaatggaacccttgcagagaagtgacatgaaagcacgggcaaggtggtgcacagcacctaccatcatgtcgctgggattctgacctggcagagccactgcccagggtgactctggcagcacgacacacaccagaataaggcaagggtgacctacctaggacctggagcgctcctacagttctctcgccaatgaacgtgttgtagcactccaacgcggccaggagcaggtccagccagcatagcgtggcctgcaggctgaatggcccccgaaggtacaagagggtgggctgggccaggatgcccgagggctggccacagccacccccctcaaaggtgttgatgagaaaagagacaccttcttccttgagaacatctttcagccacaaattaggggatctgttgcctttaaaaagaaacaaaattaaaatgcacacatatacctacatttctttaatctaatctttgtacctaaaatttcaaaatgttatgggacaatcttttttcattttactacgcattcaacttgtttcactgtaattacttccaagaaggtatttccaccacagccattctcttcaggttcctcaaacattataaaaatagttggacaccatttggagtagctgcatactaatactctttcccctgcctttttatttaaaaattattattcctttaagtcacaaaacagcatttgcaaatgagaacaataatatctacctctggggctgttacaaaaattagctgaattaaagtagttaatatttgaacatgtgcttagaataacgtctaccacacagtaagtgcagtgtttgttaaataagagaatcgaatgagccgttttttccaggaaattttcttttaaatattaaacttcttctaaattaaaaagataaatacataaaactgcattttgtatgctctgaaatcagtagcactgaaaatgtcaaatcattctgactctaatgaagaattcaaaacatgtatctctgatgtattaaaaacagaacattcagccgggggtggtggctcaggtctgtaatcccagcactttggggggctgagatgggcggatcacttgaggtcaagagttcatgaccagcctggccaacatggtgaaaccccatctctactaaaaatacaaaaatcagccaggcgtggtggtgcgcgcctgtggtctcagctactcaggaggctgaggcaggagaatcgcttaaacgagggggaggttgcagtgagccaagatcacgccactgcattacatcctcagctacagagtgagactcggtataaaaaaaagaaagaaagagagaacattttgtatattaagaggaggaatattctgtaatgttctgttactttcactaagagacaaagaaatgtataataatgagcaaaaaataaatagtaagatatttaaattctacatcaagagtgacagaagaaaaatgatagaaagaaaggacacaaaaaggcagatcgagagagagcagacaagggtacatcacaagaagacagagaagctgaagacgcagacaagcacgcttggggttggggagcctgcccagccctacttcttccttggtctccaccgaggacctgctgtctgtttctgggcctggaccacgctgagtctcagtattcagaagccgccaggagctgtctctcttggacacatgtcagagggacaaccctgcacctgtcgtcaagccctactgatctgggtgttcctgtacccaggactgctgctacacagtgagctaaagagacacctgacacagacgcttaaaaaccactgaaggaagctagatgcaatggcttgtacctgtaattccagcactttgggaagccaaggcaggaggactgcttggggtcaggactcaagactagcctgggcaacatattaataccaagaccctatctctacaaaaaaacttaaaaatgagccaggcctggtagcacatgcctgtgttcccagctactcatgaggctggggcaggaggatcacttaagctcagtttatggctgcagtgaactataatcatgtcactgcaacctacctagcctgggcaacagagtgagaccctgtctcttaaaaacaaacaggtgctgcacacctgcagtcccagctactaaggaggttgaggcaagaggatcacatgagcctaggagttcgtgtccagcccggacaacatagtgagactttgtctctaaaactgaaaaggaaaaaaataaaagaaaacaaaaatagccactggaggataaagataccaaaggagaaaggtggctacaccctgcaaggccacagaagagataaatcaaggaaggctccttaatgttatacaaattacctgttggaagaagggcaaggctcacctactacctagcagcctttgtccaacaaaacacaatgctgagaggtggaactctatttagttcagaatacatgaggtccgtatcacaggcaactgagaagagaacagcactagaaatgcctgagatcagtacagctgaggtcacaagaaatcctatgtgctaccagagtcacagactcaatgtgagatagtggtctgcccataagcagctctaccaacatgctatcagggtctcggtttctactaaatataggaaaaatgctgcccactgccctccagcccttccccagccactggtccactcttcaatgactaatttcacaaggttgctgtgagaatgacttaacatataaaaaaaaaagttgttagctaaacacattaagcaaactgaaaatgctaggccaggcgtggtagctcacacctgcaatcccagcactttgggaggcagaggctggcagattacgaggtcaggagtttgagaccagactggccaacatggtgaaaccccgtctctactaaaaacacaaaaattagccgggcgtggtagcacacgcctgtaatcccagctactctggaggatgaggcaggagaattgcttgaacccagggcgcagaggctgcagtgagccaagatcgtgccattgcactctagcccaggcgacagagcaagactctgtctcgggggaaaaaaaatttttttaaatgctaatgttttttaaacaattatctaaattaaaacacagatatacatttctattatacatgtaaaatgatatagtaaatttatacttcattatttatatagcatatataaaataatctaattcagttatagtatgtatttatacatactctatagtatataatatgtagtatataacattataatatatcctatagtatgacaaaatgtaaagtcctttttagttttagaagcctggaaatatataaagtaacttttttcctcttgttccatgaagaaaaagcccagacagaactccaccccaggccaggtgcagtggctgacgcctgtaatcccagcactttgggaggccaaggcgggtggatcacgaggtcagcagatagagaccatcctggctaacacggtgaaaccccgtctctactaaaaatacaaaaaattagccggacgcggtggcgggtgcctgtagtcccagctacttgggaggatgaggcaagagaacggcgtgaacccaggaggtggagcttgcagtgagctgagatagcgccactgcagtccagcctgggcaaaagagcgagactccgtctcaaaaaaaaaaaaaaaaaaactccaccccaacttttgccaaggaaccagcacacccatctaacctgaggcactctccacacatggcacagggctgtgacagcccacaatgggggaaggcagggcttgatctgtcctgagcacagcttccccactcccaagctatcaaacctaggtttggacttaatggacaaaactgagcaatacatttattcctgagaaacttgtcattatttcagtccataagcagtttaatggtttagtaattactgaaaagcacaggttcactgctttcctttaatatgatttgagatcattcagacttaggatgctggcaatttcttattaatcacatgctgaaacagaactgcattacctcatcaactgttaatattctgaatcttaactgaataccatgttaactgcaatgatacccaattactcaattcttctttacttcttttaaatgggataataaagcaccgtggtgaaattaaagatatacagattaccatacctggcaataaaggaacgaatttataaaagagttcaatggatttgtgtcgacattctgtctggggcctcccacaatgagctaaaagccacttgaccagatccaataaacacaatgatgcggaaggtggaaatcctctgcacagagacagcatactgtcattagtccctctccaacatgcaacattcagctaccaaggctctagaaatcataaactcatctttatcacacagatatatgtagaaatctcactaaaaggcattcgacttatttttaatgtattataattagatgcaatcaaaataacataggtgaaatgggtcctaaatgctgctcatgttcattttttcatgtggggaaaaattaaaaagttctccttaaaagaacagcactaagtattttcatgtttcctttgcaatataccttgtaaagcagtgcttctcaaagtgtggtccctggacagctgttccaacattacctgtgcacttgttataaatccaaattatctggccctaccccaggggtacacagaaattgagggtggggccagcccagcaatctgtgttttaactagatctccaggcaattctaatgtatgctaaagttagaaccaatgaactaaactgatatcgtaagttaatagtagaatctggaagaatcaacttttaaaacaactgagaaaatattaataatccagtccacatgggactgtgcttctccagagtggcggtcactagcatggataacagatgtccccagataccctgcagagatctggaggggcttatggagggcactcaccctactggagaaggcaacaccactaggatggaataagggcaaaaactggaaaccactggccaacatcccagccttggttggctctaagcagtttcatttcctaattttataattccatgtctgtcaaaatgttactatttgaacattcagttcatacacttcaaaatttacggaataatggttcatgcatattctagtcaaatcatccacatcaaaacatgttcaaaattagtgcatattaaataaaacgtctgttacaaaactaattttcaatttgtatgtactatctcaacccagatcaaataccttataccttatcccttaaaccaagtattttcaaacacaaagctttttaacgtttttggaaaacgaactcttcagacttccacacattccttgtttaggaagtaattccttatacttccacagatccatcccaggttgtccttcattagctgtgaattagttttatgttgtgggaaaagacggaaaaggaagcaagatcacctaccgcggcaaacgtcgtttctttgctttatttaaagaaacatgcttcttttcaatgatgcggcataggtgatcaatggcatcacaacactgttgaattgtacctgttctcaagtacagagacatatttccaaagaaggcatatatagctgattattattaaatttgtattataaatgtgttggcctaatttttaactgaaaaggtaattttactatagatttaatatgttttcatccctaagaataataaaattagataaatgattcacactgcatattcaaaaatgaacacaaaacccctatttaagactgcaggatagcatggtgcgtgcacgcacaaacacatgcacacactcagagcaatgccatacctaactagaaactgtaccaccaacaccacggccacccaaagcacagcctctcctaatggacctgagatggaagagactttgcaggtattacaaaacccacataccaggccagagcctgtggacttcaatgtggctattttaaaggggtgtaaatcccttgacctcccttcctatgcaggataaactacggtatcgtttggtaatacagcctctggagaagtacaacagaggtaagatggtgaagtcactcacagaagtctggaattatttaggaaaggagccttatacatcttattttgacctgtgtcaccaagaaaaagttttctatgttttttaaatatgtccgtgatcacaaaaaaagtttcactcgttgaaaaaattcacccatatgggaaatcaagataaacaaagcaaatttaagcaatttgacaatgaggactaaattttacacatttttgcccacagtagactatcaacatgaaggataacagagctcagtctgtctttttaaaaaataaacaaagttgccaggcgcagtggctcatgcctgtaatcccagcattttgggaggctgaggcaggtggatcacgtaaggtcaggagttatagaccagccaggctaacatggagaaacatctctactaaaaatacaaaaattagccaggcgtggtggcaggtccctgtagtctcagctactcgggaggctgaggcaggagaatcgcttgaacccaggaggcggaggttgcagtgagctgagatcgcaccactgcactccagcctgggtgacaagagcaaaaccccatcacaaaaaataaacaaataaaataaaataagtcaagacccgtatcagtgataaactcctgccacagctgtgtggccgtctcagtcaatgacacgcctgagcctctgtgccccaactacatcatgtgctgggaccaacggggagttaagaagtcttctagctcaacaactctatgtagttcctaatagcttcttgcatagaatttaattgtaatcatttattactctcttagctattttagcctacttctgacttaatatctttataatattccttcatcatggatgaaacaactctatcacagtcctgtaatgagatccactttctactttctaaatgatcacgagtgagtgcagaggcactgaccacatctcagtggttaccacatccagtttcttcagcaccatatctgcacagtttcatgttctgtcatcacagcatcatagtgtctgactggcttcgttgtctcccctgccctgggcagaatctgcaaccaaccagggtcaacctcaatggccaccaggagtacatggtgagtcaaagaaaataagggcatgaaaaaattattaacaagctgggtttgaggcactgaaggggattctcttcacatttattaatttatagaactcttgggaaaaaaaaaaccttataagagaatcacacgagccttaactcctcattggggaaactcttcagacctgtaacgcacacagaacactgaagcaaaacgtacctaaggacttctcatctgcatgtgctaaggccagactctccatgtatatcaccaaggcttcaaacacaaactgttccaccagagactcttcttccctgtaaaataaagaataggaaacctcacctaagaaaacaataaagcagaaaggacaaagaaaagaaggaatggaattaaagaaggcacacattaattaaatttgttttttgtggccgggtgcggtggctcacgcctgtaatcccagcactttgggaggccgaggcaggtggatcacgaggtcaggagatcgagaccacagtgaaaccccgtctctactaaaaatacaaaaaattagctgggcgcggtggcaggcgcctgtagccccagctactcgggaggctgaggcaggagaatggcatgaacccgggaggtggagcttgcagtgagccgagatcctgccactgcactccagcctgggcaacagagcaagactccagctcaaaaaaaaaaaaaattgtttttttgttgttgtttttttaaaggctcagctgggtgtggtggtgcatgcctataaagatcacttgagccctggagttcgagaccagcctgggcaacaaagtgacaccctgtctctacaaaaaattaaaaaaaaaaaattagttgggtgcagtggtgcacacctgtggtcccagctacctgggaggctgaggcaggaggaccacttgagctcaggaggttgaggttgagtcatgatccccccactgcactccagcctgagcaacagagcaagaccctgtctcagacgaaaaaaagggcggggtgggggggctctgtcttaaaacatgaaacaggtgcagtggctcacacctgtaatcctagaactttgggaggctgaggcagggatcacctgaggtcaggagttcaagaccagcttgactaacatggtgaaacccagtctctactaaaaacacaaaaattagccatgcgtagtggcgggcgcctgtaatcccacctacttggaagactgaggcaggcaaatcgcttgaacctgggaagcagaggttgcagtgagccgagatcgcaccactgcactccagcctgggtgacagagcaagactctgtctccaaaaacaaaaacaaaaaaaaatagaaaagaaaaaccatgaaacaacctaaaacacttctcaaagatacttcctcaagagcagactagaggaaagctacatgagccaaagaggcagcacacgctctgtttccacacaagtgcctctgtcccttgcatctgcagaactgctcatttgcctatgtggctaattattatctatgtgtccttctgaaatgtaaccctcacgaagggctgtatcgttatacctccaacatagacacaggtctggcacatcattttttttttcttcatcttttaagttcaggggtacatgtgcaggatgtgaggttacacaggtaaatgtggtacacaatattcctaataaggaatgctggatgaatgaatgaacaccactaccttaggtcagtgaccacttgtcttttaccttggacctctgaaatggcctgttcactggtgttccagtcttcagtctactcagacccactctctacacagctaccagcaagtggattttaggaggaaatctaaatgcatctctccctgcacccactactccacagatcctctgtcactagcggtgacctacgctccttactacagcaagcagagccctcctcgccagcctcacgacacctgcctccaaacctcaaaggactttatcgcctcagacaccttcctatttcttatctctacccccccaccacccactaactttgatctaaaatgccttggctgacttccatttatccttcaagtctcatctccaatataaaccctagcaagaggccacagcaaacttgctcaccctggatcagctactcctcctctgtgcacccaaagcccctgtatatgtgtcttttgttgcatttccaaaatggctgagacagtgtttacatgcatttctcagcagtttccaagcttctggagtgcaaactgaattttaattcactttttaatttccagaagacagcacagcatccagcacataattacttactaaatgcaggaaatatgacacacggatacacagagtgaaactccaagtcacctttcaaaaccacaagtttctcttctctgttgtgtagcttacaaacctgaattccctgtagatattattaaaggcaagtgatgctcccagcctcttgaaagcattggggtgaagcgcaaggctataaagtcgcttgaaaagcgatttggtgtttactggactcttctcctgctgctgtggtgttatttgcttaatggaccatttaaggaattctcgaatacaccgaccacaaaaatctcttaaagtactgtcaacagggtccacaattccatcctgaaacaaaacaaagagaccttgattgtactaatttttataaccactgacaactgaatacccttggtctatctctgagcataactaaagtatgttaaaaattaatttatagcactagtcaagaaaaaaataaacattagtaaaaccaatctccatagtgtatccagaatctaggcttgaataactatttccttctgatataatgaaaacattttcttttaaacaaattaataaactgaaaagccatgaagaggggagagaaaactttaattataacaaaacaatctttcccttccctgaaaaaaaagaaaatggctatatcctaagaattccagaggaattttgattgttgattttaccccataacagcttttgagacactttgcatattgaagtcaaagagaataagaccctttgaagttccaaagaaactgtactgctccataaaggaaaatcctatggaggcatgaagagcagaccccataaaggccctgccgaaaacagctatggacatttgaccaacgaccacacagagatgtattctactttatgctttgttgccttctagtcatgacgctgtctcagatctacaaaggaaaagtttaacttgaaaacgtacactcaacaatgaattaagagagttctgcctaacacttccagttatctgctacatataaaatcctttcttgcagaggtaattagaatccaaaaaggtaacacaagccatggtaatgggaggagagggtgcttcctgcttttcagagcagaggtcaccagcgccaagtggtgatgcagggaagagcagctctcaccaggaaacccacggccctccttcacttgagtgccgtgctaccgagttcatgctgcttctttaccttttctttcctcaactatctcgttttacttatcagatttctttcttaatctcttacttaatctaccttcaaggatcaaaagggagaaaagaaacagaaaacaactaaaataaaaactttttaacagaaacattataatgaaaacatctgaatgtaaataagccataaattaactttagctaactgtatttattataggtaggattcactggtagacactgcagggaattaaactacaggtttaattatgtcaccaccctaacgaatgttcagtcactctcccctacccgtaacatgactaagaaagatcacactcagagtacactgccagcagcataaccagggctgtgcaggagacataaacttatttgcacaggttcaaaatttatagtaaaataagcatcaaaaaaaaactacaatttagctggcctcactgcctctgccctcagtgagctggcgaccaaattctaagacaatgcttctccgtgtcaggagagttctgtgtaaaaggtgaactgctgtttccagggccctttagttattgaatctgagtataggagaaaattggatatactcagaaattcttcttattctttgtttttgagacagagtctcactctgtcgcccagactggagtgcagtagcgcaatctcagctcactgcaacctttgtctcccaggttgaagcaattctcatgcctaagccacctggcgagctggcactacaggtgtgtaacaccatgccagctaatttttctatttttagtagagacagggtttctccatgttggcctggttggtttccaactcctgggctcatgcaatctgcatgcctcggcctcccaaagtgttggattacaggcgtgagccactgtgcctggctcactgccaaggtgggcggatcacttgaggtcaggactaagaccagcctggccaacaaagtgaaacgctgtctctgattgaaatacaaaaaattaggcaggcatggtggtgtgcacctgtagtcccagctattcaggaggctgagacaggagaattgcttgatcctgggaggcgcaggttgcagtgagccaagatcgtgccactgcattccagcctgggcgacggagcaagactgtctcaaaaacataaataaataaacaaacatcaaatacaactaatcgatgggagtaagaggaaaagaatcaactattacttaccaatatagcttctagtaaggcaacagtatcctgactttcaaatttcttgttgttagtgaaccagtgaatcagctgcataactagtggctcatacagttgccttgtcacctgaagaaacaataccattaaagttaattcccttcatgttaaagaaatgttacgctgtaaagggttccatttaaatgccatttgcagtataaaattaagtaatactactaccatggttgtattagtttccttttttagttcaggctcaagtggtcccctcccacctcaacctccagaatagctggactacaggcatgtaccaccacacccagttaacttaaaattttttttttgtagagacagggttccactatgttgcctaggttggccttgaactcctggcctcaagtgatcctcctgcctcagcctcccaacgtgcagggattacaggtatgagccaccatccccagccccattagtttccttttccagttaaattccatgatgaagagtccagcaaagaaaaatatgcaacaaaagctcattgttcctctgattgggagggcaatttaggatacatattgttggctttgtaatactcatctttattcatttgatcttgaacgtgcacacaagatatcctggattacagacaatctagtcgctattcaactattgtacaaagcaaataacaaccctgtggttccccacagcctaactgtctccccttgtggtgacaaaatgaaacccaatcaatgtcctatatacacaaattcaaagccagtaccacaggggaggaacatagaaaaacagatttaatctgtttatatacaggacaaagaggaagctgcctctcccactgctgccaaaaggagggaggaaaacctctatggagataggatgaaaaggatcctaggtctaatcttctggaacataaataaagcctctccaggggccaggtagccccgtgctccctggctttgtaaaatccaagatgtctccaggtctgggctcctcccttatgacaagtaaatccatacccaagaaggcagagctcctgtcttcctggaggcttggaagtgtaacctagtggcctggtggaggtgtgaccatgtggccatcttggagcaaaaagagaagtggatcagagcaattagctagataaactgctacagatctaaccctcattatacatgagagtaaaatgctggccaggcgcagtggttcatgcccataatcccagcattttgagaggccaagtcgggagggtcttttgaagccacttcaagaccatcctgggcaacataggaagaccttgtctctcaaaaaattattttttaactagctaggcacggtggtgcgtgcctgtagtcccagctactcaggaggctgagatgggtggatggcttgggcccaggaggtggaggctttagggaactatgactgcactactgcactccagcatgagtgacagagggacaccgtgtctaaaaaaaaaattaaaatggccaggcacgatgtaatcccagcactttgggaggctgaggagggcggatcacttgaggtcaggagtttgtgaccactctggccaaaacagtgaaacctcttcactaataaaaatccaaaaattagccgggtgtggtggtggtcacctgtaaccccagctacttgggaggctaaagcaggaaaatcgcttgaactgggaggtggaggttgcagtgagccgagatcgtcccactgcactccagacacagtgagattccgtcaaaaaaaaaaaaagtaaaatgcttgtggtggaagttaaggtgaacactccctacactgatatcctgtacatttctgcctcagaggccagggcttttataggagtactgagccatccaggagacctttattccccacggttattgagctcaacaattaagtactttgatattagaggtccatactgtagttaatatcacctcaaaaatgatgcaaaatgtcccagggctcagactaaacaacacagagactcttccaaacagtctttctagtctttgaagctatttttttcccctaataccttcactggcctctatgaagcaatttttaaaattaatcaatataaaagggtcttaactttcagtttgaaagtttaacctggtcttaaagcatcacttttttttccacaaaagaatcatactggtgttttttttttgagacggagtctcgctctgtcgcccaggctggagtgcagtggcgcgcagtctctgctcactgcaagctccgcctcccgggtccacgccattctcctgcctcagcctcccgagtagctgggactacaggcacccgccaccacgcccggctaattttctgtacctttagtagagacagggtttcaccgtgttagccaggatggtcttgatctcctgaccttgtgatccacccacctcggcctcccaaagtgctgggattacaggcgtgagccaccgcgcctggccaagaatcatactgttttattcttagtacataagttttttaatacatgtatacatagctatatatatatatatacacacacacacacacacacacacacaatacagacatacccctttatagaaaatcatccctctacaatcctacatcccaaaggtaaccactgtcgactttcaaaatattttatttatatacctttttttttttttttttttgagacagagtcttactctgtcacccaggctagagcgcagtggtgaaatctgggctcactgcgacctctgactcccgggttcaagtgattctcctgtctcagcctcccaagtagctgggattacaggcgtccaccaccacgcccggctaatttttgtatttttagtagcaacagggtttcaccatgttggccgggctggtctcaaactcctgacccccggccaatttatatacatttaaatatgtgtatatacacgtgtaaaaataaaaataaatctgccaaggaggcagagctcctgtcttcctggaagaaaccagtaactggtttcttcttagagtactttccacgtaaacatatgcactctaccaatgttttcagtagccacccagtacctcaactatggaccacaaccaagctaccagaaccctacagctagaaatgcaagtatttctaaattatgactaccatacagagtggagagtcctgagcacactgtttaagcagctctcttgtaaggaagctgctaggccaggactgtggtcactcaatccgagcccagctgcagagcactgtgcctgtgtcgccccaccaaccatgacacgcagggtcctttccttgtgcccttggcaacaccaaacattgttcatcttttaaatatttgacagtagccaatatcattttaatttgaagttccttgtttacaaaacggttgactattttaagatacattccatcggccatttacatttcttcttttatgagctgcctatttttttctttatacatttgtccattttaaaatctgatctcttcagtagtatgttgcacattatacatgttacaatgttggttttgtgccattcagtagtcttaaacatttataaggtcaaaactatcaatacattaacacttttatgtgtctccctatctgtacaaactttatagaaagacacagaaggatgctgattatagaaaagtaatgaaatccatccaaggagcagaaatcacactgcacacagaagaaaacgttttgaaatgctacgagtctactttttgttaacaaaacatctatgcacatgtcaagatgtgttattataaagacattctccagactttacagaggatctaacatcttttcccagggaacaagcaggtgaaaggggtgacgtgaacgttcatttttatctttgaacattttaatattataaactgatgtgttatcaacaaaaaagacctaaagatatacacagacagatatgctatgtggtcattacatttttctgtaatttatttatagttcgtttttccttctaaatcttattgatttacagttagtttcttcacttgtgacaaagcccctcttccttaccctaactctagtcaggctcctctgaactcttctcaactaggccttgatttctgggcttccatgttcatctctattagtccagtttcaccaagaactccgctgagtcagttcagtgaaaactcctccccttgatatataatctaattcctcatctccccccagcccccaggcagtgtctggtcaccctggcccatcttcagccataacactcttaggattggtttagccacaatcctctttatgcctgatgtttcttctgttgtgggaagtcagggaccccacacggagggaccggttggagccgaggcagaagaacgtaaattgtgaagatttcatggacatttatcagttcccaaaattaatacttttataatttcttacacctctctttactgcagtctctgaacataaattgtgaagatttcatggacattcatcacttccccaatcaatactcttataatttcttatgcctgtctttaatctcttaatcctgttatcttcgtaagctgagaatgtacatcacctcaggaccactaccgtacaaattgattgtaaaatatgtgtgcttgaacaatatgaaatcagtgcacactgaaaaagaacagaataacagcgattttcaggtaacaagcaagggaagataaccataaggtctgactgcctacagggtcaggcagaacacagccacagttttcttctcatagaaagcctatagacggatgtgcaagtaggagaaatatcgctgaattcttttcccagcaaggaatgaccctggggaaggaatgcattcctaggggtaggtctatagacagctgctctgggagtgtctgtcttatgcagttgagataaggactgaaatatggccttgtctcctgcagtaccctcaggcttaccaggattgggaaattccagcctggtaaattctagtcagattggttgtctgccctcgaaccctgtttcctgttaagatgtttatcaagacaatccacagtgggacataggccctcatcagtaattctaattttgccttgccttgtgacctttattgccctctgaagcacgtgatctttgtgacctactcccagttcatatacccgctcctcttttaaaatccctaataaaaatctgctggttttgcggctcggggttgtcatcacggtcccgggtgtaacatttctctctttgtactctttctctttatttctcagaccggccgacacttagggaaaatagaaaagaacctacgttgaaatactgggggctggttcccccaatattcctcttagttattttccatccactgaccctgaccctgctccttggctatcaatccccctggtcaataagtatttggagtagagcccaatccctctacagcagtgtaaaggcccactggagtagcctcccctttaatagttttccttaacatcttaacgaatgtcatgaataactttttctttaacatgttagtcatttgacctaataccatttattaaatgacccatttcccacttaaataaccccctaccatagacacaattttcatatacacacaaggggccatttcccagcacctagctctcccactgagccatctgtgcgctggttcagcctcttatactccataaggccacttttcaacatctactacacaagactccctccagcgtgcaaccctttcaaaatgtgtcttgcttattaggctcaagcaattactccttcagattattcttttaagttcaaaaataaaattaattctggattttttactggaattacaccagagttatcaattgatttggggaaacgacgtttttttcaataatgacttctacctcaggtacataagctattcatcttctatagtcataaaatatgtttgcctggcacattgaagtttattcctagacattttttttttgatgctgttatgaataagatgtttatagacatattttccaagtggtcaatactaatatatgaaatatatgagaataatatatgaaaaaagatatatgagaattatgtgtttataattcatcagctttttcctttattaattcttagagtttatcagctgatatgcttactcttgggccttccagattttgaaaacaattataataatcttttctccttcttaatagtccttctatgattttcttatcttacagtattgaatagaatctcccaaatagttagtggggctgatatcctagccttactggcccgctgacaagtgtcttttgattgccaagtgccaagtgctggggtagatgctggagaggaagcaaggaacaccaggctctgtccatgcagagtttaactaactccaagtaaagcactgaccactcccagaaacaggccatgctcccatgctgggtggaagcacaagggagtgtcagtgcttcacacagaggatgacctggctgcaagattcaggcagacattctatcacattaaacatcatgtgaaactactcctagtttatcaggagctgccaaatgccttccaggcttccatggagaggttcattgctacgttaaatctatttctgtggtaagtttccagttttcactatgagctctatttaatcacagtgcatctgaacatactgctggactatatccactcatgtatactgcagaattttccagctgcattttgaatgagttttgcatttcattttcttttttaagtgtgtaccctgatatccaggtcatgctagattcataaaatgaactgagaagatttcttacctttttctgcttcatggcagcagtgaaggatttgtccataaagtcatagtataggccacttgccagccatagctattttttatttatttatttatttttttttttgagaatgagtctcactctgtctcccaaactagagtgcagtggcgtgatctcagagcactgcaatctccacctcctgggttcaagtgattctcatgcctcagcctctcaagtagctgggattacagatgcgcaccaccacgcctagataaattttgtatttttagtagagacgggggttttatcatgttggccaggctggtcttcaactcctgacctcaggtgatccgcctacctcagcctcccaaagtgctgggattacagatgtgagccaccgcgcgcggcccatggttatttctctcttcttccctttgtgaaagactacgtttgtccatgagaggggtgacagctaattcacctttagatgcctggactctcagtaacttttaactacaacagcgattcccaaactccgagacacactgaaagtggaggggagagcttttagaagtcctggtgcccaggtcatgcccatgaccaattaaaccagagcacctggggtagcagtcagggagcagtatcgttcctaaccatctccaggtaattccactgctctgctgaccactgaattagacaaaccaaacttttagaaattttacaactatttcagattcaaagcccttacctgatcaacatcacacgcaagtcgaagcagcacaggaaacgtccgcttatagagctggtacatgggtggggctccctgtcccccttctggcatctgcgtggctttgcccaacataaacataaccatgctatgtaaaagttcacaggctgcaacctaaaacagaccaggaggtcagcaatgtttaagttatcacgttgatgacaagagaatatttgaaatgtcactcaatttagcctttaagaagaaaaatttcattgcacataactatcatgtaacccaaatataaattaactggaattaacatttcttgttctataaaactaatgattctgttcactttgtttttttatccaagaacaaagaattaaaatgtaaaagctttagaaactgggaagtatatttcactgttgccatattaaagaactatataactttgcttcatctgttagcacattttcaactatcactttaagtaaaaatattttttgaagcactatagaaaatttacaaattaatacacgcatacctcattttatggagctttggacacaatgtgttttttaacaaattgaaggtctgtggcaaccctgcattgagaaattctattggctcaattcttccaacagcatgtgctcactttgttagcatttttaagcaataaagcattttaaagtatgtatataaagttctaatgctattgcacactaaatagaccagagtatagtgtaaacataacttttacatgtactgaaaaaccaaaaaactagtgtgatttgctacactgagatattaactttattgctttggtctggagctgaacctgcagtatcaccaaggtatgctatgcctgtatgaaaatttgagattatctgtttctaatctcccagagttaaggggataaccaagcatagcccgaatatcactctcaaatgccctttatgttccattttatataatgaagagcttttggtatattaacgttttgaaaggcaattttttttttttgagacggagtctcgctctgtctcccaggctggaatccagtggcgtaatctcggcttgctgcaaccactgcctcccaggttcaaacgattctcctgcctcagcctaccgagtagctgagactacactcgcatgccagcacacctaatttttgtatttttagtaaagatcaggttttaccatgttggccaggctggtctcaaactcctgacctcaagtgatctgcctgcctcggcctcccaaagtgctgggattacaggcatgagccaccatgcccagcccaattacctattaagatgatttatacttaacttacatttatcaatgacactgacttctaataagtaagtagttttctaattactatattacagaaaatacaaaattactaatattggaatggctgaaacatgttctctatatcctaagcaatatgtatttttaaagcaataggatctaaataatgggtgaaatgaaaaatagaagtactttagtttgtctgtcactggctgtgagcgctaattctgtgactcgaggcaggaacacatccaggaaaatgacaggtttcatctctctaaagggcactgcaaagctcagccgcttctctctgtcccaggccacatagctcttcatcatctcatctgaggacgtgactgttagaaaagatttaagaagaatgaaacactttttttctttttattagtgtcagaattattcacaaatcaaaacatttctaatgccagctgttctacattctattaaagtgaagcacttcattcatctttcccttttcttttgcctcagatatgtaattacaacatcagaaatcactcgatttaatttaaagtaaaattacttttaaacaagcctaatagtctcaaatgtttaatatccaaattcagtaagagttacttaaagtattttgtagaagaaagtcaatgaacaaaatttttacttaaaaaaaaaatctctttgaaacactttccaaatacaggctctaactccctaaataaccaaaagtcactggtatatttaacaccaaatttcaaaagtaaaaatacagaggaatttttactaatcaaaaatgtagacttttggccaggcacagtggggcatggtagctcacaccagtgatcccagcactttgggaggccgaggctggtggatcacctgaggtcaggagttgaagaccagcctggccaacatggtgaaaccccatctctactaaaaatacaaaaaattagccaggcatggtggcgtctgtctgtaatcccagctattcaggagcctgaggcaggagaatcgcttgaacctgggaggcggaggttgcagtgagccaagattgtgccactgcattccagcttgggcaacagagcgaggggaaaaaaaaaaaaaaaagctgattcttttaaattaaaataatagagacagcttcttgccatgttgttgcccaagctagtctcaaactcctgagcgcaggcaatcttcccacctcagcctcccaaagtgctggaattacaggcgtgagccaccacacgcagcctactaatcaaaaatggtaattctcatttggaaaaatttctaaaaatatcataatattaacaatattggatctcaaagagattaacttggaattcccgacactaatatggaaaagagtatcaaattacattgtttcaaactggataacatgcttaacaagtcaagctagaacatatgttctaccagtatactgaattattccaattttacggatacagtcaaaccattaggcaagatattattctttataatcttatttagaaatatataaatcacatataggagcaaatattcagaatatattatgacctggatacatccaaataaaagcacaaatatatctacagaggttatttattttaaaagaagtttacctgtcagaagatttttgtttatttgtcctcctagagatccaagcatttgtactactctaattcttatttcttctaaggatattgcttcgttctgtaaatttgaacaattgtatatatgtgattacaaatgggttaaagattaaatagaagacataggaaaaaactctttgccacccacttggatgtccatttcctagaaccgcagttccaaactttttggcaggatcctttccactcttaagaaatatcaaggacccccaaagagctgttttatgtaggtcctgtttatcagtattaatgacattagaaattgaaacacagaaactatgtaaatagttaaactactaaacccattacatgttataaaaagtaactatatttttcaaacaaatgaaactctgggcaaagtggccattccacagtagtgcagatccgtttacagtgtagctcactgggagacagtttggtcctcacaccgatattgcagttggaaaaccaggcaagaaattttaaatagtctttttagctaactgtagttattcttctttgatatcacaccaaaactgaaccagcgtagtttcttaaaggttagttacaatgtcgaatctgaattcttatcatgaactctacgtactctactatgttaaaatccagtggctgatcttgcactttgagtggatttttcatccatgtataatttggaaacatcatgtattcctcatctgaaaatactggttcactggattgtgcagatattccaaatgttgacacatttcattatatatgcaaaaaatcacataagcaaatatcaccaccaatcttattagaaaaaaatcttaggctgggcgcagtggctcacacctgtatcccagcattttgggaggccaaggtgggcagatcacgaggtcaggagttcgagaccagcctttcaccaacatggtgaaagcccgtctctactaaaaataaaacaattagccaggcgtggtggcacgcacctgtaatcccagctcctcagaaggctgaggcaggagaatcgcttgaacccaggaggtggaggttgcagtgagcactccagcctgggcaacgtagcgagactccatctcaaaataaaaaaaaaaaaatctttaagtaatgagaagctatcaaacttactgcaatagttacaagttctccaaaactttacagttcacttaaaagcttaaattttatcattggcaacagattttcagaagttttcctcaaagtggcaggctcggttcattttagagaaaatgtctgcatatatccacctatgaataacctcagtgtgcctttcagttgtcatttcaataaaaattgtgtccacaaagcagtggctacttcagctcccagttcaaagcaccacacagtgctttttctccagatagctgtcacacttttctacgcaggcctgcttcaggtgcacctcctgcctcacacacggagtatttttaaaaatctgtgctcagagtcaacgctagagaatcaacagtgttctccatcataataccgtggtgcaaattaacggagtaaaaatagctttggccttgcaccctggatcccccaggggtcacagttagagaaccatagtgctaaggaacaggcattgtgtatctgtacaaaaattttggcaaagcacagtggcacacgtctgtaatcccagcatttgagaggctgaggtgggcggattgcttaaccccaggagttcaagaccagcctgggcaacaatgcaaaacccatctctacgaaaaatacaaaaattagctgggcatagtggcacatgcctgtggtcccagctactcgggtggctgaggcgggaggatcacttgagcctgggaggttgaagctgcagtgagctgagatcacaccaatgcactccaccctgggtgacaacatgagatcctgcctcaaaaaaaaattaaatcgataagaaaaaaagaaattttatttgtaaaactagagatatatttattttatcctgctgtgccataaaattataaaaacttttatgccgccatttctagtttcattctagtctctcaatcaaaagatgcccaaaataatgaggtgagaagaactgaccctagagtttgcattatcagttttagatgttaaaagtttttcaaattttaattcttacttcattccaaaaatagctattttccctattctaactcaattttctctatttacgtcatattttactatcacatcgtatggctcatctcgagaaaacttgccccaaggaattatcaccaaaaagccataaaagaacaaaaaagaaaactggaacaaactgaacctgataatatgacatatttaagatctaagcataaatgaaagtcttacatatccctggtatcagtattctgacttgcttatttaatatgaaccagtttaccttttattatccactaaatacatttgagggcaggaatgaacagaaaaacaagaccaaaaaaataaacaaaacagttaatatagtttatattttcatagctaaaaatatattaattttttttgtcaggccactcccattgcccaggctggagtgcagtggtgtgatcttgctcactacagcctcaacttcctgggcacaggtgattctcccacctcagcctcccaagtagctggggccacaggcatgcgccaccacacccagctaattttttgtattttttaatagagacagggtcttcctatgttgcccaggctgagctcaagcgatccacccacctcaccctcctaaagtgctgggattacaggtgtgcgccaccatgcctggtcaatatattaaaattatttttatattgtactctactttgtatacaaaaacaactaacattttaaatgaagatttttacttttcacaagtgttagaatctgatctctgcattatgtaaggtacagaaaatacaaaggacttcttactgatgaaaggttctttgtcttcttcagatgctttaacaccactttattaaatcctttctgggcagcccgagaaagagctgacacttcccagttattcttggtctcatctatcaatagtaaacgaaaataaatttaaaatagcactcattcattcatttaatgtacattagaggcaacaaactatattgtcaaatagaaacattaaaatcctaaattatgatttaaaaaaattaagtttctaaaacaaaaaatataaatggtggttgcttttaaacatcactgtctgccaaaaggaacatggctccttgggaagtgtctgactccagggtcgagaagagcatgaatcatctcatggagcaggagtggctcccacgcatcacactcgggccaaatctgggacaatgtgggcttcaaaaccaatcatgatggcaaaagattagacccactgaaaaaataagaatccacaaatcttactaatacagataaataaataacggggaaaattgtttcttgcagtagaacatcaactaggatgaaagaaatgatgggggtagaaaatcaccattttgcaaccatcaaagtaatacctgattcagaagaatagtcagtggatactaaaactattatggtgagcttgatgaggaacaagactatttacagtgttgaagtaccccgaataaattcctttttttttttaagcaatcataaacttacagaggatggagagtatataacttctttcctgaagcactgagggtaagtgaccgactcaacaccccactgccccgaatgcttcaatgtgtgttttccacaaggacagtctcccacacaactgccacacaaccatccaaaccagattatcaacattcactcctcagcaccactccgagttcagcattcacctaagaatgtttttaattcaggacagcatattgcacttagttgacctatctctttagtctcttttagactgaagctgttcttcagtattaccttgcatttcataatttggacatttaaaaaatcatatgccagtaatttcatacgtggtctctccatatgcatttgtctaatgttttctcatgattagactcaggttatgggaaccagttgtaacattttactatttcctttattaactgctgaattaaactttgacacatgttcattttttctctgcagagtcatagttctacaactataaagtcatttccaaaagttctgagatgtccagtgcattcactgacacagccaggtgagctgcgccgcgggagggcacctgccggtggtttaactccagcaagtcttctcttggttccagaatgaatccctggcagtgggatcttagctctgctctctctagctagttcttttcctttctataagatgttaaagagttctactctctgatgggccagagatgataagagaatccagtttttagtggttttttttttttttttttgagctccaataagttaagaatttttagttcactggaaaaaacagatctttgatatctggactattcagcattttctatgtctgttggggaacaggcccccaaatctggccataaacaaaatctctgcagcactgcgacatgttcgtgatggccatgatgtccacactgaaagttgtgggtttattagaatgagggcaaggaacacctgacccacccagggcagaaaataacttaaggcgttcctgaaccacaaacaatagcatgaggcatctgtgccttaaggacatgctcctgctacagataactagccagagcccatccctttgtttcagcccatccctttgtttcccattttagttaatctataatctatagaaacgatgcttatcactggcttgctgtcaataaatatgtgggtaaatctctgttcctggctctcagctctgaaggctgtcagccccctgattcaccactccacactctatatttctgtgtgtgtgtctttaattcctctagcgctcctgggttagggactccatgaccgagctggtgtcggctatgtctgtatctcctggtttttggctcaaattgcagaactgaaactatttactaagctctctatgtgtctttgcaagtatgtgtctataattaacaaaggcctatatctaattttgtgtataatgttctcctgtatttggggggtattgataaattagattataaagtctcttaaaggagctctgtcctgatttatacagatatgtaaattgagtattcctaaaattctccaaaaataaggaagttgaactaacagtgttttaaatgtgctagattttaaaaatcgtacagaaaacaatttgggatcatttaggaatattcacataattaaggcacatctgtggtaaagagacaagtttaatattttggtttaaataaatgtattttatctatcagtattaaatataacacgaacatgcactttattctacttgtgtttgttttccctatagttattccggctaataagctaacattacttctcataacgttttttaaaactgtggtgtaatatacataacatgaaatgtactcttttaaccatttttaggtatataattgagtggcattaattacattcacaatgttgtccaaccatcaccacatccatctccagaaatttttcaacatctgaaacagtcccatacaacttttaagattatgaaaaatgtggctgggcacgggtggctcacgcctgtaatcccagcactttgggaggccgaggggggcggatcacgaggtcaggagatctagactatcctggataacatggtgaaacccccatctctactaaaaatacaaaaaaattagccaggcgtggtggcgggcacctgtattcccagctactcgggaggctgcggcaggagaatggcgtgaacccaggaggtggagcttgcagtgagccaagatcacgccactgcgctccagcctgggcgacagagcgagactccatctcaaaaaaaaaagaaaaaaaaatgaaaaatgtaataagtttatgtccaactaaattgaatcattatctgggtaaactttttatttcccaagtaattacgttgtgcagcatgccaactggaagataatctctattatctttaggcaatttgcaaccttggactgactgagttaatggatactttggatggttgggtactttgataatttctaaggaaaatattaatagaatactgaaatactgatgaaaaggcacaatttttgtgtttatgtgcttttcctttttgcttttataggccgttgaaggtaggagccttgggtcatgctaacaggcacgtgcatgctgtctcttggggggctgcagacagtggtatctgtgagctccatgagtctgacatactgctggtgtgtaaggcaattctcaatttcccactccagttttctacgtgaaacatgagtttagtaattatataattaacaagtggttgtgtggctatattagaagaatagtacagaaatacaattgcatgcatgcttttgattttctttttgagacagagtcttgctctgtcacccaggctggagtgcagtggcacaatctccactcactgcaacctccacctcctgggttcaaacaattctgcctcagcctcccgagtagccgggattacaggtgtgtgccaccacacccagataatttttgtatttttagtagagccagggttttgccatgttggccaggttggtctcgaactcatgacttcacgtgatctgcctacctcggcctccctaagtgctgggattacaggcgtgagccactgcacccagcctgatttttcatttttcttggattacaggtgtgagccacagcacccagcctgatttttcttttttctttcttcagaagggtctcactctgtcacccaggctatggtgcagtggtgcaatcatgacttattgcagccttgacctcccaggcttgagcaatcctcccacctcagcctcccaagtagctgaaaccacaggcgtataccaccacatccagctaatttttaaaatttttgtaacgaaattagccaggtgcagtggtgcgcacctgtaatcccagccacttgggaagctgaggcaggagaactgcttgaacccgggaggcggaggttgcagtgagccaagatcacgcaactgcactccagcctgggtaacagagcgatatttcgtctcaaaaaaaaaaaaattgtaaagataaggtctccttatgttgcccagactggtctcgaactcctggccttaagtgatcctcatccctcggtcaatcaaaatggtacgtgggattacaggtgtgagccactgcacccagcctgcttttcatttttaagtaaggagggtagttcctcataaaacagtgaatctcagacattttcatgtctggatctctttccagaattaggactgaccccataaatctttgttttgtgggttagaactagtagcagttactatattggaaacagaaataatgttttaaagacttattgattgatttggaggtcatgttaacatgcataacatctctgtatttcaatgagaagagttctgatctcccagacaccctgggaactggtgtttgaaagttgtgtcaattggtttcagaatatgaaaggacattaacacaggacaaatctcggaaagcgactatctgagcctaaaaagatagtatgagatgagttaaatttttagcaaaggtcacttaatcttgaaaagtttgcttctttggtttactgatcaaggactttgcctgtaccatgagaagtcattctttttttttttttttgagatgaagtctcactctgtcgcccaggctggagtgcaacggcgtgatctcggctcactgcaacctctgcctcccgggttcaagtggttctctggtctcagcctcccaagtagctgggattacaggtgtgcgccatcatgccaggctaattttttttctttttagtagagacacggtttcaccatgtttgccaggctggtctcaaactcctgacctcaggtgatccacccaagttatgggattacaggcgtgagccactgtgtgcagccaagaaatcattctatgtaatctgccaagacagcaaagattcactgtcttaccagaaaaattttctgagctttacactgacttcactgtctgaaaaaggagattcaggccatgtgtctttgacagaagaggcccagagtggcactgagttcccctcagcaagtcacatcaggatgcacgtgtggcccacaagtcctactgctagtcagtgggcaaagaagggctctaccaggtgtctatgctgtaaaatcaccattttcactctcaatcattagtacgtgtttggctgaggtactttaaaaccatggtacttcaaaaagtgccatgctggctgtgaaggtgtaggggccacctaggaggacactcagaggcctccaggaattgagaatcatgctccagccgtcagtcagcaaggagacaggaaccttggtcctccaatcacatggaactgaatcctgccaacaacctagatggggagtgaacaagcctggactagccaacaccttgaattcagtcacatgacttaacagagaacccagctgagcccatttggacttgtgtcctacaaatctacgaaataatcaatgggtgctaatttaagctaagtttataagaacttattacacaccaaacaatcaaacaaaaaaaaccactaggaaactttaacttactcattttacttatttatatctgcacatgctcactgcttcctatttgattacctgggttataacgtttctaaagttatttattttgatgctcaagtcatcactacttttgcctgtgacatttcccccatcatgctttgaataggtccttactttccggatgttctataaaatacagtattctaagttcataatatattttcccggccccaggttggaaccaaggagtcctggttccattaatggaaaatgaggtgtgggtctgggcatggtagctcatgcctgtaaccccagcactttgggaggccgaggtgggcagatgacttgaggtcaggagttcgagaccagtctggtcaacatagtgagacccccatctctactaaaaatacaaaaattagctgggcgtggtggtgcatgcctgtagtctcaactacttgggaggctgaggtggaaggaccacttgagcccagcaggcagaggtttcagtgagccaagattgcaccactgctctcccgcctgggaaacagagtgagactctgtctcaaaataataataataataataaaaaaaaggaaaatgagatttggaggccatgacctgggtgccaggtttgcttgttactattcagataccacactcctagaggtcccttcagtggccagagtacatgtaacacacaaacacacactctctctctctcagttctattttcacatttatttagatgcatccataagtgaatgcacatatataactggggagaggcagagggagacggaggaccatgggttcacactgatatacccacttccaatgcaactccacagtgtccattccagtttcctgtctttctgtatttgtagctcacttcaacatgagaaacctagtttcccttattctcaatgaatttatgtatttgttcaatctcctgtatgtaaccaaactactacctccatcgcccttctcaccctgcctgcaccccaacatcccagacagctgtcccaacacgtgggtgcctcatctggcttgggtaaaccccatgccaggccaccccatgggggatgacctcctcacacccttgggagcacctgggacctccccctgcccagcatctaccttcctctgtaccacctaaaggcctcaggactgatcactccagaaagtggagcatggaatgcctcaaattactaactcacacagagagaaaaacagtaacctgacaaccacaaaaagatgatgcaaacactgaccaaatggttacagtggaaacaaccagcaaaggcaccaagtgtcctgaagagaacccagcgtctgtcaaaaaggcacagcccaaaactcatcaagaggaaacatcagacaaacccacatagaaggacactgtacaaaataactggcctgcagccttcaaaatgtcaagtcatgagaactaagaaaggttgaagaactatcccacattaaagaaagctaaagagttacaactaaaagtaacacatgatcctacactgaattctaaaccaggaaaaatgcagctaaaaaaagaaattaatagggcaagtgaaaaatgtgcctattgactgttacttggaagaatatgtatccatgttatttttctggattttgataataatactgtagttacgtaaaagaatgtcctcactcttaagaaatatacaatgaagtcttcaagatctatgacaccttcggcttattcacaaacggttccaaaaaaaatgtcccatgtaaatataaaaacatgcacaaacacacaatagagaaagtacatgcaacaacataaatggtacaaaatcttaataactggtgaatctagatagaacacatggagttctttttactgttcctgcaattgttctggaagtttgatacatcaaaaaaagttattaaaacactaacttctgtctctaacatgatagattttgttttgtcacctaattttgcttactttctgcttttctcaattatcgaatcatctagatagggtacatgtttaacaggcaaatcctttaaaacaatcacagtaacttcctttactaatctaaaacttttcaatgagttaacagaactcaaaaaagaaaattaaatactataaagatatatgctatcagatatattcattttactaagtgatgtatttgtcatgaatactcaaataatggcactccttatataaatgtgaattttaaaagctataaaggttaactagtttgtaattttggtctctaaaatatgcttgttattacaatctgtaaaaaaatcgtgactctttcttcatgaactctgcatatgcactgaggatgtcagaaaaaggagacacagtgcatgaaatctgtcacacaactttcacttaatgtttccaagccaataagatttaacaataaaataatgatttacacaggtaaaacctcacaattttttttctgtatttctttttttggcctcatgaagaaaaaaaccttataaattaatacttgacttctactgtgaagatagtaaagcttaaattcttacaaatacttcagtctttctcccaacagaatctttttgcttgcatcggatgacaatgtctcttttcattccagtttaagtctgtgccccaccccaactctgaagtcctactttttcttttcttgactagtaatattttgacctgggcagataatttttttctttgactcttttcccaaacctgttttttctatgatgacatttttttcgcaattcttagctaccattagtgtgcttcaccagttatgttttaaaaagcaataaaaatctagtgaaagtaaaaatacaaaattactgttgaattttctgaagtgtttaattcctgactgatttattcaacaagttttttttgcaaagcagtgtattaggagtcataaaaatttcaaggtattgaagacagtacttgtctttgaagattttataaatcttagtaagctataagtgagtaaatgaaaaattttttaatacctcaactatatttctttatcacaattagagtcagataaattagggaaattacaaaaatagcaatcaaacatattttgaacacactgggcttaaatttcagaagttacaaaaatacagtcctacctattatagttactccatttccattttaattacaatacacatcacaattcttctaaacattacctgacaaggctgaagtcttcaggtatccatccaggcaggggagaatgtctttgtaataaggctgcattacatgtctgtcaatataaattgaccattcttctagagcattcaggcctacttctgccaagggggtatagctcaggcccagtttgaaagccatctgtatgttaatacaaacaagttaaactgaaacgcaggaaatataagatttagaggaaaaaaacaccaagtaattgtgatttctaattaatactcctttttattactggatgcccgacaccgctggagagttcagtccaggtaattaggaggaaagcaagcagctgtctctgtggctgtggtataccgcagcctttcaaggcacacaggtttaactctcacatcgacctccaagtgcagttcagagtcaccaagggtctaagtcccaaagccagtaagtggcagaagcagaccctgacccgggcacgcctgtgaggaaacgcctgctgggactgccagggcaagaggatggtgtttctatgtgctctgggactcacaacagcgatgaagagatggctctgttcaagacaacgcctacctgcagtgcaggaacgtaggctctaacatcgagttcaatgatgttgtgtggcaaggacagaagaaaggtcaaacaagaggccaaaagttcatctttgtactgcttcattttaactgccaccttaacaagaaagaagacagtaatgtatatctgaatagagcctacatttgaaaatcaactaaaaagtatttgccctattctcaaatacaaaaattggcacgtagcctttattgacatgaccacattcacttacaaattacacactaacctccaggaaagttaatttgtcgaaatgcttaatacctactacatggaaaaacaagaatctatttcatcttgagttgtcatcactcaactgaattatgttaagagagcttgagggactttttttttttttttttttgtaagatagagtcgtgctgtcagccaggctggagtgcatggtgcaatctcggctcactgcaacctctgccatccttcaagcgattctcctgcctcggcatcccaagtaggtgggattacaggcatgtacaaccacacctggctaattttttgtatttttagtacagatgggatttcgccatgttggccaggctggtcttgaactcctgccctcaagtgatccacccaccttggcctcccaaagtgctaggattacaggcacgaaccaaagtgcctggctgagggacttttgaagcacaataacttcctctaattagtttttttaggaccttagtcccgctccagatttagcaaacacatttttatttttatttatttatttatttatttttttttttgagacacagtcttgctctgttccccaggctggagtgcagtggcactatctcggctcactgcaacctccatctcccgggttcaagcgattctcctcccccagcctcctaacctgacacaattgtttttttttgagacagagtctcgctgtgtcacccagcctggagtacagtagtgcaatctcagctcactgcaacttctgcctccagggttcaatcagttctcctgcctcagcctcacagcctactgaggagctgggattacaggcgtgcaccaccacgcctggctaatttttgtatttttagtagagacacggtttcactacattggtcaggctggtctcgaactactgaccttgtgatcctcccacctcggcctcccaaagtgctgggattaagggcatgagccaccgcacccagccccaattcttaaaataattatttatgatcactaggattttttcaatagatattcatttaaaaacagttcatgataacactaagataaatcatttaaaaattacctctttgccaaatttcacaaataaagcaaagcaagaatacttttctgggtcttcaggagagtgtttcagactctttggactaactccctgtcaaataaaacagcaagttagtacactgaacaagaatcgggagactgtatcccaatccagtagttcctagcctgtcttcagaggggtgaatccatttcaagttaccaacatctaatgaagacaggaggcagaatcagctctgcagacatttcaaggcacaggctagtcagaacaagaggagggaaggtggcagctagtgagaagccaagcacacagctaagtccattccctcttcctcatctcaccctgtaattacccaggtgggctcctcatgtgactgactggagcgtcgagaatgctaatccagttgttctcaaacttcactgggtgccagaatcacctggtggtgcttagcagggcagcagagacctgcccccaaggtttgtgatgcagaaagcaatgctcaaggctgccggtcctgggaccatactttgagaggccttgttaatcttacataattagccaggtgtttgagcatcagggcaaaaaatgctgctagctttttagagtgctatccaactgccattcacatatcaatttttttaaacacatagaataaaattagtagactttaaaactgcataggccacaatcacatattttatgatacatttatatatactcatgacctaaaaaaacgcaagattcaacatcctgcaagaaagactcacctcgaaatattttattttcttggcatttcttactgtaatagaaagcaatttgtagaaaccactgatgaggggcaaccttgtagattgcaaaattaattcatatgaaaatgagtacacccatggttcaaaaaattctgcttgtttctcagggagaatctctctgtaaaaacaaattagaaattgaaggtagaaatttgtatcattctgatcttaaaattgtaagggacataatcgaacaactaagctacaaacccatcacgtaacattttgaggtatcctaaaatgtttagttatatctataatccatttttctctacctgaggatcttttaaatataaaaaatgaaaactgtaacctagtacacttagatatattttaaagatctatataatcgattacagattttgtcttttattatttgttatttatttattttttgagacggagtctcgctccgttgctcaggctggagtgcagtggcgcagtctcggctcactgcaagctccacctcccgggttcatgccattctcctgcctcagcctcccgagtagctgggactacaggcgcctgacactatgcccggcgaattttttgtatctttagtagagatggggtttcaccatgttagccaggatagtcttgatctcctgacctcgtgatccacctgcctcggcctcccaaagtgctgggattacaggcgtgagccaccgaacccggcctattatttcatttcttacatctatataaggaatttcctatattacagccaataactaacaatcattttcattcttaaataattagaattttaccaaatacctgcaaaattccaccaggttaatgaaagccgaaaaatctttaggtttagctggatgcaagttagccgctggatctgaagttgggatcatccaaacaccaggcgcctcatctccattcttaaagagtaattgtagcaaagaaacattgtaccattcaatcacgaatcactcaacaaataactttccaactgacttcatggtcaaggcctgatgctacgaagaaagattgcaacagcgagaaagaccaagatgggtgctcaagacctatggtctgataagaagggcaggacttgcagaaagcgttaaccaaaaggactcacaggaagtgatgagagaatgggacaaataggaaaatgccagaggtgggcagcacttcttgagggagctagcaataatgccttgacagagatagaattttaataggtgacctagagatttcaagtgaagaaaaagagaaatagagaaattattaacagtagtaagaaagataaatgaaaaatgtggtattttggaagtgcatgaagatcagttttaaacacgctaagtttgtgtcaccaaatttgtgttaccaaacacaactgtgtattcaaattaaaatgttgcacaagtagttagaaatacagagcaggaaccaacaagggaggaggaggctggagaccaaatatatctgggaagtgctaacaggtggtcattgatctgttggaatgaagctggaagggcagggaacagaggagaaagggaagccactgaagacagcaatgaacacacatgttctaaaatgcaggtctgtcagctgacacagttccaggaagtccctttgggcaagttttttttttttttaataaaattattttagacatttgcaaagcacagagagcaataaaccacacatcagtgttgctacctatcatcccgcatgaaaaacagaatactccaagtgcaataaagctgatgtgaccaccggcttgtactgtgtcccttcatgtttcctctgcacatcctccccattgcctcttgtctaacttctcaggactgcagtggaggtactgacgcatgaactcgaatcagcaccatctggtctgaaacaatcactgcagtcgaaagcaagcaagacaccttcccaggatcttagttctttctcaccagccaaattaccatggagtccagttaccaccaatgcctcggaccagagcagggcagctccagacttaagccatgacttatccttttgtttttttgagatggagtctcactctgtcacccaggctggagtgcagtggcgcaatctcagctcactgcaagctccgcctcccgggttcacgccattctcctgcctctgcctcctgagtacctgggattacaggtgcccgccaccacgcccggctcattttttttgtattttgtttgtttgtttgtttgtttgtttgttttgagacagagtctcgctctgtcgcccaggctggagtgcagtggtgcaatctcggctcactgcaacctccacctcccaggttcatgccattctcctgcctcagcctcccgagcagctgggactacaggcgcccgccaccatgcctggctaattttttgtatttttagtagagacgaggtttcaccgtgttagccaggatggtctcgatctcctgaccttgtgatccgcctgcctcggcctcccaaagtgctgggattacaggcatgagccaccgcgcctggcctttttttgtattttttagtagagacggggtttcatcgtgttagccaggatggtctcaatctcctgacctcgtgatctgcctgcctcggcctcccaaagtcctgggattacaggtttcagctaccgcgccaggcctaagccatgacttatctttaactcaggctaggaaaattgggtgtgaaaaaaagggagggcattttcttatttctcttcctattatctatattttcctatatcaggaacacatttaacaccttgtaccacaatttggagtttccttaactataaacaagagcaaccccaggtttccctatcccatacaaagtcatttctacataaaataagatttctgtcactctttactattgctaaggaataagaaacaaatgaacctagtaaataattttttcaaaaaaaaaattaacatatataaattactttttgaaccatctagtaacaacattttctatacaataggttacatccaacagaaatgcatcagtggcacataataatcctgaagaaccaaattttctccagttctcctctacaaatgtgctattgtcccctaaatatttatatgcaaagacagctgatacaaaaatgatgaaaaattactactgataaaaatttctaacctcttgttccccaacagtctgtatttcaagtgtaagatccaatttctcaacaatcttcaaaacggattttacaaattcatcataaagtaaatgattcagactttcactggaggaattcacagagaaaaatgcttcatctgctaaaatagaatcctttaaataaagaaaaacaataaacttcaaaatcttgtgcaaaaatgtattagtattttataagcattaagacacatacacagatgtatgtgccggtttgggtattatggaaacagtgatgataaactgcagcagatttacctggaagttttcaagttgcaagataccttcctaaattattataacagcatcatttcagtcagatgtcatttatccagtcatgtaacaaatacttactctgtatacagcagtaagtgagaagatttaggccaatccttgtcaaagcatttaccccaattaatctgtggatgtgtatgtataaacacaaatatgtgtaatatgcatatatagacactatatcttttatgtctgtgtacatgtaagtacatgcacatatacttatgtgcatacataactaaatatgcacacatatataaacgtacacatacatacatacgtacaaatacatatatatccatcctcaggctggacctgttaggaagaacagcttagcatgagctataccatcctgctatttaaagctaaaatgaggactcagctacagtaactaatgttaaaggagttctatgtctgtgtttctttcaattcatttatttccactctcattctaacttcctgattcatacggttttaattttttatttttgaagtacactgttttaaacttttgaaagttagtaaaatataattctgaaataagtcttatgtctaaactatggagactaataaaggaagtaaggtacatttatggctttcaatggtaaatgttaccatcatctggtcagagctcaggagatgtctgaagagatccacgtagtctttgtatgtgggcaccttccatttgccagttctgacttcccctgaagcacggtggtcttcagattcagactcagggccctggccagaaagacagcatgacaatatgtagtgatggattctcagaagcagcactgctgccagaacatgctggttttcagaattttctaaattaaactgccacccataggagaccatatgattaaggaagacatcgtattaaaaaagcataatttaaaaagctaaggccaggtgcggtggctcacacctgtaatcccagcactctgggaggccaaggtgggcggatcacctgaggtcaagagtttgaaaccagcctggccaacatggcaaaatgtctctactctaaacacaaaaattggctgggcaaggtggcggtcgcctgtaataccagctacttgggaggctaagacaggagaatcgcttgaaccttggaggggaaggttgcagtgagccaagatcgtgccactgcactccagcctgggtgacagagcgagactctgtctcaaaaaataaataaataaataaatagataacggaaaaatatgtgattcttctgtgactaaaactgtgatacaccaacaagtacttcaatacaatatccactgaatgtgctatcatcatttatcttgctttcgtacatagttcaatctttcatctcatcatatgtcctataatttctgggaactaagatatgcctcccttagcaatttgtcctagagtttcaagagagaaaacatttctgatttacaaaaatgtataaaacctaaagttatgcttaaagatgtttcataccttagaagtgtattcacctaacaaaatatagaggtattatgtcctacacttttcaaaatgtaaggcattgctaataactaagaaaagaacggccacttttgcaaaattatattcgaaaacctcagcaacattcctagctttcagtgataacagattaattttctaaacattaaattcagaatttacctttggaaggaccactggtttagaacatattctgattaaaccctgatgcactgaaaaaagaaaaagaaaacaaaaatgaaggaaacactgaaaaacagaatcaaaactcacaaaaaaaaacaaacagtcattatattttggaacccaactttacctctcaatttattttctaagttcattcacggctttaattttaaaacttaaaactattggccaggcgcggtggctcatgcctgtaatcccagcactttgggaggctgaggcaggtggatcaaaaggtcaggagttcgagaccagcctagccaatatggtgaaaccctgtctctactaaaactacaaaaattagccgggcatggtggcgggcgcctgtagtcccagctactctggaagctgaggcaagagaatcgcttgaacccaggaggcagtggttgcagtgagccaagatcatgccactgcactccagcctgggggacagagcgagactcttgtcaccaaaaaaaatgaaaaaaaactattaaaattaatagttctattaatagaactattaaaattcagaggtaataggatgaaaaaaaggaaaagattttggtctaccaaaatttaggagttcaaaagttgtgtcaaagatacaaaagaatttggtaaccagattctctttacctatatcaaataatgtgttaattatccatcattactcataaatacaataaattgcaaacttacccacagtactaatgcaattcctgagaactggcccttttgctgccaaagctaggaacaccttcactatggctctgcaacacaccagctgcatttttggactgtactgtgggaaactgtctatctgcatcaccacgaggtgctccagaactggagtatacacctcaggaacctaccggaaataatcagcaaaccgtgagttagaggaggtaatcaatgaatacaggaataatacaaatattcaaagtaattacaactgaattagatacttattaaaagaaaaacatggtttgtcatctaacctgctgcttaacatgtattactgtgattgccttaaaaaaaaaacacacactcagagtaaaaattgtcttgaggtgcaattctatcccaagcaacaattccaaatctttcagaaagatggaaggagaaacaaatatttttttcctgttctggataacaaaaaatcgagtttcatgacaataattctattgccacaaagtactaactaaaactgtcatgttgttcccaacagtgcctacactaaatgtattgtatgactccatcaaattatttgaagaaatgaagattaaatacttaaaattgtgctcagtttagttcacttactgtgtcaaggtacagcaagacgcttgcaacagactggaggaagcttggcatctgataaacacggtcgtcaccagtgtctgtctgggtgaggaacatctgcttgcagcgctgaatgagctcaacgtacatgaagtcaacatcttttgcgtttataaccttgcacggctttagaaaaggtaaaacagaagtcttcatcaatcttatcaagatcaaaataatatttaaggtgtcatgttaagccatgtgattataaacacaagtttaacaaggcttcttttttttttgagacgaagtttcgctcttgtccaggctggagtgcaatggcgtgatctcagctcaccacaacctccaactcccaggttcaagtgattctcccgcttcagcctcccgagtagctgggattacaggcatgtgccaccacgcctggctattttttttttttttttgtattaagtagagacagggtttctccgtgttggtcaggctggtctcaaactcccgacctcaggtgatctgcccacctcagcctcccaaagtgctgggattacaggcgggagccactgtgcccagccacaagctttttaattaagaagaaatacagatataaaatacagtatctggccgggtgcggcggcccatgcctgtaatcccagcactttgggaggccgaggcgggcagatcacttgaggtcacgagtttgagaccagcctgaccaccatggtgaaaccccgtctctacttaaaaaaaaaaaaaaaaaaattggccaggcatggtggcgcacaactgtaatcccagctactcaagaggctgaggcaggagaatcacttgaacccaggaagcggaggttgcggtgagctgagatcgcgccactgcactccagcctgggcaacagtgaggttccacctcaaaaaataaataaataaataaaatatatctcattataaagatgctttgtataataatctgtaaccacattttaaatatttattcacacaggaagcatttattggttgtcagctatgttctaggcactgtttagacagtgggtactgaggacaaatgagaggcagtccctgccccaaggctgtccacctacaggagaggccaggagtccatacatgactggaagatgctccatgtcacacaccctaccacaccagagccattttttcagactcacaaatgcgctaatgtaattgctcaatttcagacttttccaaggcttcttttctaggacttctgaatctagtccaggctccccgaggatctgatggtgcacctcttcagatccatttcccctctcctgcctatcatgctctagccacagggacaagctcaagtggggatagatcactgtgtaaagggaaaatctcatgcaatcttttagctcagagccttctgccattctgtttcttctgccctaagcatatttaaagtcgccaacagagacaaatggagatgaagattaagaaaaagggaaaggctgggcactgtggcttacagctgtaagtccagtgctttggggactgaggcgggaggtttgcttgaagccaggagttcatgaacagtctgtgtaacgaagtgagatatcgtctctacgaaagattaaaaaatttgctgggcatggtggctcatgtctgtggtcccagttactcgggaagttaaggcagcaggattgcttagccctagaggtcagggctacagtgagttatgattgtaccactacactccagcctgagaggcaaaaaagaaaaagaaaggaaaaagggagaggccaggagcggtggctcatgcctgtaatcccagcactttgggaggccaaggtgggcggatcacctgaggtcgggagttcgggaccagcctgaccaacatggagaaaccctgtctctactaaaaatacaaaaaaaaaaatacccaggtgtggtggagcatgcctgtaatcccagcacttgggaggctgaggcaggagaattgcttgaacccgggaggtggaggttgtggtgagccgaggtcatgccatcgcactccagcctgggcaacaaaagcgaaactccaactcaaaaattaaaaaaaaaaaagaaagaaaaaaagaaagaagaaaaaaagggagagattgtaggaagaaaaaagaaatcagttgttttttctacaaagcagaagtcacagaattccactaagaggaaataactagggttattctcaatattttttctttaaaaaaaaatttttaagagatagtgtctctgttgcccagattggagtgcagtggctcgatcacagctcactgccacctctgcctcctgagtttaagagattctcctgcctcagcctcccaagcagttgggattacaggtatgtgctaccatgcccggctaatttttgtatttttagtacagacagggttttaccaccttggccaggctggtctcaaacccctgacctcaggcaatctgcccgcctcggcctcccaaagcggtgagatggtgagattacaggtgtgggccgccacacctagctaatattcttaaatatatctctttctgtcatataaactttttttttaacttctcttcctaaaacgttgtgaaatcaactacaattttactttaggaataaggagcagcatagcacagaggggaaacatggtgtttctattcttcacacttggacttatgccttggttctgtcaattctgagtctcttgacaagtttcctaatttctctgcatctcagtttgctaatctgcaaaacagagtaatactgagctcctaagggttaggagattttgagataccacatgtaaagaattctagtacacagcagacactgaagaaatcttaactgttaataaacaatactaatacagtgaccctcagtacatgcgggagggattggttccaggcctcctcagtatacctaaatccatgcatactcaagtcccacagtcaccctgtggaagcctcatatacaaaaggtcagccctctatataagtttcacatccagcacacactgtatttttgatccgtatggtagaaaaacatctgcatgtaagtgagcctgtgcagttcacgcccatgttattcaagggtctactgtattgttacaagtattagacactattcaaaatgcaatgaattagattcctttaaacaatcacgtgaaaccaagacaaaatagagtaagttaatgagacatactcctgcaaaaagtccatatccacggatagcaatagataactccttgttgttcgaatccacatttctgatgattccataaaactgctccataaagtactgcagtttatttttatgcatttctgcatttttcgccaccatattagaaacctgcaaatacataatatttatttttttggaaatatttaatagcaatggaatctatacaaacatggaaaaactagaactgtttagatgctactaatgtactgttatagttacacgcaattgcttttaatcataaagaccctttgcttccattttgcttagtctctatcaggttcagaaaagtgtcttaaataaggctatgtgatacatttttcctagagaagggactaagagaccaaggatacacataagtctgaaaaaaaaaaaaaaaaaaaaccaaaaacaggttttgaattaaggctctctgaggaagcaaagagcagtctttagagctcacctgtcacccacagggtgaaagagagctgtcaggggaccagtgacttcagacatcgtcaataaacagagttcagaacaatctcacctgtcacccacagggtgaaagagagctgtcaggggaccagtgacttcagacgtcatcaataaatagagttcagaacaatcagaaagacaaagcatctcagttttcaaaaaaataagctacaaactataaagcttaaattaagtgatgcaaggggaaaatgtcgtctgagaagcaaatagatcattatttaccaaaccaagagacaagagcctaaatgcaagaactaatacaggtattcaaagagcattccccatttcagcacaaagactgcccagaataagaatggaagaaatctatctagacaattatcaaaggcagaaaaaaaaatccaccttccactgccaacttatccatacacttcccaatccccctaaagccactaggtcttagcgcctgaccttcggggaactttgctccttatttgttttagaagaatgaaacattgtatatactgtttcataatttccttcttcacaaaacatatcataaatgtttctcaagaagtaaacaacagcattttacttaattacagaatagcaaatattatatactataatgctaattttctattattgtattcccagtaagcatgtttttaacgcatctttattcaactatttcctggatatagtattaaagacttgaaaataattattcaacagtagcagacagaggacagattaaaacactatggctcataaatatcatatattacactgccactgaaaattaatcacacagatgttggccgggcgcagtagctcacgcctgtcatcccagccctttgggaggccaagaagggtggatgacctgaggtcagcctggccaacatggtgaaaccctgtctctaacaaaaatacaaaaattatccaggcacggtggcaggtgcctataatcccaactatttgggaggctgaggcacgagaattgcttaaacgcaggaggcagaggttgcagtaacccaagcttgcgctactgcactccagcctgggtgacagagcaaaactccatctcaaaaaaaaaaaaaaaccaaaaaaacagcaacaaaaaaaacacatcatatagatgtcactgtgaggaaaatatattcaacatagtggaaaaaaggccaaaaaattatgtatcctttatgtaaagtcctctttccctctttcttcctctctcctcactccctattctgaagaaggagggaaagagggtgcctctccttgcctggggcctcaggtcacaagggatgatctaataatgggactcagggtggagctgaccacacctggtaacaatgtgactcggaatgggagctttgggtcacacagcatccctggaagccgagacccaacaacccactatgcctacagggtggggccccaagggaaaccccaaacacagaggtttgggggagcacccagtcaatgctccacacatggatgctgggaaaggaatgctgccctgactctgcggggagaggaccagggaagatccacatttggtactttcttcatctctgcactgtgtgccgcttccttcggttgatttttatctgggccctttagctgtaataaaccatagatgtgagtatcaaatttgagggtatattgcaaactcccaaacttgcaacaggcatcagccctgagggcagcattgaggatagttctcttgaacttctcccctgactaagctcaaataactttctcacgaggtagagattagcaggtagaatatatttcctcaatgaaactctaaaatctattcaatgtagttttcattaagaattggagtgggggactgaaaagtctctggcaaggatgtgaaacagagatgtctgcgtggctcattaaagacaaccagcgcagtggagggagggctggccggcttccctgcaggcccacgccccacccagccctgtgctaggaaaggcaggcatcgctagggaacaaggcccccagggtgccaccagggatgatccctctgcacacattccggacactcctccttgctaacaaggcatgaaattctctctgtcaagatgtttatcgcagtaaatgtttactgagatccaaacatattcatatgaatcagtaaaaaataattcctctgatttttatttcccttagcaagtaaggccagccaagttcagcgtaacaggagttttatgagaaggaccaaggtaacctcaaagccaagagtgacttcagggggaacacaagtctgacgggaaggccaagtacagcagggagactaaggaggcgagagggacaggcggcagaggcagaggccaaagatgaggcccatcggctcagttttttggaaggcaggcccagacatgaaaaaaggatgccagtgctctctcttctccttccacacatcccggctgtgactctcaggctaacacaactgccacactgttcacacaggtttgcatggataccctgtgaatgcagctactgtttacccatgtacagcagggcccctaagaaaacatttgttgtgaatctccagtcctttccctcagagcaaccccagaagtccacttccttaatggccaggcccctgcagccacctctggacacccaggacatcctggagaccagtgctcagaatgacaagcacggtctcctcagccgaccagacaagcttccacatacgcaggtacagattctgtaaccacctcctatccaggtggaaaatccacaatggcaaagaggcaccccttgttttcaagttgacacacaagcatctatcccctggagacagctagccctcctcttccaggagagatggggctcccctcagccctccacccactctccagccctgacctcccagcccttccggccatcacctcaccacgtctttgctccattacacttgtctcaatctaggctctgaggccctaatcaaatctggcatctccctagctctctttcagtctggctgcctcccatatggctggctgatcaacatctttctgctttaaatactacagaagctacagatcaacttgtatttattttcaaacatgcatgcatgcaaagggaatttaattctgtgtgtgaaagaaatattgttaaatgacagttgaatttgtggtacctgtttcagaaaggattccagggctgaaagtgcagcttttttcaattctacatttgtgtgggcacaccactttaacaagacttcaaatagagacacgtagttgtccagaaggcaggtgctaaactgagatgcatgcagggcaaataggcgcaagccagctgcaaatgcaaatgccattatatttaaaatcagacgacataacacagaacagaaaaccaacaaacctgcagggatatgtcaaagtcaacactgtgctcaggaagatctagtaccattacactacagtaacccagggattcctgtcagagctctaacactaccaattaacaggcccataacttggctgacaaatcccaaaacaagggtcagaagtggaatcaggattcattgaggcaaagtcagaatcaaacagcctggatcccctgaaagataccctaaaataaagtgctttcaaccatgtaacctgagtatcagcatttcaaccagagcttactaagtcaccgaaagcctccctgtaaataactgtgtgtgaaacatcacagatgttatcacatttgctttcattcaaagtttaagcaaaagcttacttgagatgttaatttagtaatctaaaatattatacctcattataaacagaatcctacctgagggcacagcatatctcttcagatcaatctattttagaaaagaaaaattcaccatcagtatttgaaagtctgcactgtaaaggcattagaataatattaatagtaatattaatcctacctgaggacgaattgcctttagtacaaaattaaaaatctcccttgaagtctggggatctagggaaataccaagaagcctgttacaaatcgtaataacagtatcacataacacactttacagacagcttgacacctatattaaccccattaatctcttgtgaattcaggagaaacatctttcatcattccatccagctaaagttgcaagttattactgctgcacggttatgactgcgagaaaacagaaagaaaatctggaataacaaagacatggtttaagcaccaacctatcacttacaagctctaagagatttaaacaccaactcatcacttaaaagctctgttagataatctctcagagcctcaattttcttatttgcaatagggaccgtatataccttttaggatagtctggaggattaaataaagtaacttactcatggccaaacataccattctccccaatacacccaggcatttattcaacacctagtacatgtaagaaaaaaattaaaaaaaaaaaaaaaacagaaaaaaaaacatagtacatgccaagatattatgacaattacaaatacaaataaattatgatctttgacctcagcatacttattaactaaaagggaagataaaacaggcacataactataacatgaggctctaatcctggcctgactgacatcacaattatttgcataactgtctcccaccacattattcattgtagctatagagtcatgctttattcatcactaatttctctacccttctaacagtgacttgtaatcagcagagactcaagaactgtttgcttttcattgcaaggactgacatatttgagacagagccctgatgatgatgtgataggaggtggagagagaatgtggtcagagaggccttaaagcagagaaacatctgtatggttgcagaatggtggcataaatgagatacaaaaaaagctactttggaattcatgacaagcagatttcttctgactatgagtattctataaaggctttccagatatggtagcatttgttctaagactgaaagaataggtactagttggggaaaaggtcattcagatagaaaatagtcatgttaataaacgcaagtgtgcagacacaaggacacccacagtacacagtgggtttagggtggggacttagcaaggacagacttctccaggctctgccctccacagtccactctcctgcagcccctccctctagtggcccactccctgtagaagcatggtcttgtatctgtttttttcaatgtggtaaaacagacatatttatcatttaaacaatgtgtacagatacaattcgttggcactaaacatattcacactgttgtgtaaccatcactattgtctatacccaaaatgttttcaccatcaataacagaagggtgcccatcaaacactaactcccatttcccctcccccagccccagtaacctctattttactttgtctctgtgaatctgactactctaagtacctcgtgtgagtgaaaccacacattgtttgcctttcgtggctggcttattccacttagcatcctgtctgcaaggttcatccatgctgcagcatgtgtcagactttcctgcctttttaagtctaagtaatgttccattgtgtctacgtgccatattttgcttatccattcatccctggatgaacacttgggtggttctggccctttggctcactatggacttgctgctaggaacataggtgtgaaaattctatcctttttttttgacaccgagtttcactctatcacccaggctggagtgcagtggcacgatctcagctcaccacaacctccacttcctgggttcaagctattctcctgtctcagcctcccgagtagctgggattacaggcgcctgccaccacgcccggctaattgttttgtatttttagtagagatggggtttcactatcttggccaagctggtcttgaactcctgacctcatgatacacctgcctcagcctcccaaagtgccgggattacaggtgtgagccaccacgcccggcctacttctactttttaaaccccctcttggccaggtgcagtggctcacacctgtaatcccagcactttgggaggccaaggtgggcagatcacctgaggtcaggagtttgagaccagcctggccaacacagtgaaaccccgtctctactaaaaataggaaaaattagctgggtgtggtggcgcataccggtaatcccagctacttggtaggctgaggcatgagaattgcttgaactcgggaggcagaggctgcagtgagccaagatcgtgccactgcactccaacaagactctgcctcaaaaaaaaacccctctcttacccccacatctcccatcagccacagcccatttctttactctcttccattacaagatttgtctagcatgttttctacaaatggcctccacttcctcccgctcttcactctagaggtcccatttctccaatgttcaatggatgtggttctcgtggagctgaacccaccacttactgccagttcctcctcctccccaaactccaccggatgcgaggcagccctgcactgcctcctcagcactctcttgagaccctccgcctggtctctgcactctcaccccctcctcatcttgctcacactcctaactttaaatactacctacgtgatgaagacctccaaatgtatagcctgaagtctgatttctgctgcaagatcccctgttacacgcacaactgcacacctgatatctaagcctggatgcttcctaagtgtctctagttaaatatatccaacacaaaaggccaggtttctacaaaaaacccggtctctcccatcccattcagcttaggagtcactgcacagccctcagtccctcactcacagtctctcaatcctacactaactcacatcccacacccaacagcagtcaggcagacccctgtgaaacatctcttggcccacatccactcctttttgaaaagctctggctcccattccatctggaatgagatcccagctcagaaaactgtcaaacaccaaccctgcgtccttcccatctcaccctggcccactttgtgtacctccacactcttgacacaccagctcttgtggaccctcggaccactgcacgcaggctaagcacagggctagagactggccgagcatggggccaggtgctgagcagctgctgcctggaatgactgctcttcccagcacttccccagctgtctccctctcctccttctgatcacgacttctgcgttacatcctcagaaagtacccgtgggtcgtgtgctccacctctccaaattctggcattcctcttcactacaccccacctctgggcactgctgaaccccaaaatcagcagagctgctttatttgttcatctgtctcctccactagactgagctcatgatggtaggaacttggtgatttcaattactggtttaacaccaagttcatcactctttagatagatggcacccatggccaggcacagtgcctcaagcctgtaatctgagcacctttgggagggtaaggcgggtggattgcttcagctcaggagttcaagacaagcctgaccgacatggtgaaaccccatctctacaaaaaatacaaaaattagttggggccgggtacagtggcttatgcctgtaatcccggcactttggaggccaaggcaggtggattgcttgagcccaggagttcaagaccagcctgggcaacatggtgaaaccccgtctctactaaaaacacaaaaattagctggacatggcattgcgcacctataatcccagctacttgggaggctcaggcacaagaatcacttgaacgtgggaggcagaggttacagtgagccaagatcgcgccactgcactccagtctaggtgacagggcaagactcaagtctcaaaaagaaaaataaaataaaaattagcaggacatggtggcatgcacctatagtccccagctacttggggaggaccacggtgggagcatcatttgagcccaggaggttgaggatgcagtgagcccatatcacagcactgcactacagcctggataacaaagtgagaccctgtctcaaaaaaaatatatttgcacacacacacacacacacacacacacgcgtttatatatatgtatatatataaaaattttttttgagatggagtcttgctctgttgccaggctggagggcagtggcgcgatctcgggtcactgcagcctctgcctcccaggttcaagattacaggcatgtgccaccatgcccagctaatttttgtatttttagtagagacgggatttcaccacgttggccaggatggtctcgatctcttgaccttgtgatctgcccacctcagcctcccaaagtgctgggattacaggcgggagccaccttgcctggccttacaattatttttataagtcattcatacagtctgtatttcctgggtgccttgttttttttttttttttgagacagagttttgttcttgtcgcccaggctggagtgcaatggcgcgatctcagctcactgcaacctccgcctcccaggttcaagtgattctcctgcctcagcctcctgagtagctgggattacaggcatgcgccaccacgcccagctaattttttgtattttttagtagagacggggtttctccatgttggtcaggctggtctcgaactcccagcctcaggtgatccgcccacctcagcctcccaaagtgctgggattacaggcgtgagccaccgcgcccggccctgggtgccttatatatatgtacccatgaattagtatttagtgcttgaagtcacatgatcatggcatcacaaaaaaagtataaattttagcctcagaccaaggcttaaatcccagacttgccatttgttagctatattagtttcctagtgttgccataacaacttaccacaaacttaatagtttaaaacaatacagatttattacctataattctaaaggtgagaagtctgaaatgattctcatattgagctaaatttaaggcatcagcagggctgtgctccttccaagaggctctaggggagaacccttttctcacttctccagcctccagaggcacccccatgccttggctcctgccgccttccagatccccttcctctgacctcctctgtgcctccctcttccacatttaaggaccctgtgatcacaccaagcccatggggatgatccaggatcatctcttcagttcaaggtcagctgattagcaaccttaattccgctatgccatgaagcataacagggattaggatgggacaccctggtggccattattctcctaaccacgcaagtcactgtgtaacttggggcaagttacttaacctgtctgagtggcagtttactaatctatacaacagagacattttacctgccatgaagagtcattacaggaacttgccttgcaacacgtctagaatagtccttaacacacaataaatgagcactaagtgctactattttccttccactatatatgttcactgagtgctgatttataagccaagtaaacataaagacaaataagcaacatcacctgccaacagggtcaaaggagagaattaaacatatgacctaacaaacttaaaatatgaccgtaagtgctgtcacagaggggagtacagaggccagaggaagtgctcacctcaggggaatcataaatgcttcctaagaggggtgacagttgaaaagaagctgaggaagtgggagccataggatacaggagagaggagagagaagacacgaaggaaaattacacagggctactctaacaatcttgataagcaaggaagaaggcatgggtagaaacattagcttaaaatgaaactgctgcctacataggttaaaaaaaaatcattggatataagtaattttgtaagtttcaacctaatggaagaaaaacaaagtaggtccaaacatttggtaattacttgaagataaagtgataaggaggccaggggtggtggctcatgccttgtaatcccagcactttgggaggccgaggcaggtggatcacctgaggtcaggagttggagaccagcctggccaacatggtgaaaccccatctttactaaaaatacaaaaatccgctgagcatggtggcacacgcctgtaatcccagctactcgggaggctgaggcaagagaaaggcttgaacccaggaggcagaggttgcagtgagccaagatcgcgccattgcactccaggctgggtgacaagagtgaaactctgtctcaaaaaaaaaaaaaaaagtgataaggaagagcaaaggagctttttccctccccttaagattattttaggatcggccaggcacagtggttcacacctgtaatcccagcactttgggaggccgagccgggcagatcacgaggtgaggagaatgagaccatcctggctaacacggtgaaaccccgtctctgctaaaaatacaaaaacaaaattagctgggcgtggtggcgggtgcctgtagtcccagctactcgggaggcttaggcgggagaatggcgtgaacccggaagggggagcttgcagtgagccaagatcatgccactgcactccagcctgggcgacagagcaagactccggaaaaaaaaaaaaaaaaaagattatttcaggataaaaagttatatttgtcctttcaaaaaaagaaaagaatttcattggccaggcgtggcaggtcatgcctataatcccaatgctttggagactgaggtgggagggtcacttgatgggaggagttcaataccagcctgggcaacacagcgagactccatctctgcaaaatataaaaggagccaggcatggtggtgcctatagtctcagctatttttgatgctgaggtgggagaactgcttgagtcaggagttcaagactgcagtgagccatgattgcatctgtgagtagccactgtacttttgcctggggagaccccatctcttaaaaaaataaaaaaaataaaaaaactgaactttagcaaaacaagggatttttgtgtaccaaaggacataatcaacacagtgaaaaggcaactcaaaaaatgagagaagggccaggtgcagcggctcacacctgtaatcccagcactttgggaggccaaggtgggcagatctcttggttggagaccagcctgggcaacatggggaaaccatgtctcttcaaaaagtacaaaaattacccatctgtggtggcacatgcctgtggtcccagctacttgggaggcggaggtaggaggatcacttgagcccaggaggtggaggcaggcagagagccatgctagcatcactgcactccagcctgggcaacagagtgagaccctgtctcagaaaaaaaaaagaaaagaaaaagggagacagaaaatatttgcaactcatgtatcatgtatctgttaagaaactggtatctggctaggcacagtggctcacacctgcaaccctagtactctggggagccaaggcaggaggatcacttgagcccaagagcttgaaaccagcctgggcaataaggcaagaccgtgtctctacaaaacattttttaatatcaggtatacacctgtggtcctagctacttgggaggctaatgtgggaggttcccttgagcccaagaagttgagggtgcagtgagccatgtttgagccactgctctccagcctgggtgacagagcaagaccctgtctccaaaaaaaaaggaaagaaagaaagaaagaaaatgatatctacaactcaacaaaaagtcaaacaaaccaattaacctaaaaaatgggcaaaagatctgaacagacatttctctaaaggcacacaaatggtgagtacatgaaaagatgcacaaccaacgtcactcatcatcagggaaacggaaatcaaaaccacgagatatcccttcgcaaccattaggcattaggatgtctgctaccaaaaacacagaaaatgacaagttagtaaggatgtggagaagctgcaacccttgtgcactgttggtgggaatgtaaaatgctgcagctactgtgaaaaacagtatgacgatttctcagaaaattaaaactaaggttaccatacaacccaacaatcacaattctaagtatatatccaaaagaatcaacagcagggactgccaacagatttctgtacaacaatgatcatggcaatactactgagaataaccagtaagtagaggcaaaccaagtgcccatatacggatgaatgaatcaacaaaatgcagtaaatacacacaggaatatgattcagccttcaaaaaaaaagacaatgctgacatatcaggatatggacaaacctgaaagacactatgctaagtgaaataagccacacaggaaaagctacataccatgagttcatctgtgtaactttttgaaatgacgaaaccacagatggagacagatgaagggttatcaggtggccaagatgggggaagagattaactatggctctaagtcagtagcacattgggacccttgtgctaatcaatctgttcaataccttgattacaatggtacatacacgtgacagaattacacaaaactcgctaggtgtggtggctcatgcctataatcccagcactttgggagatcaaggtggacagattacttgagcccaggagttcaagaccagcctgggcaacataatgataccctgtctcaattataaaaagaaaaaaaaagaattaaaaagggccaggtgcaatggctcatgcctgtaatcccagaactttaggaagttgaggcaggcggatcaccagagcccatgagtttgagaacagcctggccaacatggtgaaaccccatctctactaaaaatacaaaaattaggccgggtgcggtggctcatgcctgtaatcccagcactttgggaggccaaggcaggcagatcatttgaggtcaggagttcgaaaccagcctggccaacatggtgaaaccccatctctactaaaaatacaaaaaaaatttgccatttagtggcgagtgcctgtaatcccaggtactcgggaggctgaggcaggagaatcacttgaaccagggaggcagaggctgcagtgacctgagatcgagccactgcactccaccctgggctacggagcgagactctgtttaaaaaaaaaaagaaagtaatttgccaggtgtggtggtgcgtgcctatagtcccagctattcaggaggctgaagtgaagaactgcttgaacctgggaagcagaggttgcagtgagccaagaaagtaccactgcactccagcctgagcgacagagcaagattctgtctcaaaaaaaataaataaaattttaaacaactgcacagaactaaatacacatacacaaatgtgtgcacgttaaactggtgagatctgacaaagctcagtggacaacatcaatgttaatgcccaccttgctgttgtgctgtagttgggaaagatgtcatcatcaggggaactcgggagggcccacaggtccctctagattatttctcactactgtatgtaaattcaggattggttaagagttcaaagaaataatcaggcattgctggttagacttacagtttttgaataaagaaaatcaagtgaagccaagcaataccttcttccatggacttagtgaagttgcacagaagtgaggacaaccccttcagacatcctgccagaacaggtagtttgggctctcttactgctgatgtcatctaaaagaaaagatttaagaagatgtcattacaagagaaaaacacaaccacatctatggaagcagaatgtcataaagttcatcatacctgggtcttaagttcacccagaaaagcgcggaacaggttttctgcattatttatcatctcactaggatgaacttcacccaataatcctaggagctcatatactttttctaaaactgaaaagaaaattttagacaagtgaaggcctcaaactacatttaaataagttaaactaaccaaaatgtatgaagaaaataaaataaaataaagttcaaaattgattttacagtaagagatataaaatataaagcttttaggactgcattctttcctaagttttatgcaaatgtattaatcatatttgtcatatcttgtgagttttctatttacaggaataattttgtaaaaattaacatttttgtgaagggaagtcttcacatgttgtttttgtttggttccattttggtttattttcagcaaaaagtattcgactgtaaaataagaccttggtagagaaaacctaagtcttatgctaataatttgttaatattaatttgctaaactatttgaaaataacatgtaaatgcatctcacctgtatctggtattttttttttcaatgcaagttctccatagaatttactaaataattctccaattttaaattcatccatgagtctagaacttctaaaagtctgaagtaactaaaagaatacaaattagtacatcaatgtagtgcgggaatcaagaaaaaaaacacaatacaaattagcattctctctaaagagggaaataacgggattcctctatctcagtgcatctgtccacagcaaaggttcagaattaggtgtgtctcaaggatttacacttggtctcacaggattcacatccacccagcttatctgggaattagaggttgagatgggtatggtggaagaacatcaggggaagaatgctctaggtgtgttacgttcccaagaaaccaacaacatgactagaacctttctcccagaagcctacaaaaccaaggagcaaccagaaacaaaggaattctaaaatacaaatacaaaaaaaacagaaacaggtcacagtgaccccaacaaccacttaactgcaacgtatcaactgattcccgccagacagtggctcacgcctgtaatcctagcactttgggaggcccaagcaggcggattacgaggtcaggagttcgagaccagtgtgaccaacacagtaaaaccccgtctctactaaaaatacaaaaattagccaggcatggtggcacatgcctgtaatcccagctactcaggaggctgaggcaggagaatcgcttgaacctgggagacagaagttgcagtgagccgagattgcgccactgcactccagcctgaatgacagaacaagactctgtctcaaaaaaagaaagaaaagaaaacatatgggccgggcgcggtggctcacacctgtaatcccagcactttgggaggccgaggcgggcggatcacgaggtcaggagatcgagaccatcccggctaaaacggtgaaacctcgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaagaaaacatatgaactctttcccattgctaaggttttaggaaaaacctcagagatataaggtgatctttcagcaattcctaatagcattaggttttgccaaagccagtaagggtgataaatgaaagagcaataaattccttagtcattttcctccttcattctcctcacaactcagaattcttcttttactacccagaagagtctgaaaacaaaaagccagggtattgtcaggtgatggttggagaatgtgcatcttacccacacatcaatgtgattagatcctatccttccccaaacacatcacccaaaacacaactcaaaactctgattttcttttaaaagttacatgtttaatgtaaaatacgtgtacttagaaacataattaccttaataagaaggtccagggctggaattttacatttagcagctctatcttttgtataaacactggtacaagtgttctaggttttaaaaaaaaaataaccaaaatcatcaataagatataaaaactaagactcagcaatacctgaaactacttctccaagaggagcaataccaaaattcagtatttagctgtggaaaatataacattaggccgggcatagtggctcatgcctataatcccaacactttgggaggcggaggtaggcgatcacctgaggtcaggagttcgagaccagcctggccagcatggtgaaaccctatctctactaaaaatataaaaattagccaggtacggtggtgcacgcctgtaatcccagctactcaggaggctgagggaggagaatcgcttgaacccgggagacggaggttgcagtgagccaagactgtgccactgcactccagcctgaaagtattcacgggactctgtggttcacgcctataatccctttgaggattacagtgtggttcatgcctgtaatccctttgaggattacagtgtggttcgtgcctgtaagcaatttgggaggcggagacgggaagatcacttaagcccaggagttcaagaccagcctaggcaacaaggcgaaaccctgtctctacaaaaaaaaaaaaaaatacaaaaattagctggacatagtggcacatcctgtggtcccagcaacttgggaggctgaggtgtgagaatcacctgagcccacgagatggaggctgcagtgagccatgattgcaccactgcactccagcctggatgacagagcaaaaccctgtctcacaaaataaaaacaaataaacaataaaaataaaaaaatacaaaataaaaattattattttttgagatggagttttgctcttgtcgcccaggctgcagtgaagttatcaagaggccatcagggccccagggagcccagggtgccactgccacctcctcaggaaaaaaaagtattaagatagttattaaaaaaaattatcaaagtagtttctctcacaaaggccttagcttactaaatctaaataactaatgggcaacaagagcaaaactccttctccaaaaaaaaaaaaaaaaaaaaaaacctaatgaagagcccacttcatttgtaacacaatgaagcagaaataagcaaattccccaatgagaaaggaaaatgttttatctttaaaataaaaatccaagttcctcacaccataagttaaaacagatgttgatatataatgtaataaggtatgttttttaattcttaccttaatttcaacagagtaaggtgcgatcttctggcccattttttctaagaaaatacataaaaactttaggatttcttctctacattcacgaaactgtaatgaaagagatacatattgtaaatatgggtaagaggagtcactccaggaatatacaagaaaagcaaaaccaaaattgtcaacttacttcaatactgttgagtgacttccggacaaatacaagcaaaccgaaatctctggaaaaaactaaagatgtctgtaatgctgttcaaaaaaataagtaaacaagttaagagagtgccaagagcatcatgtaaaccactcctaaaggggttgcaatgattttcttattattttttttgagatggagtctcgctctgtcgcccaggctggagtgcagcggcgcgatctcggctcactgcaacctccgcctcccgggttcacgccattctcctatctcagcctcccaagtagctgggactaaaggtgcccaccaccatgcccggctaattttttttttgtatttttagtagagacggggtttcaccgtgttagccaggatggtctcgatctcctgacctcacgatcagcccgcctcggcctcccaaagtgctgggattacaggcgtgagccaccgcgcctggccaaggttgcaacggttttcaaggcagccttataaatataaaacactaacccaaggttgctgtattaaaacaaagcagaaaattctagacaatgttccacagggatgcagtacgcaaaataatggccccaaagatgcctgcatcccaatccctggggtcacatcttgtgaatatgttaaatgtatatagcaaaaggaaattgagcttgcagatggaattaaggtagctaatcagctgaccttaaaatgggaagatcatactggattatccagagagcccaatgtaatcacacaggcccttaaagtaaggagatgaagaagagtgggtcagagagacaggaagttgggaaagcgggagattccaaacctctagttagggggacttgacatgctgttgctggccttgaagaccaagggaagggagctgtgatccaaggaaaggggacagcttcaagaagtatggaatgtcagggacctcaatcctatataacctgaatgaataaggcaatggatcctccccaagagccttcagaaagaaagcagccctgtctggtactttggttctagcttggtgagacctgtgtgggattctgactcacagaatcccccttacagtgggaactgtaagagtaacagacctgtgctgttttaaaccactaagcttgtggtaattgttacagcagcaataaggaactaatacacttcccctggaatctctcaagtgaaaggagatatggcataaatggaaggtaaacttggaagtgctttagaaacaagttactaaacgaacaaaaatgaattctaaatttgaaaccctgagaagagaaagtaatcacgcaatgttagttttttgtttgatatttccccattgttaatatattcttgacaacagatagagtacatataggatacatgtatatagcatctttttttttttttttttgggacggagtcgtgctctgttgcccaggctggagtgcagtggcacaatctcggctcactgcaatctccttctcctgggttcaagacattctcctgtctcagcctcccgaatagctgggactacaggcgctcgccaccatgcccagttaatttttgtatttttagtagagacaaggtttcaccatactggtcaggttggtctccatctcctgacctcaggtgatccagctgccacagcctcccaaagtgctgggattacaggcatgagccaccgcaccgtgccacatatagcatctagtttaaactgtttaagttattcctacaccatattcactactagaccctccggaagaaaatctcaccttttaatagggcacaacatcaaggtctgcatactcgtgttttaaagaaggaatacaggagatccacataattaagtatttgaatatttaaaatgctaaaaagaggcacttttactacaaaggggaaaaagttcccacccaggcattgctaaagagttaaaagaacatgacttcaattacatttcttcaatttttctcaaagtaggaacggcaaatagaggggtttggaaaaggtactggtgggattaggcgagattcaggtgaaagaaaatactttctcttggccgggcccggtggctcacgtctgtaatcccagcactttgggaggccgaggcggggggatcacgaggtcaggagttcgagaccagcctgaccaacatggtgaaaccccatctctactaaaaatacaaaaaaattagccgggcgtggtggcgcgcgcctgtaatcccagctactcggggggctgaggcaggagaatagcttgaacccgggaggcggaggttgcagtgagccgagatcgcgccacttcactccagcctgggcgacagagcgagactccgtctcaaaaaaaaaaaaaattatttctcttgccctgccccccactctgcatagcaatgattgccatattaggggtcgttttcaccaactttggctttaaaatatctttcctctaatactagggggtaaaaagcagtatgacaaatccctttatacacatacacagaaattcccccaagaatctaattgctgtacttcaaaataccgtcatctaaacacagagaagcgccgggctgcccggctccagaacgactcgggaagccaggacccacccgcggcccagctcgggccggtacccacccagcaccgcggggctgctgctcaggacgcattcctgccccaggccgcggatcagttgatgaccggccagggcagcaccgcagcggtccgcagcggacaaggtctcctgcagccgcagcagggagcaacgcacaccggctccggagcccgccatgccgccgagtcccgctcccgcgcgtgcgcccgctcggcccggacccggaaatgcccc

SEQ ID NO: 132 - DNA, 10927 bp, Homo Sapiens
ttttaatagtgcattaaatattttatttaaattaagaagtataacaaaatcacatacatttgttccacggtttgaataaaatttccaataactttcaaataatgcacacatagtatcgcatggatcaaattccgtacatttcaatatggtcatgagataggctgtattccaaaatttggtatataaatccatacataatatatactatatacattgactttaaataatctaactatgtcatttttaaaagtcaaagcaacttatttctaatgaaagttacaatatgcatgccatattgacacctattcaatagataaaatctaggaaaatcttttttgtgaatactatttatactggaatgcaaattcacataaaaatacttcctttaaagcatgttctatttcacacaagaaattaaatgtgagctacttttaaaattgcaagctttatttttaatcaaaccaattcaattttaagtttttagatcattaagtctcatacaacttcctctaatttagctaaaaccatcgacagggttttattgttacatttggccttaaccttaaaaaacaaatttgtttacatttcatatttaaatgggacattttaaaccctgagtaaaaagacatatttttacaagtccagctgtaacaattctaccctattttcttgcagtgcttttattagataaaaactattgttaacgttttgactttttagaatatactgtttagaaggttaatgctttttcatgactttaaaagtttctaaatgtattttattagtatctaagtaaaaattctagatttctatatggatattataaaaacacctcttctttagactgtttatttcaccttgatcataaaaaatcattgaatactacattcaagataatttttctttcttggctttgggctattgtcttttcaaccttaaaagttaaaattattgttttcctatatgtaatgatactttttaggcatagatttttaagatacaaaaataaaatgtagtttagtattttatcattaccacctgctgcaatgagtctgccagatcagaggctttcctcactaggaaacctagctttaaatcaaatactggttttcttcttgtaattcacacttgtctattgaatcagttacccaactttcttttaggattttaaactttctcttaaaagttcttctaaaagctttaaaatctgcaacacgactatgatcttccccaattattacatgagacactccctcagctaaacaagaaactacttttgctccatgaaaccgaagctccaaggctttaatagctaaccttgtcccctcatttttggtactcaggtcattaataacagcatacgagtccaaataaacggtgtggcgtcgaaacatactgagaggagagcaatcccaggaataccgatattctaaatcagcaatcagagaagccatttcttcaggagtctgctcgttagaatttttaattcctgagaatacttccttcagttggttcaagtctgtatcaatgaaataactatcaccatagcaatcatattcacgggcaaaatgttctttggttgatgggcacatatgaatcataaagcgaggctgccatggtacaaagcttttggtcttaaaacattctaaaagccatgcaggcttgacaacatcatgtttatttgacaaaattatgtttttcactctgatgttctcagaccctgcaattacacagtacgtgtctgggcctggattttgtactatataaccaccaaattctgcaattctgttctccaggtcaggctttggctggctatctgttccactcataacacaaaactctacatcttcaaatatattagaaattttgttaacgttagtaaggttaggtgcttttaagtgctcaataattccaataactttcttcatctttggggcagctttccgctttttttcttgtggttcatcatcaccacctatataaaggtgtttagatgcgagcttaccagatgccttccccctaagttgttctaggtcgtccagggtcatgcactcatgccactccttgtcatctcttatcttttcaattcgtggaaaacgcaaggtgcagccagttttatacatatcactgggtacgatctctgctgctttaatctgaacaatgacagaattacaaggttcaatgtatacttctggcttctctgttccacataaaatgctgcttggtggagcttttctatgaaaaggcttccaatacttggccaatttcaaacccagatcatacagttctttcatggtgcagccagacccaacacgagagagagtatgaaacacagatggcttctcaccaggagggggcttctctgctactgcacacagaaaatgagacatcattccaccccgtgatcctttaccccaatatcctccaacaattaaaatgtccaattcatccattagtccactgacatactctggtttaatttttaaccacccttcacctcttttgtctggcttgtagatggatagaggttgttttaccataattccctcttctcttttatctattgcttcattcaatgcatcaattacttcattcttagtatgagcttgtgttttctgcactatttctattctacctggaattggtgtaaaaatactactaagaatctcatacctctttctcagagtctcatgccctagctttttattattaaccatcaatacatcaaaaacacaataacaagtttgcagatcagaatcctctaccattcttttaatatcaaacttagttcccttttgcatgaaagtttgtgtattaggattataggccatcatctcaccatcaagaatacagatttgtatatctgctttgaatgcattatgaatgaatggggtaagagaaccttcagtaggagaagcaccaaactgatcagtgtagttatatccatttcgagagaagtatttatatacatctccatctttgtgcatttgcatacgttcaccatctagcttggtttctatgtagaaactctgatgtttcatatccttctcaatgtgctcaatatctgcaatagcagctagcattggtttaaatgcagaaaataaagtgatagaaatatcactgagtcctacagaaggatcatgcagttgcctacagactttttccagatctgtagtgacattatgcaactcagcagcatcattatgaaaaacagaaaagatagtttgctgactaacaccaagctttaaatcctttatgatcatccgtataagccacttttgctcaagtgctgaactctgagttataagttgaagaaggctcttttttattaggtcttttcttttagcagaattattgctggcaattgagtctaaaaggtcgtttacttgctgtatggttaaacttcctttctgtaaacatcttggcttcaacacaaaatatgcaatcattgcaaagtctccagcatctccatgagttccagtgggtgttctgtagtttaaaagtttgagggcatcttttccatctctaggtaaattaagcaactcaatataaagcttagcaagcatagtttctttaattccataggccattctctctctttctagctgaggaagaattagtctcattgctggataaaaagagtctgtgacatctttgtggttcttatgaagagcatcatgaaattttctccaagaatctaaaaattccctgaagtgtctgattttttctgcacgtcctttacttttctgtattcgttctaaagttgaacacaaatctgcaaaaggaacgtgagatgcaacagtttgtgaagtttgtgaggcagccatcaaagcggtgatgaatcttctcgtttaactagtaaagcaaaaagagaataactttaagtaaaagataagattcaactaaatatttaatgtaaagatcttacaaagatcactgagatcataataaatgtttattaatgtttactaaaaaaaagatcaatgctctaaatgatgtatcttttcaacctctacatttaataactgttttgctccaaccctaatttgaagttattatgaaaagtatcatcagctatatagctgtatttcctgtatttataatacagaaatcattttaattttctctttaaattccagttattctatgtattaattatttagcacataatacaaacaaatattgctaataatggtgacaaaaaaactcatcaggcttaattcacttcacttctgagcttctgagggaaggcctttcatgtatgtctcttctttccctgtcagactaccacatagcaccagaaatgaacttgatcttcgaacagatatttttaacaaatcactcatttgctgaactgaaatttgacttcctagaaatcctaatcataggcagggcccttgaccaaaaaacaaaacaaaggaaaaaacaggtaccctcttcttccagccaaacaaagcctacgtctatgtttcctttcacttcttcactgctagctatgccaaatcacaccagcattcgattccaactcaaaatgccctacccataaaatcctcactttatctattttaccatagttacttactgtcttataagtataaatttattagtatgctgcttttttcatatttccatgccagttattccctgagtatttaatgactacatatgagatgtgctacatacactgtgctaggggaaaatactgcatgtttctgctttaaaagaaaatatattctgtaaaaaaaaaaaaagaaaaaaaagaaaagaaaaaaagggggggagtgtagtggaaactgagtataataaaatgccaagtgctttaacaaaataaaacaaacgtaaaatgtcctgaggggagagcttttccctaaagtatctgctaaagtcagagaagaaataatgggtaccttgctaagctagggcaagaatatttcctaaaatttcacaagtgtaaatttctttagttttaaatattcatacaagttctactggaagataaatatattagagtaattttaatatggtttaaactatgtaatgttaaataacttttccaaaaaaagatttcaagtaaaatgtatggtccatgaatagaaactatgttttatcctgtggtttcagacccctcctggcacaccaccatgtatcccaggcagtggagttggagaagttttgctgggagtggggagatctattacagtgcagaaaatatgtgactccccatcttccaattcgcaaacaaatgagcaacacacacatgcacaaggctacattatctagtatccagtaaaataaatcaaatggctaattacaatactacatttactatactgtcagtatctagaggccaggaattgtgctgtaatttgtgctctagtggcagacatgtaggaggtttgctgaatgaattactgaacacctagagttgactcctggataagcacactagggaaagctatggtctggttacataccacacactcacacacgcacgcagacacacagtgggtgagattcagtttggttaaaaatattcagtagctctgactgccctggcaatggtttacaacagccatttggtggcctatagagaaaaaaggtgcacttctcagtctaatttctgacaaaggaaacccagcttctactgagtgggttagatcgagggataaacgcatgacagaccactttcctgaaacttttatctttgaatatactgttgtttcctctctctgaatctggtttgcataactgactgtaacacctggttatgtatgttcactgccctatctcccaaaatttgctccctcaagggagtaaacagggtacacaatgctatatctacaatttctatataaactatgtaaaataaagtaggttaactaatatttctttaatattcaaatattggtatatagtttctacagatatatctatagattctacatggtctcaaagttaaagtttcgctcaacaaatcccaggcaaggacttaaattactttataatgacaaaatgtaggtaatggtgtggatacacatgtatcctaaaatggctacgcctataacaaggattccaaaattgccataaactagtcgtaagtatttttgctcattacaacggcataaaaagtcaaagattaggacttccattcatttttacatgctaattttattttttggattctgaggattttagctgattcattccatttgcagtaagacaaatgaggaggttcctggttagggctcaggttttagactctaataaatctgagttcaaatgtggatggtaacatttaacagctgtgtgatactgggcaattacttaatttctctaagcttcagtttcctaaagtataaaatggggttaaaaactatgtagaaattagaatgaagataaaaatcagataatctacaaaatgtgctttaaaaagtagtaagtcttgataattttaatactataatgcttgctgatccaagcaacatttaaaatataaatattgcaaaatattaacgagataaaaaggtgggaagaagcttcactctttaacaataagcaaagctttcaggagaatgaatgcaagcaattagtacacaataacgattcatcattcattcagttctgactaaattgtcctgaagtgacacatgaaaataaaccggcaggttttattcagtgactatggaaggtgattaagtgctatgctattgcacttaaaaaagagagaggaaaaaaaggagtaagtgacgaatgcaactgaagtatccttcatgcaacccttgacaagctgtgtttccctaggaaacaaagggtttacagctgcctatcttccacagcacttagtgacaatttgggacaatctcagcaaaaagaaatgagcagacaaagacgctagaagggctttgggatcccaaaagttaatgaaagaccaagtgtaagaagagaaataaagtaattccctccaagcctaaagtctctcccgctccaatgccccctgtaccctctcggaaaatggaaaatccctaaggagtctacatcattcctctgcccgttccccctactctcccccaacccttcacggattcccagtgaatacctggcctcgggcaagctccgttacctctgtgaaccagagaatcccagctgtaaaatgagatcttgatggtttcctgcggggttgccatgagaaagaatcaacatgtacgcaggtaaagcaggcaatacagttccagggagtcaaaaacgggagaaatcgtcccacgacctggggcttgggtctagatgaagagcacagcatcaggaggccaggcttctaatgcggcgcagtctacagcgctgtggactcggcaactcccatcacctgccgctgcacaaacaccctgcttgctgcccccatagaccgacccccgcctgacgcctcccagacccccccacctgacgcccctcaggccccccgcctgacgtcccagacacccccacgaccggatcccccagacccccaatctgacgccccacttcccctacttgactccccacacatcccccgcctgacgaccccccgacccccgcctgacgtcccagacaccacccatctgatcccccagacccccaatctgacgccccacaccccccacttgactctccacacaccccacacctgccaccccacgtaaaccccgcctgacacctcacagaccctaacctgacgccccacagacctcccccgcctcctgccgccacacacaccccaaaccccgccccgaacaccccccacctgccgccccacagattcccccctctgacgccccacagacccccaacgtgacgccctacagaccccaacctgacgtcccacagataccccgcctgacgccccacagaccttcccccggtctgttgccccacagacttctcgccgcctgctggaccacaccttccacttgactccccccacaccgtcaatctgccaccccccaccccccccaccccaaccccccccaacctcccaaccgcccccacctgccaccccacacccttcccacctgacgtcaagcctgaagctcagccgctaagccggaagctggcgccagaagatgccggttccgccagctgctcgccgcgcaggcgcaggggagacccggggccttgcagtcaccgggctcaagcacgccggcgcagccaggctcgcgatgggaggtgggggggccggcagccccgtggggctgcggaggcgggacctgcaggatcctggttagggtcttgagtacacacggctcctattggcctcggcagcagatgctctctgcaagcagttgatccacacgccagtggattttgtctcgagggagacctaagatcactttgtgctctggctagtgatagcctctaattcttgttctctgtacgtaaaacagtggtaactatactgatttcgctggttgtgaaaactcccaagagagaacaggacatcctcccaactcaaaacgttggttgtttcatttaaacttttaaaaaataggcttttgcaaactatatagagctgtttttttttttaaatgatgtttgctactgtggtctcagttctcttaatacagaaataatacataacaatacataacttacaatatagaaataaaccgttgcatgaccagaaatcaactatggactcttctagtatctgtttaaggtttaaaaataaagttatttaacaaacctttattgagcacctattattatatagtaatggtgctagatattcagggtggagagattataaacaaccccagtttttgtgttccaggagctgttggtttccaccgaatttttgctgtggtcagtcctctttcgccatggagaagtgagaagttattcataaagaggggtggaaacaacttttagaactattttattttagcataaaatattgctttacaataaaataaattttgctgcagtgggccctgataaaacatattagagctgttaagtgcccttagaggttgtgtaatgtataaaaacctcctttttcaaaactgacacatttcattcagtgctagtttgtagcggaggttccgtctagcccaagaacattcagttatttacttcgtatgtctaattgacctaatatgcctgaatatctaaaatcatctgtgatgttgtaaagtctcatgatattgttttgtgagtatctgctcttcaatttagttatcaatttattttggaggaaaaatgaatagtgttaaggtagaggagcctccacttgcccatcttaggagagggtacctatccgtgtacatttgtagcttgttcaacctctactgagctcctacaatgtcagaagctggactttgtattagttacatgagaagaaccatgaattatgaaaccaggcaaactccaaattgattcaaagcccagtctccatttcatcatgttattttagttgattggttcaaagacaatcaagggtttttttcactaagtatcttctagagttgccatgattattaatttatttatgtaaatggtctactttatatatgcttggcacttattccgtgatcaagattaggaagctatgattcaagaacccagctttgacctggagctctccatctggtagcaagacacatatgttcaataacaacaacaccacaggccgggccagtggctaatgcctgtaatcccagcactttaagaggctgaggtgagcggatcacttgaggtcaggagtttgacaccagcctggccaacatggtgaacccccgtctctactaaaaaatacaaaaattaggccgggcctggtggctcacgcctgtaatcccagcactttgggaggccgaggtgggtggatcaccagaggtggggagtttgagagcagcctggccaacatggtgaaatcccgtctctactgaagaaaaatacaaaattagctgggcgtggtggcgcatgcctgtaatcccagctactccggaggctgaggcaggagaatcgcttgaacccgggaggcgggaggttgcggtgagccgagatcttgccattgcactccagcctgggaaacaagagcgaaactccgtctcaaaacagcaacaaaacaaaaacaaaaagtagcggggcgtggtggcgggcacctgtaatcccagctaggtcagaggctgaggcgagagaatcgcttgaaccagggaggcggaggttgcagtgagccgagatcacgccattgcactccagcctgggcgacaagagcgaggctccatctcaaaaggaaaaaaaaaaaaacccacagatttatgaaatatcctctgtatatataaaataggggacatagaataaggaaagcccaagggaggggaggcacacatctgtaaacaagtgtgtacacttcagtgcacaggggggttgacagcgaagctaatgaagcccaagttttaagggcccatttttgcgaacacttccaaggccttgagaggggccctaacgaggtgttcccatggtcgtgtacctcggtaaaatttgcaaaaataagacaattttacattatttttctttaaaagggctctccaaatggcacaaggttcaggcctcacaaaacctgcattcgcccttgacagtccactctcgtagaggtaaaaggagaaaaatagttatggaagcgctttaaatcgtggacctcattgcgacacccttaacaaccctatcaggcagaacaaattgctccgcaaacctgcggcttgcagagcgatggtggactcccgagctcatcgggtccggcacctcttcaccacggaggcctcgggtacggaactggagggagtcctggtgctcggaggagggtggaaggccaagatccctaggtcctggagcagggagccgggcccacgccgccgaggtatcttttccgtccgggccaccgtcgcgggggctcactggc

SEQ ID NO: 133 - DNA, 292925 bp, Homo Sapiens
ctccagccgtccggttgggcttgtcacggcaccgcctaccaagacgggcggttaagacactaggataggctcctctccaccggaaaaggcgggatttagatcacgtcccgcaggccggcggaagtagctgatactctcattggttgcaaaaccttgatctgtgaaagcgggcgttttggaagataccggaagtagagtcacggagaggtaggatccggaagtggggctgcctctttaaataacaaaaatctgaggttctgttctttttatctttttgctttctttttaaaaaagttccctgctacttacccctagaactccacaatgcgagaatccccctcaatttgtgagctcccgcgacttcctcttgtgggcttttggggatgctagggttctcggcattatcctcagggtgcgacctgttcacccccttttcagtttctccgtttgcatctgagggattcttgggaatgcgaagcacttttgaaatgctctgtgttggttgtgggattgggaggacggttgaatccagagggtagtgttgagtaggctgtttgagcatttccccagcactggcctgtcctttcaatccccagatattggtaaactgtgggttccaaccaggcatcgaggctgaaacgtactaggcaatttgaggtcaggaaagaactttctgtggtaaccaatgggaaggaactgccgtttgcggactgcagcgattgattaggtactttaaagagatcaactggcaagacaaatgacaaggcaacttttaatcagtagtagtatttagctttttctgattttaattatcccattaggtgaggttctactacacacacacgtttttctttctgcattttatcgatggagaaacaggcgctttgacatgtttgaatttgcgtagttcttggaattctaataaagtattagaaatgagagtttttcactctttgcccccttatggcaagcttttggttctaaatgtgtggtgtattttttctcaggcaggagagagttcttttcagaatgttttcaattttttatggacttagaaggtggatagagagaaagagagaaggtaactcacgtgagattttggtttatgaactgtattcggcctatgagacccttttgtatttagggcaacacaatgattagaagatttgggattctgctatttgtgtttacattgttcactagggcacacaaaggttttgttttaaactataactaacttgatatttgagtctgttatattgaattgtcaagagttggtcaaatacacaaattagcaagtatttactgggtgcctgctttattcatggatcttcagattgcagcataggaacaaagatggtctgttcctttaaggaatttaataaggttgggggagaggggaataagaaaggtatttaaaagatacagtactctccacctaaggataaaaaaagtcttttaatgttctgtcttgtaattcctttatattataccttttaggtcttgccattcaaattaaacaaacctggtttagttatggaaattatgttgtgcaatttatcgagcttggcttttagggcagtaaatgtgtctgtagacataactgcccttggtttcatgtgaagattgtcttgatctttgttacatataaaggtaatacttctgtatgaagctctgcttcaggctacctgtgaaaagcatcagaaagcttaacttgttagagatcacaattgatttgctatatctatatattttaattaattttaggctatgacttcttatgtacctgagcttcaaaacagtaaagaacggcattgccagtttttaagttatctatagagaaacacatatgccaataaatgaggctgaacaaatatgtataatgtttattgcatttatgtaaaacatcaaagttaatctgacgtggtgagttttttttgggaggtggtagtttagctccattgtcttacataaaccccctactttttggttttcagattatatcacaatttctaaaatctttctggcagctttgcagtgaatcctcatttaaaaccatcttggatcctttccttactagaaataaaatctgtctgtgttattcctttgttcaaaaattattatttatttttatttttgagacaggatcttgctctgttgcccagggtggagtgcagtggcacaatcatgactcactgcagcctcaacctccagggcagaagcgatctatcctcctccctcagtatccccagtaaccgggaccatggttgcatgccaccatacttggctaattttattttattttttgtagagacagggctcactatgttgcctaggctggtctcaaactcctgggctcaagtgatcctcccgcctcggcctcccaaagtgctgggattacaggtgtaggccaccgcaccacgtctggcctgttcaaaaagtattatctcacctgcatctggaagaatatttccaactttggtttcatgggtatattaaaatcgtatgtaaaaatagtggatatttgtagttttctgtggcgccagtgcacaggtgtcctcagtgttatgaggattacatgagttattacaagtaaatcatctaggcaaatgtttggcatacagtaagcactcagaaagtgttggctattactgtgcatggctttgtctttgctaaattaaaagtccctggagaggaggaattataatggaggaatggttgaattgcatatattaggcactaaatacagtagtccctccttatctgaggttttgatttctgcagtttcagttacccatgatcaaccacagtctgaaaatattaagtagaaaattccagccgggtgcggtggctcatgcctgtaattccagcactttgggagaccaaggcgggcagatcacttgaggtcaggagtttgagaccagcctggccaacatggtgaaaccccatctctactaatatacaaaaattagccaggcgtggtggcatgtgcctgtagtcccagctagtcaggaggctgaggcaggagaatcaattgaacccgggaggtggaggctgcagtgagccgagattgtgccactgtactcctgcgtgggcaacagagcgagactccatctcaaaaaaaaaaaaaaaaattccagaaataatgcatacattttaaatagcatgcctttctgagttgtgatgaaatcttattccatcctatcccattcagcccggggccatgaatcatctccttgtttagcgtatccctgctgtataagcttcctgccttttagttgcttggttatcagattgatggaggtggtatcacagtgcgtgtgttctaggaatacttattttacttaattattgcttcaaagcacaagagtaacgacgctggcaatttggttatgccaaagagtagctgtaaagtgcctcttttaagcaaaaaaaggaaagttctccacttaataaggaagaaaagaaatcctatgttgatgttgttaagaactatggtaagaacaaatctatctgtaaaattgtgaataagcaaaaagaaatttatgctagttttactgtcacacctcaaactgccaaacttatagccatagtgcattataaaagcttagttaagataaaaaaggaattaaatttgtggttagaaaatgtgaacagaagcatgctcagattgaaggcagttggattcagcctcctcacggggccttgggatatacacccttggataaggagaggactgctataaaaggttttagtattaagttggtattgcatttgtatcaccagaccactttctccccattttctctttttactttgttgctagtgttaatgatagggttgatttacattaccttttacattacctaccttttttcattcactgttattcacatatattgaaagacaattgttctgcttttttcctcttatcctcagctagcctccctaacctcaggtagaggtttttcatgttccagtgtttgtcctttttttctccccccttgtttttattcccttcccacatggcttttcaattcagactgaaatgtacttgaggaccaaagttaatacagttttattctgttagggatttttgttaaataagtagagtttcagctgcccttgtcacacacaaaaaataagatagatgataggtgttaatctccttgactaaaataaccattttactatctgtgtgtatcctataatgtcaacttgtaaacctcaaatatacacattaacattttttaaaaaaagaagtttcaccaaaaaagacacttctatttaatgtatgtcttatttcttttaccttaagaaatgtttctcttaacctttctccattttcaaccccatttgtttgctcttctctgcaacaaaaatcctctaaagagttttctatgctccatgttccaattcctctttttctacctctgcatcttcattggtatatttaaaagatatcttgaactcagatgtcccagaccgaactcctttcctcccaaacctttcccattctttctcatctgaattgatggcaactttatacagccagttgctcagttaaatctttggagtcatccttgactccttcctttctcttgtattccaacaaatctgttggctttttctatgaaatatatctagaattcaacagttttctactatttctgctattagtatactgatcatctcttgctcagatttttgttattacccactatcatttcttgcctggattatagtaattgtgttctgttctctctgcttttttcagtccttgcctccctacagtctattctcatatgtcagccagagtgatacttttaaaatataaataaaaaattgtgtatttacatgtaagattctaaatgcaatatgttatgctagattggatcctgaaacagaaagaggttattaatggaaaaactggtgaaatccaaataaagtctatggtttagttgatagaaatgtatcagtgttggtttcctggttttgataaatgcaccgtggtagtataagatgttaatattagaagaaattgggtgaggggtatatgagaactttctattatctttgtaacccttctgtaaattcagaattatttcaaaataatatacagaagaataaaacattacttttttgcttaaaaacctttcgtgaatcatttgattcatagtagaagctaacagccttacgttggcctacaatagtctacatcagtcttgtccaacttacagctcacaggctgcctgtggcctatgatggctttgaatgcggcccaccacaaatttgtaaactttcttaaaacattatgagatttttttttttttgagccctttaggtatcattagtgttagtgtattttatgtgtggcccaagacaattcttcctccagtgtggcctaaggaagtcaaaagattggacacctctgctctacatgatctggtctcccattacctctctgactacatgtctttgtattctctctccctttgttccagccatacttaccaccctgtttcttaagtacactaggcctacttctaccacagggcctttgcactgactgctgcttctttctagaatgcttttggatccatacagctattccttcatagcttttacatgttgttcaaatgtcacctttgcagtaaagcatatcccaacctccctatttaaattgaagctttgcaacttccatagcccctacccctatctcctccaccctgttttatctcctctttttacttcagcgcttatcattattctatatatgtattacatatttgttacatgtatttttaattgtgttcccctattaaaatgtaaaatccatgaaggcaggcatttttatctgttttgttgtcttatgccacattctaaagcatttgtctgaggcatagaagtactcagtaggttttgtttgaatgaatgactgacttgattgggtgtttgaatctgtaatttttttttttttttttttgagatggagtcttgctccgtttcccaggctggagtgcagtggcacaatctctactcactacaacctctgcctcctgggttccagcaattctctcttctcagcctcctgagtagctgggattacaggtgcatgccaccatgcccagcaaattttttgtatttttagtacagacggggtttcaccatgttggccagactggtctcgaactcctgacctcgtgatccacccgcctcagcctcccaaagtgctgggattacaggcatgaaggtgctgggattacaggcatgagccaccgcatttgaccatgaacctgtaatttttgatttgcagtctgaaacactgaattatttatcacttccatgtatcatgctatttcttgcctccaagtttttactcatgcagactcttctatttggaatgcccttccttatctttcttcctctacccctaagttgttttcacctgaccatttctctttaaagattcgtataatattagatgtaactcaaggaagccttccctaaaatgtcaggccagggtaagtgctgcttttcagaggagctcccttcctacctctgcattttacaaacttatattataattctgtttgggtgtctctatttcagtagagagttgcgaatgtgtcttactgatctttgggatatcaaatcctggtacataggaagtaatcagtgaatgttttaatgcattaatggcatgatcaaggacactcagctatgaagcatagttttgattccaacctgggtcttttgagtgtaaaatcaatggcttatttgctataccttgtttcttaggaaaaagatggctgtctttaaaataattgaaaggtactgtatccttttgatacaagtaggagggagttaatgcattgtatagccctggacaatttgctccttgttattgcggaagctgccagccctgatgaaagtgagttgtgcctttttctaaggcattggctgaaatcattgatcagggttcaattgcagacagcaaatttttaatgttgatgaaattaggcacttttggggaggaaaacattcttgagatttgtgttgccaaaaagaagaaatacttgccaaagaagaaatacatgccaaaattccaaactgttcatgaggcatttatgtttttgctagatgccattactaccagtaacttcatgttacattaaacttgtgtaccattgggaaatcccagagtgtttaaagatgttgcaaagattttctttcagcagtaccgaaatttgctcttaagattgatttaattatgattagtttgttaacagtatctctgacacgtagcacaaaattaggtaaactaattttgcgtttaaaatactgtttgtttaatcctagataatgagctagacttcccaactactctttatgattggcatcctgagttcaaactgccttctgaatattatcattattgtcgcagcctataaactaaagcagttttatcttcacctagcccttaagactaacaaaaaaggaaatcgattagctctatagattctgaaaaggcttccacattagtaatgtcgttgcaaatgataattaggcttgagattaagtaatcaaaaacaaatattacctggaggacattgtatcctgaatttgtgttcatttccatagctttgctaatcctacagaagtgactaaaatgttgaagtaagcaaagagttcaatctggtcttgtgtgagagaatgctattaacttacttctaattttacctgagcagtgaatgagaattttattggataaagaaggaacttgctcatttgaaacagaagcacatggctgctaagaaatgagatgcagccattgttgaaacctgtcaaagtcttgacagtataaatattgacatgctgagacatgtcaatatttaccatagaatttggaagttgccaagttcctgtttaagaaatgtgaccctagcattggacacagtatatcaataaatacggaacatgtccaaatgaacagctgctcagggaaaataaaattacatctgtctaaacgttggggcacttaaaaagttaaagtttaaatgtttatgattttttttgtaatttttaggtagatgcttgtatgatatagtatactaatagagttccatgtatgggtttaacataaaatgacagtatcattgctatttataaatttgtaaattagctgtgctgtgatactcatctataaattgaattttaaaaacttgccaagtgttgtgtttaggaactaacccttcattttcaacattgttcttaaggagaaattggctcatgatgacttagatattaatttggggagacaaaagtttatactctgataacttcttaaatggcaacatagaaaatagaagtttttgcactttagatgtgataagggaatatgaccttgttgtcattatctgacaagcatgtctcagtagaaaatcatattatagatcaccactgttaattcccatctgaatatcactgtattttaacaaaaagctttttgatgcaaagtagacatttgagcttttatatcaagtcattagaaccacacaatcttacattgttttgcggacttctagaagaagtttaaacttagcaattctttgaacgacagtcctaaaacaatcttaagaacataaaacatgggtatcaggacttgttttctcattgcttctcctttctaatggtagtgataggtggcttttaaatagtaatctaatcatttaaccagttcataatattgtatgagttcttagaagaaatgaatgatttattaagtccatatagtagcgtacattgtaattagctatagagttgacccttgaacaatataggggttagggatgccaacctctcacgcagttgaaaatccatgtataacttttggctccttcaaaacttaactactaatagtttattgttgaccagaagcctcatcaataacataaacagttgattaacatatgttttgtgtgttatatgcattatgtactgtattcttacaataaagtaagctagaaaaaagtaaatgttattaagaaaatcataatgaaaggaaaatatatttactattcattaagtggaagtcgatcatcataaaggtcttcattcttgtcttcatgttgagctggctggggcggaagaggaagagaaggattgatcttgctgtctctgggctggcagaggtggcagaggtggcagaggtagaggaggtggaagaggaggcaggagaggtggacacagttggtgtaacttttattgagaaactttagagtgtaagtggacccacacagaacaaaccttcagttgttcagcgatcaactgtgtatgtgccttaatttaatttctcagtttttatctagttttttttttcaaaaacagttttctaagacattggctggttctctctctttctcattttgtcctgagtcaaagaaatcccttagatattaaatcagacatacctgaactgaatgttcgtacctaaatgcctaaccatgatctttatgttcttgaatgttctaatttggttgaatttttttggccatcagctaaatagatatctctgttttatataacctctaaacaaggtttaattaaaaaatcaggcatttctaggccaggagtggtggctcacacctgtaattccagcactttgggaggccaaagcaggtggatcaccagaggtcagaatttcaagtccagcctggccaacctggtgaaaccccatctctaccaaaaatacaaaaattagccgggagtggtggtgcatgcctgtaatctcagctactcgggaggctgagacatgagaattgcttgaacctgggaggcagaggttgcagtgagctgagattgcgccactgcactccagcctgggcaacagagtgagaccctgtctccaaaaaaataaaaaataaaaagacatttctaaataacaacagccctataaaatttgtcctggttggctgagcacagtggctcacacttgtaatcccagcactttgggaggccgaggcaggtagatcatttgaggtcaggcgtttgagaccagcatggccaacatagtgaaaccccatctctactaaaaatacaaaaatcagccaggcgtggtggtgcatgcctgtaatcccagctactcagtaggctgaggcaggggaatcacttgagcctgagaggtagaggttgcagtgagccgagatggtgccactgtactccagtctgggtgacagagtgagaccctgtgtcaaaaaaaaaaaattttttttttcctggtcatagcgtgttcattgtttcagcaagcaagatgtcatactaaaatacacaaaaaaattaatacaatcttatctttgaaaatttagtaatttactctttttttggtgtatgtctcttctttatttggtttggagctacatgccttgttaaaatgaaaagcatgtacctcatttttctggatattttgtatttctgatgtttcactgggcagtcttgtaccttggccaaagtggaatatttatgcaggcagaattgaatttaataatatacatttcaattgttaaggaaaaataattttcaaggcattggaattgtattgtcgttgctactggtgaatctactagttgattgttggtatttcattttctgaacattggattcctcaggcaaaccttctcttatacctcttatttttgtttatattggtcctgtaatttttttaccttagaaaatgcagcatctttttatgtcatttagcaggtatttgatgtatcttgtcattattttattactactttaactctgctgtagcaaaattctatactaccttgtatatatttacttattttttaaataactaacaagtttaattataatttatatagaactctgtattgtcatgttctcctaagtggatgaaaagtttctggagagaaagtgtcattactttttttttctgatctgctagagttctcattgaacacaaagtttgcacatactgcttccttaatgaatgactggtagatggagtggaatttttacaactgacgttctgcaggttgatttcagttcgttatttcaacttaatgggaaatttttaaaacatattaagtgactatgaaactaacttgactgaatagcttttcagatcagcattttaaattttgctgtgcagaattgcttctcttgcacaaagtagtgtggcttcatttgttaataaacatttcattaattcttttggggaagtgtttgattaaaaataaatttttttttctaagacatgtaacattcccagcttctccctaataagaaaattattcatgatagttctgtagtttgaagattgttgatgcatataacatttccaacttccttctaataagataatcattcttgattgttctgaagtttaaagattattgataatttgacttcattttcacttcattgtactttataggcaggaacatgtttgatttagtgctatttcagaatcctttgaagaagtctgacaatctttttaggattttgtttcaaaattgatattaagttgtagccataaagaggccaccaattgattaatctttctgatcaataaggtaatttaaagatactcttttagctgtgtgaccttgtttcactgctgcctgctggaggtggttgccaattttgcaggtaactaagtgctatcagacactacccttgtagaagcacagcctcctaaattgtgataccttgataacaaatgacttctaatctggattaattttgttgcttgcttcattcaaatgttggagaggccagcacatgggaatctaacagaatagtactagaattctgaaactatcaaagttccatttctatcagccactaggtgagctttctgctgagtgattcagtgtatgtaattcagctccaggccctttccatcaggagaagaactggcagagaatctgctaagcatgattatcccaatatccttcctatattaaaccctctttttttcccccagtgggggaataagataattgacttgggatccttggaggccaatcataactccaattctctaacaccaagtgggtattcaacaattcagtacaattcaaacaccatctatctagggttagtgtcagatcccacaggtttgtgggctcagtctcacaaaattgcctccacttcagatgccagtcacaagtcctgagtcacctatacttttgaccaaccagttataaatcaaggtttcccttgatttatgcctcacgaataattttcttattagggagaagctgggaatgttacatgtcttagaaaaaaaaattatttttaatcaaacacttccccaaaagaattaatgaaatgtttattaacaaatgaagccacactactttgtgcaagagaagcaattctgcctcaggtttgataatttgctataatgggtcacagaaatcagaaaaatattttatttacctttactggtttagtacaaaagatagaacttaggaacagccaaatgagagaggacacatagggaaagttatggtggcaggggaacaggacttcaatgcccttctgtggacatgccaccttttagcaccatgatgtgttcaccaagcaggaagctgttcacatctccttgttcaagagttttgtttttttgagacagggtttcactctgtcacccaggttggagtgcaggtagcacaatcatagctcactgtaatgtcaaaggcctgggctcaagtgatcctccttcctaagcctcctgatatggtttggctgtttccccatgtaaatctgatcttgaattcccacgtgttgtgggagagacccagtgggaggtaattgaatcatgggggcagttctttttcatgcttttctcatgatagtgaataaatctcacgagatctgatggttttataaggtggtggggttggggggggctccctgcacaagctctgtctcattgcctgctgccatccatgtaagacatgaattgctcctccatgccttctgccatgattatgagaccgcctcagccatgtggaactgtaagtccattaaactgtttttttccatataaattactgaatctcaggtatgtctatcagcagtgtgaaaatggacttataaacctcccaattcaaatttttatagagctcaatctcctggtctgggtgcatgggaggaatggagggtagggaggagggtctgaaaatcccagcctactaatcacttggtgtttctggtgaccagctccatcctgaggctgtctagaggccccactgtaagtcacttcattattataaactcaggtgtaattgaaagctgttccttatgagtaacaaaaacattcctatcactcaggaaatttcaagggttttgccaactctgtgcgaggagcaggggacaaagttcaaacatatttcttataatatcacacacactcattattttttgtttgttaaattttatttatattatatattatgttatggttgtttatatttatggggtacaaagtgatattatgattttgaatgcaatgcagaatggttaaattaagctaattaacatatctatcccctgaagtatttaacattgtttatttgtggcaatattgaaatgtacagtactcaattgttagctatgttcagcatgctgtacaattgatctaaaatagaaaagtcagacttatttctcatatataactgaggctttatactcttttgactgttgtgttagcctgttttcacactgctatgaggaactgcctaagactaggtaaattataaggaaaagaggtttaattgacccacagttctgcatggctgtggaggcctcaggaaacttacaatcatggcagaaggaaaagcaggcaggcatatcttacatggtggcaggtgagagagaagagtgaaatgggaactgccaaactattaaaaccatcagctcttgtgataactcactccactattatgagaacagcatgggggaagtcgtccctgtgatccaatcacctcccaccaggtcctaggtcaacatctggggattacaattcgagatgagatttgggtggggacacagccaaaccatatcaactgcccatcctccctaccacccagcctctggtaaccaccattctactctctgcttctgtgagttcaattaatttagattatacatataagtgagaactgtggcatttgtctttctgtgccttgcctatttcacttagggtaatgtcctccaattccgtctgtgatgtcacaaattacaaagttatttttattttttaaagcctgaatagtgttccattgtgtgtagatgaattttttggtattcatttatcctctgatagacatttaggtttattccattatttggctattgtctagtgctgcagtgaatatgagactacagatgtctcttccacattctgattttaaaactttcaggtaaatactcagaagtgggattgctggatcatatagtaattctatttttagttttttgaggatcctccatactgtttcccgtaatggttatgctaatttatgttcctaccaacaggatacaaaggttccctttttctccaccttcttgcaagtgtttgttgtttttgttgatagtggccattctcacagataggaggtgatatctaattgtgattttaatttctatctccctaatgattagtgatggtgagcgttttttcaagtatctatcagttattcagatgtattcttttgacaaatacctattcaggtcaatagctcacgtttttattggattatctgttttgtttctatagagctgtttgatttcctcttatactttggatattagccctttaccaaatatatggactgcagatattttcttaattctgtaggttgtctttttactctgctaattgtttcctttgatgtgcagaagctttctagtttgatgtaatctcatttgtctatctttgcttttgtttcctatgcttttaatgtcaaatccattttaatgtcaaataacaaaaaagttatgaaagcacagaacctagtggtataagtaatactgatcaacattcagaatatttttaggatggtaatggtggtgtgtagagtaattttattcttagtacagggttaaaggacaaaattattaattgcaaccacagctacaataaactttcaagggatatatatattataatatgatgtaatttagacattagaaacataagatggctgggtaaaggtgttgagttgtatttaatcaatgttaagctgctatcaggttaaaatagacagaagtgtaagatattctttgtaagcctcatggtagccaaaaagcaaaaatctgtaggagattcacaaaaaataaaattagattcaaaagattcaagacataccacacaggaaactatcaaaccacaaaggaaaattgcaagagatgaagaaggaaacaaaatatcttcaagaaaaaaagacccaatgatagaaaataattaacaaaatggcgagaaagttagtcctttccttacttatcaacaattatattgagtgtaaacggattatattctcctataaaagacaaggagtaaatgaatggacacacacacacacacacacacacacacaagacctaactacatgctacctacaaggaactcactgcacttttgaggacacatatagactgaaagtgaagaaatggaaaaagatattctacacaaatggtaaccaaaaatcagcagaagtagcaatacttacagcagaaaatactttaagtcaaaagctgtaaaaagaagaaaatgaaggcattatataatgataaagtagtcagtttgccaagaggctataacaattataaatacatatgtacccagcaatggagcacctaaatatataaagcaaacattaaagggtgtacagagatagactgtaatacaataacagtagagaacttcaatgcaccactttcaataatggacagataatgtcagaaaattaataaggcaatgttagacttaagcaacactttaaatgaaatgaaccgtaacagacatatacagagtattccatcttaacaccaacaggatacacaatcttctcaaatgtacacagatcatttctgggatagattgtatgttagttcacaaagcacatcttaggaagttgaagaagactgaaatcatatcacatatcttttctgaccacaattgtatgaaactagaaatcaattacgggaagaatttcagaaaattcagaagtatactgaaattaacaacatgctcctgaacaaccaataggtcaattgaggaattaaaagggaaattaaaaaatatctttagacaaacaaaaatgaaaacacggtatgccaaaatttatgggatgttgtaaaagttttgcttgtctgggaaagtttttatttccttcttatttttgaaagacatctttgctgggtaaagtcttcttggttggcagcatttttttacgccccatcccccgagcagtttgaatatatcagcccactctctcctggtctggggtttctgctaagaagtttattgttatttttattggaacccttttatgtgtgatttctttattatcttttgctgttttcagaattttttctttctctttaatttttgatagtttgataattacatgttatcgtcaactcctctttggtttgaatttggttggagatctcctttcttcatgtacctggatgttggcttccttctgattagggaacttttcatttgttatttctttaaatatgcatctacctactttgtttttctacttcttaattcctattatgtataggttaggtctcttgatggtgctccataatccccataggctcccctcccctcctttcccgttccctccccttccctcccctcccctctcctccccttccctccgctcccctctcttcccctcctttcccctcccctctcttcccctcctctcccctcttctcctctcccctctcctcccctcttctttcctttcctctttttctttttttctttgctcctctgactgatttcaaatgtccatctagaagctcactgattctttcttcagcttcctcaaggcagctgttcaagcttcctatttcatttttcagtttagtcgttgtattcttcatctcctggatattcattttttaattgtttctatttctttgtcaaacttttcattttgttcatgtattttcaaaatttaattttctatttatatattcttgtggttaactttttttttttcccaaaagagttgaggtttcactctgtctcccaggctggagactggagtgcagtgacaaaatcatagttcaccatagctttgaattcctgggcacaagggatcctcctgcttcagcctcctgagttgctggaactacaggtgtgagccaccatgtgctgcccatttaactttttaataaggattattctgaaatctttttttttttttttttttaccattttatggattccattttctttgggattcattgttggagttttattcatttcttttggaggtgtcatgatttcctgagtctttgtaatcctgtgtccttgtgttggtgtttgcacatttgtggagacaaccaccttttccagcttttacaggtgttcgttggcagggatagaactttactatttattctagcctatacttctggaggggccagctagtaataacccttagcagacacagcttgcttttaggttctgtagaaagctggcctgctacctttgctctgaatttttttggggtagctacataggttctcttatctgacaggaccaccgtctgagctctgcaatcaggccgagctgctgaatggacacagaaatttcctctgatcagccttggccacagggtgtattcctttatttgagttcagcagttggacagggttgcaggagggtccttgaggttaagtggattggggtggatggaccaatttttatgttcaatagaaatgcttattagaaatgatcagtggggtaggaaagtaggctttgaggctagggaccactctggttaaactccctcctatgtcagaacaagtgcctgcctgttgtcaaaatctgctgaggatctgttgtgggatggtggaggctggcaagcctgtcccagttgctcagactggctagtcttctggtagttctctacctagacaggattactcctggactgcagcagagagaggctgtagctaagcagaggcccttcaggatctgctgtggattggaggctaacaagtctgtcccagtgcacagatcatgaatctcctagcagatctttgtacttgcaggatagttcttaaattgcagtgagaggggctggagcagagactgggccccttcacagtctgctgtgggacaggagctggcaagcctattccggtattattaagatggatgcttctttcagcagttccctgtccaggcaagatagttcccagcaagaggattggagctgagactgagcccttccaggatctgctgtgggatggaggcagacacacccgttgcagtggttcagacttacacgaatcccagaagttctttgcataggtgggatagttcccttactgtggcagggaggggttggagctgagactgagccctgtcaggatctactgtgggatggaggctgagtcaccaagcctgccttggtgactcagatatatgagtctcccagcagttctctacatgggcaggatatttccagggctgccggacagaagtgctgtagccaagaaaggtcccccttgggatctgctgtgggatagagggtggcaatcccatcccagtggctcagatgggtaagtgtttctctgggtttttgtgtgaccagtgataagcgggaaccacagatgaggggggctggagctgaattatagggtaacttttgggtccactgccaagactgatgttggtgggctgaccggcctttgtggggcacttgggtgtgtaattcctccaggaccccttggcaggtggttttggttgcaaaagccaaagggggctgaagccaagccgtttggggaacaggattatttctgtgtttgaacccaggagcccaatctgtgtgtccaggtgcaagtttgtaccctcaaaatggccttcctaagtcttgggctccacttgggttttacagcctcctacctgaatcccaagactcctacaacaagatttttgtttgtggatggctgcagaattcttattgtaggtgtacacatataattttggaaactttatacccagtgttttgaaaaacaatatgagccaacatttcaaagccagttgacttctacataaaaattggcatttgtcagtttcttgaataatctgaatgacagaacactaaggaccaatacttacccataacaatctgctttgcagtgagtaatggctaccacctttatatggtacttgtagtttctagtttcccacagtcccactcgtcatgcaatggatgcatatgacctcactcctgatctgcatggcccctggatatattagaacttgtacccttacaagagaaaatagagcttgacttaaattttaggtataaattttagtccattttgagaatgtataacccaagggttatactcagaacagagtcttgcttatactttggaacttcctcctgctggagttgtccaaaatgtattcagagatgtggtcaaaaatgacagactgagaaattgaagcgtgggaaataaatatgtaattactcatccaattaggaatgaaagtgcttatgtgctatttataactgttactattatttgaactgtatgaaattgtcatttttataggttaaaaattgtgaaatgttggtaattttatatagttcctaaatagttttgtattgctgaatttgaggatatgttataggttttgtttttttttttttcctcagactaagttgctcagtcctatcacttgtcatcttgtttgccattaagaaataggcagataaatgggtgcggttttaagtaaatgatgggtttgtgagtggggggaaaaaagtacattgtttataagtcttattcctttttcacacaagtgcttttagttacatttcagttctgaaaaacactttttttttttaagtagaaaagactgtatataagcttaattggtgatgtttcataggaacaccctcactcttttggaattgaaataagagaggtgtcaaaaattttgaggcttaagaaatcataattactgagttcttgttgaaaaagactgctgcttagttaatgctgtttcaggtactatcttatctcttctcttcagttctgttaagtgtcattctcacgtgaaactgcaattagaactaaagtgttcttgtgacagtctagaaagtttccaaaatgataagtgtactctcatcctttctgccaagtttatttgtaatcaagagtggccgctcaatgaatatgaaggaagttatagtcttggaacttagggtccaattttaagagcactttggagctaggtattaaatagtatgtgggaaatttgttcatgcattaggtcattttattgctttttaatacccacttatagtgttagagtaggaaaggagaggaagtgaaatttatgtttatcactgaaactaatgattattaatggtatttgtaaaagataagcagaggaaatgagaagtaatatgatatttggaatggcagcaactggcattccacagtcatgagaggtaattaagaatggactgtgacctcaaccaagaggccttatttttctagacttattttatagtactaatgctctgttcctaaagcatcagattaatttaatgtctcccttatacatcagctgtatattacaagtttttgaataagattatgttagcagttataactgtattttactaccttatggtgactaaacattgtggtttgcctggaattgagagattttctaggtcttgggactttgtttgaaaattaggaaaattccaggaatacctggacaggtggttaccttactttcaaaattattaaaatggagttaattctcacatgattagaagggtatttagtaatcctgtgaattctttacacttaatgtttagaaaaaaatctaactcaaaaatattattttaggaaagcactttttatgtagaagtgttgctgggtatttttgttttaattgctttggaaatttaaaggcaaactgactttgtggtagttttttcaaaaaaaaaaatcttaatttaccctttggtaacactaaccagcaagttggcaggctattaataatgaaaatactagcaataaattattcagtaaaaaaaatctttaatgtggggagtgggtattctgataaaaaaggaaaatgcaaatagtcagtgcttttaaaaaatactaaacaagaaataatccttttctttgcacttagttttcctaaattgttgtgtgattgtctcagaagtgaatagcctagtgtagtttcataaacctttctttccttttttctagcaattatatatgttcctgtctttgaatttttataatgtgataagactttaaaacaatctgtgaccacacttttggtttgcaatttaaattttctcttttaagaataaaaataataaggtcaaacaaaataatgtaaccaggaaactaattacagactattaacagcatatgctgtgtgctaatctttattctgaactcactttaggtatcagcctacttttctcaacaagggggcacttaagttaattgcttcattagaaacatgcatttagcactttctgatctgtaagtacaactctttggcagagctgcagaagtttgaacacctgcagcccaagcagcttaaaaagaagtcataatttactataaaggaaaataaaagaagctcaagttcaaaatggtgttatcaatgatatagtgttgtaactaacttgagctgacctaaaagagagagttggcttctgcactgctccttatcagcatccaaaagggcatacaaaattctttgtaaactaatttaaaaagtgtcttgtttattcagaagcaactgtgaatggtatttgttcagaccttagatcacatcaattgcataccagccaacaacttatttctcttctaagagagaggccaagtatcaaagacacaaagtactaaagataagcttctcaattctcaattgttctgaactctcaataaagctactgatgtacaaattggggtgggacccaactgtttccacctgcaggcttgtcttagatccttggctctggctgggagaggtgctgatactaatgtgacctttagtgcccttggaaaacaaaacacaggctttcttatagccctaatcaatcagtccctctgaagaggattccaccccgtttcttcaagtagtcttggggcaaaaaactatggctgactattcccatttacagggctggtgaaagcaaagagatcgttcatttgctcttactgaatcttaaaagacattccaagtcatctttttttctgtttccatgggtgattcttactagatgttttgtatttgatattttgtaagacggtgatctcagtaagtaaaagaatgaagtgctttcaaacctcattcaaatagtatggtattaggaaattaagacttatttgatataaagaacatttctgagactgctgaggcacaaacaagttacttgtaggatactatgttgtcacttatgggctattaatgttaattgcttaaatgtggttcacaggtagtctccaaaggttcaaatgtgagtttactaaataatagaatctttaaaataaaatcatataatttttgtcatgagtacctagaattagaaaattggaaaatatttgaaacatgaataattcaaagatgttcttaaaactgatccccagatgtctttttaacatcattgagattaaagccctttatattattgtgaaagtagaaggagttactgaaaggcatctggaatattgaattttaaacaaaattttctctgtaattagaaatttgtcacttggttcaaatatggctttaaaaaaaagcaatgaaaccaattgctatttcacagtaattataagtgctgtattttcctttcacaaaattatattaatggtaacaatagccatggttcttaaggtaagtttaagacaaaataatctgtataagtatgtgtgcatctgtgtatgtttgtatggaaatactatagaggcaaaaaatgctatgccacaagtagttcctacaccctcccatgcaccccacccccaaaattgtgggttttgagccaattagaattatgtaagccttgaactatatgtctttttcaatgattggcatagaaaaacagtaacagattttccagtaattttcaaatttaaggattacagagcatgtgagtaatttactgcacattaaatgtattgactaattgatctaaaagaaaatattcacaaatggataaagcatttcagaattaagcacatctaggcaaaggaccttattgtaggagaaaattttgactaaatggaatatttaaaaattattttttctgtgattatcgtatcaaacctacaaacttaaatatatttaaaaattttacatgcctaattgatggggctataaggattactttataatgtttttttaaaggatcatctaatgagagattcatgctatgtgattaaataatagttgtaatgttttcatgttggaagtttgtgctttgttcctgattctgactttttataatgttttctctttgcatatttataatttttatgttatttctctagttttgtttattagcttctacggtataagcatcttttaatgaagctcacaaaatcaattttacagtatcaggcgttacagtattagaacaaatataggtatttgcttgaactaagtaatatgtgtcattttacagtctgataaatttgaagtcaatctgggcaagattctagagtgatttaccagaagaattgcttttggattaaaagaaaaagaacctatcattgttacaaataagagtaggatcactaattaacagttttaatttcttttttttttgttgttgttcttttaaatagtgttgataggctggtagagtggatagattttgccaaggattcttcttacattcttgtgacttggaaatataagtggtgttcccacatagtgttgatgattgatgtctacttgagggtgtttctaatggcagactatacaggtctatgcctgagcttgtcctgctcaacattttatgtgcatgacttgaatacttagaagaagaagtttatcagatttctagatgacaaggtcagagagataataaacatgttgggtcacaggaacagaatcactattcaacgtaaccttaacaagccaatataaaacataaaattgaacctcagcaaacacatcagacaacatcaacaaaaattacaaacaaaggatagagtaaaagtgacttagtaataacatacatagaaaaacaactaaacaaggtttagttgatattaaactcaaataggaatttttagaatgatgtagctgccaaaaacataacaaaataccctcaacacaacccctatcactctcactatcactaaaaacaataattaaaactgaatgtgatatttccttgaaattatagaagtgcagtatttaggatgaagtaatagtctttgtctattttttaattgtttataatacaactagactaccagttgggactcagtgaactatgctttgagtggcagagattaactgtagagaattttgtggagattaatcaaactagtgagggtatcagaaatcatcttataagaactgttttgactgcaagcatatagtcttaagaagaggcctgtcgtgtgtaagaggatttatacttaatctgtatggaccctactggtattactaggaaaaatgggtagaattcaagggtgacagatctgaaataattttaaataaatccaaggacaagtatttgtggaaagccttctttgggacaggcatagacttttcaaatcctcagcagacatatccagaagtcagcaatagggcataggagatcagagttggaaacttttttcttgtaacttgttccagaatcagaactggctgttttgtttcccacacatctcatatgattgcagaatataagcttggttaactaccatttgatgggagactggaaataaaagtcttagttttgttttagagtagtcttaaaacaacagctccttatctggcaatgctgtcacatggcagaagctccctaagcatacctctttcatggtccaaccctgtttctttatctggtaactttagaagtctggtttttcttaacatcagatctactagactttcacattcctactgacaagcaaagtgctgtggtaagaagagcaggtggtggatttgagtccttgcaccaccacttagtgtgtgatcttgggtattaaactttacctctgttttttattcatacaatgaggatcctgttagttgctatattcatagggttccagtaaagatagagctgatatatatatatatatatatatgtcaacatatttccattaattatagtacttaatggattattatttagtcactaagaatgctaggtgtaaaactctgtgccaccatgaaaaaagctgtttataaggtttatttaaacatgcgtgtctgtggataaagacagagggaaatgttcagataatcattgttttgggaagggcaagattaggtttttagaatttttatattatgtggttgtctgtttgttcaagtaatgaagttcttgtgcagttgcaaagtacttaacaaatggatgatggtgatcttagatctgactcccttctaactctaactttcagtattacattgtgtacccctaattttattttcttctttattgtatgaagtaaaaaattggctaacatgaaaaccatggaaaatgtttgcaagaatgtgcagtaatcagaattctcatactatcaattgtaaactggtacaacgcttttagaaaaatatttgctgtgtagcaccaaaattgaatatatccatatcctctgatccaacaattttactcttaggtatatactcaacagaaatgcatatgtatttgctagagtgtttctgccagcagtatttgtaatagtcaaaatctagaaagtacccagatgcctaccactagtggaatggataaataacctgtcttatactcatataatagactactatactgccctgaaaatcatctatcactttaacacatagtgtggatgaatctttcaaacataatgttgagcaaaagaagccagacacaaaatagaacatgctgtatgattatatttacataaagtagagaaatattcaaagccctcatctctgttagaagataagatagtggttatttggagaggccagtggctagattggagggagtgtgagaatgaattttgggtagcaatgttctgcttcttgatctaggtactacttacatggatttgttcaactgtaaaattcattgagttgtacttttgtacttttgatgtatgtacttttctgtctatatataatacttaaatacaaaacttaaagaatgcagaaacatttattggcctcaggctgtgataatctgatgcaacttatctctattacagagtgcccctgtctcagtggatagggtgtttcagtcactgagcctggtcatctctgccttagacaaggcatgactggatactatcagctgttgggttgtgagattttttttcccccattgaattatacttactcaactttttcattccagacagtgtctccagacagagactaagatacttggtcaattttatcctttctaattactgtaatatttcagtagtgagatcagttccaggtcattctcacaagttcttgcaaccatttcttttgtggtagaaaaaaagcctattgaatctgggggaaaagaagtggtaaaatttactcagcatattgttgagatgataattttttgtttttttttagtagagacggggtttcaccatgttggccagactggtcttgaactcctgacctcaggcaatctgcccgtcttggcctcccaaagtgctgggattaccggtgtgagacaccgcgcccagctgagatgataatttttatcttcattacttggacaaatcattttccatttatgggcctctgcttttctcatctgtaaaaattgtgaattaatattgaagaaaactgtgaatttactgaatgtattatttactgaatttaatggttgaatctaatggttgaacctattatacagtttttttgttttgcttattttcttatttccttggtgtttgtgtagctgagaggccagtacagaaaacattatttgagttacagtttcttttaaaaatattaattgtattctcccattacaggtattaagaaatggagagaaaaataagcagaatccaccttgtttctgaacccagtataactcattttctacaagtatcttgggagaaaacactggaatctggttttgttattacacttactgatggtcattcagcatggactgggacaggtaatactaaaaacaaagtttttataagtaaaatttaagtgtgctattcttcagtcctcagggatacttttccattagatattgggtaaaactgatattaattttacttgctattgctgtcaaatttatacacaggtttgtaatatttaatgccactttctatatttaatagtaatagaaaaacaaacgtgtcctagaaaattccggttaccatttgaatcttagtaacttggatttgttcagaggtttaaaatgacctctttatagaaaatataaatagtactttctaaatacatcttttctcaggaccccagggaagaagtctggggcagaggaaggagattggttaggtaaatgggtatgtgtgttgccttggggcaatggggtagtggtgggttatttatttatttattttccccagtgaacatatattacatttgtaacaaaacaggaccagagtctaaaaatttgtaatgcaaggttcacacccacatttaggatcttggctgtgattttaggaaatagatttttttaactctttggtaataatattttaaaaatgctaatgaccctcaaatcatgtatggaacatggtggatataaagtaaaaatatgtagccttatattttccttatatacgaagttttaatactcttctaaagtatcttattgaaagatttaaagaactatttttataattatgcaaaagtcttttctagagttatgttgtgaataatgttttctgtaagataatttttacatgttaatttacatactatttatatcttctattaactttagaaatatttctctagaatttgttaccatgattattatatcgtctttaaaattacaatacattgtaaaattttgtttctttcttgagcgttatgaattatgttatacaacacagtcaaattgaatttatacttacagagtttcaaaaaaattgtcttttttgacacagaacaggtaatgttgatgtagggattcctgtaaaataaagaattttcaggggtaatatttgcagtacttattatgatatctatttaagctacacatttatctgtaagagaaagcagaaatcagattggttgttgcagttcaagagtagaagatttgtcagcttggttttatgtatgccagagagattatatccagaagacaatatttcttgttttagggtgaagagtgtataaggctaaagacaagggcaatagattaatgctggtcatctgggtaagaagagcagttctaacaacacagcttggaagcaagtcctaggggaagtggttgcttgtatgtaaggaatactgtatttataactttaggtatttctaattggcaaatggcgtattctgtatacttagttgttgtcagacagatgaccttaaggtgtttcaggagccttaattatcaaaggaagaggctgaattctaatctagtccataagcctcattcaccaagataaaaatcagtgataatatgttatttgaaattttttaatcattaagtattgggggaaaaaagaacactccattaactcttatctcttaatttaaccagaaatgtaagaaccttacatttatggaacatttcgtttatatcatacaattgtgctggcatcattcttaataatattaacatgaattatcatttcactagatggtactgatttatactgagggtaagagacacatttggtttgtcaacactctttgcaattatctagaccggtacctacgaaatacattctcaatgaatacttttttgattgaaagaatgaaaggatgtctcaaatatataaaactggtctgcgaaaaaagaaaataaattgttcattttagagttagcatgtttttgaatgaaaactccagttttatatttacttattgttgacatttgtcataactgcagtatattctaccatttattttttagctagtggaatttaatgtgacaaaaatgtgatatcaaacttatgtattctcaggtggattgttaccattttggtttcctgtaccaaacaagctttaaaacagaaaattttatagtgcactatgtggtcattttattttcaaaaatatctaatagtgtttaaatctctcatgtgttttatgccttcattcatttctgttttcttgtttacatatcagggacaaaataggaaatcaaataatataacactgtgcccatgtttagttaaggcttattccataaatgtgatctggtactttacatgtagacaataacatcactaaggacattgaaacaattaaataattgaaacatggaaacggatttccttccgatacctcatcctgtttttttttgttcaacattttgattactgcaaccttcaatttggacaattttttttctctttttatttgagtgaaattaaaaggatgtaagttttcttttaatctcccctacactaaactcactgatttccattagcaatgttttatctaatgaatgtttttgaggtccaattatctaattatcatgtggtctatcatcacatcagtattacaggcggttatatcacaggggtaagtcacaaagtgggttaatgatcgatgactctgactttcataagaattcctattggcagtaggaaacttatatcacccatctctggagtagtttgaagtttattaaagagtaaattaaactttactaattgttctattatccactaattagatccacttataattatcttgagtgtaaatattttttgacttatatggaaatagtgacagaactcagtggaaagaggattttaataaatcaagcagtgaaatgggtttatgatgcaataccaactagaatcctaatggtatgataagactgtatgtcttctgagctccagtacaagcttaggatgtgtgcaggcttttggctagttatatataggtatctgaaggaaaaaaatcttctttcctcacttacatcttcatctacctataaacactgcaaaagtgatgcttttcagtgttaaagtgagtctcagtctgacttctaccagttccttgttttttggtcatgttgggctgctcatgttttatgccttattatgtggttcagttgcattcttgctgaattttattatttccattgcctttattcttggtcactgaagttttagagcatcgcgtgcttacagctatactttttccagatgttcttggcacagaattcaaaactggtgaccaggttggttttttaggattgaagccctatgtaggcagtcagatttccatgtttacttttataggaatttttcaagtacatttttgaacaaatagctgttttacataattaatttcctttcatacgtttttttctccttcaaaaattaaatattccgtaataatcagcacagtatttattaggagaggaaaataagaggatatctaggatgataactgacagatatctaaaatgttgtctaagatattagcacttgaatttgagctccacaggctagcatttttggaatgaatgaatgattacatattttcagacaggtatcttttcattttaatgaaatttagaatacttttaactagatgctttttaaatagatgttctctgttttcttttgtgttttcttcaagtttttctatggccgcattaaagatggcatctacaaatttatttcctatttctctgtgaaataactgttcttcctaggtattggtgagttaaagttagatagttactttttaacataatgcaaacacaaaatatgaaattattccttaaataggaagcatttatcttcttctttttttttttttagaagagctactagggcatttgaaagatcaataggtttgatagtgatgatcatattaaatgtgtccacttccaatagagaaaatgtgaaagtgttttagaagctgttaatatatgaatataagctatttttattcttacctccttccaaaggttgtgtgacgtatgagaatcatattttattatcaaaacttgttatcaaaaattgatcatataaaaatattggtaccttgcaagactccctttttcattaactgtcatgggtcttccagacacttgatagcatagagaccaaaggtatgaaaatgtgtgttccattttagggattctttaatcatgatttccttatattctgtaatattttatactaatgttgtttttcaaaattatggatggaaataatttatccaatgtttcatgtctctgcttcacctcaaaataaaacatgcagagagatatgagtattaatcccagcttcactagttacttacttcatcaccctagaccattacttgatctctgtgagcctcagttttctcttttgcaaaatgaaaataatatctgtttttcagttttataaggaattaaaatagataagtgtaatgcataagtatgaaattatacaaccatatgagacttttatcattactgtgatagcctaaattaacacaggaaaccatccaaccacacacacattccaacaaataacgagattgaatcttgtaattttaaaaacaaacaagtatgcagacccattgccacttttgagtgtaagaaagggaaaacctcagacaccatgtttgaagaggtatttcaaaaccaaagtaattgatgagaattaaagcttacttgtagattcatggaatatctgaactagatatacttctagatgacagtgagtataatgtttgagtgaggtagaatgttgaggcttcagacctcttagggaattggagttgagctctcagcataaagaaaggaacctggaaaatatatgctgttaataaaataatcttttaaaaaaactactactctctgtccagaggatgcagcataaaaacagaacaatccctaaggactatgagtgaataaaagtctcaagaaaaatcagaaccctaaacctgtgttatgtgtggatgggaggtttaaaatggaacactttgcctcaaatgtaaaaatcgaggtgagaaattaactttcaaaactagtcccaaactgataaaacttgtaatgacccccagaaaggcaaccttcatttaagaccacttcttcccagagcacttgccactttggctagaggtgagctgtactcaaatgttacaaagcatgaaaggaaaacaagtaaaacaagaatttttccacagatagaagaaacataatttataccccaggagccacacataaatacagaaatgaaagagatcttaaaatacgtttatttaaatatttaaaagaagggtaggataagaacaggatataatgacaaaggaacaaagataatatctagaattgaaaatataattattgaaacaaaaatctcaatgatagtaaaacatcagctttaaaaatacctagataagagaattggaagcggtctctagtatagtatgtgttgcagaggagatgctcgtacattttagtttccttcctattatttccttatcatctcctttcatccatattttctgttgttggcacatgatatgagaatagtgagctccacttttgcttttgttttactctgcccatatgagtgagaaacacagtataggctattgaatctttgatgcaaggaagaaagatgttataaaatactgaacttattattcattgtaggaaattatctggctttgacctaagagcagttacacaaagtgggagtttctgtaataatttacaatgcgtttcatctgaagacagagaaagaatgtcaagggtttaatgtattttacgagatgtgagtctaaattaatgcatttctcaaaaattgctagttcagtaaaaaggaataatttgatttaaaaatgtgtagtatagggattgattttacttgtttgaatttctgttacatgtgataaattagtactaacagataaactaatattttctcatgtgtagtcatttacttttcattttaaaacttttgttaatatttcccatagtttctgaatcagagatttcccaagaagctgatgacatggcaatggaaaaagggaaatatgttggtgaactgagaaaagcattgttgtcaggagcaggaccagctgatgtatacacgtttaatttttctaaagagtcttgttatttcttctttgagaaaaacctgaaagatgtctcagtaagtaaaactttccaaaatgttacatagtaaaatgtcagagcatttattgaggaattatatttaaatttaagtgactactatattattcccagaacacctcagaagcaaaagcttgaaaagtacttggtttccaaattagaagaatacttcaaagctaaagtcattaaatatattaatgaatcatgaaaaataaatattggaaaatgtgtttagtttttaatgcttgaaaaattttaaagtattacagagttaattatacaaaagaataatcttgaaaaaggtgagatcagaagttttaggccatcgtgacaggtcttattgaaaaaagttttgtgaaatattgattttaagaaataaaatcaatcaaaatatatctttgaatatagaataattatgacttattttctactttactagagtatatttgaaattgaaaaatgcatagtaagtattaaggatactttatattgtcagatttaaaaatattaaaatagaaataacttgaagcctaagctttgcaaacaagagtatctgctacttattctgctcagttcctgcaccaattcagatcaaggcaggtggtttatttattaaagtctggcactaattatttgtatattttacctaagtttaatagatactgaatttgtttttttaaccagtggttttcagtcatatatgagatctatcatttctgaaggagagggaaggaaatgtttgctacattaagttaacagaaatgtattgagaatttgttttagtgctcaactgagtttaggaaattcttttaaatcaaccttttaaatttggaataattaaagagatttcattaattagataaacatttgtagaaacaaatggagtcattataaatttatattatcgtgtagggaataatgcagagaaactacccttagtaatttatatttaaaataaacatactttttctaattagctgccaatttatataagtttcaatatgctgaatttcttaaaatggtaatttaaaataggttcagtaagaaggttggaactagctactacaattttgttatttattgtaagtgttctttcctgtggcccaagctcaatcggatgatattatatgttacagaagtgcagactcttctaatgttttgaagcagatcattgccaaattgggattaatgccatttcccattcactaaacatttgcatgtaacaactagcattattttgtgcagcgattttctagtttttatctgtttcacacatattgatacataataaattccaaattagtgaggtacattttagaaggctgaaaggcttttgaaatttttgacatgctaaaagacggggcttggtacagttggcatgtatattaatctgttctcacactgctaataaagacatacccaaggctgggtaatttataaaggaaaaagatttaattgactcacagttccatatggctggggaggcctcacaatcatggtggaaagcaaaagaggagcaaagtcacatcttacatggtggcaggcaaaagaacatgtgcaggggaactcccctttataaaatcattagatctcatgagacttattcactatcatgagaacaacacaggaaagacccctcattcaggattcagttacctcccgctgggtccctctcataacacttgggaattatgagaactacaattgaagatgagatttgggtggagacacagccaaaccatatcattccgcccagcccctcccaaatctcatgtcctcacatttcaaaaccaatcattccttcccaagagtcccccagagtcttaactcatttcagcattaactcacaagtccacagtccaaagtctcatctgagacaaggcaagttccttctacctatgagcttgtaaaatcataaacaagttagttacttcccagatacaatgagggtacaggcattgggtaaacatacccatttcaaatgggagaaattggccaaaacaaagaggctacaggcgccatgcaagttcgaaatccaatagggcagtcatgaaaccttaaagttccaaaatgatctcctttgactccatatctcacatccaggtgatgctaatgcaagaggcggactcccacaaccttgagcagctccacccctgtggctttgcagggtacagctcccttcctggctgctttcatgggctggcattgagtgtctgtggctttcccaggggcacagtgcaagctgtcggtggatctaccattctggggtctgcaggaaagtggccctaatcttatagcttcactaggcagtgccccagtggggactctgtataggggctccaaccccacatttcccttctatactgccctagcagaggttcttcatgagggccctgcccctgcagcaaacttctgcctggacatccaaacatttctttctttttttttttttttgagacggagtctcgctgtgtcacccaggttggagtgcaatggcgtgatctccatctccactcactgcaagctccgcctcctgggttcatgccattctcctgcctcagcctcccaggtagctgggactataggcgtccgccaccatgcccagctaattttttgtatttttagtagagacggggtttcaccatgttagccaagatggtctcaatctcctgacctcgtgatccgcccgcctcagccccccaaagtgctgggattacaggcgtgagccaccgcacccagcgcagacatttctatacatcatctgaaatctaggcagaggttcccaaacctcaattcttggcttctgtgcactcgcaggctcaacaccatatggaagctgccaagacttgggacttgtaccctctgaagcaaggcccgatctgtacctttgcctgttttagcgactgctggagtgactgggatgcagggaaccaagtccctaggctgcacgctgcaatgggggcctggacctggcccaggaaactgtttttaccgcctaggcctctggagcctataatgggaggggctcctgtgaacatctctgacatgcctcggagacatttcccccattgtcttggtgattaacatttggctccttattacttatgcaaatttatgcagcaggcttgaatttttcccccaaatatgggcttttcttttttattgcatcgtcaggctgcaaattttccaaacttttatggtctgcttcctgttgaatgctttgctgcttagaaatttcttctgctagataccctaagtcatttctctcaagttgaaagttccacagatctctggggaaggggcaaaatgcccccagtctctttgcatagcaagagtgacctttagttcccaacaagttcctcatgtccatctgagaccacctaagcctggacttcgttgtctgtattagcattttgttccaagccattcaacaattctctaggaaattccaaactttttcacatcttcctgtcttctgagccctcaagtctctaggaagttccaaactttcccacattttcctgtcttcttttgagccctccaaactgttccagtctctgcctgttacccagttccgaagtttctttcacattttcgggtacctttatagcagcactccagtctaccggtaccaatttactgtattagtctgttcttacactgctaataaagacatacccgaggctgggtagtttataaaggaaagaggtttaaatgattcacagttccacatggctggggaggcctcataatcatggcagaaagagaaggaggaacaaagttacgtcttacatggtggcaggcaagagagcatgtgcaggggagctcccctttataaaacctttagatctcatgagacttattcactttcatgagaacagcacaggaaagacccacccccatgattcgattacctcccaccatgtttgtcttacaacatgtgggaattatgggatctacaattcaagatgagatttaggccgggtgcctcccagcactttgggaggctgagatgggcggatcacctgaggttgggagttccagaccaggctgaccaacatggagaaaccccgtctctactaagaatacaaaattagctgtgcatggtggcgcatacctgtaattccagctacttgggaggctgaggcaggagaatggcttgaacccggaaggcagaggttgcggtaagccaagatcacaccattgcacttcagcctgggcaacaagtgtgaaactctgtctcaaaaaacaaacaaacaaacaaacaaaaaaacaagatgagatttgggtggggacacagccaaaccatatcagcctggatggagtacttgccatgactggcagtacatcaggttttaccctttctatgaagaaagagctttaagtcctcttgattcatgtcttctacagttggtttggcatatatcaacatcaaagactcataataatcctgaaagatttttgcttaccaccctgaaagtaaacaactttatcagagccagcatcttgaactacaggtactaccttttcaacaaatgttcacaagtaatggaagcagcctgaaagattaccagcaatgcaaaaagtgtgctggttccccagagaatgtcttaaagcactacattgcagtctaaatatctgtctccttatttattcatttatttatttgtttatgagaaagaaaagaatattctcagaacggcttgacaaggaggagtttattcatggcttggcttgagagatattttggatatttagatgaggtaaaactttcagtggatggatgcagctgagagatcacaagttcatttggccaaggtgtcatgggagtcttccagtattcaggatgtgcttctgcagactgatttcagagtgacaatgtcttgtagattcatctgctggcaaaaaaaatctgcagacaatgggaaacatggcagacagaatacttttttaaagctaattttgcttggatgacctaaaaattgagaaggagtttgtaatccttttcttgatgatacaaacatctgattgttgccaaaaatgacctcctaaacttagaagaaaggaaaagaatgaacataaattcaactaaaaaagttgtgaattctgttgtttcttaatgtaaggttgctcctccgtgacaaagacttgctcccagatgcatacctctgggagtcagggttttaggcatttattgccatcagttcaagaaattttgtgtatctaattgtgtgttcactgtgcaatttgaacattttgaatatctaacttatataagaattgtttgaaatttacatttataacaaactttctttttttcttaaaaggaagtaaccactattttagtattcaaaaatacctgatattttgaaaatcctgtcttatgttttgtctgagtgaaagaattaccagtttctctctctctttttttttttttttttttttttttttttttgagatggagcctcactctgtcacccaggctggagtgcaatggtgcaatctcagctcactgcaacctctgcctcccaggttcaagtgattctcctgcctcagtctcctgagtagctgggattacaggtgcatgtcaccatgcccagctgatttttgtatttttagtagagacggggttgtgccatatgggccaggctggtctcgaactcctgacctcaagtgatctgcctgcctcggcctcccaaagtgctgggattataggcatgagtcactgtgcccagccagaattaccaatttctaatgtagtgaaatatttaaaatttttagcttgtttgtcaatatttatactcatgttttgggagcagtgggtcagcaattttcatgagattgcttttgagcttatcctcccaaaacttcccttaggctttaattggcttttctttatagataacatagatccttttattttaacttcattctcatttgaataaatgttgggcgaacagctacacactaatttcttttctccatagagtgcgaacccatgtgacccttcctgccttagtgctcttcatttaacagtagattgttctggttgaaagcatactatagtgccagcatttggaactcctcatctcttcagcacaaggactgtcactcacacaagagatcatttgtgtgctttgggccactgttttccctctacctttaacaatttatcctgattttgccatacagactttgtcatgctaacaatgcatcttaatgaataatgtattcatcttccttttttgctttcatatctcactctgtttctttagaaaaatattcatttatgagtcaaagaaaaacaattatttttgataagaataaccttgggctagtcatttaaccctaatttcctcatgattctgttttttcatctgtgcaatttttaagtgatttcttagattaattccagcttagctaacatattgtagagctacatatatatgtgtgtgtgtgtgtgtgtgtgtgtgtgtgtgtgtgtgtgtgtatgtatgtatatgtatgtatatataaacattttggctataaggatatgtctttttaaaaaaattaatttaattttattttaagttctgggatacatgtgcaggatgtgtaggtttgttacataggtagacgtgtgccatggtggtttgctgcacttatgaagccatcacttaggtagtaagcccagcatgcattaactatttttcctggtgctctccccttgcctggaccccctgaccagccccagtatgcattgtgcccctccctgtgttcatgtatttttgttgttccccagtgaaggaagctatgaggtttgaagaaaaattaaacatgatttaatacatatatatatgtgtatgtatatacatctccacacacacacacacacacacacacacacacacatatgtatatagtgaatatctaaaactctagaatttgctacaagtctctagtagaattaatgcaaagtctacttctatttctttaccctcatttcccctactacttaaatagcatagaggtttatttttcagtgatataaaaatccaaataggcaaacctgggttaatataatggctttatgatattggagacacaggcttctttgatcatgttcccttggcttttttttttttctttaattgagacagggtcacacttttttgcctagtctggagtacagtgatgtgatcatagctcactgtaacctctgacacttaggctcacaagaacctcctacctcagtctcccaaagcactggattacaggcatgagtcagtgtgcccaacagtctactttgtaatttttaacaggtagtttttatttcatagtccaagatgacttgtctagttttactattatgttcacctttgaggcagcaggacccagttaaagagacaggaaataatatgtgctttttctttaagacagtcactcccaaatttgatacattccttttgctcacgtcccattggccagaatgtagtcacatggcttcacctagctgcaagggaatctgtgaaatgtgatcttcagctgtgtcttgtgcacagaagttttcattactgtgtaaaaactggaagatggatatcaatggtcaactagcaatctatgcatttaacatgcagggaagattgaaatatcattcagaaggctttgctgtttttgttgcaaggatgtttgtttagcatttcattacaaataagggtttcagtcatatttcaatttaagaaatgttacaacataaagtaagtatactttaaaggataaagtaagtatcctactctgtatcttactatattttagaagttttatttattttttagtggaaaatccattctaagtttcagacagccttcccaccattatttaattgacgtttctcaaatatatgaaaatgaggtaaaaccagtttgccaaaataaacatccagagttctttttaaaaacagcagtccaaaatcctatattattgccatgtgtccctgtggtttcagggactctgaattcaaagggctatttccagatgaaatatcagaattgtagcatttattgtgtattctgccaaagattttgtcaaaaatagtaatgactttcaggtctgtgggaatatgggttgcagatgtgttgtttgaatgcctgaaaaggaaatcatagtattctttattttggtgataaaagtatttgtgtacatgtgccattttgatactgaacactatataatttttgtgatctttttggaatgtgaggactaagtaatgtaagtggtgaagaaatcccattaaaagtatacgttttctagctaagccatatattaaattttataatttgaaaaacaaaaatatcagtgtttagttatactgttttttgtttgtggacccattttctttcttgcttcatatttttctgcctttatttaaaatgtttgcttcaataataaatattttaaagtcattatatcttaacttttttgttcagaaaaggaacaacttagcataagaacagagcagaagtaggcatggcatagtggctcatgcctgtaatcccagcactttggaaggccaatgtgggaggatcacttgaggccaggagttcaagaccagcctggacaatatagtgggacccttctctctaccaaaaagaaaaaagtaaattagctgggcatggtgggacatgcctgtagtcccagctacttaggaggctgaggtgggagaataactttagctggggagtttgaggctgcagtgagataagctaaggttgtgccagtgcactgcagcctgtccagcctgggtgacagagacagagtgagaccttgtctcacaaaaaaaaaaaaaaaaacaataacagaaacaaaaacaaacaaacaaaataaaaaaccagaagtagaaaatagcattgtaaaaactatgttgtaaaaggacatttcaatttaacaatattaatatttgcttattttcagttaatctacttcagcatgcaatctcatacttcatcaagcgcacttggtattgtcactgtttatacatgaagcaatacatgctgaaagtataagtgagttgctaaggaaaacaggtagtaagctaagctaggatagaattcaggccgctgttttatgaataccaaatcagtttttttttaaatttgtttagggataatttacaaacaattaaatgtacttatggtgagtatacagttttcagtattcataaaagcactttcaagcctctttgcagtcaggctcccaactacctgttttcttctcccaaccctacctactctcaaggccccaggcagccattgggctgctttctttcgttatagatcagctttacatgttttagaatttcatgtgaatggaactatgcagtgtgtattctggctcataactttatttgcatagtataacatttttgagatgtctcattgtgtgctgtatatcagcatttcattccttccattgctgagtagtattccattgtattgatataccacttttactttttgatgaatatctggtgatttcaagttgtgggctgacatgaataaagcagctatatacattcatgtctaaatctttttgtgggtatgttttaatttttaacaactttattgtgatacaattaatttataaaatgtgcatatagaaagtatacaactgggtaaattttaaaatgtgtacatacccatgaaactgtcaccataatcaagatgataaatcctcaacctgcccaaattttttagtacccatcataattcctttctccctccttcctacctcttcactcagtccccagaaaaccactgattagatttctgtcattatagattggtttacattatccatacatttaaccatacagtatgtacttcttttttcggtctggtttcttttattcagcgtaattgttttgcgattcctccatgttgttgtaagttttaataatttattctttttttcctgctgagtggtgttccattttatggatacaccccaatttgtttatgcattcaccagttggtggacatttgggttgcttccagttttggactataaccaataaagctgctatgaacatttaaatctttgtatggacatatgttttatttgaataatatataggagtagaatagttgggttatatggtaggcatatgtttagctttttaagaaactgcccaacagtgttccatagagttcgtactattttacattcccatcatcagtatatgagttccagtttctccacatccttgtcattacttggtatggtcagatttttcattttagacattttagtgggtgtgtgaccatgtctcatattttaaattagcatttccctaatgtctaatgatattatttgccatctatatatcttctatagtgacatatttgtttaaatctttcacatttgttttatttgggttgcttattttcttactgagttttgaagaactcttcatatccttaacagatacacaatttgcaaatactttctccaagtttgtgggagaagcagataatttcttaactttgaggaacttacttttttttcttttattaatcatgctttgagatcacttctaatgcatttttgcctaacttgttgcagacttacgctttcatgcatgagcgctatagttttagattttacatttagagtctgtgatacattttgagttaatttttgtacatactttaaggtatgggttgaagttcattttttatatgaatatttagtcattctagcaccatttattgaattccctgctgaatttttcttgcactttgttgaaaatcaattaaccacgtgtgtattggtctatattgggactctatactgccccatcaatctatttgtttagctctgtgccagccataatctgtcttgattacttaggcttataataaatcatgaaatcaggtgaaatcatgtagtataacttcttcaactttgttatttttgaatttgctttagttatctattatttcaaatatttttatgaggtgtagaatcagtttctcaatttttccaaacaagtctgctggaatcttaattgaggatgcattggatctacagaattgacatcttaaccatattaagccttctgactcataaatataatacatccatatatttaggtcagtgtttcctacccaggggagattttgctcatctagggtcacttggcaatatctgaagacatttttgattgtcacggccagcagctcctaacaggcatccaatgggaagaaggcagggatgttgctaagtattctataaggtgcagggcttccctccaccccaaaaattatctgatccagaatgtcagtagtgttgaatttataaatcttgatttagatctcatcaattactcagcaattgtttgtagttttcaaattatagatcttatgcattttatattaggtttatcactttgaagcagaaagtgaggtcactgaattaaaactttccttttttctgatatacaatttaggatctaaattttattccaaatgcttcatttggaataacttcattcctcacattttggtatgttgtgttttcattttcatttaaagtatttcctaatttcccttttcattttagtcctcacccttgaattaattagtagtttgtaattttgttttcaattttgtttgatattacagatatcgtgccaatactggtttttaatttaggtccattgttgttagacaactttatgtgacttgaatccctttaaatttattgggacttgtattatggcactgaatgtaaccgttgttcaatgttttgtatgcacttgaaagaattattcatttgctatttttgggtgttattagatgtttgggtatttttaggaattaattagatcaggttggttggtggtgttaagttttctatattcttgcttattttctgtctacttcttttaaaagtgactgataatgtattaaaatcaagaactgtaattctatatttgtcttacttctccttgaagtaatatcagacattacttcatgtattttgagtctttgttaattaggtgtaaaacattaagctttgacatgctctcttgatgagctgacctctttttcactatgaaatgaccctctaattctattgatgttatttgtcctgaaaatctactttatgcatgttcttatactcctctagttttcttttgattggaatccacgtggaatattttttcatccttttgcttttaattatttttctctttatgtaaattagatttcttttaggaagtgtatagttgggtgttgtttttttaatccagtctatcaatctgtgtttttccattgggatgtttaggccatttatgttttatgtaattattgacaattacataaaaaaatggtggtttaaaaatctactatctctgtttgttccatctttattttatttacttgttcctctctgttttattttgggttaagtattttttattattcttttatctttttagttatcttgttatctataactcatctttatgctatttttatgtttgctttagggtttatagcatacatctttaccttatcacagtctacattgaagtgatatactacttcacagatattatggcaccatactttcatttctgcttttatgagcttatgctattgtggtcatacattttacttctacatatcttatacacttcacagttattgttacattgattttttttacttttaacagttaacttacttttttaacttttcattttgaaataactttagagtcgaaaagtttcaacagtaatacacagaggtcctgtgtacccttcactcagctttcccgatgataacaatatataactgtagtacattattgaaagcaggaaattgactttggtacaatattattaactaaactacagactgtacacagattttatcagtttttatgtgcactgtttttattgttcttgttgttgtttcggcatatagttatgtgaatttggttccacatatggattcatgtaactaccaccatagtcagggtacagaactcttttattacctcaaagaaacctctttattcccttgtgttaccccctttatattcagactatccatccaatataatccctggtagccaccgatctgtttgtcactgtagttttgtcactttgagaatattagtggaattgtacaatatatatccttttgagattggctgcttttcactgaccctaatacttttgagatccaccaaatcgttgaatgtatcagtagatcattttctttattgttgagtagtctattcttacctcatggaatgccatggatgcaccacactttgtttattcatttattcactgaaaaaaacctttaggttgtttccacttttttggctattagaaagctgctttggacattcatgtacaggtttccatgtgagcataaattttcatttatttagtacaagggttggcaaacaatagcctgtgaattggctgcccattttgggaaataaagtttcactggaatgcatgcatgcttatatattgtctgtgtgtacttttgtgctacaatggcaaagttgaatagttgcaacagagtcctctatggtgtgtaatgactcaaatatttacctttcgcccttttagaaacaggttgctgacccctgctctaggataaataaatatctaggattgtgaatgcagggctgtatggtaagtatgtgtttaactttatcagcaagtgctacattgttttcccaaatgggtgtactattttacattcttaccagaaatatataagatctacattcttatcagcacttggttttgtcagaatttttgcctttagccattctaataggtgtgttatggtatcttattgtggctttaatggacatttctttaatggccaaggtgctgaaaaatcttttcatatgtttatttgccatctctgtatcccatttgttggtttgttcaaatcttttacccctttttgattgtatttttatttttgttgtatgtgtaatgtgaaactattttcttctagtctcttgctggtctgatcattttattaacagggtcttatgtagagcaaaagcttttatttttgatgaagtccaatttgtggactatttttcttctatgcttttgcttctggtgtcatgtctaaggactcttcccttaaccctatgtcatacaaatttttgaatatggtttcttttaaaggttttgtagttctgtattttacatttatatctataatctattttgaattcctttttgtataaagtatgaggttgaggttcactttcttggctatgaatgtcaattgttctaacaccattagttgaaaagactcttctctctccattaaattgcttttgcatcttcgttaaaaatcattgactggacttgagtgggtctatttttgtattttctatgctgcctcatggatctatgtatctgtccctccaccaacaccacactgtcttaattactgcagctacatccttaccctttaagttgagttatgtgggctgggcgtcgtggcacatgcctgtaattccaacaggccgaggcgggtggatcacctgaggtcaggagttcacaaccagtctgaataacatggtgaagctctgtctctactaaatactaaaaaattagccaggtgtggtggcgcattcctgtaatccgagctacttgggaggctgagacaggagaattgcttctacctgggaggcagaggttgcagtaagctgagattgtgccattgcactctagcctgggcaaaaagagtgaaactccatctcatcaaaaaaaaaaaaaaaaaaaaaaattgagttacgtgaatcttccaactttattcttttgaaaaattttattttagataatttacttactttgcctttccacatacacttttaaaatcagttttactctatttatttaaaaaaattgagtcatagagtttatcaacatggtatgtctatataggtttactttgaaatcttgcatcagaattttgtagtttttagcatacagatcctatacatgttttgttagatttatgcctaagtatttcagtctttttggcactgttataagtggtattatatttttaatttgagtttacagtggctcattatgagcatctattaatagaaattcaactgacttcttttgtgttaaccgtatattctccaaactttctaaattcccttatttgttctaggtggttttttgttgttattgttgtttgcttttaagattctttgagaattttttctgtaaacagtgatgttatctgcaaatagatgcagtttaaaggctgttgcagagagcttcaaggcccaggcagagacttgctatggggatggggctgccacagagcccccacaaagtcaatgcccaggggaactgtggggtataagctgctactgagagcccccttctccactactgcaatgcctggtagagctgtgggaagaaggccacctgaatactccagaactaagagccacggtatgcagtgccagcctggcaaagcttacaagcataggttttaaatgtgtgagagctgtaatgtgggctgtgccagcaaagccatgggggcaggaatgtccaaatcttagagactcaatccttccaacgtatctggaaggtgggacatggaaccacataagattattctccagccttatggtctaacattgtatgccttgttgggctttagacatttctgggacttgcaactcccttcttttttcctgtttctctttttggaatagaaatacctgtcttacgcctgcattgtgttttagagcgacaaaacttacctgtttgattttacagggaaatttgcttaaggattaattgttccttgagtctcacccatatctgatttagatgagactctggactttagacttttgtgttgctgctgaaatgagttaagacttttggggctactgggatggaatggatgtattttgtgtgttataaggacatgaatttggggggctaggggtggaatactatggtctgaatatgtctcccaaaatttgtgtgtggaaaacttaacccctgatatggtttggctatttccccacccaaatctcatcttgaattgtagctcccataattttcacatcttgtgggagggacctggtagatgataattgaattatgggggcagtttcccacatactgttttgtggtagtaagtctcacgagatctgatgcttttataaggtgatacccttttcacttggttctcattctctcttgcctgccgccatgtaagatgtgcctttcaccttctgccatgattctggggccttcacagctacgtggagctgtgagtccattaaaccgtttttgtttttgtttttttttaaataaattacccagtcttgggtatgtctttatcagcagtatgaaaacggactaataccatccccaattcaacagtgtgaggaaatggggcctaatggtgcatgatcaggtctggagcaatttattcctccatatagatccagatttccatgtaataatatttttcttctgtttgaaggacttcatttaatattccttatcatgtgagtctgcttaggatgaattctatcggattttatgtatcttccaaagtctgtactttgtctttctttttaaaagttattttcactgggtagagaattctaagttgactttttttttttttttcagtactttaagagcattgctctgccttctggctagttttgttagtttgtttgtttgtttgctgagaagtcatctgtcatttatttatttatttatttttattatactttaagttctaggttacatatgcaggttttttacatatgtatacatgtgccatgttgctgtgctgcacccattaactcctcatttacattaggtatatctcctaatgctatccgtccaccctcctgccaccccacgacaggccccagtgtgtgatgttccccatcctctgtccaagtgttctcattgttcagttcccacctatgagtgagaacatgtggtgcttggttttctgtccttgcaatagtttgctgagaatgatggtttccagcttcatccatgtccctacgaaggatatgaactcatcctttttaatggctacatagtattccatggtgtatatgtgccacattttcttaatccagtctatcattgatggacatttgggttggttccaagtctttgctattgtgaataatgccgcaataaacatacatgtgcatgtgtctttatagcagcatgatttataatcctttgggtatatacccagtaatgggatggctgggtcaaatggtatttctagttctagatccttgaggaatcaccacactgtcttccacaatggttgaactagtttaaagtcccaccaacagtgtaaaagtgttcctaattctccagatcttctccagcacctgttgtttcctgactttttaatgatcgccattctaactggtgtaagatgatatctcattgtggttttgatttgcatttctctgatggccagtgatgatgagcattttttcatgtgtttttgggctgcataaatgtcttcttttgagaagtgtctgttcatatcctttgcccactttttgatggggttgtttgatttttttcttgtaaatctgtttaaattctgtgtagattctggatattagccttttgtcagatgggtagattgtagaaattttctcccattctgtaggttgcctgctcactctgacgatagtttcttttgctgtgcagaagctccttagtttaattagatcccatttgtcaattttggcttttgttgccattgcttttagtgttttagtcatgaagtccttgcccatgcctgtgtcctgaatggtaatgcctaggttttcttctagggtttttatggttttaggtctaatgtttaagtctttaatccatcttgaattaatttttgtataaggtgtaaggaagggacccagtttcagctttctacatatggctagccagttttcccagcaccatttattaaatagggaatcctttccccattgcttgtttttctcaggtttgtcaaagatcagatggttgtagatgtgtggtattatttctgagggctctgttctgttccattggtctatacctctgttttggtaccagtaccatgctgttttggttactgtagccttgtagtatagtttgaagtcaggtagcatgatgcctccagctttgttctttttgcttaggataatcttggcaatgcgggcccttttttggttccatatgaactttaaagtagtttttttcaattctgtgaagaaagtcattgctagcttggtggggatggcattgaatctataaattaccttgggcagtatggccattttcacaatattgattcttcctatccatgagcatggaatgttcttccatttgtttgtgtcctcttttatttcattgagcgtggtttgtagttctccttgaagaggtccttcgcatcccttgtaagttgtattcctaggtattttattctctttgtagcaattgtgaatgggagttcactcatgatttagctctctgttattggagtataggaatgcttgtgatttttgtacattgattttgtatcctgagactttgctgaagttgcttatcagcttaaggagattttggcctgagatgatggggttttctaaatatacaatcatgtcatctgcaaacagggacaatttggcttcctcttttcctaattgaataccctttatttccttctcctgcctaattgccctggccagaacatccaacactgtgttgaataggggtggtaagagagggcatccctgtcttgtgccagttttcaaagggaatgcttccagtttttgcccattcagtatgatattggctgtgggtttgttgtgaatagctctcattattttgagatacgtcccatcaatacctaatttattgagagtttttagcatgaagagctgttgaattttgtcaaaggccttttctgcatctattgagataatcatgtggtttttgtctttggttctgtttatatgatggatcacttttattgatttgcatatattgaaccagccttgcatcccagggatgaagtcaacttgattgtggtggataagctttttgatgtgctgctggatttggtttgccagtattttattgaggatttttgcatcgatattcttcagggatattggtctaaaattgtctttttttggttgtgtctctgccaggctttggtatcaggatgatgttggcctcataaaatgagttagggaggattccctctttttttattgattggagtagtttcagaaggaatggtaccagctcctctttgtacctctggtagaattcagctgtgaatccatctggtcctggactttttttggttggtaggctattaattattgcctcaatttcagaacctgttattggtctattcagggattcagcttcttcctggtttagtcttgggagggtgtatgtgtcgaggaatttatccatttcttctagattttctagtttatttgcgaagaggtgtttatagtattctctgatggtagtttttatttctgtgggatcgttggtgatatcccctttatcattttttattgcatctatttgattcttctctcttttcttctttattagtcttgctagtggtctatcagtttagttgatcttttcaaaaaaccatctcctggattcattgattttttaagggttttttgtgtctcttatctccttcaattctgctctgatcctagttgtttcttgccttctgctagcttttgaatatgtttgctcttgcttctctagttcttttaattgtgatgttagggtgtcaattttggatctttcttgctttctcttgtggacatgtagtgctataaatttccctctacacattactttaaatgtgtcccagagattctggtatgttgtgtctttgttctcattggtttcaaagaacatctttatttctgccttcattttgttatttacccgtagtcattcaggggcaggttgttcagtttccatgtagttggcagttttgagtgagtttcttaatcctgagttctagtttgattgtttagtgcgatgtggttctgagaagaatgtatattctgttgatttggggtggagagttctgtagattgtctattaggtctgcttggtgcagagctgagttcaattcctgggtatctttgttaactttctgtctcattgatctgtctaatgttgacagtggggtgttaaagtctcacatccttattgtgtgggaatctaagtctctttgtaagtctctaaggacttgcgttttgaatctgggtgctcctgtattgggtgaatatacatttaggatagttagctcttcttgttgaattggtgcctttaccattatgtaatggccttctttgtctcttttgatctttgttggtttaaagtctgttttatcagagactaggattgcaacccctccttttttttttattttccatttgcttggtggatcttccttcatccctttattttgagcctatgtgtgtctctgcacatgagatgggtctcctgaatacagcacactgatgggttgtgactctttctccaatctgcctgtctgtgtcttttaattggagcatttagcccatttacatttaaggttcatattgttatgtgtgaatttgatcctgtcattatgacgttagctggttattttgctcgttagttgatgcagtttcttcttagcatcgatggtctttacaatttggcatgtttttgcagtggctcatactggttgttcctttccacgtttggggcttccttcaggagctcttataaggcatgtctggtggtgacaaaatctctcagcatttgcttgtctgtaaagtattttatttctctttcacttatgaagcttagtttggctggacatgaaattctgggttgaaaattcttttctttaagaatgttgaatattggcccccactctcttctggcttgtagagtttctgctgagagatccgctgttagtctgatgggcttccctttgtgggtaacctgacctttctatgtggctgcccttaacattttttccttcatttcaacttcggtgaatctgacaattatgtgtcttggtgttgctgttctcgaggagtatctttgtgacgttgtctgtatttcctgaatttgaatgttggccttccttgctaggttggggaagttttcctggataatatcctgcagagtgttttccaacttggttccattctccctgtcattttcaggtacaccaatcagacgtaggtttgttcttttcacatagtcccatatttctcggaggctttgttcatttctttttactcttttttctctaaacttctcttctcacttcatttcatccatttgatcttcaatcactgataccctttcttccacttgattgaatcggccactgaagcctgtgcatgcggcatgtagttcttgtgccattgttttcagctcattcaggtcatttaaggtctcttctatgctgtttattctagttagccattcatctcatcttttttcaaggttattagcttcttttcaatggattcaaacatcctcctttagctcggagaagtttgttatgaccgatcatctgaagccttcttctctcaacttgtcagagtcattctctgtccagctttgttcctttgctgacgaggagctgcattcctttggaggagaggaggtgctctgatttttagaattttcagcttttctgctctggtttttccccatctttgtggttttatctaccttcggtctttggtaatggtgatgtacagatggggttttggtgtggatgtccttcctgtttgttatttcccttgtaatattcaggaccctcagctgtaggtctgttggagtttgctggaggtccactccggactctgtttgcctgggtatgaccatcggaggctgcagaatagcaaatattgcagaatggcaaatgctgctgcctgatgcttcttctggaagctttgtctcagaggggcacctggccatctgaggtgtcagtcggcccctactgggaggtgcctcccagttaggctactcgggcgtcagggacccacttgaggaggcagtctgtccattctcagatctccaagtctgtgctgggagaaccactactctcttcacagctgtcagacaggaacgtttaattgtgcagaagtttctgctgccttttgtttagctaggccctgcccccaaaggtggattctacagagccaggcaggcctccttgagctgcgttgggctccacccagttcgagctttctggccgctttgtttacctactcaagcctcagcaatggtggacgcccctaccctagccttgctgcccccttgcagtttgatctcagattgctgttctagcagtgagcgaggctccatgggcatgggactctccaagccaggcgtgggatataatctcccagtgtgctgtttgctaagaccattggaaaagcgcagtactagggtgggagtgtcctgattttccagttgagaggtgacaacatgcaagcagcccttgcttgctcttggtgcctccttggccttgtcgtctgctctggctgcacttgaggagcccttcaggccaccactgcatatgagggcccctctctggtgcttgccaaggctggagctggctccctctgctggcggggcagtgtgaagagagaggcgctggcgggagttggggctgtgcgtggtgctcgcgggctggtgtgggttccaggtgagcacgggctgggcaagcgccgcagtcttcacggccggctagctccttctgggcttgatcggaggctgaatcccatgcttggaccgctgttccctattcgtggaatcattgaccatgatagcaggtctccgtctctttctcgctttccctattttcctcttgattgtctggaacgagctccctctgggctgccggagtgtccggggtaggtgccgcaaagtcccgcggtgagtgccagtgagaggtgaagctggctgggcttctgggatgggtggggacttggagaacttttgtgtctagctaaaggattgtaaacacaccagtcagcactctgtgtctagctaaaggtttgtaaatgcaccattcagcactctgtgtctagctaattgggtggtgacttggagaacttttctgtctagctaaagggttgtaaatgcaccagtcagccctctgtttctagctaaaggtttgtacacgcatcaatcagcactctctcaaaacagaccaatcagctctctgtaaaacgtaccaatcagctctctgtaaaatggaccaatcagctctctgcaaaattgaccaatcagttctctgtaaaatggaccaatcagcaggatcagggtggggccagataagggaataaacgcaggcaacctgagccagcagcagcaactcactcgggtacccttgcgtgttgtggaagctttgttctttcattcttcgcaataaatcttgctgctgctcactctttgggttcgctctgcctttatgagctgtaacactcactgcgaagttctgcagcttcactcctgaagccaacaagaccatgaaccctctgggcagaaggaacaactctggacacgccaccttgaagagctgtgacactgaccgcgaaggtctgcagcttcactcctgaaatcagcattgaccacgaacccaccagaaggaagatactccggacacatctgaacagctgaaggaacaaactctggacacaccatctttaagaactgttaacactcaccgcgagggtccgcagcttcattcttgaagtccgcgagaccaagaacccactctaagtaatcaattctggacacacaggtaccgtctgtcatggcatcccttggctaggaaaggtaattgcctgaccccttgagcttccagggtgaggtgatgccccaccctgcttcggctcatgctctgtgggctgcacccactgtctcacaagtcccagtgagatgtacctggtacctccattggaaatgcagaaatcacccatcttctgtgtcgctcacactgggagctatagactggagctgttcctattcggccatcttggaaactcctcctaccttatctttcttatctaaggcagtatgccttttttttttttcctcagctgcttttaaggttttttcttttttatcactgcctttaagcaagttgattataatatgccatgatgtagttttctttgtttattgagctttgatctattcatttatagtttttctattttcttttctcgttttttggggattccatttatatgtatattatgtttctgaaatttatcacacagcccactgatcctgtattgccccctgccaccatttttttgcttcctgtgttttgttttggatagtttctattgctgtgtctttacattcgctaatcttttcttctgctgtgctttgtctaatgtgttgtttttttcatctcaggcatggtgatttttatctttctaagtcttttaaaatatatttcaagttttgtttacattcttgaacatagggaataaaattgtaataacctttaatgaccttgtgtatgaatatttcttaatctttgttatttttggttttgatagatttttctgctccatatgtgttctgtttttctttttctttgcatgcctgtttatctttgattgtatgctaaacattgtgaatctttttatttggtacagtatatttgtatattcctatacacttttgctttgttctgggacgtaggtaagttatttagaaacagttatactttttgctcatgcttttaagctttgttaaacaggaacaaacatttattttaggtttaattttaccccgctattgaggcaaaatacttctgagtccttttacctgatccctattgtttttatacaagagggtatagtgaataattttgtgattatatgtggtattttagctttgtgtgtcaaatacatcatcttgtctttagcaagctagatcaccaattctgacgacccacctattaatagatttgtgcttattttgctcatgcagaaactttgaaaatctgagatattttcttcctttcttgccctctgctctggcttagtcttctggataccattgcttcattccatgcacataagacattcagtgtcaggaaaagaattatccgggtacttgttgaaagttgtgttgctcctcattgtttagttactgttttggaatttgggttttcttttgactatcatcgttccccaactttaataaaaacttgctattaattattgtcattaagttataatcatttaaaattaattaaagataaaacacttaaggtgaacctcagccttttaaattctcacttcaaaatttcaaattttcagaatatttttggttacctacattctgaatgctgtttcaaattattgcatagaaaaaaaattttaagattgatttctgaagcaataaagacctgcagtactcttcattgatttaattgaattatattcagttattttcttaaataggcattttctttatttttaaaagcaaactgtttattatgaaattcagtcaaaaatcatattaatgggttctggagatctaatttataccatggtgactataggtaccaatattgtactgtatttgaaggttgctaagaggatggatcctgtgttctcttcacaaacacacacaaaagaggtaaccgtgtggtgatagatgttaattagcttgattgtggtgattatttcacattgtagacatagatcaagtcatcaagttgtgtaccttatatacaaaaaaatccagtttttatttatgattaccatccaaaagttataaacaagtaaccaattgaaaaaattaacagaatctaagatattttaggaacatcaaaaatcagatgatgatgttgatcatgatgatggcacgtaattatataaaataactgctaattaaattggtttaaaagggatattttatatatgaatgaagaacagaaatcttcactgatgataaatatcacaaattatataataattagacttaactgggatgtttcagtaggtgagtttggaggggatgcaatgtagtctagttgtgttcacaccctccaaaactactgaatttagcaagtttagtgaggcagctatagaaatattgttcaaattacatatggttattaaccatttttgaatagctatagtcttatatttcaaaatattactattaaaaccgtttatagccaggagaatcatattgtgcatctgtaacccgttcttggcatgttattgtccactgcctaggtagtgatgaaccctcctgactacctggatttgaatctcagcactgcacctttcaaggtgtgagattttggcagcttattcaactgtttgtcctcaattgttttgtttataatttagaaatagtactagtactggccttaggaggtggttgtaaggatttaattaattagtgtgtgtgtgtatgtgtgtttattctaggacagttctttcttgtaacagatcctttaaaagtctttgttgttagtatttacttgtctattctagtatatagtaaattccttgagggaagtggtcatgtttagctggatttcaaactgcagcaaatccgtatgttctggggatggtcttttattgagaggacatgtttgcatagtggacagaacatagtatctaggcctgactcttgaatttaattatttctaatcatatatttctcagcaaacatttatctactttataatggaagtacttgagttcagatagattaataatgctaactcacagggttttatgcttgtggactgtgcttgtaaactgaattggtgtactacatgatgccattggggtgatgtttctcatttagaagggcctcaaacatatgcttctgatgttatctctaaatgattttatacacatagtcagagcacacattatatgtacctatttaaaactgtttcccattacaagccatactgcttgaagtgcactataaataacatcattttaaatatgtcaatccagtttttataacctttataaccttttactatatctggagtctaataaattgggagtggcttgggtcttccttgaccttatgagaggccttgttagatatttgttattgcttgctatatactttatcaaatatgtttgctagtagacccagaactttcaatttctgtattgaattttctggtagggtaacataacatgcattgatggaagtatacttacaaagtatactataagcaaagtatattagcaaaacctagcacacaacaaaaactagcacactttgctagtatactttataagtatactttaattaatgcatattatgttactctgccagaaaattcaacaaaggattatccatttccatacttttttcattacatttccagtcttgtaataattaaaggcaagtttctttatttgtgcaactccttgtaagaatgtgatatttttagctacaaatgattcaacagcagttcagtagtggggaattgctcgtagtgactagaacaatgatggtggattatagtgatgttttctggcttgttatagttcttggtcatttatgtgttttgagaggtaatatatattttttattgcttaattttagacttatagagaagttgaaaaaataataaagagaatttctgtatacctttactcctgtgtcccctaatgttcacatattccattatataattatagtacaattattaaaactaagaaattaacattgacatagtaatctacagattttatttcagtttcaccagttgtcccactaaagatctttttcttgtctagcatacaatccagtatcccacattgcatttcattgtctctttagttttttacagtttgtggaagttcgttagtgtttgtttttcatgacattgactattttgaagactactggccattgagagtttgtaggacgtccttcactttggatttttcctcaagattagattgagtttatacatttttgacaagaataccatagaaatgatgttgtacctttctcagtgtaacatattagaggatacttgatattcttaagcattactgtgggtgatattaactttgaatacttgcttgaggttttgtttgctaggttttgctaatttctccttttgtaattaataagtatcttgtgaagagatattttaagagaatacaagtatcttttgtttcattatacttttaccaactaattttagcagagttagcaaatacagtcacatgttgtttaacagtggggatatgttctgagaaatcttcgttaggtgatttctttgatgatgtgcaaacatcatagagtatacttaatacaaacctagatgacatatcacacctaggatatatagtatgtatagcctgttgctccaaggctacaaacccatacagcatgttgctgtgctgagtactgtaggcagttgtaatacagtggtaaatctttgtgtatctacacacacctaaacacagaataggtacagtaaaaataaggtattataatcttatgggactacgcttttccttgttgactgaaatattgttatgtggtgcatgattttatggttggttgtatactcatacatatacattcacacatctgcatttgtccatctgtatttatgttaaaagccattagttcaatgtagagtttactctagcctttccttctttcttatttgtaactttctctgacagtgaaatctggctttcatttttcacaatatgttcacttattttctcagtcctagtatgcatgtgtattagggttctccagagggacagaactaataggatatatgtatatatgaaagggagtttgttaaggagaattgactcatatgatcacaaggtgaagtcccacgacagggcgtctgcaagctgaggatacaggaagccagtagtggctcagactcagtccaaaagcctcaagagcagggaagctgatagtctgtggccaaaggccagagatcccccgcaaaccaccgatgtaagtctaagagctcaagggccgaagaacctggagtctgatgtccaagggcaggaagcatccagcacaggagaaagatgaaagccagaagactcagcaagcagcttatcccacctttctcgcctgctttgttctagccgcactggcagcccattgagggtaggtcttcctctgccagtccactgactcagatgtcagtctctggcaacacccttaaagacacaccgagatacaatattttgccagctatctaggcattcttcaatcaagttgacacgtaatattaatcatcacagcatgtaaaacagtttaagaattgctaatgaatatccctgtgaaaaacaaatttttaaaatatagtacagtatttgatatagtcctttttgtctttatgcatatatttaaaatttcttaatttagttttattctttcccacccctttctgtttctcaatttcattttggattcatctcaattctagctggtattgattaattatttacttttgggtatgtgaacaattacaaaaaatcagaactacctaaaaaggtatattcagagatgtgccactgcactcttaccctactacactcttctcatttccagacattttacattacatttccatccaacccttttatgtagccaagctcattagtttctggtttatgtgtcccgtatttcttttgtacaaatgagtatgcacattttcttatattctttcttaaatgaagggtagtacgctataaacacaattcttttgcattttgcttttttacatagcaatgtattctggaaatcactccatatcagctcataaggaacttctccttttttgtgtgtacaagtacataatatgccatttagggatatgtcaactttcaacaaccctccaatgtatgggtatttgagttgtttccagtatttcattatgtaaacaacactgcaatgaataacctatgtatttttgtattgttgaaggtttatcttttcaggtgaattcctacatgtgtgattggtagatcaaaaagtaagtatgcatgttgttttcttagatgttgccaaatttctctccagaaaaggtggaccagtttgaattaccactagtaacatatgaaattgcctgattcctcacaccctcaccaacagaaccccattgtttttactttttaattttcttttctctgataggtgagaaattatatctcagtgttgttttagtttgcatttttccaattgcgagtgaatttgaacacattttcatgtctctaaaggtcatttctgtgtctttttttgtgtattgtttgtttgtgtctttttcctcttttttttctatttgattttgatcctttgtccttcaaatttgaagatgttgaaaatgtattagggacattaacactttatttgagtactacttattttgaagtgttccaatataatgtattcattgtgcttctttggtgttggacttcccaaaatattaatctggaacaggtaggtcaggtctcagatattctgaatcttgtacaaaaaaaaaaaaatgctgtttcaatctgtttgtgacagaaatgaataaacttaggaaatgtgattagaaaatagacctctgtgtggccattgttattctctctatatcttttacacctactgtcttctggaaagttcttattgcatgtgtggaaatatcttacctatcagttttcagttaccttcttttattcaaaactgttgtctcctttcttggtattcctatagattttctatatttcattattacatttacattgaattgtgggctggcgttttagctgcctgaggttcagggccttgttgtcatatttccctccttttctgtgcttaataatgaaagttactaataatgaggatggccactgtgtgctgtacgtgatactctgccctgtacatgaaactctgatgatattatccagtaggtcctgttaccatttcagtgttatggatgaggaaactaactctcagtggtgtttagatgaggaaactaactctcagtggtgtttaatttgtctacagccaaatagctagtgagtggcaaagctggaattgaacacaggtggtgtggcttcaaagcatatgggactaattacaatactatatatcatgtcttttacttttgtacttagttaatgtgcttaaatgttaatttagttgatttattaaagttctgtgacattcttgatattccaggtataaaattgggagggccttggccaagggagtggaagtgaaagtaaagtgtaacagcaagagaaattgaacatccacatggaattaagtttggttaagtttgtaaggatatttgaagttttgtgagagtgagtctcctgttttttttgtttgttattttttaattgtcattaattctgattacatcagcaaaaggaacccgttctgtagatggcaactatgtagatgacatctcagagtcaccagttcatttgtacattgttttaaaattattaagagatctcagctgtgatgttatttttatttgctaagtgctaaacattaaacattactaaaatttccatcggagaaattatttgtttaaataattttaacaaagccttgattagcataaatatttcttaatggggttgcttgccaagttgagatacaatgcttatgatacaattttgaatatataggtgttcctttacacttggtaacacttaaatgtagagattcaaatagttaccagtgacagtactttttgatgaaaaatgataaccttttccatactattttacaggtgcctcataactctatggaataagtgtgattatttgttagtattattttaagattaaatgacttacgaaagtcctgctccagtgctgttttgatattttgagaattagttttgttattattgtattttaatctacctttatactgaaaatacttaggtatagtaaggtctattacatttataagtgaagtgaaaataccaaaatgtgtagtaaaacagctacctgaccaattttaaaggaatgtactacttcatattgcaagttcacccactttgatcactatatgtgtatcaaaatatcacaggtatgccataaatatataaaattatgtaacaatctaaactaaaaaaataaaattataagaaaataactgttaaaagcaacattctaacattctgttgtggagttggtatttccatttcttttgcttcttattccttcctgctgatccatatttctgtctggtatcatttcattttatcctgaacaaattcctctagcatttcctgtagtacaggctggctggcaacaaattcccttagttttattttaattttgccttcaatcttgaaggaccttttctctgaacaaagattctagattgaaggtttttttctttcttttagaaatttcaatgtgttgttttgttttctcgtctccatttttttttctgataagttagcattcatttgaattattgttcttttgcatgtaattgtttttccttgactgcttttaatattttctctttaactttgatttttagcagctcgactatgatgtgcctaggagttttctttcttttttttaatttcaataggttttagggtacaggtggtttttggttatatggatgaattatatattggtgaagtctgagattttaatgtaccagttccctaattagtctacattctaccctatatgtagttttttatccctcattcccctctgccttccccccttctgagtctcagatgttcattatatcactctatatgtctttgtgtaactatagcttagctcccacttgtaagtgagaacatgaagtatttgattttccattcccaagttacttcacttagaataatgacctccagctccatccaagttcctgcaaaagacatcatttccttcttttttctggctgagtaatattcctctgtgtgtgtgtgtgtgtgtgtgtgtgtgtgtgtgtgtgtaaaattgaacatccacatgtagtcagtatatactgaactaatttgatcaagtttgtaaggatatttgaagttttgtcagggtgagtcttcccaatatccttacaaacttcacctaatgactatttctcagaacatatccccactgttaaatacccatgcatgcatataccatattttctttttccaaggagtggacttttaaaaatgttttcttttttgtttgtttgtttgttttgtgtctccccacccccccccccccacccccacggattggctgagcttcttgaatctatgaatgtatgtctttcaatcaaattgggaaattcttggctattatttttaaaatgcttttctacctccattctcttttttccttttcttctaagactttaaaaatccttctgctgtttgtcctgcagattggataatttatattgatctttcttcaagttcattgtctctattttcatctcaatctagtgatttaaaaaattttatagttttttatttgtaatatttccatttggttcttgtttatagcctttatttcccccatgaggttttctgtattttcatttgtcatgatcataaattattattattatttgagacggagtctcactctgttgcccaggctggagtgcagtggtgcaatcttggctcactgcaagctccgcctcccgagttcatgccattctcctgcctcagcctcccgagtagctgggactacaggcacccgccaccacgcctggctaattttttgtatttttagtagagacgtggtttcaccgtgttagccaggatggtctccatctcctgacctcatgatccgcctgcctcggcctcccacagtgctgggcttacaggcatgaaccaccacgctcggctcataaattatttttaatccttaattacagtgataatagctaattaaaaatccttgtctgctaatttaaacatctagataaacttatgtcagtttccattgactgtggcttttcttcagtgtgttatttctctacttgttgacaacttttagatttaatactgaacattgtgaatgatgtagagaggagattctcttagactcatctgaggagtattggttttttgaggtaaggaggagtctgttttctgagtcagttaacttggctgtatttcaacttcaaactttgtttcctatgtggtaggtgttagctgaaatttcaggtcagttcttttaaccttagcactgttacttggagtctgtctcaaatatacttcatttagagtttagcaagagatttgaacagtttatccataggatttagagcttctctcctctgcttcttcctttctaaaattgtcttcctcacttttcaagtgctgtgatttctctgaaagcctgtcttcaggatcttcaatttaatagaactggtttctgctaaattttagctgctctgcatggctgatatttgagccctcactcaggttatgggaatcttattcagtgttattcttttttttccccagaatcaatctgctttcattcactttcctgtgcagtcaggtcttttttttttttttcctaatattttgtgctgagtttataattgttatctatgatagggttgttcctatgggaatggcctgaccatgactaaaagcagagctctatacttagcttttgagctctccagtcccttatgtctcatgacttttctctatatttcaacaaaagtatgtttatattattgaactttccacttgttaggaaattggtactgtgacctaattccttagaatcagtctttctgctgtcctagtttatgccttgcctaattaaagtcatgcctgtatttgaaaagtggaaaacttccaaggaaagtgagcagctggtattgacactcaaaagagttttatgaaatgaaagtaagcaaagggccagttaggctgaacttcaggaaaaagtatctaatggtgagatttgtgagactaaacaatctggcaaggggactttctctgagctatttcaaactgaattggaaaagtcagggaaaaaacaagtaataagcccaggtcatgcattggcaaatggacagtttgtatgatctcatacttacctttcccagtggctatttggttgtggggtcattagcagaaaagcgctttaggttttacattattaatatgaatgtctgaattggacagagaaaatagatttctcaaaattgcttaaaattgatgataaaaatctttctggaaagtaagaaatcatatattattcatttttgtgtggtgaaattctgtgagagcagggacaggagctctctcatttgtcacggtattgcaagcaccaagcatagtgcctggcaaatagaagacgttcagcaaatattagcattacttctacttttactataccttactaaaaagtgacacacccacaaacaaatgtcaactatcagaagtgacaattaaagttaatgttttccattatttctcttatttttctgtatgttttctttttccccgagtccagaaagcctgaatttaaggcgattaggttttctttgtgattttgtccacaggaaaaatcaaaaggatttaatttagtccactgtgaaatgttactgtaagaaaacaaagtatcaaagatatttgctggaagagagaatattaagcaaagcagttaatcatactgaatctgaagtcagatggtcctgacttttaattctggccacaaattacactcgttctgtggcctttgacaaatacttgctctgtgatctttaacaacttctcaagcttatctgaaccttagtatcatcgtgttttaaaaatgtgggtagaatccatggggtgtggtgatggacacctgtagtcctagctatttgggaagctgaggtgggagggtctcttgaacccaggagttcaagtccagcctgggcaacatagcgaggctttgtctctaagaaacaaacaaaaactccatacacacaggaaagaatcaacccgggtatccatcagtagatgaatggagaaggaaaatgtgatagatctacaaaatagtatactattcagccttaaaacacaaggaaatactgtcacttgtggtaacatggataaacctggaggatattatgttaagtgaaataagccaggcactgaaagacaaatactatatgatttcacttatatgtggaatctaaaaaagttgaactcatggaagcagagagtagaatgatggttacctggggttgggggtggggtagaaggtgcttgaagaaattttggtcaaaggatacacaatttcaattaggagaaataaattcaagggatctgttgtataacacagggactatagaaataacatgtactgtattcttgaaaatcactaagagtagattttaaagtgttgtcaccacaaaaaatcataagtatgtgaagtaatgcatatgttaattagctcaatttagccattgcgcaatgtatatatatttcttttcttttttttttttttgacacacagtttaactctgttgcccaggctggggtgcagtggcacgatcttggctcactgcaatctctgcctcccaggttcaagtgattctcgtgtctcggcctccttagctgggattacagacacatgccactatgcccagctaatttttgtattattaatagagatggggtttcaccatgttgaccaggctgttctcgaactcccggtctcaggtgattcgccctcctcggcctcccaaagtgctggacgtcatcttatatgtgataaatctatcaactaacaaccgataaattcatcaactttaatcagttttaatttatcaattaaaaattaattgattaaaaagcatggatagctagcacctattaaatatggcagttgtgaatttaaaatgagattagtatataaaattgttttgcattgtatctgatacacagtaggtgcttgataaaatatagctgcagttttggtggttattgtattcatcttaatcttctttgtagttccttctttctgttttttagataatttgatactttaacatagggccaattagtggctttgtgaccttcaacatttttgacttaactgttactcttcagttaaattgtttatgaaatgaggggatgaatcaactcagttttgctcccctgtatcaactgtacttggtggacttttctgggagagttattctttgagtactctgagattacttccattgctcactagaatacatgatgtaattctgagtttgtgaaccagatatgacatcattcactatccatttatagcttccgtcttcaattttcaataggtgagaatataaaatacgtttttaaatcctcgtttatataactttacatttttaaaaacaatgattaagtgctcaatttatgttatgcattgtattaggtgcttcccttgagtttgtgaggggtgaaggtatcagtggttgaatcctggaatagatagcttacttaggacatcaataatgataataataataataataaagtaatactgttataatgaagatataataataacaatgaagaaataaaaaatagtaaagagattgtatcaaatgtactcaaaattaatacattttttgtaacagtgtttaacaaactgtaagaatttaaaactaccagcaaaaagaagagcttatgctatattatttttgcaacattgtacagtgaatagcactatccaaagcaagacctttgttattgaatcagaatactgaaacatagtgcattttgctttaattatcaaataaatcataattgacatggtaatatgactatattgatttatattttcatttcctaatggtatctgtagccacgcatagatttggatcaatccactgatgattctttttgttggatcttgaaatgtgagaaaagtctctctacatggtattctgctgttcgcagagcttactttggcctgtttttctatagagttactaagattcagcaggtattcttcaaatggctgaatgacattgaagtgtgttgcattatcttctggtctacaatatttaggttttttttttgagatacaggatatatatgtaatggatatttcattatgtgttatacttttgtaatatgctatactttaataggataataattaaaggcagctttaaagcaaaatgaataactcattcaatacaacaaaaactccaaattttctagtgttgttaattataattattgcttttctttttgtcttttgaagcagtgatcaaagaagttgcatttctgtgtgattcaatattttgaaatatttagttcaactcaatgtagtatttcatcaaaataagatggtggtgttaacactgatttataaatgtaccaatatgctaacctgctaagctgctatctggcaggttgtaaatattctatatgatagcaattttttagggttttgggtagtgatagcagaacatgttgtttctccctattaagataacaatttggttggtatactctgttacaacccagctgcaaaaccaaagtggaccacccacagagagtccagttagagattactgaggtttggctggctaaactactaccacctaaacaaatatcatcaccagttctgtgactcagtgcttgatctaagtaagtgattacttagaagagaatttttccaagtgcccaagcttctgagattctgtatttaaaaaataatagaataataaaagcaggaagaacatcctttgaaacaaattttaaaacctgataattaaatttaatcttctattcgtggctaaattataatactttcctaacttttggtatagcaagcctcttattattttaaatgtgactaaatagcttcatgtgtaataccagcactcttcataaaatattttttgtattgtctgtgttttgccattacaatgagatttttgagaatataagaaatgcacttgttactctgatatcattttattggatatccttgaattgcacacattcgtagcagtgtctcataatgaagtcagtgtattccttttttgggggaagcttcttaatgttaaaagcttcctaagcattatttgctagatcacagtttgaatggcagtgtaactgtgtagtctgatgatatattgtttgcataacagaggtcacatggagttctgagtatttcccagataacttaactaactgctcaattaagaaaaaaagcttgctgaaagatgaagtgatgctttcaatggtcacagagaatacaggtgcaatgaagatctctctaggtgttaactaatgactgagggtacaacataaatatacacacatgttcttatgttgatggaatatgaataatgagattattggacttgtgtgctgtgtgatttattccaaaaatgtatcctagcctttttgaaatttattctatgttctgtcatgacagccataaatcagcatgaggaattattggatttactatggcttgaattgttacctccatgataaagataaatgtaattattcaggaaattatttgcttgtataatttatagtttgctggtcaagaggattttttatattgtaattgatagatagataccttattagaaaaatagcctatgagggttttgttttgttttgttttggagtgaatggattgtttattctggtatgattcctttgctatctcaatttctttttctttctttcaggtgcaagtttaaaataagatttatttaaaataaagctgtgcattttaaaatagcaaggcttcatatatacattttagacacagaaaaagttacaaaaaatgccaaatgtctccataaaattgaaatagaataattagttgtattttggtgttaaaaaataaatgtagtatttcaaaactagattctgaactccatgaatcacataaatcataaatatgacagtattttcttcatagggtagtcttttatatgaatagtttatagtctctgacagtcacaactagaggaaataagatgaagaaccagaatgagttttattaggcaggtggctttcctcctagtaaaataggcttatgtactgctgaaaagtgccatataaaaaggaagaactgttgatgtattgaatcagaagaaattatgttttcctttgcaaaaaggttcatagaaaatcccattcataaagattttttgtcagtatattattttttatcaggccttaaaagctgaccaacagaaaaaacttgaattactataaacctgatggaagtggttttagtttagttgagcctatattaatgatttaaaatcttcattaagttcccataatataatagccatattggattggggataaaaataaataaataaatgaataaatatccataacacaatttttccattgccctcaccaatgttctgtgtgcactaatatattcaacaaatatatttctgccgaaaccttaccactaagagtttgaaactgactagaagcaaaaatcagataaaaggatatagtaacattaaccaaatgtgcagtttgatgtggaagaaggtttaacttttattatacaaattcagttcagtggagattattcaatactatgcttcattaaaatgttttctacatgcattgcctcccctactaaaacatcacatcactacagacttgggactttagccccaagaagtgctccaaagcggaaccatggttagccaagtgttggcataactagttattattttttaaacctacatattacaaaacataccaactaatgactaatgtgatagaaatgcaaaattgaagtaatagttctcagcaactaaagtattgaattaaatgttactaagcaataaaagattaacaaatgttaattccattgttgttaatgatagtttaatattgatgtctgattagtcaaattaaaaagatatagccaaacttttttaaattagtgtttaaggttttttaggcaactaaggttttcttcctaaattgaaacttcatgcctaagaatatttaatgatatatgtaggtataattgaaatagaacttcaggcctggcacggtggctcacgcctgtaatcccagcactttgggaggccgaggcgggtggatcacgaggtcagggattcgagactcagcctgaccaacatggtgaaaccctgtctcgactaaaaatacaaaaattagctgggcttggtggcgggtgcctgtaatcccagctactcaggaggctgaggcaggagaattgcttgaacccgggaggcagaggttgcagtgagccaagattgtgccactgcactccagcctggacgacaaagtgagatcctgtctcaaaaaaaaaaaaaaaaaaaaagaaatagaacttcaaatatatttcaaagacctttaaaagaaggtttttggaaagatctatgttctttttaaagtatttctctttaaattttgacataattgtagattcatatgcagctacagaagtaatatttacagagatcctgtgtgtactttacccagtttcccaaatggtcgtgcagtcgatctacagtacaatatcacaaccagaaaactgacattgataaagcctacccatcctatttcgtcagttttaaatgcattcatttttgtttgtgtatgtattaaattcgatgtgattttatctcatgtaggttcctgtgtctatcaccaaagtcacaaatacgtttctatgaccacaagaatacttcctgttgtcccattcctaacccctggcaaccactaatccattcaccatttctatgattttgtcatttcaagaattttgttctatcagtggaatcacagagcattcaatcttttaggactggctttttttcactcagcataattcccttgagagctgtccaagctgtttcatgtaacaatagttcattcaaacttttttttttttttgacagagtcttgctctgtcactcaggctggagtgcagtggcatgatcatggctcactgcaacctccgcctcccgagttcaagcaattctcatgccttagcctcccaagtagctgggattacaggtgcccaccacaatgcccggctaatttttgtattttagtagatagggtttcaccacgttggccagacttgttattatatattccagatactagagaatatataatcattctccaaatgtaacagtaaaaaatgatttagaaaatgtgcacaagacatgaacagccatttcaccaaggatgatatataggtggcagataagcacattggaaatatattcagcatcattagccatcagtgcgcaccttcctatcagaatgactaaaatgaaaaatagtgatgatgacaaaggctggcaaggatgccaaaaaacaatcacacatgcattgctggttagaatgtaaatttttaaatttccctccactcctcaatgtcaatgatttttttgtgagtaattttcatatgttgaatttctagtaacagatataatcatatttaaacttgtgatttatatactcatgtttttgtcaaactttaagtctggaagatgtttaatttcttatttctacctaattgtcaccatgttgttactggtagaagacactttttattcacataattgtgttattgtatatgtatttttacaacttttttattgggtgaagaaatatatggtacttcagcctcatttacctctcataatgtgctgtgcactctggagaaagctagttggatttttggaagcagatatatctttatcatacagttaaggaaagtgttggccaccaaggccatcattctaattttgaatacatatgaattggcctttttgctacttacagttttggaatctttggtggggatacaaatgcacgtcccttggaaattttttggttttattttttatcctagaaaataactgttgtgaagatgtcaatatggaattattttgtctcaggcatccaaagactcatcatgaattaacttagggaaaaaaaaggttgtattgccagttgagcatttcaaagaccaaaatccaatatttgaaatgctttaaaatcttacattttgagtaccaacatgaaattcaaaggagatgttcattagagcatttcagatttcatttttggattcctgatgctaaactggtataatgcaaatattcccaaatctgaaagaatctgtatctgaagcacttctggtcccaagcatttcagataagggatatgcaatttgtataagaggcatggaatatcttaaggaactcaagaaccaaaatgtagacaattattaactatttgttctttccctgagtctttctggtttttctttcttattccatttggctttctttgtctttagttatattatggcccaggcatcaagagcaatagtctttcttttattgaacttgagcatttcaaaattccaagagaaggatttttttttctctcgtgttttgatttgatatctacccttgacaaacctattggacaaattgaaaagtaaccacgaggtgcctttcagtcacctacaggatatggttcagcttcacacaaccttcaagtctccattatctggcctgcgccttcatcccactgtcatctcttatcattcgcagtcttattcttttatatccaactacactggtatggcttttagtttctctgcagaaatcacactatttttctattcagtgttcttgctgctgtttttaccttgtctggaaattctttactcctctacttattctttaatacaaaaattcttagtcctggggctggggcaggagaaagaggaaggatattgtttcaacaagcatatctaatattgtaataatcacatttggaaaattaagtttgtttcttggttttaaatttaaattactcaaagcaaagtttgttgtagtcttgcttactagaaatacactcatatcatgagtgtatatgattcttggtcagacttccttggaggactactcatcagattctttgaggaggaactttgatgtatttctaaaggggaaaagttgtcactgttaggaagaatgttcttagttcttacatttgagcaaatcatatacaaaactactaattgctacatgcataccagtcaactgcatatagtatttactagcgtaaaaggtatgtgcaggcattgattttatgtggtattacatgatgtgaaattggaaacagttgtataataggtataaaataaatgtatattgattgaatcttgaacgctgtcctcagtggacttaattccagcacttgaagattcattgtagactagcctatactagtgtgacttattagttacttggatgatgtgtacacatttttccactgtattgaaaaatgcacctaaaatactgttaaaaattgtaagaacaattagaatataataaagaataatttcagcatttagaatattttaaaacatttacaccagtttaatgtcaatattcatttcagtaccaagacaaaacctaaaaaaactgtatttaaaagaatgatttctttcaaaaataatttaaaaaatagttatttctaggatattttgtctaaacctatcgttattttagatgtttttttctctagcgttaaatagacaatatgaactgagtcttaatgtctttttacatgttgatttgtcatataaatattactctcactctcaagcctggtaccagttctctgtcacagagcaaaaatcctcacctctcatcccctttttaatttaaatctttacattcaaagagttttctttgctgtatttttgaaaatgctattttcctgtgctttggctaccaccctgtttgaatattgagactactctaaatttacttaaagagttatgaatatgtgtttggtaactgtagtttgtttcgtagttaaggaaatgttgcttgtggttacaattcgtgtgcagttattttagttaattttgggaaccataagtgaaataaaattgtgactgtttgcctaagtatttttttttttttttgcttttttgttggtaccctgtttaaattctagaaggagaaatatgttatttagagagagagctgtaaaggaagttttgggaaaacatatcaagatatggatataatgagttttgaagcctataatgagggggagagagaaagtcaaataaaataaaattttcctgattgacaaagaaaaaaggacattttattgtgataatcgtatttcattcattttttaatatcagagattctggttatttagtcagtatgtctcaaattttttttcactgagctatcccttcttggccgaagagtacaaactgggtgtatggcctattagccagcataaatggagaatatctttgaagtggcttatattgccttaaatagttcacttgagactttctgttaatatggcagaaagcataaatttgcaaagccaagaatagtagagagggtctaataaatatccatacatttttggaagatgcagatgcataatttgtaactaactaagtggtatggagaaagggtataggtgcttttaggagaggttgctagagaggcaaatggattcctaagcagaaacccccatgaattgggagtaccagttacctctaaatgtggacgtataaaacagtgctgaaaccatgaggatttgtttaaggcttgtaagggacacttagaccacccaggcagctgtacacctagttctccctcctttcatttttagaaaaaaaaatcaggattcacaatactaaacactggtaaaggaagattgagggatggactgtacaaagaacgtgaggattaaatgaaagtctgcataattaaaaaagggaactggctcccttcctttgcttagttgcaagtcttctagcagcctatcttataactcccaagtaaagagtaagctgatccagaggaaagaccatcagatattgacagtcagggaggtcattcagtggaaggtctctgtgtgatcacactatcctctatccttcccactctatcctgaagcttccctactctgttctgcctattgtcggatgcctgaaaagttacttcatgtgtttgtttccagagtaactgttactctgtaaatagagtttataatcagttttttagttcctcagtcttaattgtgaatggataggcaaggcttgccaggcatttggggaaatcctgtaataaaaacgcagtgatcaaataaaataaaaaaaacatgaaacaggtttgagaaaaagagaccttgagagaacagaatagccttttagtaatttataattaatatttcagataaacaaaagaggcttgcatcagtaaagcaaagatagaatatatgctattaaaacagagctgtcagagaaagaaaagagttgttggaaattaaaataaagttttaaaaatatagaatggtaaaacataaacagaagcagtcttccaggaagtaaaattaaaataaaaagagatgaacaatgtaagaggaaagttaagaaaatttgatgatcaatccaggaagtttattctctaataagagttccaggaagaggaaaatgatagagaagttaatttaataaaattcaaaatattagtgtatgaatgaaaaattgtttaaaaaatactttggttattcagttattgaaaatgcctatccttattttgaggtttgttgttttccccacttgctttttattaagaatccaccttcagatgggtagtacattatatgggtaatatttactcaaatgcaatttggaagtgtttgttcattgttatgaggaagcactccttaaatcttaatgcttatatgagattttatctcttgaaaataatttgaaaaaagctagttacgttcaatacctttaactttgtgaggtgatggcgtttctaccaagtaaaggacgaataacgtcatcttctgtaatggtcttttatgtttctgtgttaggaggaagtgcagacaacaaatggattagatgatctaatagttatttttccatttaaaaggaattcttgttttctttttaataaattgagaaaacaactatcctacatataatagtttacaagagggattggatctctgtagatattgtgaaagaatcattgtctatattccaagaccaatataaaatcctttaattaatgtaagatcagtgtcaacctatgaaagatactttgagtatatttttaaaataaatcaatgtaacttagctgatatacactaaataaatagcagttattgaatgccaaatactgtaaaatcatcatggattttgaaaaacaaaagaggaaagtgaggaggaagtaattcatgaatagacaaagacaatttgaggttaggctttcaagattcataataaatactaaatttttttctcataagacagttgcacattatactaaagaattgcaaacaattttaattgtgggaggcagaaaggaatgttgcccagttttactgtaagaaactgcttttttctctttagttatgaaatagatagtatgatagtcctaaagaactaatcttatataaaaaacattgaaaaaaatacaaaatgtttattttttctaattggcatagttatattaattccttttataattctcctctttcacctcctgccagattgctttacttgttcaagtagtgtttgaactgtgctactatgagctgacgtcactaacagccccagctattctgttcctcagccatacaaattgagagaagaaatgtgttggaaattaaatacctatagtgtaagttttgtgggattcttgtaactacagaattctgagattaatgaacagaggactacctggaaaatataaaaacaatcattggtttgaggtagtaagatagtttggaacttcacaaaaatattaaaatttttccatcttgtcattattttaaaaaataataattattcatttcaattctgcttatatttccaaattatattttattatatttgcaaggcagtaattcctttctttagggaatttataatttattaagactgttagtcattgagatggggttgatggagaacataagaaagtttgggggcaatgggaatgtttgacccagagtgctagtgcatgcgattaaatgatatccatgaatgcccccagaacactgccatgtgagtgaaacagataggcatagtgaaaggagaaatgtttaggaaatttgatgaatatacaactataatacagttatgtatgaccaaggtatgtgtatatgtaaaagacaagactttttgttctgatgataggtgaaaaaccaaggggcctcacatgaccttgtttcacatgacctgtcttcttatacggaaaatatcggaattattctgtagtcgtgaaaatttgggactggggtaggatgggaaaagtagaaattctcataaataatcagaactaaaatacatgataatgaatcaaaatctcttagctcaatgcattgaaacattgttggtggcaaaatttacatttgtaaaaggctcaaacttagacactttggtgttatttccaaataagattttacctgtagtctatggacacctgacaggataaaagaatacattcttttaccactgtaaaatttgtcccattatcacctatattgcactgtgaatatttttagagcctctgaaattctgattataaaagcataggattttatgttagtgaatgttgtcaatgagtaaatgttaaatgtaaacatttaaaagagatcttagttttcaagaccctgctagatatttcttcatttttcaatatgccgtgagtttaaaatttaaaaagaaatagaaatagccctgaatcttatcttccaaattttgtcctttttcttaaattaaagaacaattaaatttatcaaataattacatttctgagagccatttaaaatgttaactttgaatgacaggataaaccatttgaattatatcaatcagggaatattaaattatttgagggaataaagaggaaaaaactgaagtcacctatgcatatgagtgtacaacaatcagctttcaaatttctgatccaatatattgatcatatttcacaactctttgatgcatctattattaattataattttgtatgtgcagtatctgtttggaaagcagtatcatcaattctgctttctttattagtatttttcttgaaatgttctagggattggtggtaacagcctctttgttccaaggtgtcaaatgttttatattccaaaatgagattatatatgtgtttctgcagatgctgcaagtgtaccacgtgggatgattgataaccttttattaatatcattctgtgaagctcttaatttattcttacttcggaaaatattctttcagaattataattaagtagcatgttcatgtaggaagttagttttagttgcctttgggtaaggtttcttcttttcttctctatgtatttctatgatgtatcttttggttgtttgtagacaagtaccacctcagtgccgcaagagatagtgcagacctctacccaccccgccacccccttcttttaagcttttcacacttaaggaagagaccaaatttaaatttggttacttggaaataatcattttttaagttggtcatataatattctaaatttgtcattttcaggcacttaatatggtgcttatgtgggccagttaattattccaagtgctttgcaaatacaagcttatttaataatagcaaccctatgaggtagatgttgtcattgccatttgacagatgaggaaactgatgcagtgaaaggcacatagctagtaagtggccacagtgatttcagttcttttaattttttttttttttttgagatggagttttgctcttgttgcctaggctggagtgcagtggtgtgatttcggctcactgcaacctctgcctcctgggttcaagcaattctcctgcctcagcctcccaagtagctgggattatgggcacccaccaccacacttggctaaatgctttttgttttgttttgattttcgtatttttagtagagacagagtttcaccttgttggccaggctgttcgtgaactcctgacctcaggtaatccacaggcctcggcctcccaaagtgctaggattacaggtgtgagccaccacgaccggccctttttattcttgtgagatgaataatctaaatataagtcatctttatcttttaatagagacactaccttttagtagataagtaaaataatacctgattgttgaagtctaggggatcctttaatatttgttaatatatccaatttctatgtgtttcatttcaattcaaattagttacatttggccatttgtttgtagatgtaacagaattagttgctaatagaggaatagattgctgcaagttactcatgaaatactgttctctccttcaatcaacatatttgttcgtcttgtttattaaaagcataaggaacttcaataagtaggctacatttttatcttgtccttgaacctgtattatgatttcatgtgaatttgctacagtgaacttttgatttgctgatagcagcaagtttttggaattgttatctcaaattctggtttggcatatgcctttaaaatgttattcaatcttcctgtaatcccagcattttgggaggccaaggcaggcaggtcacaaggtcaggagattgagaccatcctggctaacatggtgaaaccccgtctctactaaaaatacaaaaaaaattagccaggtgtggtggcgggtgcctgtagtcccagctactcgggaggctgaggcaggagtgtggcatgaacccgggaggcagagcttgcagtgagtggagataaagccactgcactccagcctgggcgacagagcgagacaacgtttcaaaaataaataaattaattagttttaaaaaataaaataaaatgttattcaatcttatttgagtagctattgaagtcaagtgcttatgtaaaatttaagatcgtttattttccacagtgaagatgctaatgccctcttaaagttggttaccctgcttgctgttgtcatttttaactgaataactaaacttattaaacttcagtgagttattcattagtgaattggggttggggggagtgataagtaaaagaaatgcattttatttcctcccttattgtcagattcctgtttgaattcaatgtgtaataatggcttatggagtttaccagttttagtggaatcctcactgcctcttcaactgctttgcttattgctgaaggatagaaaagtgtggaagcttttgattaactcttataaatctactgaaatgtatcacagagtttaccactgagtcattttataactttctcctttttgcttttaatatatttttttctatgtgaatacagttattgagtttctggaaacttaaagttcgtgggtttctagaaacataaataaagaacagatggcagttcacgcctaacaatgaatacgatgggaacagaggactttcatcttgtccctagtggtcaccatgtcagccatcatgtggtggacatctgtgactgttgagcatagtccctgctgctattttggagtctctcaggtctggtgttagtcatatttacattagctttatttttttttcctttttcttttttttttctttttctttctttctttcttttttttttttgagacagaagagtctggctctgtcccccaggctggagtgcagtggtgtgatctcggctcactgcaacctccacctcccaagttcaagcaattctgcctcagcctcatgaatagctgggatttcaagcatgtgccaccacatctggctaatttttgtatttttagtaaagacggggtttcaccattttggccaggttggtcttgaactcctgacctcaagtgagccgcctgcctgggcctcccaaagtgctgagattacaggtgtgagccactgcgcctggcctgcatcagcttattttcaagaactgtcattctcagtcatttatcagtctgcaaaaaatataattctgaataaatgagaattgagaagggtcccaaataagggttactttcttttaaattgacccatagttgtacaaactgattgattactgtcgattgatatgtctttattcatcagcattgggaaatttaggaattgagcttcattaatgaaaccattttattggacacatagctgtaaattgcatgtctgttgacagagcactgtaaacaaaataaagcattaaaatttagataaattcagggagaagaccacatgtaagcatttaaatcataacagattcctggtatttatggctttaatatccaaatgatgagcaactcctacgagtctatgacagggaattgtctggaattgtatatagctatgaattttaattttgcaccactgattcttaagtgggcgggttgtctattcatccacatataatatgaggctttgttttgtacttgtcattacaataaactttgaagtgtttaacacattgtgtctttgtggagaaatggtcatcaagtaagacaattttagggaatactgaaaatgctcttagcttgagatgtagcaaattgtatcagaaacatgtcccttgagagcagtgtggctttgaaaatgctaggagttgggagaaagatttgtttttattaatgtggagaattgcaaaagttttagaaaatccacccaccatgtcaaagatcttgtgtgtagaatttttaaagaactgctatagtagagggcattaagatttttaagtaaaataaaacaaaaacctattggatgttaacttgaaagataattttaaaaacttaccctaagttcttagaaagtcttctctaccctcatgacctctgctatctatataagaaattagtgaactgaataaatctttagcctctcactatcttaaattaccatagaattaaaaactctagaatataatgaatttattctatcagtacagcccatgagtgaatttcaaacgtttaagttgtgcctcagaggaatttttgttatgcatcttttaaataataatattttcaataaatcattccttataaaagtccccaaattgttgctctttagacattactaaaatcaaaaacaacaaatttaaacatttacagtttgggacctaatttaagcatgtatcacagtttattaaagttatcttctgttagaaatagctcccttagttctggagatctgttgtgcagcatggtgactataataatagtgtattgtgtacatgacatttcctaagagagatcttaaatgttctcactacacacaaatgagaatgtgaggtaattgatatgttagtagcttgattgtggtaattatttcacaatgtgtatatgtatctcaaacatgttgtacaacttaaatgtatacaatttttatttcccaattataccttaataaatctagaagaaaataaaaatggtaagttaaccaaatttttttctctcagtctctcatattttctcccagattaagtaagggtacatctgtgaatcacactgatttcattttgttaaaaagcttaagaaattaagagtaagctataagtagttgtagctgacaatataagaactgttagaaatatgaacttgctttatgaatgctatatttattctgattgtgttgcattaaacatgtttattttattttaaataaaatatttttctcttcaagcttctaataatgttaaatgttaaagaaacaattatctgtttaggtaggaatttgacttaatctcattataaatagcatcctaaaattttacagctttgaacaaacattaaaattagtaataatttttctattcaaaatgaaaagaaatgtgaaccttttctgacacaggtcataatgaaataattccccctttaaaaaaaaatctaaacacacataacctatgagaataaaattaacatagctgctgtaagaagttttaaaaaaattcttagcatgtcttgaagtaataaacatgtctctgattaggtgaatcaatagacattgatttatatattatagatacaattccaatattatgaaaaagatactgtggaactagagaattttatatctgactggaataccagaatagtggtaatattgcttgttgaaattactgaggagaatgataagtgatcttcaggccatttatttatttatttttaacttttattttaagttcagtgttacatgtgcagctttgttacataggtaaacttgtgttatggggttttgttgtacagattatttcaccacccatgtattaagcctagtacccatttttatttttcctgatcctctccctctcccaccgtctaccttccatcctccaacaggccccagtgtgtgttgttcccccaccacgtgtccatgtgttcttatcatttagcttccacttataagtgagaatgcacagtatttggttttctgtttctgtattagtttgccaaggattatggcctctgcttccatccatgtcctgcaaaggacatgatctcattcttgtggctgcgtagtatttcatggtgtgtatgtaccacatttttctttttcttttcttttttctttcttttttttttttttttgagatggagtcttactctgtttcccaggctggagtgcagtgacgcaatcttggctcactgcaacctccaccccctgggtccaaacaattctcctgccccagcctcccaagcagctgggattacaggcatgtgctaccacgcctggctaattttttgtatttttagtagagatggggtttcgccatgttggccaggctggtcttgaactcctgacctcaagtgatccacccaccttggcctcccaaagtgctgggattacaggtgtgagccaccacacccggccacatttttcttatccattatatcattgatgggcatttatgttgattccatgtctttgctattgtttcagttgtgaatagtgctgcaatgaacatacatgtgcatttgtctttataatagaaagattcatattcctttgggtatatacctagtaatggaattcctgggtcaaatggtatttctgtttttacgtctttgaggaatccccacactgtcttccaaagtggttgaactaatttaccctcccaccaacagtatataagtgttcctgtttgtttttttttttttctttttttgagatggagtcttgctctgttgcccaggctggagtgccgtggtatgatctcagctcactgcagcctccacctcctggattcaggtgattctcaggcctcagcctcccaagcagctgggttttcaaacatgtgccaccacgcctagctaattttttttttttttttttgtaatttgagtagagatagggtttcaccatgttggccaggctggtctcgaactcctggcctcaggtgatctgcctgcctcggcctgccaaagagttggcattacaggcgtgagccaccgtgcttggccaagcatttgtttttttgctcaactttgccagcatccgttattttttgacttttaaatgatagccattctgagtggtgcgagatagtatctcattgtgggttttgggttttttgttttttttttgagacggagtctcactctgtcacccagactggggtgcggtgacacagtcttggctcactgcagcatctgcctcccgggttcaaacaattctcctgcctcagcctccttaatagctgggattacaggcacacaccaccatgcctggctaatttttctatttttagtagagatggtatttcgccatgtttgccaggctggtctcaaactcctcacctcaagtgattcacgcgccttggcctcccaaagtgctcggattacaggcatgagctactgaacccagccctcattatggttttgatttgcatttctctaatgatcagtgatgttgagcttttttttttttcatatggttgttgtagacttataaattccaagtggacagagattgtgacgtttctttgtcattcacatgagcagaacactcaataagtatccagtgatattcatgaaagtaatgtgagtgatcagatttgtgttgcatgagattctgacagtacaaggaactgatctgtgttgtaatcttctatcccatttcaggtatgtaaaaatgctgaggaaagaaaaggggagaatatgcatgggtcagaaaggaaaagataattcaaagccagggcatgagttatgctgcactggccagggggtcatttggtctatacataaactctatggacttgggcttgggttttaatgcttgtgtggtgataggagataaggaaattagggatgggtttggtggaggaggaggagatgcacttctgcacatgtttgaatggagtcagaatttacactgtcctcatatcacagggatctcaagataagagatagtgacaactcctgatactcttgcaaagcaaatgctaaactattcagaagctaaggcaaagcctgcacagatgagaatcttatggaaagaataccccctctgaagataagttcataataaaaagctccagccacatgaattaacatgactaatatattcagcagccacaagacaaaggagatttattaccataaaacatgaagtaatgggacaaatttaaaggagtataaaatatatttgaagtaattaagcagatttttagggaatattaagcataattaaatgtaacaaaggaaaataaacgcagaaaataggaaaacaaaaaatgatggtagataaaaattattaaatcaattatgccaacataaactctacagttaaaagattctagattctataaaaagcaaaatccaactgtatgctgtttataagaaacatctaaaacctaaggattgtaaacattggaaagcaagagataaaaataacataccagacaaataccgatcaaaatataagtaagataattttattatcgtaccaataatacacttgaaggaaataagtgctaagaataggggagaccaaatgagtagaaatacaaaataatctggagaatgtgtattcaccttacaatgtaacctcaaaatacataaagcaacaatggactcaattacaaattgaaattcagaaatacaaaatcacgttgaaagttttaaaaacgcctctctcaaaaaccaatatattaagcatatgagaaaatagatttgtacagtgtattttaacaaggttactactataatggaaggaaggatggatggacagagatctcttctagcaattagagaatgtacatttttttcatgcatactaaaacatgacaaaatttaagtatgtactaggccataaaggaattctcaaccagagaccaacatatggtccaaatttctgtagtaacttaattacaaaaaaattgtcttcctcacaaatatcaagcacacaaaaacacaaacacaagaaaattaatgggccaaagaagacattaaaagaaagattatgaaacttttagaattgaacatcagccaaaatactgcttgtcagaacttgccgctaatgaattagcataactttaaatgcatattttagcaaagattgaagattgatgaaccaggttttcaactcatgacatatgatctaagaaagagggtgtataacaaagagaatccccggaatgatgctgatgggagctcctagatgaccaaaatacaattgactcttgcagcaggggttggtcagagggcctggagggatgaattcaagggagctgtgggtggggttaagtgggtgattatctgatgtgctcaatcattttcaattagagttaaaatttgccaaatctgaattgtttgtaatattttccccattcttattttccatctattttgtgcttccatttttaaagaaatatactttgtatttattttctaatttcttagaaaatagtcatttttccaaagtttaaatattatatttccttttgaaattatagattcttttatttcttactaaatttaaaggaagtactcttgttctatttaaaatatatgctgattggacaactcaatttcagatttgatttttctctatttctacatcatgggagtgaatttaattgattttcttttagtatttgatttagggtaaactgtcagttttaatctaaagcatttttttgttttctttgagagaagaaagttgacctgaaagattaaacaaaaagcaagtgctgtgcttactaacataaaatgaacaaaatggacacgttatgtcatgggctgcttgtccccctcaaaagacaaagagtaagccaacccaggccatccttttactaagctagaacagctcgagtctgacatttttcttctctaaatttaaagactggctaatgttcatagtgggtcttacttgtcttttacacatttggtctcctgtgttctttttggcttgagatccttgttagtgtgcagtatgactttgagagaaaaaaaaatccttttcattttaggatggaatatttaaaataaacaggctgtgtgtttattactgtggaaaccagacagtaagtgtgacggtaaacagaatgatttcaaaagagtaagcagttaaatgctaacagactgcaataatactatcattatttcataaattttatttctaccctaattattgaaatgctttctgaagtaattttatgatttacatgttaatcttttgccatatgtgattttttagttttagtagaaacttagccattttttctatagaatagagaaacttgaagatatacttggttatagcagttatgattgctagaataccttatgaaggcatttgattcaggaatgacatggcatttttcatgtttgttaactaccaataacatacttagtaacattgtgtcttgtgagcttgctacaactgtatgctttcttctgtagtctgttcaaaggtgcttactctaaaaaaacctagttgtaactgtccaactcctttactatgtaatttaaaattttatataacaccagtagttatttctctttgtactgaatcattttgtgccttatatgacatttggataaaactgagtgaaaccaaatttgctgttaaaaaggaaaaaaaaatcagcttgactcatttgtgacagttctaccaaccccatcaactgggttctctgctcaggatctcacaaggctgaaatcaaagtatcagttgggctgcattttcatgtggggctccggttctcttccaagctcacataattgttggcagcattcagttccttgctgcctcttagctaactctgctctcagctcctagaggccattttatggtaccctccatattcaaagccagcaacagacaagttccttcaagtctaattcccactcctcatgaagaacccagtcccctttaagggctcacttgatttgatcagacccaactggaatgatctccttttatttaagtcagttttgccatataagctaacctaatcatgggagtgaatatctctcaaatccacaattctcactcacacctgaaaggagggggattatacggggcagggcgtatataccagcgggcgggaatcttgagagccatcttagagttttggctactactaagataatagaagcttttaggtagatatttcttccactttcttttctatcttaaatgtgtctgtattcttttcctcctctagtttcagaaaaggaaaaatccctatcttgttctaagtccgaattctccagtgccggtctttcccatccttccttaaattcactctaatagacctgcactcattcccattcttacactccacttttctcttgtattttaatttccccactctgcttgcttccacttctcaacttacatgaatgcctagtcctcaattcttttcactcaagtgaacttctcagcacttgtccagatttaagtttacaatcttttcttgctgatacttttgcaaacaactgatcttcttatctctggtcctgcctactctaccaccagaggagcatttctaaaatgcagatctaattcaattattctcctgcttaaaaatcactggggaagtcctaccttgttgtccttatcagaggacaaaatatagtctatagatattttgtgtttgggccttacatgtagaaaacattttaaatgaacttccaacaattacaattgggaacttacacttaaaaaaaaaatctaagtttctggcttctcttggaaaattagaaatctgggtatactggcacacaattccaaaagataacaatctactaccactacctaatagctgccctgaagatgggaaatgctctctgtattttgccattccatcaacttgactcatttgccgtacctacctgtcctctgaagatacttgactttgtaagccctagcctggaaaataaaggccaaatgccttagcctagcattcatgatttttttctaactttatcccatcaactcttttcaaattgttgttttggttacatgattgcatttcagtttctcctgccagattataattttcacaaggacagaaagtatgctttatttatgcattcatgctaagcctctagcatgatttctaacacatactattgatttgaatagtactaattttactttcactgacgtattgattttatgtgtccatataattggtcaaaaggcaatatggacaaaatatgtttttactttctagcactattgaaaaatcttaaaatgttgttttctgtcaaatgaatcaatagaattattttgatttgcaaaggacaatacatagtagtactatgatggtacagtgggtggtggagaaccttcattattttcagtgtcttgatcctttcattctttcataggagtttgggaattgggacttccctgtcagtgtttatatgttcagtcttctgaactacactgagagaaaatagggcttccagttggctctggatccttcttttgcaagatattgaaaagctttctgttgacatccatcgatcagttaatatttataacttttccaaacaagccttctaaccattgcttgtccctaaagaccattttaaactgtgaatctttaaggtctttttgagaataataggtttggttattggaagatttaatgcagatgattaatagaatttccactgtagttctctctgtttataattgaattaacacataaaaatgtaaatgggattattaaactataaatctagaaggatgaagtttatagtgctctgtgtatttactttgttctgttagattttgagtatggtgtttcctctgcagactttaattctatttttcagacatgtcacattaaagtataagaaaatacatgtctttattcaatatgtcacaaaagtattttttcatgaaattagaagtagctactcatgttaaaaagaatcatagattgcttttggcaatgagaggaaatcatttaattcaagacagggtggttcctctaggttactcactgatgagacaacaacaatggaaaaatttgcatcattgctctctttcctctctgttaaattgtgaacaagttctttctgtgatcctgtttttgtgttgtgtctcacaaattcaaaacattctggactcttccttttttcagtggctgttcttagtgatgacatcagttgtctacaagaaaatatttgcacttgtgttctaacaacagtcactgtttgttatagtctctggttttattttcagatattgttccaggatttctttattttgttatttataatatgaaatccatgtttatgaaaaaaacatgaataaaagtcattcttattttctttacatctttctcttgcattacctagagtatgcccagggcactgtaggggaatttgggaaatgagctatccttaggatataaccacagattcaataaagctgaaatactagccattgccagtcttgatgttgggagtctgattatgttcctatatgttgacattttgattaatgttttacgctgctactattatcccccaaatttgttcatctactctgagattgctatacttgtgaaaaaacacggtattaatgaatactcttttataacatttctcatactatataagttacttctttataaatctcttgcctgcttaactgagtgttactacacaggggaaagggtgttgctttaggaagttgcttttgagggaactgttccagatattcaacttcaagaagtctttctagattgtatagtcaagttagattttctaaaatcataaagaagagatcaccagtgaccattgaagatggaaatgtattagaaatattcatacatatcagagtatgttagtcaggggaaggtaaggacagaatggaatatagccacttttggcctccagtcacacctggcatctagttcctataggactaatatgtagtgaactagaatattagatctgtccagttgagaacaacctaactaggaactgccttctgtagtttccctaaaatcaccacttgattgttaattctaaggggacatggaatgtgacaattgctgttacttagtacttagaatccctttgggaagagtttagaacaagtctcttaagaagcagtcagctacctttatactcagtctttctgtgattttctttttcttgtgtgtttatccaatttagcaatacctgggtgtcaaatttatttatccaaaacctggacttctaaaaacttaccatgaacttgtacatgtttactcggtttaaaaattaaatgaacctgtgggagctaccgtgctaagaaggggctttgactgtgacaggcacaccaggcatcatggtgtcatcttcaacttatagccaaacactgatttataaaattatactaatttttaagaatgcatattctgtagttttgtgaactggtttattaaggggaatgccttttcctagttaatttatttttaaccatggctataagtgccaaagcatttctcataattgaacataaatctttgatctggccttttgagtgatacaatcaaagaaaaatctttaaaaattttttttgaagagtcgttttgtatctgatactgtttctctatggatatcacttctcatataactatgtatcttaatatagactatattgtcagagtaatcctttcccttccactgcttctttagttttaggaatttatactttagcactccattgaatgaaatgtggttactaaattgtcaaaatacagtaactgctgtactatttgaacattttttggccatggataagtgttctcatttgagattgctttttgaaaaacaattcgctgaagtggaactggagtaatgcacaacagttgatttcttttggacttaactgaaactatgtttctggttttaaaatttgctaacaccaaggcactgttctatgtaacatgacttatttacatagttaccacacaacagttggtatttcatacagtaacataatttcattgcaaacagtaattttagtactgcaatagttcaacagttttgtctggctacatatgtagttagagcttttaaaagttaaaaattcatggtgtggtattataatcatagtttgtattaatttttatgaaaatcaatatattagcattgtaggccttatactactactctcttttcatttatataaagcagatagtctgattaatcgttctataatgtagactgccttgttcacatacatggtaggaactaaagaaagaatgttcaattgaatttcaagttttcttgtagcattctacagaagcttattgagtacacctcatatattccttatattagtttagtcttagattcagagtttgaaaactgaacttactactattaactccctcctgaaacttctgtattaactgacataatgaatgaaacatagtaagtacttagtaaatgttatttagtagtaaatgttacctggtggtagtggtagtagaatacattatggtataatttttaaacttttcttgtatctcattccagttatagctccttatattcaatgctattgaaactaaaatgataaagacctttacatcccataataggaatatctggaaaaaatttttaaaaatatgtatttaaaaagtgacaacatgaatgaatgaataagagttattagtaaacttttgtaaataaactattagtaattcaagttattttgaccatagtaaatgctgctaattaaaattggagactggatgccgtggctcacacctgtaatcccagcactttgggaggccaaggtgggaggattacttgagggccaggagtttgattttttgtttttgtttttttttgagacattcttggtctgtcgcccacactgaagtgcagtggtgtcatctcggcttactgcaacctccacctcctgggttcaatcgattctcctgccttatcctcctaagtagctgggactacaggcatgcaccaccatgcctgattaatttttgtattttgagtagagacggtgttttgccgtgttggccaggctggtctcgaactcctgatctcaggtgatctgcctgccttggcctcccaaagtgctaggattataggcgtgagccaccattgcccggctgaggccaggagtttgaaaccagcttgggcaacataatgagaccaggagttcaagattacagtgagctatgattccaccactgcattccagcctgggtgacagagtgagaccctgtctatataaaataataataataataataatgatttaaaaaataagataaaatcacattaattatgtcagtaatagctacccgtatcttgattattgattagcgtaagttataatctatactaaacattagaaacctttggccaatgtttgttatggttgttacttagacataattcatttactcttttatcaaccttcaaatactttttgggtgctaaggatatgctgataaagaagttaaatatctttcatgggacttgctgattgtgggtagatggttagacagaaaatacataaagtaaaaaaatagtcaaagtaattttagtgaaaattgttgtgaatacttgatgacagatgaaggtgccacctcttatgtacccataaaaattaaaaataaaaataaaattttaaagattgagcaaggtgcagggtagaggccgtggaaggcttatctgtactttcttaagaaggaaggttaagtatgtggtagttactttctagggacatgttttgtgacacaatgcctccctttcctgggctaatttgcaaagatatatgtatttagaagtaattttaagatacaataggcatataaagtattggaattttttttttttttgacaaggtctcactctgtcacccaggctggagtgcagtggcacgatcttggctcactgcagcctccactttcagcctcaagtgatactcccacctcagccttctgagtagctgggactacaggggcacgccagcacacctggctaattttcctgttttttaaagtgttggggtttcgccatgttggccaggctggtctcaaacttctgagctcaaaacatctgcccgcctcagccttccaaagtgctaggattacagacatcagccaccacacccagctgggaaatgattcttggtaccagttaatgaagttgcatcataatctatttttagataaaattattaaaatatttgtttcttaatattataaataaagcagtaatattagcatatatgatagacatgagacacgttttaaatcagcaaattacccccttatcaattttctatttgtaattgcctttaaatattatttctgtaaaaggacttaaatgctaaatatgctgttttttctacattacctataaattgatttttgttcctttattttgaaacagcctttaaggtaggtttcagtaaaagcagaccaaatgtgtgcaaatgcattgactttaaaacaagaatggggacaagaaataaggaagaggaaaccttctgactcagaaaagctttagttttagcataagccttaatttttagtacttaacggaaggagaattgattacgttgctcccaagctctgttaggtagtaaagcagtaacactatcagtttgttcatcagaatagctttaatacctttttttttttttttttggttttgattctttaaaaacatatcgagcttgggtcttattatatgaagggcattgagaaacgtgatgaacaatattttatacagcaattatgaagccatttctgcatgtagcttttctttatattgagactcaattcattgaaattccaggataaaagtaattctaatagggtcagagtgatgtgatttaattatgtagcaaatagatttgttcagtggtgtacagaaacaagaaaagagaacgtgaagattcaggttggaatggagggctacaaatgtttcagaaaagtggatcatgggctttgaaatgggtagttgtgagagataaagcttgagaggtaaggttctgaccaagaagccttgtgggccaggaaggctttagaatcttaagccaggattgacataatcagatttacatcttaaaatatcactctgataaatgtagagaaagaaacaagtcactagaagagtcagagagcctagttggaaggctgtcacagtaatctaaatggcatgctttggggattggaactaagatagctgtaattgagattgagataagggggacagagtggagagctatttcagatatagaattgacagaaactggtgactaaatggatgagggagataagaaggaaaagcaaaatcaaggatgatgctccagattttaaattgggttactagatgggtagaggtttcggttactgggggtaaagcaggtttttttgggaaatggatgcgtttagttttcgatatggtaaatttgaggaccttttgcgacattcaattggagacagctagtagaaagcttagtgtatggatatgaaggtcagaatactgatctggactagagctacagacttgaaattcatcagcatattgttggtgggtgaaatctcatgatctcaaacttgagatcactcaggaagagaatggggagaaagaagaggagttgagaataagaatgtagtcagccatcacagggctggcaccaaaacactactacaaaaaggagactgatcaaatgcgatagatataggatgaaaaccaggcaagtatggtgtcagaagccaagccagtgcaagcaaaataaaaaccgtgacatgtctgttggttttgaaaacaaagggcactgatggcattggtagagagaatttcagtggagaatatagaaaggggaggaggaaggcagtagtaaagggggattaagggagatttttaaaatgcaaaacatttgaatttgcttaaacattcaaaggaaaaatgtaccaaagtattagagtttgcaaatgctggagagaggataatcgacatcagagtttttgatgtggttttcatgacctggtcttgggttacttctccagccatgtcatttcctacttgccttctcaatcgctatttctcagttgtaatttttcagtgactccaatgtgtaacattcactgtcacctctgaggctttgcatgtggtactcctgcccaaagtactccttctctattccttattccccttgcgtggctagctcttatttagccttcaagtctcaggttgataccggtttactccactagaatagattgacctgccatgtactactacagcacttggcatttctcatagtaacagccatcaagctttaatataatgactgatttaattatccatctctccttctggttaatgtgtcatgaagagaagaagcatttttagtgttttcacattatctgttatttctcttctcaaatgtctaacacctaacatattcttaggtatgtatcgaacaaagatgtgaaaaatgagtgggatccctaaagagtcagagcgaatgctatctagagcaatgttgaagaaattattcctgcaatgtaataagagcatgtctctcttttttaaatatgaggcaaagacatgaaggtgatggaaaaatacttggtttatctttgaaaaagctaggggcggggtttgccagggaagtatattatggaagtgcagggtttcacagaatccagtgggattaagtagagctgtgaatacctggggtcaacgttgtaaacagtcgttagttttccagcatctgctttaacttcttggctctgtttgcagactgactttgtctgcttcattgttctcatggccaaaaaaatgtcttctatgccccagctctgtgagaacccaccagcacccagcacttaccctctaccagtttgcattattcacagagaactggataggctcaacccatcataaattgtttcttctacagtcagattagtctaatcctgctccactcagctctggccaggggactcatgagatgacctctagggaggtcaacctggattataaggtgatgaattttctgagaaaaagatttagaaaggcaggccataattatctttaattaatagaatatagataagagtctaagtgtcaggaatctgaaagagttcatacttgatctggaatttttttactgaattagaaggcaaggtcatctgctaaatatagaaaaagtgtaagaatagtggtgaaggtttggaaaatctggtgcaaggaatagttaaagggccttaccaggaaaaaccaataagattgctcagagaagcagctgataatagtgaatttttatcatttcttcagtagctagtgttcctttgcccagttatagaaatgagaaggcagatgtttatattgatctaaattgaaagggattgtggttgaggatgttgttaagagtgtggttggagaaggatttcatggaatctggattatatggagaagctttgcaggcagaaatggacttcagaaaacagatgatcatagtataggagagagtattgtaatagaagtcagagataagagtgatatgagggtaaaaggttatagtcagagtggggaacactggaattaagatttggaggaaatccaaatatatgaaatgacaaggctgagctaggactatgctcattaaaacatttcagcggctcaaatttttaagtgctcgctcagaagtaggccccaaactctgtatctacagggagttatcaagtgtctttctccactttgagagaaccccaaaattgtttctgctaatttcagatgtgactttgactttatattcttggtaacaataagaaagaacctaccgaatagcatttttttattattgtacattaggttgctataatgtattggccaaaaataattttgcgtttggcataattaatgtttagaagttcttctagaaaatatttggctggacaccattagctttttcaagaggtcattcattctattcttgcctggagtattgatgagctatgttaccagactatgaaagaatacttttatattcatttttgatgttactctatcaacagtgaatgttctgtagccatagcaaataacctaaaagtagaactagtttaccttatctcaaacactatttgtttttgttttgttttaatttttatcttatcaaagttatgtatgcatgataatttaaaaagtcaaatagtttctacaaaccttataatgaaaaattggcagtcctgtacctgtccctccctgtccctgattgtactttaaactttctttttttttttttgcgaattctatttatcgcgaaggttctaaataactcccttgttccatttcctttttttttcaattttagatattatctattatctttttattatggaagatgagtaattttcttaatttattaccacctctaacaaaccttctcaatcttcccttaatttccagtatagttatggcttaattttttatattttaattgtactaatattgagtattttattatgactctttaaatattatcaacattagaggtatatagtgaacatttcctttcttgaaaaacattctagagtttttaaaaagtaaatatcagttttttgtgtatcaatctctaaattatatccaaattctctgacagatgtattagtcttctctcggtatttagacatggtataaaatgcatcagttcttttttatgcgttattcatttattgtgtaattctctgtccttgttactttggagtgatatgtctttaagcatctgcatgcctgttttctgagctctcctttcactctctatattaaacaaggttcaatcaggaaactaaaccagagtaggtacttcaacaaagatttaatatagggaattaccaggagaactgaaacagccaaaagggaacacaggtaagccagagattaatgattacaggaagaggctaccacaccaaagcagtgggaacaaaagtgaaaaaattggcattaccagaaccaatgagcttacaggagatgtctggtggagctcaaacttggacctctgaataagggagtgcttggctgttggtgcttagtcagaaatacagcaaatgtgcctgtagcgccagggtatggactgctgaagtggggttgctgcctatcgatatctttgaggtttgcaatatggcaattctgggagagccaaaacaagtaggaagttgaagcaaaatgcccttgttgaagcaatgctgatagatatatgttaaaataaaaacaactccctttccccaaacaggaagaaaacctctggttttctcatccttctttgtaatctcctctagtgtatcctgttaccagaatggaagggaaaaccaggtgatattaatgagcagagtatagaatagttgctgtggcctgaaagataaccagcacaatccacagctactcagcatatttaataccctcctctgcatatttgaacttccatacgaaacagcaataacaatttcctgcttctgcttaacaggatccaactgttttttcttcaaatgaaggtgctctcatgctcactcacataaataaatatatagtatccaactcttggtgtattaatttatcttctaattcaggaaaaacactcccaaaaaccaaacatctaaatgttgtgtaacttaaagcctaatttattaaactaactgtcaccaaaaatctttatataaaattaacacagggaaaaggaaggaggacagaagaaatgaggtaatctatacaaatcccttcaccattgttttgaagattgtttttctttcttttgtactgaattccaatattttttgacccaatgttgcagtgtttgaatgtttgtgtctctccaaattcatatgttgaagcttaagtcttcttatcttaatgggatggtattaagaggtgtggctcttgggaggtgattcggtactgagggccaggtcctaatgaatgggatcagtgctcttataaaagaggcctgagcgaggctattggccctttgtttctcctgtcatcctgtgtggatgcagcaagacggtgccctctgtgaggaacaagccctctccagatgccaaatgtgctagcaccttgatcttagacttcctagctcctagaactgtgagcagttaagttctgttgtttgtaaaaacccagtctaaggtatttggttatcagagcctgaatagactaagacacatctcttaccttttctttgtttattttgtcacactaatggaacatattctcaaatagcttcttatctgaatacgtatttatcattttaaaggcattaattcattgacttctggtatctagcactgttataaaaatccagcaccattctaattcatcatcatttatctgtaacctattttattgctctgaaagcttttagaatctcctttttttccccagtcttccaaaaattaatgatgctctctcttgatatgaatcttcttttaatctggtgtgctaggttcttagtggactcatgtctacacattttttaatttatacatttttttcttttatgtcttttaaaattctgtctcctctaactctacggtgtcaattttaagcttcctgtaatgaccccgtcttacattttgtctcctatttttcatttatttgtgtgtgtgtgtgtgtgtgtgtgtgtgtgtgtgtgtgtgtggcacatcaagcctgtaagtgtggtttctacctaagctctagcactcaatatgtggactagagtgtgtcctctcaggaaaagccatgtaaacatggatccagtcctatttgagtatccgccagtttctgtctgcttttggtgattttccagtcccttgaaatagtgtttttgctgttgatttttgtttgtttgttttgtttggtccagagtttataattgttatctttaaagggttagtgtaatacaacttactttgccattacctgaactggaactacctcattgttaacttttcattatttgtttttggcaagaaaattcaattaaacgcatggttaccgtctatcatactccctagcttctcccagtctcattaaaaatagatgttaaaaagatgctaatagatgttaactatcttatgggcaattttcttattaaaaacactttgaagattttaaaatgttttttagaccaataatttgtttttatcttgtctctaggtaaataagattatatagcaaagtaaatattacaagtttttcaggggaatattttgaattgaaatgtatttttagaagtttggcattaaatcgtaagtaaagtttaaaaaaatttttaataaatatttttgaatgaaaaaatttggcagaatttttaatccattgtttagaaagacaattaaggtttgaaaaatttcttagaaataagaaaccaaacataaaattaacatactaaaatttgatattttatttcaattaggaattttaaaatacttatttttatgattttcaaaagatcactagttttgagtttattcattaatgataaataataatggccttatagttaacacagtaagtttttatgaaaatttttttttcaaatttttattgtcagtgtaataatgccttttaaccaatcatgctatttcatcaaataaatttagttcagtgacttgcatgggggaggggtggtggagattggccttaatagctgacattttttaatgggaaggagctagaattttatagttaggaaaaaaaattactgttttaatttagtttttttggagaatgttatgagagacctaattgttcctaaacagggaaaactggtttaaattgagaaaaaaattactcacaatattttacactacgttctattaagttatagtttctgagtatcccatagcatgataattttatcatattataacttttggccagtatttgcttactcactgtttctatgagcaacagaatctacgcaacagcaaacagtgatcccagccccagttagatttttctctttcataggcactctggaatgctactgtgttaaagtaatcaaccattttaaaaagacaaatcaaatttaaactgactcgagagtgtagtttttttttacccatagatgttatttttgttgtggtttatttgcaaaacccttcaccagtcatctttagatattgttcacaagtctcctatgggataaatcattactttgaatacagaggttacagttgtttattcaggatcccactataaattgaggtcaatactgggattctaacgtagagatttctaaggttcccatatactataattgttttgatacgaccaagggataaaaaaagaataataaaagactgagtaggcacttacatttatatttctacttacagattatttaatagtgttatcagctatagtgtaggacgtctgaatgaagagtaaacgatggaaaacataaccaaaggacataactatgggcatcttgattagatgaaaaaacatgatggtcctaaatggggggaattcaatattactttgtaattcattttggaaagaaattaattcctttcacaataatttgaaaattagtgtagttccaaaccacatgcccagcattaaaaaaaaaaaacaacactttattaaggtatgattgatatacaaaaaaagtatgtattatatatatatatatataaaacttaatgagtttgttggtaagtatacatgtgtgaaaccagcatttttctttaagttgctgtattttgtttattttggtttggatttgtctgaaattcgtagtcaaaatttcatgggatgttcttggtaaaactagatgatgaatgtttgaaaaaagaattaagagatggagtttatagttcttaataataaaacatagtataaagctataataattaaaacagcatgttattggtaaatggatagaaactaatgagactgaatagcaagctcaaaagcatacttaaatatatataaatacttaatttctaatagtggtatttcatatgaataaggagagaatagattgctaaataactggtgaagaagcattggttaggtatttggagagagaaattaaaaaatgaaaatatagatgaataatcactttctttgataggcaaagaccttaaaacaaaactatttttagacttaacaactttaaaatgtaactgctccacaagtaatattgccaaaccagaaaaatacttgcagcatgtatgacaaagtattaattaacttcactgacaaacactttctgaactcttactatgagcatagagcttatgcttggggtggggaaagaaaacaataaacatttacaaattagataatttcagataatcacaacttttatgaagattataaaatattgtttctcaatacttgtactattggcatatctttataggactgttgggaagattctagaatgattatatcctagttaaagaagccaaggaaaaaatctctagaaaagtaatattgagcagagaattgaatatagtaaaggagaaaaccgtgaattttgaggagaacattcttggaaggatctgcaaagaccctctattagtgttttgttaaaggtgaaacaaagtagtacacacttagtggtttccttgtcccatccagctcctagaggctttcagcattcctaaacttgtgactacatcactcccaatttctgctttattcgcacatcaccttcttactgtgatctccttcctttctcttgtaaggaccattgtgattacattgggcccacctggctaattcatgattctctctccctgtctcaagatctttaagctaatcacatccctaaagtcctttttgtcacataaggtaatattcacaggttctggaaattacaacacagacatgggggaggagggctactattcagcttcccacagaccctgattcagtgtgttcattttcaattgctacagtagcaaattaccacagacttagtgcctcaaaacaacataaatttaccaaacttaacataaatatatattttacttctgtggcataaaagttcaatataggtctcacctagcaaacatcaaaatgtcagtagggctgtgttctggaggctctacaggagaacccattgtcttgtctttccccgtttctagaaaccacatacatttttggctcatggcctgcttcttccattttttttttttttttttttgagacggagtctcgctctgtcgcccaggctggagtgcagtggcgcgacctcggctcactgcaagctccgcctcccgggttcacgccattctcctgcctcagcctcccgagtagccgggaccacaggcgcccgccaccacgcccggctaattttttgtatttttagtagaggcggggtttcaccgcgttagccaggatggtctcgatctcctgacctcatgatccgcccgcctctgcctcccaaagtgctgggattacaggcgtgagccaccgcgcccggccctccatttttaacggtagcagttttgtatctctctgtgtgtatcttcaccgcttatccctctgactgcagccaggaacgtgtctctaattttaagtatttatgtgaatacattgggctcacccagaaaataatgaagaataatctctcatctcaaagattataaccttaatctcatttataaagtcccactttactgtggaaggtaacatcccaagtttcaagaattagcttgtagacatctttgggggaacatcattctgtctaccacattcaggaatattttgacctattcaagcatagaaagaaggcaagtggctggggcacagcaaagggagggagaatggtgagagatgagattggcacggtagtcacaggccagactgctgtccattggagagtatttcaagagagaataggatgtcataaattaaagaaatagatcaacattaatctacagaagtttctgggatgataaaaagaatgagatgatagattctgtatcttatctgtttttggtgtatccgtactgcccagtacagcaaccattagctatatgtggctgttgaacactaaaatgtgacttgtgtgactgaggaacttactttttaatttaattaaatttaaatttaaatagtcatgtgtgactagtgatgactgtattgaacaggacagacaatagatacattttgggagaagttttgcaatgacaggagcagaaaaatggacaatagcaactagagggatatgggattaagggtgttttttgttttgtttagattggtaaaattaaagcatatttgtattcattatgtattattgagtaacacattaccacaaatttagcagcttaaaaccatatacatttattaatctcactgtttctgtgggtgaggagtccaggtatggcattgctaggagtcctagcttttacatgagtttgtaaaagctgcaattaaggtgttgtccaggggctgtggtctcatctcaaggtgaaggatctgccttcaagctcagtggggtactggcacagttgagttccttgtagccttttggactgagggcctcagtttcttgctggctatgatggttaattttatatgtcagcttggcagggctgtggtgcccagatatgtggtcagacattctgggtgtttttgtgagggtgtttttggatgaaattaatattcaaatcaatggattttaagtaaagaggattgccctctgtgttagtccattcttatgtcactataaagaaattcatgagaatgggtgctttataaagaaaagaggtttaattggctcatgattctgcatgccatacaagaagcatggtgccagtgtctgttcctgctgagggcctcaggaagcttccaatcacggcagaagatgatggagaactggcatgtcacatggcaagagtgggggcaagatagagagaagcagttctcaagtgaactaagtgagaggaggccccacctagagatacagatttggcagttttcagcttatttttaataatggaagctgtgattgcgaataaccctttcaacctctgtagagttaaataagaagagggccaaggaattattccaggaaacaatactgttttacctctgagtagacaatagagaagcatactgaaaagatatgcctagagacctgtgatgagatctggaagagtgtcagggaatccaagattctgtatagaaggaatcaaatctgtatttcttcatcagcacctaataccaaaaataaagtagcaggcaaataataggcaacccctgccctctccctctgaccaatccggttattatagggaaagtcttctagctggttgagtccatatacaatataatgtttcatttttaattgtaacacctaattaagccaggatatataccctaaatgtaactatattgtccatgaaccaaaagactcatcatctctgtttaagacaacaatagcatgaatatttatagcccttcaatgtaaagccaacttctgagatttctgtactatgtagacttttgtggagtttttttctttttttttgctctcaagaactctctgattcccactatgacttttgcaattattaagacctaaataagaattcttagatgacacacttgaaatattaaatcgtatagcgtagccttaaaatgcttataatttttgtagcacaataattacaattttgcttacttttcacccctagattattgcattttgattttaagaacctgtaagatccaaaatacatggagcttgattatatgatcagcttgagatatataagcattttttattagttctaagaaatttgggcaataatatgttgtagttgggaagatgagattagtagttttgcaaatatagttttcttatctttttagaaggagtccttatcagtatccttttctcagttccagttaccttttaagatcagtgtgagcagttgtcaactgagatatgttactgtcccttttaggaggtgcatttgtgatgttctttatttaaatctaaaacaaacatttcaggccagactcagtggcttacatctctaatctcagcactttgggaggccaaggcaggcatatcaatttaggtcaggagttcgagaccagcctggccaaagggtgaaactccgtctctactaaaaattcaaaaattagtcaggaatggtggcaggcacctgtaatcccagctacgtgggatgctgaggcaggagaatcacttgaacccaggaggcggagcttgcaatgagccagggtcatgccagtgcactccagcctgcgtgacagagcgagaatctgtctcaaaaaaataaaataaaataaaaagtaaacattttagaaagtcactaaactgaagagttcaggatataaagacttaggttgtagttgattcaaaactacaaccaaaagttgatcaacttgtagttgatgaggaacatagctaggtcaaggtaatacagttcagtcacctttttttaaacatatcttgatcaatttcctgtattactagaattttacaactatgtatcacaactatatatatgcaactgtgtatatatctacaatagacaatattctgcattataaactgtaatggatagactactgtttttagtatacatatatcttgatacagctaaatttttctctgatgtgaataaatttaaaagcactcactgcaacaaaatgagattctatctggccgttatgcacctagtaataacatcaagatacctttatttttcattttcctttagttccacatcttgtttcccaggatagtaatgaactttaattctgcaagtttatgtagtctactttgataatatattgaaactgaaaccctttagtggatatattttaagcaggatatcaaatcacaccttgataatctcctctcctcagaaacacttagaatggccacaaataactctctaggaattaagttattcatagtatttattttgtatgctttactgatacttttatttgtgtggccatttaaaagaacctgaaaactgagtatataactatacattctttaaaaaacatctgtttaattattttcaaatctatgtattatgatagcattaagtgctattaagcaatctttaactgtgccctttttgtttaaattgtactaatcaataaataaccctgtcatgtctttatttctttatttggacagaatcactgcccaaatcccttacctatcctattgtagttatagtttcttaatgaggattattacaataaataaataatcaaaattttatcaagcacatagtatgggccagagctttgaaagataatttggaggctatggaagaaatagaaaagagggtcccagatctcaaaaagcttgaaatctaaagggaaagactacatttctgaaacaaccaaagaaaaatataagcaggatataactgaataatacattgtatgagactgaaatattaagactagagaggccaatgtaggctgatatggtttggctgtgtctccatccatatctcatcttgaatggtaactccaacaattcccgtgtgtcatgggaggaacctggtgggaggtgattgaattacaggggcaggtctttcctgtgctgttctcatgatagtgaatgagtctcatgagatctgatggttttaaaaacaggagtgtccgggcacagtggcccacgcctgtaatctcagcactttgggaggccgaggtgggcagatcacgaggtcaggagttcgagaccagcctgaccaacatggtgaaaccctgtatctactaaaaatacaaaaattagggcatggtggcccacccctgtaatcccagctactcaggaggctgaggcaggagaatcacttgaacccaggaggcagaggttgcagtgagccgagatcatgccactgtactctagcctgggtgacagagtgagactgtctaaaaaaacccaaaaaacaaaaaacaggtttccctgcataagctctgtttttgcctgctgtcatccgtgtaagatgtgacttgctcctccttgccttctgccatgattgagaggcctccccagccatgtgaaactctaagtgcattaaaccctttttcttcccagtctcaggtatgtctttatcagctgtgtgaagaccaactaatacataggctaacttagttaaaaagaacttggcctgggctttgaggtgatggtaagggagtatggcatttaatcttggacttgaagggttgacaaaaagatatccggaatagacaaacccctggctaaagaaaatgtatgtgttttctgaaattgatgatttttaatgcggattaaatttaaaaagctaaaagtatttattctatcacttagaatgataactattaagagtcaactagtgaaacctactatgattctttatatatatatacacgtatacatacatatatatgtatgtatacgtatatattatatatgtatatgcatatatgtatgtatatgtacatattatatatacgtatacatatgtatacatatatgtatatacgtatgtatacgtatatataatatatatatatatttttttgagacggagtcttgctctgtcaccaggctggagtgcagtggtgtgatgttggcttactgcaacctctgcctcttgggttcaagcaattctcctgcctcaacctcctgagtagctgggactacaggcacacgccaccacgcccagctaattttgttttgtattttagtagagacagggtttcaccatgttgcccaggctggtctcaaactcttgagctcaggcaatctgcccacctcggcctcccaaagtgctaggattacaagctggagccaccgcacctggccgattatcaatattttagaatttaattgctcttaacttctttacatagagaaatgcagacatagcttaaactcttagaagattatagatagactgaggttcttaacaagatctgtgtactcttaattattaataaaattgagaactaactacaaaaaaactcttaattttatctgtttctaacagaagagacatgctctcaaaatgtcttttatatgtggtttctggctgtgctgtaccattcaaagtcatggttttatactgtagattattttgaagtgacagaactgataaataaagaacagctgtgacagtaaccttatatgtcaaactagaaactggagtaaaaatttaaaaattgacacaacagtacgatatagcttttgtgctaattttctggcgttaaaatgatacttaaattgctgcttttgttgtgagacagaataaagatggactgggtgtagaggtagaacacagaaatattttatacttctcaactcattaagcctgatgaggccctttttgaagtccagtgcatctaggcacgtggccccttgcatctgtagtaatgtgcacagcctagaacagcagcagtgaaggtgaaagagtgcctcctgctcctggctatgcaccgtgtgtatacgggccaaatacttttgagaattaaaaaaaaaaattaatctgagtatttcaagtaaaatccttttctttgattaaatttatagatacttttagtttatttttattctgtagaataacagatgtccttatctattgaaggactagaaactggtgacaataattagaaaatagatataaaaaaagttgtatacttttaagaagaaatgacatttcatgtttattttacactgattagctgcaaaaagatctaagagggttttggaatttttcatcagtgtgtttgagtgatattttgaaagaagttgttattagtgatttaaaattagtcctttctttgtcatctgagatagaagtgtagagggctggacttgtttatctcttcatttgtattttactgattattttatttcaggatcaaagtgtgggatgaattctttatccttttggcattttgaaacttttcaaatgttaaaaaaaactttttatttctaaaaatgtccacttctctcaaagctacctgacaattgttaaaataaaagaatacaaaaccactttgtgggtttatgttttgctattgtaacctattgtctaaaataaagtaagcttatttttttctcctgctttgtatcaactcaaaacaataatattctgtaggtgactttttttttcctttttttgtttttgttgttgttgttgttttcgagactgagtctcgctgtatcgcccaggctggagtgcagtggcacaatctaggctcactgcaacctgtgtctcgcggttcaagcgatccttgtgcctcagcctcctgagtagctgggcttataagcgtgcaccaccatgtctggctcatttttgtatttttagtaaagactaaacactgtctttacaacactgtgttggccaggcaggtttcgaactcctgacctcagatgaactccacctgccttggcctcccaaagtgttgggattacaggagtgagccactgtgctcggccaggtgacatttttctttaactttgtgtgtatatttacactcagagaggtttcaaaaggtaactgttcaaatttactttcaatttatttattctttatataggtaaaactttcttatttaagcttatatgcctgttaagtggactcatatttcattgcatgagaaaactgcaattgctttttcaaactgtacgaatgcagtttcacagtggatgtctaagtgaagtctgcttttatttgtaaattgtgtaataaagatttgtctcaaaattatcaaccatattaaatatttcttaatctgtatgtaatatatttatagaaatattcttttaaaagcaataccttttggaaatattcttatcagataaatggcataatagaaattcacaatctaggaggcaaaaaacaaaaacccaaaacaaaaacaaaatcaattctcattttactcttctacggactcagtgctaccagcatctttctttggaattatgtgtaggttctgaacctaattcttcccctactttttgtctagttgggatactctcttaccaagaaacagcacaacagcatagcatagcagaatcttgactttaccccttcaataacttggataactactctgaacctgagtttactgatctataatgtggatatgataatagttctcttacggtgaagatttatcctagtttatatttttgctacacttgagttacacttcaaccaaaagatgtggtaactgaataataatcatcataatttgttatctgttataataattttaaggataaatataatcattattactaatcattgtgtttcggcatccttatcagccaaatggggaatacctgtgttctcttcagaattccataagtgtactaaaactatttgagtattttattttaaactgtaccctagtagaggaattaaggtatttttaagattcttacctttatgcaaaagtactaaagcttgacacttaactttattattggcaatttatggtaataaattattgtctttagataaaagagtaattactgtgtagctactagtttcctaaaactctacctttctcttagctataacaaaattttgagctttcttcaacaaaaggtcagttattccattttagcatttacatgaacagaaattagagttaaaattatcatatataattccttttcttattctgagcagagagacttaaaattaggctttagcaaacagatggtagtaagcttatacagtatttatgttgctttcttttctgctaggagatggaagagtgacttaccacttacaaaaattattcttgggctatatgttgatttatatgatcaagtaagaaactttaggtagaagcccagtttttttgctcactgtttgtatatcttgtaaatgcattgtatttaaatccttcttacacttttttattctcagaagaaattgtgtatgcttaaaaccaggcttctcaatcttgatattttccccaaattaaccatgtttttctttcattttagttcagacttggttccttcaacctagagaaagttgaaaacccagctgaagtcattagagaacttatttgttattgcttggacaccattgcagaaaatcaagccaaaaatgagcacctgcagaaagaaaatgaaaggcttctgagagattggaatgatgttcaaggacggtgtgtacacagtttgcttgtggtataaaaatacggagccctctttatgttgttatagctttaagttaatgattggtaaatttccaatatatgtggattagcacatatatatttaccttaactgaatatgattaaacgaaattattcatcactattgtatattataggaatacattaatacattatgtcattagtatgtggtggcaccagcaaatttataaacaataaggattaattgggcattgaagatcaaaacccattaatactaataaaagatttaggtagtaaatatttattaagattaattcagctcaaattataggattaataatgaatgaaaaagagacatgaaataaaataagcataattgatttctcatttgggctcagtgagtggcatctatttcaaattacagtgttttggctcctaatagacttatttctctggatttattgaaaattcatactataccatttttaaaggatgagctaattgtggctactggataagacatttggaagccttttatttttatggctttgcctctttttaaatgaggaagaaaaaaataatttttttttaaattatgaactttctcaactaaatcctaatctaggctggcccaatgtgtaacctttattattctattagtataagatatttgaaggaaataaaatgcatgttgtgaacacttgtatcctcacttataatatatatatgtgtgtgtgtatgcacacacatatatatacagtgagaaagaaaatgatgtctgaaaaattatgtggaatatatatataataatgataataattattagtacatccagtagattttttaaatcttttgcttaaataactctaaagcatgggaacagtttatccaacatatttagggtctttttagcgcaaccattgtgattgctctgtatagacgttagtgagtatatgtgaaagtatatgaaaaatggtgacgattttaccactatcaacatatgtatgtgaaaatgaggctgactaaaagattatttttctgtacattcaattatatttattaactaatgcaaaacatgtaaaattaagttcctaacatctagtgttatttggctttcatgtattatattaagaaagtggttattttgttctatcttagatctacatttttatctccaattatttatatatgttatatataaataatataaaaatgagaccaaatccaaactgtgtatcaggaaaccatgcagaaaaagttaatttttctctttaactgctgtttattcataaagatgatttcaatgtgatagtatgaatcagtatcagatatctgtactacaaagcatttcttggacctgtatctgtagcttgggtgtattttctatttaatatgtgaaataaatcaaattaaaggagatgtgctatggtcgtgataagccattatatttaaaactcagaataccctcaggatgataggaaatttgatccacaaattgcctacaaaaatgcagactgggtacttggtacttgaacaaattgctttaaaatgtctgccagaggttgaaagaggtattatctcatcagtattcaacaccactcccatagaattgaaagcagcagggaacgaagatggggaattagagacaaatgcaccctgtgctgtaacagtgtgtgtgaggggcacatattatatgtggctcacagatgcttgatttgctatttctggactatccagcaagtgcttttgtcttgttgtgaagagatttcctgtttgatcaaaagcacagccatgtaccctgtcacctgctttattatgatccagctatttttttgatagtactgtgtcagatgtcttcttcagggtctatagatgtgtgccagtgggtggccctatgtcctgagaggaaagagagtccactccagagaattctagtctctttattgtattccagatcttagattagtagctttaaatatttcccaaatttgattttctttcctttcagaggacagaggccactttaaggagctgtaaatacatcttgatcatggccaagcagcagtttcttagtgttccctcactagagcctttgcatgctggaaaggatttacagctttagcttccataaggcagtagttctgattaagtgtctttagggagattagaaataggacatgagcatatggagttaggtaactggggacatagaaagtagagaatcattagagttggggccatgatgttaagcctggcaatagttaattttgggggaagcctccgattatttttgggtcagtgtccattcatgatccaaacatttcttctatactacatatgaagggatgggagggtggtgttaaaatagtggggaaggacacaatgtaagggatgggaattcccatagaagcgatggtagatgggtctgagatacatttactaccccataggatattatatgagaataaaatagttgtgtacacatgtgtttattagcatggaaaatgttgatcatatattaaggtgagatgtgcatcaccacaaatataaacaatatcccattgtttgcaaaaaaatatatttatatagagagtatctggaagaagaaaattaaatgttaatagtgtatatctggaattgtagactacattttcctttaattttggggagtattttttgtatatgttttagtatttaaatatgtatcaccattataatcaaacaattataaagctattttcatttgggatgatggtggagaataaacacttgagtgaggaatgagaaattacagcataagtaaaaagtgtgagctttaatgcatagaattttaacatatatatttgctgttatttttaattaccacttaataattgtgttcttggctccattttgaacaagtggcatcagtggattaattttgtatagtgtagataaaggaggaaacatttaagatgtgtacgtgaatccttaggttactggctatatttatttcatgggttttctacttaattacaaataaaaactctcaagttccatgttactgaataggtgttttgtttgcactcagacctctacttagaaattacctgcctttattctgagttatagttattaaacccataattggaggcagttttcagggaattgggttgacactcacagaatcatcaaaataaaagaccttgaaagctcttctacttcatctctctgccttcaagatacaatcacattatatccagatgaattcagtccgatttttaaagacctcaagagatatcttcatctcctcttgatagcccgttacagtgtttaagaactgtcgcagtcagaaaattctttcttccatctatgggtaatctgaatccttcacggtatagttgaaggccatttcctcttgttctcttgtcagaaaggatgaggaacagctgttcaccatctttttccgtacttaaagccttattaaatctctttaccactgcttgcttttccagttctttttagctttctttgtcttcccaactctattcagactttcttttgacatacaaccctgacctgggccagatataattttggccagaactgattattaatttaaggattactgcactgtgtctaaataccatatgttcacatttatatatctattattttattttgagctatcatttaatctgttgtttcatttttggtgttatttctgcatgaaattgttgtgtttttcctcctagtttgttattgttttgacatgttattcttagattgttttcccacccagagacattttattttgaatattcagtatttttttgtatttttttatccttttaattttttaaaaaaaattactatttttttgtccaaggttttagatacctcagtgctaggttgctaattaaatttagcattattgttctgttttcctagttattgtagaaaggatgaagtatcattagacctttcttgtttgatgttatttgtgatttcgtcccaatttgagatttgcctggatttgatccttggactagtgtggtctgatctagttgtacatgggctttttgttagtgtcaccagacttagcagtgaatcccatgtctcttctccactaaatgttctcacctaacagttcctgtccaatttcttgaggcataagcttgacaggaagcacgtaatggaatgcatagtaacatcataatgctctaggagaggattggcattaaaaattaggtgggaatgatacgacatacctcttagttactgattattggataaaaggatagcattctctgagtcttgaaaaattaaaagttaagagtaaattcatgtcatgcaactgttcacactaatactttttctccagtcagctcccgctcccccacttttctaggaagtgttgtccagtttgatgatcagaagtttggttgcaaaaaaatcctaaagctttgctgaaaccaagcaaggttaactcacatgataccattcattctattgactgtgttttcctgtcacagaaatgtttcctttgacaacatagatctgatactggttacttaagattaacaatattctttaggaatattatatgatatttcattttcatatttattttcactttgaatgtgtcataccaaatgttaattttaataaaggtttgggaattagcttgttagttgttaagtacacatcatcattcaatcaagaattattgaagtgacttatatggaaattaaatatggacttaaaccagataaattactaattggttaccattcctaaaatttaatataagaaattgtaatatatttgtttatatgttttcacatattggtttttactttgcatatgtttgaagtatgttattatatactcaggtatttcagtaatatgtatgttttaaagttttttgttgtgtttttttgaaaatattataggaagataagaatatcatgcttacgtaacactgaatctgaaatataaatgtagtgacatgtctttgcttaaaataaactatcaatattgctagctccttttcaatattcagtttttttctaacatctttcgtgtacttctttctcagagaactttgcttaatgaagggaatactgttagattgatattatttgccacagtttttttaaaagctgaagatgaaaaacattacttttacaatggtgaatagctattaaatgagggaaaaaatacaatattcggaatcactgtttttctgtttccttataagatgtcaatattagccattctccttggctcttcttctttgctggagggctatagtcagccatggtgcccagcaggaatggcataatcctgaagccccacttttgtaagtactggcagtggcctatagcaatatggttcacccagcctgcaaggaagagccacagacatgggactgggcaagcccactgcattgcccggtgccttgtatctggacccactggcccctagtaaaatgccccacatgaggtttcacaccaagtacaagctggtaggggcttcagcttggaagaattaagggtggccagcatccacaagaagatggcctggaccattgatttctctattgatccaaggaggtgagacaagtctactgagtccctgcaggccaatgtataacagctgtaggagtactgctggaagcttatcctccttctctagaaacctcagcctccgagaagagagacagctacactgaagaactcaaattggccatcacactgacaggaccggtaatgttcatatgaaatacctatacgaaggagaaagccagagtcatcaccaaggaggaagagaacttcaagactgccacgtcaggccaggtgcggtggctcacgcctgtaatcccagaactttgggaggctgaggcagatggatcacgagctcaggagttcgagaccagtctgaccaacatggtgaaaccctgtctctactaaaagtacaaaaattagccaggcatggtggcaggtgcctgtaatctcagctactcgggaggctgaggcaggcgaatcgcttgaaaccagaaggcagaggttgtagtgagtggagatcgtgccactgccctccagcctgggcaacaacagcgaaagtctgtctcaaaaaaaaaaaaaacaaaaaacctgccatatcaatgcctggctctttggcctctgggcaaaaaggaccaaggaagctgcagaacaggatattgaaaagaaaaactaaagcactgttgaggccttgtaataactctgcagaaaagctgggaaaacgaataaaccactgggaaaataaataaaccaaaaagatgtccatattaatttattcactttattcgtttgtctaataagaacctaccaaacatctgtcgaatgctaaacactatgctgggcactgaggatacagtggccaataaaacacacatgctgtctgctttcgtggagttcacatctttggcaaagactgtgctgtaagaatttgctgaaattggtcccagagaatatattgccatattttcctttttatcctatgatacgttctaattctttgcatctctagataggtagattgttgaaagtttaagggcatgtatataaaagctatctaatttggacatttgtgtttctaatttcactgaaatatatatgtgtgtgtctatatatgtacacacacatatatattactactggtatatatgtgtgtgtgtgtttatgtacagtataaaaatactaggatacctgtaaaacaacaacaatgtaaataagcagtatgaaacaacattgaaaagaatacataaaataatttgtatttgaatcaataaaataggaatgtattcatcatgtatgtgtatgcatatattaagtatatacaacctcagctattttgctttctttatatatctcttgggagcttaaaataaatacaatcccttgttagctcatttgagcagtatgggatgaattaaaaacaatagagaattttgtatgttttgtcttacgtatctaaatttgaagatatgtagtgttttacatttgctgttttattaatctctccttgaatatatcaagtagaatactttcattgggtatgtgtattgcatttctatatgtatttgtgtgtgtgtgtgtgtggtgctcgcttataagaatataactggataagtcgtgttcttgttgtggagcagtttgttgtctagtagataaatcagacaaattagctatgttgccttatcacaaaataagattgtagttgcttttatagtaatattaacatagtactgaggaaacaggctacatttactcttgtttgaaatttatcccataaaaacattcttttgtaaataaaccatatgtatcaataaattatctttaggcattttgattttctaaaggcttatttgtatcagttttcaattttgatccttatctcagtaaataaattacattaataaccaataatttctaattgtgtatttaaccatctttataaaacttccaagtcagtgaaagcatatgtgaaaataatctttaattgtattttccttgaaatcttcttgattattaggctgaattatgttaatgctaagcagaactgcatgactaatttgtttacttatttacttttttagatttgaaaaatgtgtgagtgctaaggaagctttggagactgatctttataagcggtttattctggtgttgaatgagaagaaaacaaaaatcagaagtttgcataataaattattaaatgcagctcaagaacgagaaaaggacatcaaacaagaagggtattttcgctatcttgtttttggatgacagatgaatacatttaagtggaatttcttcccaaagttaatgaacattagatgccaactttttgatcatatgagataatttggtagtctggatgtggatgttcaggctgttagataggggtaccatgggctagagagttctcagcatggtctctctatgtctgctcaactgtgtcacctacacttaaattaaaaaactgacatgaggcttattaaagtattatttaattcttagacattagtaagacatactaatttaaaaaaaaactttcatctgcagaactacaaaagttggatgcatatttgtaatcttgatgtctaggcaatgattaactttagaatcaagtggttaatattaaattccagggagcacttattttatctgattagagtgtgattatcagttttattcttctttcacatattctctgaaagtacatatgtacttgatttttatggaagaatcctaagtgacaaatggctgatacggctttcgacgattataacttttttacgcattagcaaatacaagttagggtctgttgctttgaatcttagtagaagtacagaattaccagtgacgtagtataaaaaaatttgatatcagctagtcctagcacaggtactggtcttgcagtcatacctattagtttatagctttggacaagtcactttatcttcataataaaggtaaagatacccatcttagggttttgcagagatcaaatgaaatgcgaactgttctgagattagtaaaatgttaaatactctgtgactcacagagataatttgttagaaaaagtattttgatggaagaatagtacctgataagaaactgatttaatattaattataataagtactaaattcagattaaaattaggtaaaagagaaacttgttcttaagagagttaatatataggttttaagatgctttcatctaaatcatatatattttcaatatgtttgtctaattagaatctttttctaggaatattttctataattgcttactgataaatctgctgcctagcagggggtgagccagttatttataattctacctttctctgtttctagggaaactgcaatctgttctgaaatgactgctgaccgagatccagtctatgatgagagtactgatgaggaaagtgaaaaccaaactgatctctctgggttggcttcaggtaagagatacatacatttatctcctctgttgaatatcttatttgggcttcttattctaatgacaagaaaccataatggaaaaatgttgtgaaagaccttattctatgaaaattctttagcatttttattttaaaaactcaaatttttaatgttaaaacttaatattatttgtaaaatgcagcaactcattagcacagcagtgtgagcaagcattcatacacatatactccaaggtatactattcctggttaaatataaccaggaaaagcataagcaatgaggaagaaacacctttatgctaaatatcatcagcttaaagctggttgcctttaacatttgagatcttatttagctaaagccatgaataggccactggagcagagtaatcaagaatgctctaaattatactgaagttgaggccttctttcactcttcagaaaaaagattgcaacaagtgagatgtaatagaggaaaagagaaggggaaaaatggcagtttagtacaaagtacctatgacttactcagtcctttggatcaagttcccagcaagtgtttaaacccatgagttattttttaaaatgttttatagatttcctagtgacggtggaaacaggagcctctgaactcattttatacttagatggttttgacctaaaaccaatactattaaaataaatgcttgatttatttatttagaaaatatttttgagttcctattatgtactagaaactttgctatgcattagacagcaaaacacaaaaatctgtgccattgtggagtttaaattgtagtcagggaaacatataagatgaataaatataaaatatgttaggttgataagtgctaaagagaaaaataaaccagagaaggcgttagaaaggtcagggtgagaataaggatgagggttatgattttagccagactatcagaaaaggcctcagtgagaaggtgaaggtgacatgctgtcttggggaagaccatgccaaacagaaaacaaaaacaaaaacaaaaacaaaaaaacactaagtacaaagttcctgacgcgtttaagcaatactatagagtgtaatctggataaagtagaaagatgaagactgggagaattaggaaatgagatgagagagatgatgggacctcatcacgtgtagggcgatataggctaccattagaacttctcctgttactttgaattaacttggaaactactgaaggattttaaacagtcaggtgacataatctgactcaaatttcaagaggattagtctgtgtattgtgttaagaatagactataggatgacaaatgcagaagaagatataacagatgggaagctagtacaacaattcggtgaaggatgaggctggcttagaccagagtgatggagaggcgatgagcaaggagcagattctaggtgtgcttagaggcagcaggatttgctgatgaaggggttatgactgagcaaataagactgagaaggagcagccaggaggtaagaggcaaaaatataaatgtggtatcctgctgattgatggatttagcaatacaaacgttattaaggatcttaatagaacatattcactggattggtgaaggaaggggataggagagaataggagtttcaaagggaatgggaggagagaactggagatgagacaggcaatactttcaacaaatttcactgtaaaaaatgggaaagacatggggcggcagctggaggaggaagtaggataaagaaaagtatttttgtttgttgtttttaaataaaagaaagaatatgtttgtatactgatgagagtaactaaagagagcaggtaaaaccatcaaggcagtagacagaggaaaaactactggaaatctgtctctaaaaatataagtggatgggatccaagggacaagtagtagattagtttagccaggagcatagtcactccccataatgacaggagaaaaggtagaataaacagatgaaggcacaggaaagtatctaactgcagtcacagaaacttattaacattgattaaactggttgattcatctgattctaatcagatttgaattggattacacaatacacacacaatcatacttttgcacttgggaatgaaatttcttttcacttggcagttatgcttgttttaccctagtgtcccatttaaaatgaaattattatttaataatcaaatagagaaaaacttacaaagataatttgtactctttccagtttaaactttcagaatttttattaaatacaatgacctttggtcttgtttcttagtcagagtatcttaccaatatttgaagtaggtgaaaattattgatgagaaaatacgtggttaaatatggctatatgagaaagaggacttttatgtgttcagtctattttaagtaaaactttaagctacaattgtactattttcaatttggcaaaattctcctttctcttcagaaatgtttagtttatttcatgttctttctctattttacgtgtctttatttctttagcccacatctagttcattacacatatgatctataggtctctgtttttattttttatttttgcatttaacttgcttttagtaagttttcgatgtcaagaattaatagcataatagaactttaccctttttcttctgctgcaaaaagaaatgtttaggaaacagatgctgactgaaatagaaaaataaatctcatctcaaatgcttgacactgaatcaagaactagatttcatagatctgagaaagaaaattgtagatgttaaacaacaaaatgggccaccctataatttaccagtttccacaattaattcttctacagagacaaaatatgtttttagtccatgagagataattctgttgaacacagctttctctttttggtactctatgtagtattactatgttttttgaggcagagcagtgagaatttcttcctgatcttattctgccatcttgataataaattacttgctctttgaatacaaataaatttgtgaatttattttagatattgcaatttcctgtgtgcttttcctacaataaaaacaagaaaaagagaatctgatggggattaatacatttattcagactttcagaaagctgtctttaagtggctgaatatataatttggtagttattttgttatagtaaatggatttttatcattaattattaaaatgcccaaatttcatctggagttgttcacattattacccaatttcttgatgataaaatagaggtttagtgagatcaggatcatttagtaatacgaagatgaatatgttaatctgaatctgagtatggtaaatttgaattggattacacaataggcatacaatcatacttttgtaaatgggaatgaaatttcttttcatttggtagttatgcttgtttttaccttactgtcccatttaaatgaaattattctttaataatcaaatgtagaaatattcacaaagatggtatggtaattcattcacaaatatgaaatggcaaattcatatttaccgtattcactctagggaaaagtctggttacttttatgcatatatccagaagtagagtaggggtattacaatttgaaggaaattgttaagttacatttttatgaatacgcaatcaatttatggctttttttcctctaaattttcatattttcccactgccattaggattactgaggaaataactaatgataatgtagatcagtctaataaaccacatcatgctcatatgtactgtatgatgtagcatgaaaaacctcaaaaaatactcattttcttggctaaaaggaaatccccaaagtattctgaaacttgaatatcacagtcaatatcaccgcatactacattttatatttttccatagcaagatttacttttactatgtcttggattttagaatttccagatagatagtgattgtattactgactttatttcttaagctatggctgcatactaaggccctggattttataggtatttcactttgttttatattaagattatgataaatataatagttgctgtagtctctatttgtagctcaagctttggactagaaaagtagggatcactttcacccctatctagttggtattaagtacttgtggccttaaagatttcctgcttagtctggactcctcctgcctccaaagtgagtgtgtgtgtgtgtgtgtgtgtgtgtgtgtgtgtgtgtgaatttaatagaaatctgttgggttattatagatactgtgaaacagtcttccctataagaaactctttttctttccaaatcaaggtaaaacacgatgtccctatctaaggagaaacattgttaaactatgtccactaaataacagaacctcaacaaaatatgtagtgatagaagcaccattatgtatagcattagagccaaaatctgcaacaccaccacatgcaattggccttttatttgccccaaccatatcagatataatctaagaacagtttcgcattgtgcagttttaaaatattgcttcagaaccattttcatgctgtgataacagaattgtatgtgaaaacaattttaaaatatatatgaatattctaagaattttagccattatgaaacatttcttagtcttaacataattcaaaaagcatgcaaatatttagtggaaaatttgaatttatatgatagagttaggatttttcttgtgaaacattttgaaaagctatgcttaattggctcctaattagttagctatcataaggctaatgattttaattcctcactaattattttaatatataatcagtatttcaaaattatagttatttctatgaatagagttgacaatatttattacaattataggataattaagagcattactaaaatacaaataagaaatcttttctagaatgtttcactctttttagctgcatattaaaggtgcacaaccactaaaaacaaatataataagctttcctaccacttttctacataattactagcccaagatttagcacattagtttaattaatcctgcttcttaaccaacaggaaggtccctgtataactgctatcagtaatttaggctttcacttagttggtaggcttcctgaaaggaagtgtgattatagaatagcctttttgaaaataaatgaatggctatgtccaacagttgatgaatactgatatagtagcttttaaaaatagaacagaatccaatatttttaagtatcaaagggcttgttgcttcaaacagtgaatgtctactcacagaggggataacaacatgtactgccaaagagattactcagaaactcagctttagaataacagattatgctcttagtcttgcccagcttgtttatcatagacacatttatttataagttttaaattaaaagcttgatttagttaaacctaccaccaaactggaaaagaaatttaagtgtatttcctagcaatagtgggcttttatacataaccattgttgctaggaataacgttatatgctttggaaatctagactgtatagttctagatcctgttatttaagctcattgtttttccagtgagggaacagaggcctagaaagattaagtacgttacttttggttacacaggggaaaataatgaaaagtatttgccttgtaatataataattaaccacattagcacgtctactcttgaaatattataaaaacccttgcaaattttctaacaatgaggaaattgccactgatacaagagaataatgggaacacttttttctcctatatagaaaaaagatcctatttgtacatacattctcaagaaagatagtcaacgtcatcagattgaacaagtaagacttcatggtaggtagcttgtggagaaactaatagaatgcacatatttctgttgaagtcatccctgtgtatattaatttcttcagattttgacttagtatttattcacctgagaactctcaaatgtcccaaaggttgttagcaaatctatgatggtttcttatttcctagtactaaaatataactttgatatgacctcctaggcaagtatctctacatctttatatgtttggggggagacaaaaattattttaatgttatttgtctctgactatggatgagtgagaaaacaggcaaatcctttacccccaaatcaactatgaatctaaaattgacccaaaaataagcaaataagtacttccaaacatggccaaaggcaaacagcaatatgagaactgtttattcttgaaaaactgctgaagtttgggtaagaactgggagtctgtggatttcttgcttgcctaagactgcctctatcactgcctgcccacattcatgagtttggtcagtatgaaagttatgccagcatctggctggccatgaggactggcaactgctgtacctgagctaaagagggctcactcaatttgcagcagagggtgatactcacaaccagcagcattgtcagtagaagtaatgatcttggtgtcagtgggtaggtgtgttaggccaatggatctactaacctggttgtgctcatggttggggtaaacatattcctagctgaaagtgtgcatgcacttttgcagtagagactgaagagagggcccaagctatttttacagttctggcctaacctagagataatacatatcttcataggagaatagaaaaagagaggctagactttcaacatactcctgttcctgccaccgcccctcccccaacaaaagaaaagaaacctattagcttgaggtgtttgtgcattatttctatcaattactggctgacgtcaaaactgtctagacacagagtaacccatttggagctaggctttaaaatttaaaaatcaagaataaaataaactgtgcagaaacatcaattgtcacacatcacaagagaaacagatttcatacatttaccacaggtaagttaataaacaaacaaaaagcaacagtagcaaacttcagaaggaaaatagtcaaaacccaaagttgttacaatatattatttaaaatgtttagttttcaacaaattggacatacagagaaacaggaaagtgtggtccatacttgggggaaaaaagtagtcaatagaaaatgtttcagatgttgaatttggtagacagacttcaaagcacagtttatatctatatctgtatctatatatatatacacacatacacacatatgtatgtttatgtgtatatgtatatatacacatatgtatgtgtgtatatatacacacacacacatttatatactaaactaaacaaaaacatgtttaaagccctaaaggagagtacgatataaatgtatcaacaagtaaagattctcaataaggagatagaaattatttgaaatgaacaatatgaaaattctgaatttgaagagtgtaataactgaaatgagaaagttactatagcagttgaacaacagattcaaattgtcagaataaaaaaaaatcagtgaacctgaatatagatcaatagagtgaataatttcctaggaatgaagagcaaaaaagatggaagagaaatgaacagatcttcagagacttttgggacatcacatgtgccaacatatgtgtaatgtatattctgggacaaaagagagagaaaggtagaaaaaaaatacttgaaaaaatgaaagccaaagctttccaaaattttatgaaaaccattagtctaaacatccaagcaactcagtaaactttaagtgagataaataccaaaagataggctgggcatggtggctcacacctgtaatcctagcgctttgggaggctgaggcaggcagaacacccgaggtcaggagttcgagactgacctggccaacatggtgaaaccccgtctctataaaaattcaaaaattagctgggcatggtggcacgtgcctgtaatcccagttagttggaaggctgaggcaggagaatctcttgaaccagagaggtggaggttgcagtgagtcaagatcatgccactgcactccagcctgggagacagaatgagattccatctaaaaaaaaaaaaaaaacaccaaaataaaaaaaaaaaacaaaaagatacattgagacacatatacgtagaaaacatttgaaatccatagagggagacacttataggacagcatcaatataacaacagacattatctgaagcaatgaaggacagaaggcagcggtatagcatttacaaaattctgaaagaacaaaaaaagaaatcataaccaatagttttatatccagcaaagtatctttcaaaataaagacgaaataaagacatttattaattaacagattcattggtaacagacctgttttgtgacgcatattaagaaatcttcagggtgaaaggaaacaacatgaaatgataacatgaatctacaggaagaaataaaaataataaaaaatgtaaaatagtggattaatagaaaatataaatacatattttcttttttattattgtcttttatgccagattgaacaaaggaataattacaacactgtgacattgggtttataatatagatagatacaatatacatgacaataataggacaaattggataatatagctatatgagagcaaaatttctatatttgccacatataaagatattattaatatgaaatagattattaagtaaatgtattgaattagtaatttaagatatttccacaaagaaaaccctgggcccagatgacttcactggtgttttctattgaaaatttaatgaaattataccaattccttataaactctttcagaaaatagaggaggagcgaacacttcccaactcattttgtgaggccgatattatcataatatcaaagccagacaagacattgcaagaaaataaaactatagacaaatatccatcatgaacatagatataaacatttgaaacaaaacactagcaaaaagcaaccagctccatacagaaagaattatacactatgaccaactgagattcattcctcttatgtaaagatacttttgcatctgaaaatcagttaaagtatttcacaatgataaaataaagcacaaaaccacctgatcatctcaatagatgctgaaaaggtacgtgacaaaatccaacacacattaataacaaacactctcaacaaaccaggaatatgaggtaacttccttaacctaataaaggcatctaggcaaaagaccacagctgtcacatacttaatggtgaaatactgaatgtttacccctcaatataggaaaaaaacaaggttgtctgctcccatcacttctattcagtgttgcactagaaattctaggcagggcaattaggcaagaaaataagataaaaggtattcagattggaaaagaagtaaaacttcctttttgcagatgatatgatctagtgtataggaacactacggaattcactaaaaaactcttagagctaataaattgactccagtaaggttacagtgtacaagatcaatatacagtaatcagttgtatttctatatgcttgcaatgcataagcaaaaaatgaaataagaaaattgctcctggccatggtggtgtattcctataatcccagaaactcatgatgccaaggagtttgaggccagcctgggcaacatagttgagacacccatctttaaaaaataaggaattggccaggcacggtggctcacccctgtaatcccagcactttgggaggccgaggtgggcagatcacaaggtcaggagattgagaccatcctggctaacacggtgaaaccccatctctactaaacaaaaaatacaaaaaattagccgggcatcgtgtgggcgcctgtagtcccagctactcgggaggctgaggcagggagaatggcgtgaacttgggaggcagagcttgcaatgagccgagatcgcgccactgcaatccagcctgggcgacagagcaagactccttctcaaaaaaaaaaaataataataataaaaatacagaataaagaaattaaggaaaagaattgccttcacaatagcatcaaaaaatacctagaaataagtctaacaaaagaaattcaagactcctacactgagaactatgcaacattgttgagagaaattaaagaagacttaagtaaatgggaaaacatcttatatttatagattagaaatttagtattgttggccgggtgtaatggcctacacctgtaatcctagcactttgggaagctgatgcgggcagatcatttgagctcagcagtttgagaccaacctgggcaatatggcaaaactccatctctacaaaaaatacaaaaaaacttagccaggcatagtggagcatgcctatagtcccagctagttgggaggctgagacaggaggattgcttgagcctgggaggcagaggttacggtgagccaagatcacaccactgcagtccagcctgggtgacagagcgagaccctgtctcaaaaaaaacaaaaaaattaatattgttaagataaatactttcaaattggtacatagattcagtgagatgcctatcaaaatcccagctggttttttagcaaaaattgacagaatgatcctaaaacttatatagaatttcaagcaagcaagagtagacaaaacaatcttggaaaacaagaaataattggagaactctttctgatttcaaaagttactacaaagatataataaccaagatgatgtaatattattattataaagatagtcattatatcagacatagtctcactgataaaatgagaatctagaattgagactgtagaagtaagccttcatgtttacggtcaattggtcctcagcacagctgcgaagacaatttagtggggaaaggatagtcttttagacaaacagtgcttggacaattgggtatcgacttgaaaaacagttacacaggtgtttacctcatatgaaacacaaaaattaactcaaaatggatcataggcctatatataatagctaaacctattaaagaaaacagaaaatctctgtgaacttagttttaggcaaagagttctcaactataatatcaaaagcacaatacataaatgaaaaaattgataaattggatttcgtcaaaataaaaaaaattctgcacttcaaaaaggtatcattaagaacatgaaaacacatgccatgaattgggagaaaatatttgcaaatcacatatctgataagggatttgtttctagcatatataaagaatatttacaactcaataataagaaaataaacaactgggtcaaaaaatttgcaaaagacttgaataggcatttcattgaagaagatataagaattgttaataatcacatgaacagatgcttaacatcatttaatcattagataatacaaattacagttaaaatcagataccactacacacctacctgaatggatataatctaaaagttagaaaataatgtgtaggaaaggatgtggcaaaacttgaatcctcatacatttctggtgggaatgtaaaatgttacaaccactttagaaaactgtttggcagttcctcaaaaagtaaaatacatacttaccctataacctagctattctacttctaagtctttactgaagagaaataagaacatacgtcctcataaagacatatacttgactgttcatcagagcattagtaataataactccaaactggaaaattctgaatgttcatcttctggtgaaacgttaaataaaatgtggtctatccatacaataaagtattatttggcaatataaaggagtaaactactgatagatacttattgtggatgagcctcaaaaaaattatgctaaagcaaagggaaccagatgcaaaggttgtttattgtatgatcctatttatatctaatatcaagaaaaagggaatatatataggtactgaaaaccgattaaatgtttgctaaagcttggagtggaaatgatgattaattcaaatgagcccaagagaatttttggacatgatggaactgtcctaaaactgattgaggtgatcgttgtacaagtataaattgctaaaatcattgaattgtacacttatactgggtgaatgttatggtgtatcaattgttcattaataaaaactttctaagagtttctttctaaaaaaaaaaataagcatttgatcatcttgagatatttcaaaacacacacacacacaccccaaaaaccaattgtgaggtcgggtagctcacacctgtaattccagtgcattgggaggacaaggcgggcagatcacctgaggccaggagttcaagaccagcctggccaacatggtgaaaccccgtctctactaaaaacacacaaaaaattagccaggcatggtggcgtatgcctgtagtcccagctacttgggaagctgagtcaggagaattgctcaaacctgggaggcagaggttgcagtgagccaagatcactccactgcactctagccggggcagcgcagagcaagactccgtctcaaaaaaaaaaaaaaaaaaaccattgcgataatttgagctgttcagaaaaattcttgtacatcctaggtcaagaaagccagagttcaaaagtgcaagtttcattcaagagtaaattaatccggagggtaatgaaatacaagtatacttcttgtttttctattcttattagtattattttctgttcttattgctttgataaatccctaatattttcataaatcactggagctattgaagaatgaagtagagctgaacctcagcacaaggatgcagatgtcagcagaattctgtagcctgtgtaactcttacctgaagtttttactatactcaacttcaatgaatgccttctctctcagtgtatttttgttggtgtctgccttccctcctgccctttctctctaattcttacattcaaatcccaagggaagtggcttaagggtgtcttcaatgagaatagaacatcttgtaggtataacacttgttctgccacccataagactgctagccagcctgctacttggttgcatttttgctgttttgctccaagtatctgtgaccaggattgcataaagtatagcaatttgacattaacttgtgtcatctataagctgtttcagtgggcaaaatatatatgagaaaaagtatgtggtcgcttatttaacttaaacatttagtttcttgaacttctcagtctttaccttttttatatatatatatatatttattagattttaagttctagggtacatgtgcacaacgtgcaggtttgttacatatgtatacatgtgccatgttggtgtgctgcacccattaactcatcatttacattaggtagatctactaatgctatccctcccccctccccccaccccacaacttctcagtctttaatatgctaattaatatgcatggtgataaagatggtacatactctgcaacatttctcaaactcataaaactttatgaacttttttcagtggatattagtgttccctgcaacctatgtgagaaatcctgtgttagatggtttcgactttcatatgaatgaggtgagaaaagggaaggtatctaaagaaaacaggtatttcctaggacagtgtttgtatgtctgttttaagaggacatgtactaaatatgaggagaggatcatatatttgaggatacagttttaaaatgtagcataaaatcataagaataatattaaacctcaaacatgcaaaaacttggaggaattctgaaaatggttaaaaaacgatgttttgttttgtttttttaccattgttgtaaatggtaaaaacattctcagatctcagactactctgagaatttacttatcttagcacaaatgtctgttggcataactaatgttaatagatgacagaaacaatacacaaatgctacttaatttggtttattttgcctcaagttgagttcttaacttgtggtttttaagaagtgtttagtgaaaggatatctgaactctttggatttatgtgtaaaattttctatgtttatctgtctatatatctatttgtatatctatatgaatatgttagtttgccagggctgctgctgtaacaaagtacataactgagtgacttgaacaacagaaatatatttactcacattctggaggctaggatcctgaaattgagatgttggcagggttaatttcttctgagggctttgagggaatgatttattaaccaggcctctctccttggcttataggcaaccagcttctccctgttacatcaaattttcttccttctatacctatctctgttcaaattaccctttttataagggtaccagtcatattggattagggctcaccctaatgacctcattttaactttattacctctgtaaataccctacatccaaataaggttgcattcttaggtcctgggagttcagactgcaaaatatctttttttgggtgtgttggggggtgagggggatttccacccataacaatgccaataggtctatatctttctgaagcaaggatccaaatcaagatgttggctgggttgctgttttcaaaagggaccatattccaaaaatgattccaaaccattgatctaagagactgatatttaaactagaaagaatggagtaagacttgttaaaagggaactgaagtctacaatagacgagatgatgagataagaagagaaagtaacagcattcaaacagatagctaaatcactgtctgtctgtgcattagattggaggtttgtttagagctgcagtgttcagtaaggttgccactagctacatgaggccattgaagatagaaatgtggctagtccaaattgagatgtgctgtaaatgtatactacacactggatttcgaaaacctgctatgactaagtatgaaaaaaggaatgtagtatgtctcattaataaatgtttatattatacgttgaaattgtattttgagtatatttagttaaacacgtattaatatcaacatattctttttctttttcctttttaaatgtggctaaataggaaatttaaaattttatatgaaatatatatattcaacatagtcatcttgaggttctcaagttttatctcatgctgattttgtggttctagaatagatttatattactttgaagaggaaatcaaattgtactaacaagtctttatggagcacttaatatgagggtctttaggtcatgagatctaacgacccatgtatgactaggattgtgggtataattgagtatttttacctaagaaaggcaaaaggtattgtactttactacaattaatcaatttttttgattaattatagtaaaactgacttaagaatgcgtggatcatttatttgtttgtcccaggaacgtgaagctagacgtgttcattgtccctgttaaacagcaaaccatgactgagttcagacaaaaggtgatgtgaatgcagcaacaatttctaaatcagttaaatgtctataatataatatgtaggattcttgtctttctgggattgtgactggaatctctaccacaaacagcacatctggtcccctgagccaattcatcagcatcgcctgtaagccatatttaagatcaaaaggatagacaaggttaccaatgatgaggttctggaatgttgccagcgcatcagcactaacatgatacttgccacgacttaactctgagggcctggggatgtgtgaaggatggatatcagcaggctctctaagcagattctgaatgcatggtgtggtgaaacagaacagttacaagtatggtggccagaagaaaagctcaatgtgagacccttagtggcaaattcaagccttgtggtaaaactcaggaatgctgagaaatagtaaacctagttaacacccaggattttttgaggagagagagaaaggatataatttggggagtgacaaaataaaaaagatcttaggtactgatggtcacattgcttttcgagctatattatcttttaatttaaatgaataatttggacaaaatcagaagttgtaaattgttgatcctttctgcgaactaagctacatattttctttctttttcggtgacatcagtgttttaaataattgatacaaatgcatttaaacagggcattggtttcctgattttctgtaatctgcaaccctccttattgtcttagatctggctcacattgtttattcttatcacttgcataacttctagaagtatttgtgacccttggaggaagataatgatactgatgataatgagtactgctgctgtactagtattctaattctcctactaacaattattgttactactattcactactacttctactttttgaattactgttattttttattatggcatcactaccacaactgctacagactcattaatttagacacctaaattatttaagcactatttcatttaacttaacaattctatgaggtatatactattattatcacccattacaactgaaagaactgatgcacataaaggttagagaacttcctaagggtaagctgtctagtaatttgtagagttagagttctaacccaagcagtctgattacagagctcatctgtgagagccctcctatcctaaagttctttatgttttttgaaatagaacactctaatttattaaaatcctgtagttgagtgtggctttgtattttaaattcaattatattccatgccttcattttaataaaataatttagagctccttaaaagaggtgaaatatattatttctttctcatcttaatggaagaagagaaggtgcttttttggtggttctgttacaatttgatggcagagcaaataaagcaggagaacagtgatttatgctcagtcctagattaaagggcttgtgttaaaaggttattaagtatttatttaataaatactacatttaatattaataatattaaatgtccatttagacattaaaataatagatttagttttaaatgtagccttatatactattaatgttttatttagtggatataaatttagaattgttatagcttattggtgaattgacttttttatagttatgaaatatctctcgttatctttcgtaatgcttctttccttaacatcttctttatctgatagtagtataactaccccaactttcttttctttggtgtttacatggtttatcttttaattttttttaccattattctttcaatcttttatatatctgagatcggtctttgtgtcaacatcatatagttgttttttaaatctgataatctttgtattttgattggagtatttattccatttacagttcatgaagttaattatataatttatatattttaggttagatctactaagattctatttgttctttattttaactattccaactttcttcattatttcttgtagattgttatgattttgttctagtggtcactctacagatggcaacatatccgtgatttattacagtctaatataaattttcactttcacactttttaaaacaacacttcagtgcattattgcattgttagcttgtatttaaatttgccttatatttttagacctcataaaacattgttattgtagtttggatagtcagcattatgtatatctgtccacatctttatcttttaccttgtgcattatccctttttgttcatatgtgtttttatgtggaattctttttcatcagcctggagaaccctcattttcttcttaatttctttattggccaaattcaggaacatgttgtttaattttcatgcatttgtacagttcacagagtttttcctgttattaatttctaattttatttcatcgtggtcagaaaatatatttgatacaattttagatgtttgtgtttttttgtttttgtttttgcttttttgtactttttgttttgttttgagacagggtctcactttaccacccaggcttgagtggagtggtgcgatcacggctcaccacagcctcgacttccctggctcaagtgatcctcccatctcagccttccaagtagctgggactataggtgtgtgccacaacacctggctaatttttgtagtttttgtagagatgagattttgccatgttgcttaggctggtcttgagttcctgagttcaagcaatgtacctgccttggcctcccaaaatgctgggattacaggtgtgagccttcgtgcctggcagatgattttacttttgaaaaatttgttgagacttgttttgtggtctaacgtgtcatctatcctggaagatattccatgttctgatgagaagaatgtgtattctgcagctgttgggtgaaatgttctgtaaatgtcaagtctatttggtctaaaatgtagtttaactcagatgttactgtgtttggtttttggcctatttttgaatgtggggttttgaagttccctattattatcatattgtcatctatccttttcaggatacagttctatttctttctattcaaaggagtctattcaatctccttttcagtctattaatatttgctctatatatttgggtgctgtggtgttgggtgcagatataacaattgttatatcctcttgctgaattgacttcttaatcattatataattacctccattgttgctttttgcagtttttttgttttgttttgttttacctaaagtttattgtatctgatataagtatagctactttgctcctggttttggtcaccatttgaatggaattttttttttttcatcaaccctctttcagtctgtatgaccttacagatgaagtgagtctattgtaggtagacttgggtcttgttttttgctttgttttgttttttgttttttgttttattatactttaagttctagggtacatgtgtacaacgtacaggtttgttacatatgtatacatgtgccatgctggtgtgctgcacccattaactcgtcatttacattagttgtatctcctaatgctatccctcccccctccccccaccccatgacaggccccagtgtgtgatgttccccttcctgtggtccttgtgatagtttgctgagaatgatggtttccagcttcatccatgtccctacaaaggacatgaactcatccttttttatggctgcatagtattctatggtgtatatgtgccacattttcttcatccagtctatcattgatggacatttgggttggttccaagtctttgcttattgtgaatagcgttttttaaaatccatttagccattcttttaactggagaatttagtctatttacattgtagattattattgataggtatggagttatttctgcaattttgtttattattttctagtgttttttttgtggataattcgttcccttcttcctttgtgctttgatagctttctatagtagagtgctttttattcttttctgtttctcttttgtatatttattatagtcttttgttttgtggttaccctaaggtttgcataaaacatcttatacttctaacagtttactttaagctggtagcagcttaattttgattacatacacaaacgacactgttgctctccctctttatatgttttatgtttttgatgtcacactttatatgtttttataatatgcatcccttagcaaatcattgtagttttagttgttcttagtagttttggcttttgacctttatactggagatataattgatttatccagcggcactatagcattagagtgttttgaatttgacagtgtacttaattttaccaatgaattttgtacttttaaatgtttttaagttactaattagtgtcctctttcttatgcttgaagaacttctttagccttttttgtaatgcgtggtgataaactctctcagctttggtttctctgagaaagttttcatcacctcttcattgttgaattcctctgcggaattattcaattcagatatagcactcttcagatgtatgatttccatgtggcactttaaaaaaaactttctgtctcttcattgaaattctcagcttgttcttgcattactattgccacttctatgagcatctttcaaccattattttgaattccctgtcagataaatcacaaaacactactttatttaggttagtttctggagatttatcttgtttatttgtttggaatatattcccttgtttcttcattctccttgaatatctgtgttgatttatgcacacttgataagacaactacctctctccttcttgttagactggtcttatatatgagaatgttttcatgaacccatttggacagagattttaaggttcctctcaaatctttgtgtttgtccaaactgttatcgctgtttttggtgagcccctgaagcttattatgtgccttgtctggtcagtacctggagaccaatgtaataggagccagactcttaagttgtagctgttatggttggggtgttgaatgtgtgttctagttccttctatcttcatgatgcggctgggtgtgggcatttactttttactttttctgtactgggacagggagaggaactatggaaaatgcccattctcatgttcatgctgtaccttttgatccaaaagggatagctgctggaagtgggcttattatatgtccacctgcttgttttctgtgttctccggttatttaggatcacaaagcccccttgactttcatggctaagttgttaaggagacagtcccttaggtaggagctatggaggttgtggagcttggtgcatcgccaaatttattccagaaaaaaaaaaaaaaaaaaaaaggataggcctggatttatctctggggtgagctggaggaatgttgcatgaagtgaactctggtttcagcttccaaaaggctattattgtttgccctgttaattccccactgtaagttcattggaaaccaggctatcaattagccactggagatgtgtgcctaagcctctgctacgagatagtgagagctgcatgttcctgccccatttctgcactgctctgagtgggtctaggccctggaaatgtttgaatgcctgttaaaaatcacctcttttttctttggtcaagggagactcttatatgcctctgctctcagagctagtaggtttagggtggagtccttctgcagatagctctaaaaactggggcttttaatgtgtgtccgaaacctcttcgggggataaacagggatctgcatttttttaaagcctcttctttgtaccactccaggggatgaagtccctggaggtgctcgtgtgcccacttaaaagtgcttctttttactatggtctagagagatatatgtgctagttccctctgcttttggagctaggagatttaggatgcagttccttaggtagatgttgtaagagctgcggtgcttggtgtgagtacagacactttctaggctggcagcagtttattaattgactttcccattaattccttgatactaagttagtcagaaaccaggttagtaggtagaccctcgagttgtgtttcataaacccctctggggctggagggagggtggaaagagagcatcatacgtttctttttaagtcctttttctatactggcccaaggggtttgaagttcctggaagtgcttgtgtgcccaaataaaactacagccttttccattacatataggtgtctttctagatacacaggtctactcccctctgctcccatagttggtgaatttaaagccaaactatggggaaatttaggattagggccctctatgtgggatccagaccctcctctctaaaaggagaagctggatgttggggatttctttcccagttttatggtacactgcctgggataggatctgtgcccgaatttatctcagctttttctattcattaaatgtagatgttttctcagttgctcagtaggctgaaagtctttcagttggtctctgacttcctctcagaggtaactgatctgtagacagatgtttattcggtgcatttgaatcaggagtttcctattccaccatgtttctgacattactctggcttggtgtcttttgtcagctttagaaaagtattggtcattgttttttcaaatattgattctatcctgctctttgtcttttcattttctgggaatttcattacatgtatattagacttttccctgtattagagtttttcacttttccctgtgttagagtttttctcatgttcttttgcataatttcaattcacttttagttctctgtgctttaggctaaatattttctggtgatatactttatttattaaaattcttagtttttgttctttacccatttcccttttatattgtaaatcagttagggatgtatttttatctactgtgtaaatatgtttctctccactccgttgtcagatacttaaacgtagtattccctcattgcacctagttcattcagtgtcttgaaagtaacaggaatgctgtaattttttaaactacttaaattaatgaatacaatttatatctatgcctcatattgtttgctgatggacgattatgtaatataccttgaaagtacattactgcattggttatacattttgacatatacaaaaatgcccaaactagtgttgaacatgttgtagttatatactaaacaggactataataaactattgatataattaggaaatagttgtctgaaattatctacgtgatttttactggttaacactctgcttcatgaaacccattttcaagatcgttatctaaaggtagttgttagcttgttctccggttggtattatttcagctgcaagtaactaacactcaattataggtaataataaagattttattatctcacataacaagtttgaacatgaaggattttcatagttggataattcattatctctataatgtcatcatgcactcaagttctttttctattctgttctactcaggctttttctctcatgagaaaaaaatgtaacattgcagacattcttgaagctcatattcatcataggtttatacagatttcttctcagggattcgtaaagaattatcccacttgtgataatcctgaaaccatcacttgtagggaggatagcgtaccttcagtgacttccttagacaaatgaaggtgtcctctctgagaatgaacaaaaatggttttctttaaggggaggaggaatgtcctctggctagacttggaaaaaagtaaaaccaagggtaattccctgaaaaacttctattttctgtaccagtgtcatgcttggaaaattgttgattaaccaagtaatgtcttaggaaagaaactaggtatctatattttaaaactatgcatttcctttatttattaaaatgttatttatttagttttcatcctgtgacaatataaataacatataacaatctttacaataaagtaaattcattttttcaaaattttgaatgtatgtggtagactaaactttgatttcaaatcgaattttcacattgtgatactacttttacataaggcatctagattatgaattacttgcaggaaaaaccatgtgtccttgtgcctccagagtttctttctagggtcccacttgtgtaaaggttttaatgaggtagatttagatctctaagccaacacttgaaaaagaatgaatattttcaagaattactattataagttcagtactgctcagttcatgaaaaatttgagttcacacctaggattttaaaagttggccattaattaatgattattcatttacaatggtcacccaggtctctaaacattattttgaagattgttgtgtttctttatttgcacttaaacaaaaataccatctgatagttacatgcaacatgtaaaccttggtggtaaattttattcactaaaaaaacaattattccattatgttctaaacttaggtagagtgtaccggatactgatttcaagtagaaactcactttaccagttttggcaacattttcttccataaggcccttagtgatatcccgctttcctttttattttaaacattgtactgtctcctttttcgattaagaagtaatcagaggtgatgctccttacgatccctgtatctgcaatatagaatctctgtgtgtcaataatggccaaatattggcactatcatgtgtttcaacctaatatttatagttcctgtggtgcagagaaacaggacccagttccatttggagacttgttgaatgcgggttagcatcataactaactcctaccaaaagacgaataaaatgaacagaaacaactctagaatttaaacgctatagactttccacttctcttgatataaagttccactacttattactggaggtagtttttgtggtattggcaaggaactggaaatggtttgtgatatgaacaacaaaaaattgtgtgagctggacttgagttttggggcactgatgtatgccatgatcctctcaggcattgtgctggcaggtattatgatgactgcaaggtacattaactaacatgatgccagtcagcctgaactctttctttaatatatcgccttggcaatcctaagatgattaaaatttctgcagccagtaacagtgacagtggtgatggaggatcagggatggtatctagtattgttaactcaaagaccaatgacgggttgtgaagaagatgctatccaccctgctctgaatgcatttccagtggttcttattttggggggaaaaaaaggttaaaattgagtagaaataggaagataaatttgaactagagaaatatcttcagagaaattatgctcattccattaaaactttattccaggagacaaaatgtttaaacttttttttttttttttttttttgctaaagatgacttttatgaccaaatacatttggaaaacaccgagttaataaaaactaaacaggtttattctaaactgtttggtctttaatatggtagttgatatgcagtttcagtctcattaaatactgcatgcaccattttgcacagttgaatgtttgcattattagaaagttaatttattttcaacagatcatgagattattgaaaattaaataaagtgtgaaacaatatttgatatattttactttttaatttgtgcttctatactagaattaattttgttgatattaaattatgtctccaataaacagtgtctactgaaatagaggcccccttccattgctctgtgcatttatcttttctgtctattttatcttttctttttattggttattctcttccatagtaacatttgcagcatgtttgatttggaagtgcagcattctgaagttaggtaatatattttaccataacaattttaatggtttcaagttacaagagatttaaaagataataagcaattttacctctcctaataaacttttgcccctttcttattaagaaacaaatttcaaagactaattaatgtgatcttccttttgaaaaatctgaaggttgtttttcaagatttttcaactacatagcaaacctacacaggcgttctatctctgatatattatcacatagctttccaaagtgaaagaaaattaggctttgccaccactggaatccacactcacgtaaataatttctttatggcatgatatgtgtgaagtattatgtagttatcatttctgttacaaaggagattgtaaataatgaattatttctttttaaaatttaatttttttaactgacagtctttcttttatgcttttttacaacttaaacaaaaatagcatctgatagttacatggagagcttcctatagacatgctgtcagttggaaagcatttatattcaaaaacaagtttttatagcatatgttacaaggagtgtgattggcacctaggtcccttggcaactcagaataagaaatgaattgatttataaacataaatgaagatggtgcactttattaacatctctctattcatttcatgtttatgtaggggccaaaaattaaaaactttaactaaatctatgttctcttgtagaagaaaaatgtgacatctcttgaactactagttctttgtaattctaaacaggaaaaattaccctcttataagaattcattttttttttgcatagggttgctcgtgtcttatgctgcctgcttgtttaaaactcacgtaaatgattacagcccactgaaggtagaagtcatacttctgatttcagtgtcaggattatgaaagtaaaatacgtaaaatacatgtctgtaaggagaggcagcatagcctattttagtggaaaagatttagactgtgagctgagagctcatgtctaatcttctgtttattattatgaataatgatactcatctttttcctatatgtcaggcagggattctggaagctgtatatatgtgaaagtatttgcatcctatggagcacacagactagtattattcttaccaatgttgctcattacagtaggaatttaaagatcccagagaacttttagattccattttctgggtttcccatatttcatatttttgttttctgtgttctaaaaggcagttgagtttatttagcgttaattctgcatcaccaagcccagtgctgtgcacacagtaggatttttaatgtttgtttatcaagtggtgaatgaatgctttgcagtacaactgaataattgagacaaatacagtaaatggagtttaagttgaatgattctttttaaatcattttatctgccatgtttaaataccattagtaaaatgttgacacatttggactcttatcgttattatctggcataacatcaggactacctaagagtttattttagcactgtcacattgctaaacaaagctcatcagttattactttaatttggcacaatttcctacctatttcagaaggataaagtatggtttatgctagttgtttgtctccaaccttcataacacttatttaaacattgcgttatatccaaattagcctaaaaagactccattcattcactgttctttggctggtgtgccccttactcactgattcattgactgtggttgattataaactgccagtgagatccatttctatggatttgtcatttgttacagtttaaatgcatcacaattccctctgctattggactttataatgtgtaatacggtgtttttaatgaccttccctgcaaaatacactcccttgatctcaggtcagcctagtttaaatctgttttgttggacattacccccaagaaaatttgtgtccctcgttattcttctctttccatgaaaccatatcctgcaatattttgaaagccagagtgcaaaataattgtgtctctataaaatattttcagaaagataaacagccacaatattttacattagcctcttcaccaaaatcaccttttacaaaaattttcttcattcctaataaatcgtgtaaagttccacaaagccacccttttagttagttgtgtactggcctgtttgtgaaccccttaagaaaaaggataaaaccacttttgcttcccaccatcatcacagttctttatacttaacaactttaaagagcagccaacaattttcatcaaatcaaattgccctaatacttccataaaagatttataaaaaattatttctgggactgctccacaaaggtctttaggaagactgttgcttaaagccaaaaaactacaagagcaggagcatagctgtcttgcagttttcagaccaagtaaaagagtaggcattagagcattgagactttcacctgaaactgcttgtttagtttgtgatgaagaactaaatactgtgaaattttgtccaaattcttctagatatcctcctatctctcttccaaaaaaatatctaaattaggatgactggatcattgtcattaaatcttgttcaagagcaaagctattaaatcttgtaaatttctggtcaaaaaaaataatgggaaagtgaactaacattgactttatgctgttattttgagattctgtgcagctagttgctttatataatttatctcatttcatcttgaccacaattaatattaggccttcatggctctcatttcaagaaaggttaagtaattcgtgcaaggttacacaactagcaagaggaacagccatacttcgaacccatttatgactgacaaaaaagcccatgctatttaattacccactctgttatttgtgctcttttaccttcaattaataactagacttggttgttaaatgaatcttaaccattttttatgggtgaactgacaagagttaatgtaaagaatattgaagccaaaaactaagttgtcaattatcatactggaaaataaatagtaatgcggtcatcatttaaaagtcagctggatgcacagaaaggatcaatctgtaaagaaactttcatagtttaatatgtctgatgtcaatataaatcctacttatttctccagctttgacttggataaccacatcttctgtggctggctgtgcagtaggcaaatggaagtacccttgattctgacttttctctggaagtgaatccagagagaaaataagcagcttttctattcttcctcatctttaggcaccctagaggaggttgctgatgttaataatcaactatatcacttttgaagacttagtttaatatatgttgatcgtttccttactgtttgccttattgggggaacccattcttctccagaaaaggacagatcctctcttggatttatatatatatatattatgcagaaacgtttcttctagaacttctatatataaaagaattataggccaggcacggtggctcatgcctgtaatcccaacactttgggaggccaaggcaggtggatcatttgaaatcaggagttcaagaccagcctggccaacatagtgaaaccctgtctctactaaaaatgcaaaaaaaaaaaaaaagcaattagccaggcatggtggtgcacacctgtagtcctagctactcaggaggctgaggcagaagaatcgcttgaacctgggaggtggaggttgcaataagcttgagatcgcactactgcactccagcctgggtgacacagcaagacttcatctcaaaaaaaaaaaaaaaaaagaattctagctatcaacaacaatcaccgagtgatagacagcacagttatttacagcactatggagatctagggtttagttttagttctaccaatacctttgctcacgaatacaggcgttttatacgaacatctctaaatctcacttttttaatctgtgaaatttaaggagaaaattaggtaatctgcaaaattctatcagctctacatttacagttttccagcacatttaaggcctaccttttgctttataatgaggtcagggaaagtctacaatgtgccaggaggtgaatgtgtaatgctgtctgatggaagtatattcctaagttttcctccacctattgccatccgaataattttgaaaggaattatataagtggcttactgctgaaatcacaagctttatctttttccatctgatttttcataatatgcattcttatttatttacttatttattcattcatttattcactcactcatttatttaattttagacatgaggtctcactatgttgcccaggctggagtgcagtggctggtcacagtaaaatcataccacagtacagcctcgaactcctgggttcaacaatcctcccatttaacctccctaccacagatgtactctattgtgcccagcttcttctatctgatttttgagaggtcctatagtattcgataattctgcttatcagggaggataatctagaaatgtaatcagaaggaaacttatgctggttatgaagtcatccagcttgagatagaacatttctcctatgtcacaggataatgtatgatttaccttgtttatattgctaagggattgaggggactatactatattaatctcaagctttggagtctgacttcactaaaggtatgtaatttgacatttaaaaaaaaattttaagccttagttgtctcaattataaaatagactataggtttaaagaggtttaagttaatcctctttaaatagatatatttgtatatgatgtagaatatatattattaaatatacatataatttaatatggtatctatcacatacttaaacattagcttttatcgcattaatattattattatttttattgatagtggcattggtaatggtaaaaagtaacactgttggctgggcatggttggttcacacctataatccgatcattttggaagtccaaggcaggtgaatgatttgagcccaggagtttgagaccagcctaggcaacatgatgaaaacccatctctacaaaaaatacaaaaattagctgggcatggtggcatatacctgtagtcccagctacttgggagtctaaggagggaggatcacttgaacccaggaggcagaagttgcagtgagccaagatggcaccactatactccagcctgggtgacagatcaagaccctatctcaaaaaaaaaaaaaaaaaaagaaagaaaggaaaaaaaaaagtaccactgttctcagggatgcaaggatgtttcaacatatgcaaatcaataaatgtggtatgttgtatcaacaaaaatggccaaaaatcatataatcacttccacagatgccaaaaaagcatttaataaaattcattatattttcataataaaaaatatctcaacaaactaggtatagaaggaatataccttaacgtgacaaaggtcatgtatgacaaacccacagctggtatcatactgaacgggaaaaaaacaaaagtcttttctttaagatctggaacaaaaaaggatgcccacttttatgacttttactcacaatgtttattcctggcaagggagtcctaggcagagcaattaggcaagggaaagaaattaagggcattaaatttggaaaggaagaagttaaattagccttgtttgcatgagatatgattttatatttagaaaaacttgtagattccaccaaaaaactattagaactgataaattcaggaaagttgcaagatatataatcaatatgcaaaaatcagtaatatatttatatgttaacagtgaaagatctaaaaaagaaaccatgaaaagaattacatttaaggtagctacaaatgaaataaaatgctaggaatagacctaaccaaagaagtgaaagatctctacaatgagaattataaaacattgatgaaagaaattaaagggtccacaaaaaaatggaaagataatccatgttcatggcttgcgagaatcaatattgttaaaatggccatagacccaaagcaatctacagattcaatgcaatccctatcaaaataccaatgacatattcacagaaatagaaaaaataatcctaaaatgtatgtagaaccacaaaagactatcatagccaaaggaatcctgagcaaaaagaacaaaattgaaggcaacacataaccttacttcaaattatactacaaaattgtagtaaccaaaagagcatggtactgtctcataaaaacagacacataagccactggaacagaatagagaaccctcagaaataaatccatgcatttacagtgaactcatgtttgaaaaggtcaccaagaacatacatggggaaaagaacagtctctttggtgctgggaaaattggatatctatatgcagaaaaatgaaactagaaccctatatctcaccatatacaaaaatcaaatcaaaatggattaaagacttaaatgtgagatctcaaactatgaaactagtagaagaaaacattgaaggggtgattcaggacatttgtctgggcaaagattatttgcataagacctcaaaagcacaggcaaccacagtaaaaatggacaaatgggatcacatcaaactaaaaagcttctgcacagcaaaggaaaaaaaatcaacaaagtgaagagaacaacccacaaaatgagatcaaatatttacaaatcacccagcaagggacaaataaccagaatatataaggagctcaaacaactcaataggtgaaaaaaaaaaaaatccattttaaaaacaggtaaaagatctgaatagcaatttctcaaaataagacatacaaatggccaaaggtatatggaatgatgcttatcatcactaatcattagagaaatgcaaatcaaaactgcaatgagatatcatctcaccccagttaaaatgccttttttcaaaaaggcaataactgatgctggtgaggatgtgaagaaaggagaacccttgtgtaatcttggtgggaatgtaaattagtacagcctctatgagagaacaatacagatgttcctcaaaaaactaaaatagaactaccttggaatccagcaagcccactgctgggtatatacctaaaagaaaataaatcagtatatcaaagtgatacctttattctcatgcttattgcaacactgttcacaatagccaacacatatatccaacctaagtgtccatcaatgaatgaatggataaagaaaatgtggtacatgtacacaataggatattatgcagccataaacaagaatgaaatcctgtcatttgcaacagcatgaatggaactagaggatgttatattaagtgaaataagccaggcacagaaagacaaatactgcatgttctcattcatatgtgggagctaaaaaaaatgcaaatcaaagagcttatagaaatagagagtagaatgatggctaccagaggctggtaattataatgtagagggggtgataaagaggggaatagggtagggttaaggggttcaaaaatacaattaaataggagaaataaaatctaatgttcagtagtacaacagataaactgtagttaggaatgtactgtatatttcaaaataaaagggtggaattggaatgtttctcacacaaagaagtgataaatgtttgaaatcatggatatccttattaccctgatttgatcattatacattgtgtgctcttttttttacaataaatatcacatgtaccccataaatatgtacaactcttatgtatccataataaaataatttttaaactacctatattactattttatctaaattttcaaaaaaatttaaataaaatatggtgatagtattcattccagtaattaaatatgtttaaaatattcttggaattaatcttagtagaaattggtaatagtattatgaagataacataaattagcccagtactgcctcaaacttctgggttcagtgatcctccaacctaaacctccctgctacaaatgcactctatcatgcccagcttcttctatctgatttttgagaggccttatggtattcaataattctgcccatcaggaaggataatctagaaatgtaatcaaagggaaacttatgatggtttcgaagtcctctggtctgagctagaacatttctcctatgtcacaagataatgtatgtatgatttaccttattacctactagtggcagtcctcagaaaatgagatcttgcctccttaatgaatgcttttgattttgggaaaagatctgtcaggcttcagagaaatgttgttgggagaaacaataagccttcacacccctgggtgtttccaaaatttggatgacgctgctgtattctaattattttaatgtttatctcggtcagtagatgttattaaatgcacacaaagctctatcctgagcgaattctctagcttgcagcctaattttaaataagacaaaaataaatattaaagaataagataaaaatatatagtaataaacactaataattactaagacacacaaagtaataatttgtatatgtaagtaaatggagaactgtatttatatgagatttttctgatgatgatgtttggtctgtctctgaatcgttttatttttcataaaagaagtaaggttgggtccttttagctaaatggccttcgggtttatcagtaacaaaaaaaaattaaataattgtcaccaaaaatataaaagtttttaagaagagattttttgaagtgtgaagaactaggctaaataatgtcaacttttcctttaagaaatagttagctgctagaagaccacaaatgagtgataagtttcaggcagctctgaagtaggctggtatctctttagaaaagatgtttaattcctgttcacactagactgtgcaattaataattaaatgtctaatgattctgttctcacagaattttaaattttgctggggagaatagatgtaattgcagtgtagaagaaaatagtgtactagaaagtatcaaattaatgtttttactctaacatttgttaaatgcctgttaggtgttgggcctgatgtctggctccaggaatgccacattgaataagatattgtctctgccttttagtagttcactctctagttaaggaaaagaaaaaatctaaacaattagttggagtgcaaagtagcaagtgttaacatggtactttgtcatagatggtactcaatatatgttaaatgtataagtgattaatgaatgaatgtttaactgcttcatagaaagtgcagtgaagaaaaagaggaagaaatgactctccgtctgtgatttacagagaagattatgctacaactatatattaaggagtgagcaagagagctacagtgagcaggtcaagagggcagcacaggacattccaggtagagagaataacatatgcaaaggcatgaagatatttttctggctgggcgcagtggctcacgcctgtaatcccagcactttgggaggccgaggcgggtggatcacgagatcaggagatcgagaccatcctggctaacacggtgaaaccccgtctctactaaaaatacaaaaaattagccgggcatggtggcgggcacctgtagtcccagctactcgggaggctgagccaggggaatggtgtgaacccaggaggcggagcttgcagtgagccgagattgggccactgtactccaacctgggtgacagagcaagactctgtctcaaaaaaaaaaaaaatatttttccttttgttttaaagtaaaagaatagtgttgggtgtggtgacgcatacctataatcccagcactttgggaggctgaggaaggaggattgattgaggccaggagttcaagaccagcctggacaacatagtgagaccctggctctacagaggaaaaaaaaacaaaaacaaaaacactttacctgaatgtggtagcatgcacctgtagtaccagctactcaggaggctaaggcaggaggatcacttgagcccaggagttcaaggctgcagtgagccatgatcttgccactccacttcgggctgtgtgacagagtgagaccccgactcaataaataaatgaatgaatgaatgtaaaaatataggacatattcaaggaagggggagaggctgtgtgactgactcagagtttatgtggcagagtggtgagaaatgagctggatagaaagcctcagagtattaaattgacattttagaaagataactctgactggagtgtggaggatgtctagagaaagaagacacaaggggtattggatcaaaacaagagagaagcgatgacctgaactaaaacagtatcctcagaaatagagagaggggagagctgagaactatgtggagatagaattgacagaacttaattatttgctaattattacaattggaggcattctgacttttaggtttctagcttaaactaataggtagatagtaaagatagtaatcaaaactaatgatgtaaaatgcttacatattgaactcttactttggggccacacaaaaaaatgtccaggaaacacttggaactctgtatccagagttacaaaacacacaaaggtaggttctgtattcttgtgtgtacaagatagctgaaatggtgaaagtgagtgagatcaccaggaaaaaccagtaccacggtatattgggagttctaaaacttacccactaagaccagtgtgaggaagaagaaagattgtatttgaggggtttctaaggtaacccaagtattttcacaagtatgtaaaaaccagtgattatatttaattgacatcttgcgaatgtcccactgcactttgtaaaagtgattcattcactgacttaaaaattcagggccaggcgcggtggctcatgcctgaaatcccagcactttgtgaggccgagacgggcggatcagttgaggtcaggagtttgagaccagcctggcgaacatggcaaaactctgtttctactaaaaatacaaaaattggcaaggcgtggtggcacacacctgtaatgccagctacttgaagtaggaggctgaggcatgagaattgcttgaacctccaggtggtggaggttgcagtgagcccagatcatgccaatgcactccagccagggcaacaaagtaagactctgtcaaaaaaaaaaaaaaaaaattcagtaatatgaagtaaataaaataagaaaataaagattttagttgtaagatttttaagttaatgcatttattaactaattgcagccatattaatgatttatattgaaattcaagaagcacgacataattttacacaaatctatctttttgtgtaatgaatataatatacaagtgaattaattctgttaaataaaatagtacttccctactctcagttcactgatcttttttttcttctcgtttgaggaaaaaagtccacctttcaaaagtgtcatatactctagataagaaggttcaaaactttttactgagacccacagtaagaatatatttcatctttcaaccaagtacagttgatccttgtacaatgcagagtttagaggtgctcacttcccatacaatcagaataccacatagaatttttgacttgtccaaatctttactaatagcctactgttgaccacagcctcaccgataacataaacagtcatttaacacatattttatgttttatgtactatatactattatatattcttacaataaagtaagctagagaaaaggaaatgttattaagaaaatcataaggaagagaaaatatatttactattcattaagtggaagtggattctcaaaaaggtctttaccctggcattcccattgagttggctgaggaagagtgggaggaggaggaagaggaggaggaggaggaggaggaggaggcggaagggttggtcttgctgtctcagggtggcagagtcggaagaagtggaagagaaggaaggggaagcaggagaggcaggcaaattcagtgtaacttttatttaaaaaaaaaaaattcacgtataaatggatcctcacagttcaaatccatgttgcccaagggtcactcgtatacacattgtgtgtgtgtgtgtgtgtgtgtgtgtgtgtgtgtgtaagctgacacaaaccttgcatgaaactacttacccttgtttgttcctgtactcaacacttttaatctccttaatttctttctgtgttttgcttcatggatatttattctgtttctcacttttgctaaatgtatgagattgtaaatatgaagttctgagattataagcatgcacaactctcctttattttaaaacaaataaacaagaaatatttatctcttgctctacttacttcattttccttttattttattattatttttttgccacagggtctcactttgttgcccaggctggaaagtcgtggtgtgatcatagttcactgcagccttgaactcctgggctcaagtgatcctcctgcctcagcctcccaagtagctgtttggtctacaggtgtgcgccactatgcccagtttcttcttattttaaaaattattattgaatgtaaccttcatttaactccaaatttctaatgtatatataatcaacacttgctactttaacctcccatcaccgaggccctttttcctgcacttacttccttagcaatcccatccaaaatcaatttcctttgtaatagctagcacttgtataacaactaatgtgccaagctaactgctttacaattgttgatatagtttactcacaacaaaaatatgaggtaggttccatttttatccacagtgagattaagtagtttgctcaagattacacagatggtaagcagggcaactaggattcaaaaccaggtatcatatataaccaaatcttaaactaatttctataacaccacattgctatttagattttcaattatgatatctttcatcttgtttttttctctctctcgacatatcatttatgttcaaaattaaacttttctataaagactggaataatagtctagaagtagcggtagttggtaaatgttctgactacatgcttgtattacttcaagggatgaggataatgttttaatggaagtgatgacatcaagttagtttcataatgataaagaaggtgagtgaacacttcaggaaagatgaaaatatattcaggagtgtatgagtttgctagggctgccataacaaaatactacaaattggggacttaccaacagaaatttattttctcacatttctggagactggaagtggaagatgaagatgttggcagatttggtttctcctgagacctctctccttgactggcacatggctaccttcttctctgtacatacacttccctggtgtttcttgctcttataataaagacatcagactcactgggctagggcccacctccttgacctcgcttaacattatctacctattttaaggacttttttccaaagacagtcatattcttaggtgtgctggagatttaggacttaagaatcttgggggaacacaattcagtcttttaaaagaaatttcttaccaacagaagaggcactctacagcatgcggttaccttggaaaggattgtggatcagtttagtgagaatgagagctaggaaaaagataccagaagggaggctattgatcctgaaaccagtgtcagctggataaaggaagcaagagattggaaaattggaagcacattttaatgttgtggagaagggaaggacaaaacaggaaggtgtgtgttaggtttgttgacctacccggcattcctaattacaagcagaaagttgatgttcagggttctgcaaaacttagaatccctgctgcatgcctgtccctgagaaagtttaaattaatagagaatggaggaagtaatattggagatgtggcagatgaaggcaggctcttagagcatatctttcaaatataatgtgcaaagttaaaaatggttttggaattgaagtggtgtaactaatttaaaagatatttttatattatttcaaggattgtactgttatgtaatggtatatatagtagaaaaggaaatataactctcctcattatgtacttgaagtattaatgatttcttctttatgggtcacattttcctgttctttcacgtcagtaattttttattatatgccagacgttctgatttctatgttgtaggattttgttgtctttctttaaagatcattgagttttgttctgggagacaaataatttactggaaagtcagcttgctgttttcttcttttttgtaagctcaattagggtgggtctagaccttttaggggtgtcacttgagtgcttagcattttcagtgaagttctacatctcttactatatgtgacatctggatttctgttcaaatcacagctaatggctcttgagttagctgttttctgccaggtcttcagccttgctttgtgcatgtgcagcttaatatgcatccaatgacttatgataactcctttggggctcgttttttgtgtagttaatgctttcccacagctttgccttataaattccagctatttcaacagcaccaaactctactttgtgcctctttagttgaatgaggtcattgtggtctgcctgggctccacctacatccctgtgctgaggtctggaaagtacagcaggtagaaagagagagtggtcctagggctcacctcttgtatttctcttctttcaggaagcacaggcctgcacaaactgttgtccaatgtggaaaaccagtaatttcttcttgagaaattgaaaacatcttaaacataagtttggcatagaattaaattcaacttcttagaaattggtttttgctgaaatcagttttatatatttcatactaataatactgctgttttgaagtaaaatatgcatatatattacaacatataaaagataaatcacaccagcttggaacaataatgtaaaccactttgtaaaaaccccatcctgagaaggagcagcatgttaaaatcacttgtgttgagaaaagtgttctgagaatggttctattaaggaaagtttgttttcttagcttttgatgtcctcgggtaacaaaatcaacatttttctgtatttaatgaaaataagttgtaaaaaagcaacaggtgttttggttaaaaaaaaaaaactattcagcgcttaaatcattagagtaccctgttttctttattacaattaccgaaacaagagattttgaaattaatctgttgctgtgtagacttggagaaaggagtctaggaagtgagttatatgaccttattgacctttggacctatcatgtttaacataattacccacaattagtagatttttaaataatttattgtctgaaaatataaacaaaagagaaatatgtagctactagaaacctaggaatataattgttattgtcatataaatgcatgataaatataaaataaaggaaaaattagagaaagattactttttgaataattgcataagattttttggctgaaaattaatagatgttaaaatgtgccagtttatttagatttccaataaaaatgttcatttgatatccgtatttaaaagttattatttacctaaaaagcaactatgtatagtgtaaataattgtttggaagacatttgaaaatatcttatttgatcagggaagataatacagattaactttagaaaagtttcagtaaaaatctatttctcgatctgttctctttcccccacttttctcactccccccctccatctgtacttttaatacctctctcttaatctcctctacttccctctgcaacaatcacattacctacaagaaatagattattgtctattgagtactcattcttgaaagtaactgtttctttcatccttgtttttctatagattaaaatctctcaaattatttatcgaagtttcttgcaagttaatttttttctatcattgtcctttttcctattaagtttggcataatatttctcacttttacttacagcatttatattttttattttccaactgatataccagtatggatatagatttctatatctatctatgtatctattcatctgtctgaacagtaacaaaaatacactttttctttcttcttttctacttttccagctgtgttatgttaacctcccttgtgtaactgtattccttggctaagatatctggtaaccattatttacaaataatatactcctttgtacaagactagaatattctccacagggacattttaaatgccgactccagttaaatgtgttaggctttgaattcagtgttggccttataatgaaaattacagactttttttaagaagttatgtttatagattaacaaatctggcaacattttagtctgttactttgtccacatttaattagaaaaagtttgtgtcttttatattctacttatataatcttcagtattttctttggtgctatttttattaaacaataatttttggggcatctaatacgtaccaagcaacatgatgaatcatttttctaaatgtcagtttattatggaagaattataaatttaaaaatgtgagcatacatgaaacatttacctcattggaaagatgtttcttatttaggtagtcttttctcatttttttccattttatacaaagtggtaatactacaaaattatcaatcctttaaagtaacagtttgtgcattttaacttataagataaatgcattttgcacaaaagcacattttatgaatttcagagatagtaagatagataactttatgaggcgtactatgatctgatgtccccacttccagtttcaagagtaaaatatcttatgaggttgaaatgtggacttcctagctgtttatgaatcatagtggagtgacatacatacattaacctttttaaactgtatttgccttctttgattgtgtttgctaggtaaatacagattttagaaagggaagagaaaatattttaaaatagttctgctgattgcctgcaattctgcttaaccaatttagttccacaaacagtggttttaatcaaacctgatagaagttaataccagttggaaaaaacttatgaacaagtatgcataattctaaggatttggggctattgacaaggaaatcataaacactatttaggtagccaaccaagtaagatgatgatgccttcatccatatcttacagcaggggtcctcaatcccctagcagcagaccagttctggttcgtggcctgttaggaactgggccgcacagcagtcagtgaggagtcagccagcatgaattaccacctgagctccacctcctgtcagatcagtggcaaaatcatccccccaacctcacccggtccatggaaaaattgtctttcatgaaaccctgttcctggtgccaaaaaggttggggactgttgtcttagaggaaggaaaacaatgaaaaattaattgggaactatcaagaaatctgaccaaggaagcatcagaggaactgatatgtcatccacagaagatcaagatgatgccatcgtactagcaagttgaagctttctgtattcatgatatgttttagataattgaaaaccttgagtgattttctctctgaatacagttttttaatgaaactgtatactgtggtatttattaaatatttatgcatgtagaccatactgagttatatgcatagcactaggtattactctacataatggtaatttcagaaactttcaaaggtagttttgattaattatgattgctttgtgtactgactttacaataatattcaactccagtaagagaactcaaaacatttttcatttttcttgattaattattcttcctagtcagtgacctttaccacttctttatactgcagtaataacagtagagaaaggtgctaagctgtgtgggcacagaggagactttggaatagcgaagccctcctgacagaagtgatatcttcattgagacaagggttggtgagagttactactctcaccaactcaactctcagttgagcaactcaagagttgagcagaatactctttctggcataagattgatcatatgtgcaaacccaggagtagagtgagagaatggtacatctaacaaaattcagtataattgtagaagtaagctgaccaggaaaagaatgacattttaaaaaatactttagggagttttatttttgtcttgaaggcaatagaaaaggatctgacttgatcagacttgcatttttagaaaaattctcctagatgttttaatgagaattaattttatctgcttggccatgtataaactatagcagtaatctaagtaagaaactgtggaagtattggagatgcggataattattagacagatctaagaactgtttatgtggtactgattagattttcaagatgaagttttgaaaggcatcaagactgattccatctttggggcgtgacaagttttgtggacggtaacattaagaaagctttgacctgaacacattactgagacagcatgctcataataaggagttcacacattgctaataatcattgctaactgtaatttgaagatagctaaacagtcttcataaatacaagatttcattaaaaaatacatttataataaaccatgataaattgaccagttactattcttgtcaaattgatgctcaaagtaactttagcttttaattgtctgattttgagtataaataaccaaaggatatacaaattagtcatttaaaaaataaaaaccttacgagatttttgttgaaaattttgaaaaatcataagtaacatgaagtggtacaacataaagaaaacatgtggatgtttggaaatgaaaattcttaagtaaaactttctaatttgggcaatactttttgacccaatactaacttaaaagtgcttcaaaatggtctgaaagtgcattagtctatcttaccaaatctggataatataatcatttttaaaaagcataataaggtaagttacagaatcagggatttttttataccagaagtaaccatgtagtctaatttttccccacctaattttatggatttaaaaataaacctttacagaattgttatgtgacctgcccatagttatcgagacaatgactaacagactcaagtttggaattcttctaaagtattttattaattcagtataaacattttcttagttatttgaccatttggtatagattttttcttattccttctaaatgaaagtgttgcctaatcccattcggttttaaagctagttaggacatgtctagtgttgcaaatccggaaatctcttttttgaaaatcatttcacagttttcaaggaatgcctccgaaatttagccttctagtttccttttcatagaacaactacaaactggccaaattatatcacagaggcaccaaccttgttgtaaaggagtttaaagaagtgcaaatagaatgttttttcctaatgtatcaaaattattccagagttttctgagattaagcatgcattggcaaaatgaagtggaaaggtttatcattgtcaaattctgttaagttcttcttcctacccctgttagtgatcagagagagagagtttgtggtatatattactgttccttatccaccaaattcaccagataatcatgccaataatttagtctgccaattttatcagattttgattttgacttactagtcaagctagtgatcttgtcctagttctaaccaggtaatgtagagtcactgcaggtaatatgctggtaatatattattttcaaaaaataacctgaaagattccctctaccatttcttttacaaaggttttatattttatttattttgtctaatttttaaatttatcctagttcaatgaaagcctctctaagctttgtaaaaagtctagatttgattaacagttgagtaaaataaaaagcaatgaaaatttcaaaaatccttagacatctctgtgaagaaatcactagcaaatgtcttaggttgacagaagtgaacctatgaaaacaatgaagctttgtgttggctccaaacatttcatgacataggtagctgttgaaagctgagaaattgtagttttgttttctgagaacttattaaccatttaaagtgctctcagaggtttgttatttttaactgcaaaatgatataaattgaaggcttaatgttgttctttcacaaattgcttttccccactaatgtttttcttttcttaatgttaactggaactggcaccagcaggcataaataatcaataatatggtatttcacacagatgcaaaataacttgtaagttatttattattaggttccattagtatttaagaatttatagcaatcattgaatatttattgagaaattacttagtgttacacaccattctagtctgtcttgatctatcagtggataagacaaactaagtccctgccttcatggagcttataaatattagataaattattgcaagtttgatgaaatctaaggatgcttgagggctacccaaaagttctacccaaaaaggtggttgtatagtttcaattcagatttgctgtttgagttcgttctgaaacatcctgaaaacctaattttaaagccaggcttttcttaaatcagtttgctcagcgtgagctagccctttaattttctcttttggaaaatgtacttcagggccacctgattgtaaggattatgctttcaaaaaaagcatctatataagaagaaaagcaatgtaagaaataaaattataatagatatttgacaatggaaaagaaaaatcgaagcttcacagattaatttgggaaatgtagtaaacagctggaaatctatgcctacctttggactattaaattagttcctttttaattgcttgtgtggcttatggcttccttacaaatagttgtgtctttctgtcctacttaattataaactttttgaatgcatgcttgtagtgtcttctggatagtgccagagttccagagttttcaaggaatgcctctgaaatttaccttaatatttgcctctgcatagaatagttcataaaacactcaataaatattggttgaatgagtggaggaataaatgaattcttaaggtctgaagaactgaattcctttggtagtaaagttttaagaaacaattttaacaaattaaacattgaggccaggtgcagtggctcactccagcactttgggaggctgaggcgggtggatcacgacgtcagcagatcaagaccatcctggctaacatggtgaaaccccgtctctactaaaaatacaaaaattagctgggtgtggtggcgagtgcctgtaatcccaactactcaggaggctgaggcaggagaatggcttgaacccgggaggtggaggttgcagtgagctgagatcgtgccactgcactccagcctgggcgacagaacgagactccgtctcaaaaaaaaaaaaaaaaaaaaaaaattaaacattgaaatgttttgtaggcgtagaacaataaatatctaatataatcaacttactcttttttatgctgcagatacttctggggtctgtggtttatccttaatagcccactctgcctctgacattgagagtattagatttccaaagatgacctcctgagttaccccagtgtcagcaggtatttgtcattaagtctgacttatagctgtactggctaagagaggaggctgacatttgggaaagttatgtaaacagatgcagacacatacattcttaagtgtttggtgctatgttaataatcagtttatttggtgattggtaattaatagattacaccattgacctgtcttgtaagatggtcgtcagttattcaggttaggttgtgaaaactgagtagcaactgatttacagaattgaaaatgggcatttgataaatggcatggaaaaataatgtttgcttgtttggtcagattagaaatttactacctcaagataggtaactttgagatactgcctattgaagtatggtgtgctagaccttatctcagcctcttttcttgattatctttatacttgtcagtaagacatactacagaggcacaaggtagcctgaggcattggttggttgttttctcttgggaaagaaggaatatgtgttttgaagtttcagactcatttagggttgtattttaaggtttgcgttttgtgcttttttctcttaatattttatatcttttgaaatgaaacaaggacttatttattctaaatattttataaacacttgtgaaatgaataaataaataaaacagccaaaagcagtcatagtagactgagtactctgtgttcataatagatggtggttctgtgacaattggaatattttgaataggaaaactagtatttatcttactttttttttttgtctgtgagaagatatagaagatagcctaaatgaatattaatttggtctttcgttgacaacatactgttttaaaaataataccttaatgatgatattggatatttctgatacttttttatttaaaaatatttgtaaatatgtacattgatttataatcaatttacattattatttactctattttgtcatctcagaaattgtggtttatatacattttctcagctgagaaacttagagattctgtaatatacccaaggtaaatgcagaactggagatccaaacccaggcattctcactccactttaccctacatctcatctggaggtttataagtaagtttttgattaaaaaataagatacacatttgaaaataagagatccagtctttatatttatcttgtataaaattaccgagtaatatgttagggtttagcacaaggcatgggttccagctatagggtattcataatttaattggagaaacaagagataaacataaaaagaaagtaacaatataagattgtatgtataagatgagtgattcaaactgtaagtcctacagagacaggaaagatttctgtggattgggactactaaactaggatgactgaaatgagttgagctgtgctagaaggaggcacatagatgagccagtaaaggagtagagggcattcaaaacaggggaagtacagaacaaaagtaaaggtattgttgccctgcagcccttggtatagcttacatatatggtagaagatttgtgggagatgtggttacaaaggcaggtgaaggtcacattgtagaaggatttgaacgcagggctaagatcttaggactttattttgtaggcaatgggaaaccactcatggttggttggttggttggtttgtctgtacatggcatttgcaaacagtacacatttttttttttcatggtcaagacacctgaagattagagcttccttccttctataagctacattgccacaactgtgaataacatgcttcactacattggggtgtatgtttgtgtgtgtgtgtgtgtgtatatgtatttgagggggctagagatgagcatatctgtatggcggggcaaggggaagagaggtggcaatcttcattcaagtattatagactctttctgtgtgccaagctatatatcatatgaaaagaaaaacatctataaatacaagataataatgaaggccttataaaaacaaattataaacctgaaaaatgatttataaaaataatgagatttaaagatttcttggtcagaggctgaagtttaccaggtaatttaacttaggagattcagccaaattcctggcagcttagccaacagtgtcatttcattcccacattgagagtacccagggaagctaactccctgcctttctcatgtctgaactactgttgccaagatcctgcagttcttctgtcagatgagaagaagtgtggctttttgtggagccacctttcacaataacagggcttgtgaaaagattccccattttcaagatgcagtgaacctaacaagaacttgaaattcatcccacggccataccaatcagtattccagctgtagtaagttaattggcaatcgttttttgtttttttttttttcttttgtcttctatttaaaaaaaaaaatcctggaaatggtaaaagacatgttgtcgtgacaaaaaaaaatgattgcaatattaaacactgagaattctggaggtggaatcttaagaaaaaaacctccccagtcaatatcgaatccatacttttctgcctgcatttgaaaacttgcaagctgatttaacatatcgctctgccttcttactccttccatttcttttctgctgcccatatttatcctgtctcatttcctgcacctttcatgcatgccattacaacaaggccaccctcctcctcattaccctttgaacatttgccatttttttccgactctattcaagttctctctcatatctaaaatgaatacatataacctaatacacttaatacgaattgatttttttaacaatgagatgccagacttgaaagtgaaaacttgaattattgcactcaaatatatatataaggtaatgaatattatagacatttttgaactcctatctgtgacctcctattgatatagttgggatcccttctgttgtgtgtgaaatagcattgctcatttggagaccgacagtcattgttcaagggagctaatttcagagcagaattgtagtatttagcatcaagaccaaagacaatgaaaagaccaaacattatcacaattggaggaaagaggcaggatgggttgaaatttgaaaaatgtagaccaggcgcggtggctcacgcctgtaatcccagcgctttgggaggccgaggtgggtagatcacctgagctcagtagttcaagaccagtctggccaacatggtgaaaccgtgtctctactaaaaatacaaaaattagccgggcatggtggcaggcttctgtaatcccagctactcaggagcccgaggcaggagagttgtttgaacccaggaggcagaggttgcagtgagccgagatcacgccattgcgctccagcctgggcaacaagagcaaaattccgtctcaaaaaagaaaaaaaaaaagaaaagaaatttgaaaaatgttcgagatgagcaatttaatacttaggtaccaagtattggagtagtacctttttatcctggtttcagggtggagagagaaggatagaatggattgtttttgccttttattgaaggctagatagataatgaaacttcattttaaagaaatatttgaagtaagagaatctattacaatatggtttgctattacatttatgtgaaaaactgaggggaacactgtttcccatggtgcaaacacaaaccaaaaaagatgtattccatttaaactgtaactaagcttatacagctagccctttttcttcatgccaattttatagaaaggttaaactgtaattatcaagaggaatgaatcataatgtggtgaactggccagaagtacttggtcacacacaacttcagtttatttgtggtataataatgatagtcaccaagaagtttgaagtatgagaacattagacacttctcctacaattttgtttcagggcaattaataaaattctcaaattaaattttgccacacatacgattattaactaaatatttacttgtaagtaagcacaaaataattcatgaacctgtcctataggtttgaaaaaaaattgcaagctctcggtccttttaggtgtcccagtcactacctcatagaaaatgttcatttttgacaaatgtaaagattcctgagcaggaatgatgattcttcctgacttcaaacaaccacagttgttcagggttcatagctggacacagaaccatttaaaaatttagcaggttatctctaggtgtaaataggcctcatgggatttttacaccttgtccataaaatgatgggcagtatttctaaaatattttagccagtctgtataacactagtacttttaatttactcatgaaaacccatatgtaatattcatcaagttagtttacatgctttgtttttatcaataggcatgcattttgtcattcagtatactgattagtaagtcatcagttattgattgaaatatgaataacaaaagtacctggagtggcctccttaggagtacagatttctgatcccatcagcctgcttctggccggtgcattcctgattagatgctagaaacatcttggttatagtccaccctcactaacatacctttagtaacattgtattttaaagtaagttgcagacattataatacatgaggtaatcacttcccaaatacagtatcctttttggttgccaatttgtaagacatcatttggaattctgaaatgaatggcagaaattttcactaattttatttttaaaaattttgccttgtattttaatttaaacttaatattcttttttcctagatatccgctgtgacattaaatataatctttctccagtttacaaatctataactgaaatgtcctctacctctaacagttttgctagttttgttcatagacaagcatatacttgtactttcattagtcatctcttagcttaacagcattgggaaatctttcagcttgaatgtgtttaaaaaaaaaaaaaaacttcctttttaatttacccttatctattccccatacatttttagaggctaataaaaaaagtcctaaaatttaaacagctttggaaagtaaactatgctttgatgggctttcacttagtatttgatcaaagaataatttaccaactaggaaaaaatattttttaattgtcataatgacaaaatataagaataaaggctttgtgatttgggaaagtcacttaacctctctgaagccttgttttccttataaataaaatgaagatagtaataataagtactttatgaagtaattttaaggattaacaaggtaatacatggaaaacccatagcaaagtgcccaaaacataagatctggaaattgatagttattaagaaaaaaaaatcaagagaggaatttcagtagagtgttcaacagtgtccaagttgtctcgtagagatcaagtaaagcatgaactacacagagtgagaactcaacatgcaagcttttctgccagaatgtaatatatgtgtacctgaaaaaccactcattctgcaaaattacacagtaaaaataacaggcttaagggagaaaaaattaagctttgggcaatatattcaaaatcgactcagtttctcccattctgtagcaatttacccatctgacaaagggctgatatccagaatctacacagaacttaaacaaaatttacaagaaaaaaaaaaacccattaaaaagtggccgaaggatatgaacagacacttctcaaaagaagacatttatgcggtcaacagacatatgaaaaaaagcttatcatcactggccattacagaaatacaaatcaaaaccacaatgagatactatctcatgccagttagaatggtgatcattaaaaagtcaggaaacaacagatgctggagtggatgtggagaaataggaacgcttttacactgttggtgggagtgtaaattagttcaatcattgtggaagacagtgtggtgattcctcaaggatctagaaccagaaataccatttgacccagcaatcccattactgggtatatacccaaagtattctaaatcattctactataaagacatatgcacatgtatgtttattgcagctctatttacaatagcaaagacttggaaccaaccgaaatgcccatcaatgatagactggataaagaaaatgtggcacatatacaccatggaatactatgcagccataaaaaaaggatgagttcatatcctttgcagggatatggatgaagctgaaaaccatcattctcagcaagctaacacaagaacagaaaaccaaacattgcatgttctcactcataagtgggagctgaacaatgagaacacatggacacagggatggaaacatcacacaccggggcctgtcagtgggtgaggagcaagaggagggataccattaggagaaatacctaatatagatgacaagttgatgggtgcagcacaccaccgtggcacttgtatacatatgtaacaaacctgcacgttctgtacatgtatctcagaacttaaaagataataaaaaaaaactatgcagttttgtttttgttgctatgatttctagttacaatcctaataaaaatactatctccattaaatctccaagaacacgttcacccagcatcaaagatcattttgatcaaattattccgtgtgtacaatatacataatgttttttgttggtagtaaagtatcatatggcatctaactgacttgattcaacaaatctgcataaagatttgaaagaatagttttgctatattttaattgtcaccttatgtcaatgctaaaacagcaagttaatacttacaaatgatgtgcataattttgttgggtcacattctcatctcattttatttcagctgctgtaagtaaagatgattccattatttcaagtcttgatgtcactgatattgcaccaagtagaaaaaggagacagcgaatgcaaagaaatcttgggacagaacctaaaatggctcctcaggagaatcagcttcaagaaaaggaaaagtaagtcattttattctttgccaagaagtgagatgacatttttgaaaatctagcatatgatcttaaaaattatgttttcattttgaacgtttttaaagttatttttaagaaaatgtcattttggaattgtaaaatgtttgaatcaatgtattgtttcagtatttggttaatttctattaatatttaaagctgaaatgctgagaacgtaagcaaaaatttttttctcatggtttttatagattaattagaaatggcatgtaggatacaaaaaatattggaatccaactagtgttcagtaaagtgtttcaatctaatttactgcttgaaagagacccgtatggcattcaaattagccatttaatttggttatgcttggcattttttttcaagtaaaatgtctccttctcatcatctgtttatttctatcaagttttggcattgtgtactttattttcactgttttcactctttggttctgattaccctgcatcagtctgtatttcaatttaggtgtgatgagttgcgaagttgaaacacttaatatttcgttacagcaaaacaatgagcatttataaagaatattatcagtttaatccaaaatgaatgttcaaatcatttgtatctttgggtatgtgtatgtatgctctgaaaatttattttttctaaagtttttgttaattcagtaaatagttattgaatgatgatgctgtggcagatgattttatagttcagtgattttcacaggatggaatgagggtacctggggttttccaatggccctttgtaggggtccataaggtcgtcccttcttaaattccatacctgtgtgaggctggattttcttatatccttcaattaaaataacatttcactgctgattgaatgcagaagctggtgaaaatccaactgttttcaatcaaaccagctatcaaacaggtttgaaaagtataaaacaatgccctcataacatttttttctggaaaatacgtttcataaagaatatatcattcatattatcatatactggatttgtgttatttttaaatgaattaatgaatctgtttaaattttctcaggtttaattttcaatatggcaaatagtctacataaactaaaatgtggagtcaaaactcttgagaccctcaaaaattttttaaagtataaagtattcctgagagcaaaaagctttaaaattctgttatagacaataaggatgcaaagaagcacaattcatgccatcaggaaactggcagcctagtgggaacatgttttagtttctagcgtataaacattgtatagtgggattattttgtctatcattgtgtttttgttctctccacgattggcctgatctacatatacttaaaaatgctatctccatactatgctgtatccctaatgtcttcagacaatatatgcaaaaacccattgtgcactaaattctttccggtttgtgtttatcatttgaatttattcgtagcttataaccccttgatagagctcatagagttcaaggcatagtgtgatctcttttatacggtgaaccaaaaatattttcaatttacagacattgaaatagccaaactatgggaaagaataaaattataagcagtttaaaacgttccagaaactaagtacttcattcagtcaattagtagacaagtgagtaatgagttgaaattgaattatgtgccaggcataatgttgatcatgctgaggatcccagaaagtagaaaatagacacagctcctgtcctcatggaactttcagtccaattgttttgtctgataatgacttaatggtttgcgggaagaaggaaatattggttttatgttggagagctgcatcttaggtcttttcactctatgtgtgaaccaaaggtaaggttttaggttgctaacattttctgagtacactgtgttgcttaagcaggtttctgatatgcatgatacagagatgaaagaagtttagctctgaatcaagactaaatatttttatttagctttttaataaagataatgtgtttgtttctccaaacatacagacaattaatattatgttccttttcttttccatgtttaggtaatcatgtcaatgtttatgttatatattttcaccattttaaaagttgacaaagttgatgtaaaccatatcagctttggtaacggtctgctaattatatcattgtaggccctttaggcagactgcccctaagtagaaatgaaaacacctgttagatgtcagtgagcattttaaatattaagagaaatttagcatgtatcagtcagatgttgagtggttgataccctactgtataatgcctcctcttttgctcaaataaaacaaaatgttaaattatgtatttttttcttatttttttatactataggattttttttgcattttgaatacaggagactgaaattttatggctcttaaaaattttaaatactagttgtactttcccaatatttttaatgaaaaaaagaagcttctataaaacaaaagcaaaaataagccttagctcttaaaaaacctcagagtaagacgttctcaattactaatggctagcccttattttaagttttaaaattaaaactgctacctattttcctcccttcctgaagcatgatttttttctctgacagcttgtcatcaaaaacataaacatcaattaggtcatgtaccctatctgtagactcacaaataaacgcagatatggttagtttgctacttacgggtgaaaatacatcagtccctacctctaaacttaagtttcctaggcccttctgattgcatgaccttcagtcccttccaacattcccaccagacatcttacatgtgattccactatttagcttctctatctctgcaactcaagaaaaaagaaacaaaagtaggggaaggagtggtcataagtactatggcttaattttttttttttttttgtctacaagactttgtgcaagtcattttacctttccaagtttcagttttctcatctaaaaatgaaaggattatactagatgatctgtaagatccctctcaatatttatagatctattgtatatttaactcttcaccactttcaaaacatgaatatgatttagcaataaaatacttccacatttattagctattattgattaaaattcatgaagcaattaaaaatatgaaatatccatgagaaaagtattcattttttaaatttaactgtttataggtattttacaatgtaacatattaagtactttataaataccacagggttattttgcattctgagaaaaactaaatacttatctataaaacaaaatcataataatttttaaatttagttgaacatttattgcaaccctaagtcattgttatagtgacaaggtatagaaggagagagagatataaaaataaatcagaattttgataagtgctttatatgttatctctcatttaaatctcacacaaaccctacaagataggtattaatttatccttcttacagatgaaaagcaaccaaggctcataaagatatagttcttttgccagagcagcacagccggtgttttattccagagtttgtgcctggttacttcctcaactgggtttataatcttttgagagacaaagatatacacaaatagttttgtgcagagcgaagggagtacatcggtcataaagttctaaattgaaatatttggaattgtgttccagatttgtgagtgcactattatatgtgggaatggatttggggcattttattttatctgagaaccacttttttggggggtggggaagctttccttttattttgactcaatatacagagagaaatgacttcagttaatacctgaaatactctgcaaagcttttagagacttcagaacaaatataaatcactgtaaaaggaatacagatataaaataaatataaattattaaattcacagagctttataatgaattgttttattaatcttgtaaactttcaaagtatctagacaaactgtctttcaaatataaaagaaaatttgttgtaaagttgcttttaccaataaaaatactaaatagtatttcaagtgaatactggatgccaaaacaacacacacaccttagagtgagttttttatttaattagctaggactacacaatcttatcacagtcttttttttttttttttttttatactttaagtttctgggtacatgtgcacattgtgcaggttagttacatatgtatacatgtgccatgctggtgcgctgcacccactaactcgtcatctagcattaggtatatctcccgatgctatccctccccccctccccccaccccaccacagtccccagagtgtagtattccccttcctgtgtccatgtgatctcattgttcaactcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagactatcattgttggacatttgggttggttccaagtctttgctattgtgaacaatgccgcagtaaacatacatgtgcatgtgtctttatagcagcatgatttatagtcctttgggtatatacccagtaatgggatggctgggtcaaatggtatttccagttctagatccctgaggaatctccacactgacttccacaatggttgaactagtttacagtcccaccaacagtgtaaaagtgttcctatttctccacatcctctccagcacctgttgtttcctgacttttgaatgattgccattctaactggtgtgagatggtatctcattgtggttttgatttgcatttctctgatggccagtgatgatgagcattttttcacgtgttttttggctgcataaatgtcttcttttgagaagtgtctgttcatgtccttcgcccactttttgatggggttgtttgtttttttcttgtaaatttgtttgagttcattgtagattctagatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgttcttatcacagtcttgtggctacaaggtgcagaaaaagatgtagcgtatttcagcccagtatttccccacctccatagagtgcagtgccactgatagagtttgtataaggtattgtcttcctgaacctacaaaagctcaattctttattttgttatgccggatgcttacagtattatccttgaagaaattgcacaatccatgcacttttgttttgagaagttattataagcatcagaatttttgtagcttccaaaccaaagtgactatatctattaaagcttttcagggtcctaaagagctcatttccccacagtaacccagttgcagtcacatagagtttaggcaatattcactcttaataaagattcttctttttaatggagttttgaagaaagttatttgtttgctttctgatatcttcttcctatgtttttattattaatgttatgaattataaaaattaaaacagtgagggggtcagagtctggtattaattcatttattttttaataaaatgaactttattttatttgtttcccaattataaaagcagttcatgctcattccagaaaaatcagaaaacccacagaaacaaaagaatgagcatatgggaaactcgtaatcccacccacctggagatgaccaccgttgagacctggtactctgtgtcgttgcagatccctctctcttccacacttcattgacaaaactaggctcacaccagttatgctgtaacccacaactttttttttcttccatttagcaatcaatatggtgtaatatgggaggaaaataatatctttggaagactatgttttaaaagcagttgattaatttgagatatgtaatactttatatatagagagagttatacatggaattacacatatattacacatacatgtatgtatgttttgccagaatttctccaggaaggctataacaatttgtaccctcacaacagtgtttgccttttgagttttttgttgttgttgtttaccaattcattttagaaatacatatatagagagaaggagatgaaattgcatgtgccaacttaaaatgaggtagttgaccattccatcttttcaaaaagaatttattttcataccttgattcttaaaaattgctagcaatgtattcaaagtttaaatctcaaagtatttgaaaattatgttttttaaatttagatggataatataatcatcaaattcaaatatccaatttttgtagatttttggtacctgaactatagactttttaaatgtcaaattaggtacataaaatgaatgttcaattgctatatatttactctggtcatcatgagcaaacctcattttttacacaactttaattttatcataatgtttatcttagttgcaaaagtaaacatggtggtggttttaaaacgagataggtttttattagcttcactctatgtttacctaactggtcaggctgcggctctcactttgcttgctgcatattttgattaatggccccttggccttgttccagagtatactgattatggtcagtgcacttcaaagatgatttattaattgtgtttgtgacccaaaataattcaataaagattgatcatatgcattattatagatttgccaataaaatcaacagttacactttaagagtatgtttgcctgaatagattttttaagtatacaaaaaggacaaaaacttttttttaatgtattctgtattaaacacagatttatgaccttttaaagcatgattattaaatgtatcataggattggtcttgtaagtgcatgaattgtaagttctactttaacataatttcaagataatatgtttcattggagcttacataggtgttttaataaatatttcgatgtttataacaccctgggaacaacccttactacaattcccctaggctattacgtacatttaaattttaaattactgacagactcagatgtctgtttttaaaaaaaatgtttataggagacttttataatctttctgagttttaagtaaaggggatttatcgtatgtttcctatatgttatactcttgtcatttgaaagactttgatatgtacaatttctctaaatttggcttgataatagttattgtttcaggcattttaagcactctaccaacatagaataatgtgtaaatattcactatacatggccggcaaagttattaatcaaaggaaatgactccccgctcataatttatggttcagtattaaaggaaaaataggaggtatatattttttggtatactgtatccaaaatttacactgtaacagtgaaattctgtaacttaaatcatctagtatgatgtgttactcaatgtaaagtaagtatttggtccgtagtaaaaattatgaaataaaataaaatattttacccactagaaatatagactgtttcatgttatctgaaaagtataaactaattatgccaaaataagaagatatgaacccccaaagtaacagatgtcagcaaatggaagaaagaaatcagatatgagaataaaagataaacctaagaaattaaaaatatataatgatccattagtattattcaaggactttgcttgtttttggaaaattgttactaaaggacaaaagcacaaacatgctttatttaaacatcattattcaaaaatacttttagtaaaattttaggacatagtattttgtttaattgaaaatcttttacaataactttgtttctaaacaatttctaaaacttatttctctagatcaaatatgtatatgttactttgtaaaatgttatttttgtagtaaatgaagataaattatcagtgtattggataaagcagtgttatcattaccaccattattgaatgtttactcctgtataaatcacttctagaaatacagaataagaagttgatacagcctctatctttgtctttgtgtatgaatagaacaatgaaggaggagtaatgaatagcacacatacgttgtttgcttttgggccacattacattttctgacaaactatctttaatatgtatatggctaactataatatgtctagattgtgccaaattccatagtaggtatgaaagctatgaaatttcagaggaaagagagttgctaatccttttggagctatatggaataaggagataggataaaatcagagaagactgaccaggaggaagtgttctttgagtctggctttggagatgaatgttgtttctaaaggtgtaaacacctgaggaggtgtaactggagtttggctttgaagatgaatgttatttctaaaggtataaactgaaagaaagagagttctaattgaaccccatccacagcatccccttatttcctttagtaacagaactcctttccaccacctgctctatccacagggtttaacagtgcatgtgcctatcaacctagaggctacaattcccagcctcactagcagtgatgggtggccatgtgacaaagccattgctaatgagatataaatggaaatgatatgggcaatttggggatcttgcccataaaacgattgggcatacattcctatgtctctttcttccttctcagccatttaacatttaaggaaaccatggtaggagatgggaaagcaagataggaggaatcatggtccctggacagtctcagggagcagggcagcatacccacaatggaccacccagctacctctggactgtcgtgtgagaaaaataaatgtctagcttgattgaagccatggtggtggtttgtttttgttttgttctctttgttagagaaatctgggatagtcccttactaaaaagaagggctatcctatcaggggaacagattgtataaaacaaacgcatggagaaagtctgaaagattgaggacaaatgcctgtatcattgaggtgcttagaaatatgaataaagctggcaaggtaggcagaacgtagagcacaaagagacttatttatttggacttcttttatgaatgctacaagaactgttaaaaggttttgaaccaaataatggcataatgaacagagctttacaaaaattttcctggaaaccatatattggatggaaggaaagtttacgggttggcagtgaagataggaagatactctagtagtaatccaggaagagttacctgaagaatagtgactgtaattggtgtaatagtgaatgtgattggaaggaacagcagggatgaattgagaaacattcgaggttgctatcctcttactaccagagatctgggaagcctcatcagttattgaaagctatttggtaaacttagtctttaccaaaataaatcatctatcttactttagaaatcaacctaccacaaaagatggataaacaaaacaagtcatggggattgacttctcaaaagactggaaaagctcccttttccatgctgctatatttatctactcaaatatatatattgtgatgcattgatattatatcattttacatcatttcatttatttcatttttgaacttaattgcacctataagtaatttatcagcaagctttcttcaaattgtgctctaagaagggttactcaggaaggtgtattgtagcctctgaaaaccttccttgtcatagaggttcttgtttgctccaaccacaggaaatatttcctctggacatgtgttttgattgtgatctgaaggcatggggtttctcttacttggggttatatgacattctccttatggaatacggagaaaatcagctttttcactgacacattctgttatggatgtagtgctgattttaaagagtatttgccctaggaccatgatatatgatgttctagaaatttcccaactttagagaataagatatgaattgaacaaatcaatttagcaaaccaatgaagtaatgagatattaatacaaaaccaaatggacctatatatcccatttcaaggaaatcatgaaaatgataattttctattgaagtttatcttgggttaagcaataaatggcaccatataaaacaggaactgttggagagcattttatctgttctcaactgctatgtgggcaaataaggcagatgaaaatctcagtgttctcactgaataataagatggtctttcgggtctcaagtatatttttggagtcttccatctaagctgtcaggaacatacaccaataacttccagaagaggaaaacaaacccatcataggactgaaaatttggcattacatattatccttagacaatggttataggcctctgccttttatctccaccttaatatagtaatgatgtacctactgtgtgccaagcactgtgtcctatgctgggactatagcaccaaacgaaagagaccaggtgctttccctcaaggaggataggatgtaatttcagaaacacaccaataaataattacagtacaatgtgataatgaggccaattggtgtaatagttccaagtacatctagaatgcccaattaaaatgaatagtagagggaggcacaaataacaaagaaaaaatttgctactctttctcattaaccaaggatggatgcacagataagtaactctaggtgagaaaatatattacatttgatagagttcaaaaaataacctgaaattgggaattcagtaaaaatagacagttacaaaaaagaaaatattatacactagcataacctaacacatagtagatattcaataattaccaagtaaatgaagtaataaataggccttttgtataatacgggaaagaaaatatttagtagatctaacccagcggaatcttcccctttttggaaaatggtactacatctgtaccagaggtccccaacctttttggcaccagggactggttttgtggaagacaatttttccatggacctggggtgggtggggggatggtttgggggtgattcaagcacattacatttattgtgcactttatttctttaattattacattgtaatatataatgaaataattatacaactcaccataatgtagaatcagtgggagccctgagcttgttttcctcacctcacaaatggtcccatttgggggtgatgggagacagtgacggattagcaggcattagattctcataaggagcacacaacctagatgcctcgcatgcacagttcacaataggatttgtgctcctgtgagaatctaatgctgctgctgatctgacaggaggtggagctcaggtggtaatgtgagtgatgggaggcggctgtaaatacagatgaagcttacttactcacccaccactcacctactgcctttcagcccacttcctattaggccatggaccagaggttggggaccactggtctatacagcaactaaagccttaaatttaagagttatctttagcttcttcttttctctcatgcctagctctactccatttgtcagtctcatacttcatgcttctaaaatatcttagaatttaatctcatgctttctacttctgctgccactaacctagtctaagccataatccttttgcatgcatgactgcagcctactccctttttttcccatttccacttctctgacctctaaactgttttccacatagtgaacttctgaaaacacaaattggattatatctttatacttctccgcatgtctccagactttccatccctttcctagagtattccagtgccttcccattgtacttagtctaaactcattaccataggttacatgctctgaatgaccttgcccctgcatcatcctgaaacaaattgtgggatttattcattttttcgaaaaaaaaaatatatacatatatatatgtatatattttttttttgagacagagtctcactctgtcacccaggctggaatgcagtggcaagagctcagctcactgcaatctctgcctcctgggttcaagcgattctcctgcctcagcctcctaagtagctaggatcataggcgcccgccaccatgcccagctaatttttgtatttttagtaaagatggggttttgccatgtataggaagacagaaggggttttatttagcccatttaatcaactactaactaaaatgcattcctggattgtctttcacaggcaccatgaacctgattgaagttttctgttggttgaagttacctgaaattttgaaaattcttatttctcttgacatttatattattttacttaattgcttactgcctttggcattttttgaaacttgaaaattattgtaatcctgtcctacatttgaaataatttataatgataaggaattgaatccagcaactcattcattctgaatgtttggaatatcatagattattatgtactctaagaatcctaaatttattactaattatacgcccatttgaattacaagcaataagggaaataataatgtcaatctaaaatagcataaagtcattcttatttttgtgttttattttgtctacttgttccacaaaagtattgttataatattgggatggaatttattaattatctaatccaaaataataatacatggcatgtaaccattatataaatgctttgtgggacagtaagacatattactttaaatgaaaccctattttacctggtaatgtctactctttgaccacagttttgccttctgtattatatcagataaatcttctacattaaatttactaatataaaatagagtcatgttgagtacataaaatttatgcaaatgcatcatattctctctattcccctctcctacataaaaagtgggagggaagagagagagagaaaagggaacaatttaaatagtgctgggcattctagtccagcatatgcccaggagtgaaaatgaaatgggaaacatatatctcctttccctagctgtttgagttcccgctatctttctattatgtgagcactgcatttaaagataaacctttacatgcaactaaacacaaggcaaccatgtaacattttctagtgcttcatggaaaacaaatagccataaatcctaaaataggaggaaacctgttgatcctggggtgctggaccaattgaaatttgtgtaacatgctggactatggtattttcctaaggatttttcaggataatttgattttcacagtaagacctacaattaaaactctatcactaaattagatataattctatttaactcgaagaccattttatactccggagtttttcttctgcaagctaaaagagcctaagtttttaacattattgtgtataatattgttgtcacatatcagtctcttatttggatttgcttttcactgaatgcatttaattttccagtgttccattaaagtcatacccccccaaaccctgtttatatctcagacatggtgtggtctttacagagaataatgggatactacacttctgttagtgtggggtgttcccttgttgttacacctttttattattattatgtattatactttaagttctggggtacatgtgcggaacatgcaggtttgttacataggtacgtatacatgtgccatggtggtttgtcacactcatcaacccatcatctaggtgttacgccccgtatgcattaggtatttgtcctaatgctttccctcttctttccccccaccccacgacaggccacagtatgtgatgttcccctccctgtgtttatgtgttctcattgcttaactcccacttatgagtcagaacatgcagtgtttggttttctgttcctgttagtttgctgaaaatgatagtgtccaacttcatccatgtccctgcaaatggcattaactccttaatttttatgactgcatagtattccatggtgtatatgtgccacattttctttatccagtctgtcattgatgggcatttgggttggttccaagtctttgctattgtaaatagagttgcaataaacataagtgtgcatgtgtctttatagtagaatgatttttaatcctttggggatatacccagtaatgagattgctgggtcaaatggtatttctggttctagatccttgaggaatcaccacactgtcttccacaatggttgaactaatttacactcccaccaacagtgtcaaagcattcctattcctccacatactctccaacatctattgtttcctgactttaatgatcaccattcttactggagtgagatagtatctcattgtggttttcatttgcatttctctaatggccagtgatgataaactttttttcatatgtctgttggctgcataaatgtcttcttttgagaagtgtctgttcatatcctttgcctactttttgatggggttgttttattcttgtaaatttgtttaagttccttgtagattctggatattagacctttgtcagatggatagattgcaaaaattttctcccattctgtaggttgcctgttcactctgatgatagtttcttttgccgtgcagaagctctttagtttaattagatcccattcgttaattttggcttttgttgcaattgcttttggtgttttagtcatgaagtctttgcctatgtcctgaatggtattgcctaggttttcttctagggtttttatagttttaggttttacgtttaagtcttttaatccatcttgagttgatttttgtataaggtgtaaggaagggatctagtttcagttttctgcatatggctacccagttttcccagcaccatttattaaatagggaatcctttccccctcacttgtttctgtcaagtttgtcacagattggatgcttgtagatgtgtggtgttatttctgaggcctctgttctgttgcattggtctatatatctgttttggtgccagtaccatgctgttttggttactgtagccttgtagtatagtttgcagtcaggtagcatggtgccactagccttgttctttttgcttagtattgtcttggctatatgggctcttttttttttgttccgtgtggccgttacaccttttattcctgagttatcactacttttctagttgtagatactgctgctcctgtgtctgggctcaccactatgtgagcaagctacttaatgagtctacacctcaatattataatttctaaaatgggaatagcaatacctacctcgttaaaattaaagacatgacaattatattatgccaggcacatgataagtgttcagtattggtaaatgccccaactcttgctcatgttcattctgttttccctttccagtactcaactgtctaggtttgaatgtaaactgtcttccaagtcaggttaattacttgtggaaaaattacactacaaaagcatttgtctttgttatgtttaataatttataatctaatttttatcatctgaaattccagaataattacaaattatcaagtgttgtgttatgtaacttttgtaccttccctgctcatgccatgtactttgtgtattttgaaatcataagcatcttttcaacaaatatttgctgagtacctaatgtgagccagacagtgacttaggcacagaggatagaagacatggtggggagcaaaacagctgagattatgttttagtggtgtgaaacaagtgaaaaagaataaataaacatggacacattgtaaaataataaagaaatatgcagataattaaggtgatgcaaaagatagtgatgaggtggttcctttttatatagaatggtcaggaaattggcatttaagctgagcctaaatgacaagcagacatcctgcaaagattgaaagaaaggtaatgcaaaggccctcaggtgagcaaatccattgtattgaaggagtagaaatgtgtaccatgtaggggaatgagagggagtggtctgtgatgtatgtatcagtgaaataagctttgagggccaatggtctttaaattttattcaaagtataatggtaaattttaagggcaatgacatggactgatgttgtttttaaaagattgctattataagtatgtggaaaatggatttggaagtaaggagttatcactgtgtggaaaatggatttggaagtagggagcttgtgataacagacagatcagttaggaggttttaacagtagtccaagtggaagttggtcttagagtaggctaatagaggacctagtgaagaattcttaggtcatgcatatgttttagcagtaaagttcccaagacttgctagtaggtttgatttagaataagggagagagaggaatcaggaggattcctatattttagcttgaaaaactgggtaaatggtgcagctttcagacatgggaagaactcagaaagaaacagctttgcaggtcgtgaaaatagatggttctgttttggctaggttaggttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggtctcgatctcctgacctcgtgatccgcccgcctcggcctcccaaagtgctgggattacaggcgtgagccaccgcgcccggcccaggttaggttttagaaacttaacagacatcacagcagagataccaagatatatatgaatctagaattcctgcgacaaatgaggtatggagataaagattggagagtcctagacattttggatttatgaccatgatcttaaagtgagcacagacagcctgagtggctgtttctcttcagcaatgtgtggatggttcctaatgtgtagatttacacagcaaatgcaatgaaagtaaagaaagggattattgtagtgtcagatttacatgcatgattctttaatggattgtagcatttgtggaaaaatgaatacagttggtatttgaataactattttgttgattatacctggatttgatacccaggtgattccaccctgggctcttagctcaattttagtatgatcccagaactggatttaaatacagacagtccctgatttacaatgtcttgacttaggattttttgactttatgatggtacaaaagcaatatacattcagtagaaactctactttgaatttgaattttggtcttttcctggactagcgatatgtggtacaatacttctcaagatgctgagccaaatcatctaacacagagcctattttaataataaagtgttgaataactcatgtattttattaaatactgtacagaaagtgctctgagcatttctaagataggttaggctaagctatgatgtttggtagatggtatggtttcaatacttgtttcttccaaaatccatgatgaaatttaatcccaaatgtgtcagtattgagaggtgagacctttaagaggtgattgggttatgagggctttaccctaatgaagggattaatccattcatttatgaatggattaatgcattaatgggttatcatgggaatgaggctgatggctttatatgaagaagaagtggaagaagagaaatctgagctggcatgctctgcccccttgccatgtgatgccctgaacaatctcaggattctacagaggcttcacccacacaaatggtctctccagatgtggcccctcaaccttagacttcccaggatccagaactttaataaagaaattccttttctgtataagttaccgtttcctatttaatatacctaacctagtgtctttgtgtgttttctgttgcttataacagaatcttgttataatttgttgcttataacagaatcttgttataatttgttgcttatgacagaatcttgttataatttgttgcttatgacagaatcttgttataatttgttgcttataacagaatcttgttataatttgttgcttataacagaatcttgttataattgtttacttatgaattttcaatttgtgatggttttattgggatgtaacccatcataagtgaaggagcatctatatatttagtattggggggaagttctaagaggacataatttatttatttaaatcacactttatattgaactcatctatctatgtagaatcagtgaatcaaaagaatttgttgggaacctttcaagttgtagattctgatttcatagtttagtcaggcagagaaaacaaagatatatgaaaccataatagagcaattttttgggtaactgtgacagtcattagttctgttcaccaaatatttccagctctctgccttctgggcacatgatgaaattgcacttcacagctatcgttgagtaagactatattagttcttgccagcaagttttgattaaaagtgacatgtgtaacttctgagccagagaactttcttctgccatagcaactggcaaagttggtggctgccctgtcatcctggatcctggaataaggagatagcacggagtggagccctcaggccacccgtgatggacatgcaacagaatgaaaaattaaagctttgtcatttcaatccactgacatgttggggtatttgttactgtatataacccgacctattccaactgatgggttacagagacatctaaatatagcatatttttagcaccatcacactcctatgtccatttaaaaataagaaactataaaacaacatcggttgaaagtttaatatcattaccatgaagtgaatattgacaccttcactgtaagcagaatagtcaaaataaaccattgtttagctaccttgttacaaatttacaagtttgtaacacatttctaaatgttataatctggaagttttgttttctgtctgtaccaatgtgattgtctagtacagaaactttaggataactatacattctttgatgattttgcaaaaataatttaatatcttgtttaagaaaaatacagcattttcatttaatatcttgtttaataaagaaaacaatatcttgtttaataaaagcatttaatattttgtttaataaagaaaaatacatcattttcaagcaggtagtaggagtaggttttgttatttacagagctattcaacaaacgctcttttattagctcatcaatttgccagtcagacaaatggagtcaagctcccatccaggaggttaggagagaaaacactcagatttcacatcacttcaccccacctaatgacttcactttccatttgacttgttgtctggctctgttaattattgaactaaaaaaatgtactaaccagattgaagcggtagtcttcactcccactaaatatgcagagattaaccacaatgcagatgatctggaaacataaattaattttggtcatagaatttttgaggtagaagtatagtaagaaagacttttctttactaaatatttagtggtctctgtcttagtccatttttactgcaataataaaacaccacagtctgggtcatttatagataatagaaatttacttctcacagttttgaaggctgagaagtccaagatcaaggttctggcattgtgtctgatgagggctttcatgctgcatcttcacaaggttaaaaaagacaaatgctatgtcttcccatgatggaaggcagcagcgcaaaaaagcgcctaaactagttttctctagccccttttttaactgtacaaaaaataaataagttaacattattaagttactacttcagtccttatgttgttttttaaaaataatcagtttgaggccaggcgcagtggctcatacctgtaatcctagcactttgggaggccgaggtgggtggattacctgagctcaggagtttgagaccagcctgggcaacatggcgaaaccctgtctctactaaaatacaaaagaaattagctgagcgtggcgacgtgtgcctataatcccaggtacgtagggggctgaggcaggagaattgcttgaaccgaggaggcggaggttgcagtgagccgagatcgtgccactccactccaccactccactccagcctgggcggcagagcaagactccatctctaccaaaaaaaaaaaaaaaaagatatatatattttataatatattatatatttttataatatatataataaaatataatatattataaaatatatataatatatatttatatctatatcagtttgaaacacattattgaaagtgaatacacacaataaattgaaaaatagggatgcatagtgctggatacatatcaatcaacttatcttcatctgttgcctgctgttgtagacaaaatttgacacacaattagcatattgacagagcagccagaatacataggagaaagtggcaaactactagaaatgtagcttagctctggatccatcaccaaaaataataaaaataaaaataaaaaaattcattgtttatctgggagctaaccgcactatggcactgaattatctactactcacaaaacaatttttaaaataccaaaagtgccagagaaccttcattaacagtgtttttaagtcaaagtttttactttaaatatgtgatgattactcaaataccctaagccatttggcaggccctatcacaataagttacaaatagtctgaatttaataacttaaatgtgatatggttgctgtaatatatactgtgtgaatatcttaacctctttcaggtagttgataattaaaagatttaaatttacagtttcaatttctgcttagaagaatgatgtcagtattctagcaatagtgatggcatcccattattgtaaatgcagaaaatgataatgtctgtacaagtgaatctatattctatgtgaaagttttcaatggtgcaagtttataaccaaagctgggtttaacagatgctttctgacttctgaaaacatcataaaaatccttcctaaagtgaacaaactaaagttacaagtaggtgacaccagttgttttttccctttatgcgtgatgaacttcatgaagcattaactcctgaggtatatttatttctggactatacaacttacatcctcttctttcaaggcagctaccatctgctttacaacttcatcaaaaaacaatgtggcaagctgagagtgtagaagagattgcaattcaaaagaaattgaaaaatcagaggtacacatttttcagtagcctggaagacctgggctaaaacaccagtctccaaatgatcgagaagtttcccatcaatacaggatgcctttccaaaatgaggtttcaccaaggttactactgatgtatattgccccaacacaggtggaaacccaatttctaattgtgttttacaatatccggatgtctttgatactacatttgatgttttacaccaaggaatgaaatgcttgtaatcctctattcctgatactagatcatgcatttccttcatgtttcttgaatgtcttaaaattcttctctctgaatattctttccttttgtttattaatggtgccgcaattttgaagaaagttcttgcacatatctccttaggcaaaattgaggtatgtagtagaagagttctgctcatcagtataccacaggaagctaaatatctgacattctgcacaggcccctgcactggagcccacactccgaccactgtagccgacttcagatggcatcccaagaccacccttctcaaggctgcctgaccagtccaagctaccatgatagactcctctccagcccttttataagacatgaatccattcataagggcagagccctcatcacttaattacttccccaaaaggccccacctcttaatatcacctcattggggattaagcttcaacatgaattttagaaggtcaccatcattcaaaccatatcaatctgtttatctgttgtttagttgtaaactggcatagaaagccaaatgaagtatgaggggctttattcatggtcactgtatttgcccactgtgtatctcatcaggatttctctacatatcctctttcctggagtttcttttagtgcaaggtttacctacgctacatgatagctataggaaaaaatcctggtatttcaagctaatgtttgtgaagaacatcccctgtatcttaagacttgcataataaatagcattccactcaaaagacatcttgcaatactggtatagttagctataagaatatcaagcaatataaggtaggagacctgggttcaggtttcaactgtgtaatttactaaaccatatgactttttaacctctttcaaatctgtctccttctttccatgcctccttcactgctttgatttaagcccttcttacatagctccctttcagacttgactccaatacagctgccagagtgatccttctaagatgttaatcagtgtcaagtctttttaatgagtccctacagttctcaagataaagttcaaacccctgaatttagtatacacaggctttcatgagctgcactttccctaactccctagtcctaagattgtaaagtgagacaggctgttagcaaaatgcagctcacatatgtgttcggtcgagtttgcactgttttttgttttgttttttttttttaattttgtaccatcattaatttaaaaattgaaaccttttatggctttggaaactggaagatattccctcacatggtggcaattggttatactgactgttctctttagaatggacattcactcttaaatttactacagtttccacccacaaagttttacccccttatgtaacttgtgggcaatttgcattcacctctggcctcatctctaaccacttttttatgttcatcatttatagcactgaactatgccaaattcctccaatgttgtctgactacctttgcctggaattctctcctgcccttttcatttctttgtctcactaaaagtgccaagtaacaaaggtattccccccaaaaaggggactgtctgcttttgattagctaccttctatagaagctgactgcctggacagatcattgtccaaagacaacaaaaagctcatccattagtcacccagtggcatttaacaggaaggaaatattggtgcttcaaggagggcatttatttagccttaatactagcctatttggcatcataaataagagaaagaaaagatgaagaaatatgtcagaaatagattctgattcaaatgctacaattggggttagttaccattaaatagcaaaatagaaaatggatgactcctatggcaaatggtttggggagagacaatgtcgaagttgcttggcatgacaatgagtgccttaaaaccgtttggcctagaagtttcatctgcaggaatttatccaaggaaaataaccaggaatgtacgcaaataactgaatgatatttataatagcaaaaaaaaagaagcaatgtaaatgtccaacattagaaaattggttaagtcattagtttttagacagtacttcttaaagtataggattccataggagtgtgttgataaccatgtcagaaaagccacaggctcttcatcaccacttcaatcagagtagtttcagttttatgtgttgtacatattaaggttccatgtgagactttgtttagaaaaaaaaaaatccgatcataaaaataaaaatttgagccaggcatggtggctcacacctgtaatcccagcactttgggaggccaaggcaggtggatcacgaggtcagagatcgagaccatcctggctaacacggtgaaaccccatctctactaaaaatacaaaaaattagccaggcatggtggcaggcgcctgtagtcccaactactcgggaggctgagacaggagaatggcacgaacccggaaggtggagcttgcagtgagccgagattgcgccactgcactccagcctgggcgacagagcaagactccatctcaaaaaataaaataaaataaaataaaaatttgaaaaccactggactctgtaaattctagtaacttatacgacaatatatatttggaaacatgtatgttaacagctcagttatctttgggtagtgacttttttgtttgtttgtttttgcttggatttttctgtgttttccatattgtctacagcgaacatggtacttactatagccagaccaaaaaaaaaaaaaaaaggtttttgcaaaaaaacaaaaaaggaattgacaacaaatagtccacaagccactgaaaattcttcagcttaccatttttggcattcaaataataggtttgtaaacctgctgtagctatgaaatgtttcctactaagtataggttataaagaacgttgaagatacagttcaacaccctcattttacatttgaagaaactatgtccaaaatgtttcactttgtcgaagctagagctgggacctcatggtcttctgattccattgccttttctgctatccacctaatttataaaatgtatattcataattctcatttcttccatttatgtctacctagttggagcattcatcattgtgttactactttttcctttgagtgaaaactattatttttgaggtgccagtgatcaaatttctctgtttaaaaaactttgtcacaaacctagaacattaaaacaggtccaaaagctctcatataactaattgttctgatatacacaattggaattttataattgactttattccactaattcattaaatgtgcatgtttagtcaaatttataatttggaattgaactaaattgactccaaatattcttactgttttcattctctcttggcatctacaaggaagacattagaacatgttccatgtgccccaccttccttctcagacatgaatgtacttgtgaagcactctgtcttgtattttagggtcttaactcatctcggagttatcttactatgatcacattgatctaacccccaaagtaatggatctgtgtaatattttctacatatgtatgtgtgtcaggactttcccatggtttctttcgcattttaatgttgagaagtgaaaactgggtatccagtcaagcttggagagtctgaagaaatagtatgaggtaatgtgtttcaaataaaggaaaatgagaagattcataaacttaagtcacttcccaaaaaccttctaccaacccagagcaaaaaaaaaaaaaaaaaaaaaaaaaacgaataattcatgatgaaaggtaatcaaatacataaaatacatagaggtttttaaggtgaaattgatatagtttgttattgatgatcctattcatgaaaaaacttagaaaagagggattttgtagagcactcttttcatttgatgtttaattcttctggtaaaaagggaagtccatatacccaataacatattagatctataaccaaccacacaatattgtaccttaactcagtgactaagaatttttttaaccattttctctaagaatcctaatgttttaatttgcttaaaatgttaatctttcagatgtgtatctcatagagaacattttgcttaaaagaattgtaattaaaactgaaatcatttataaagttgtttgtaccaaaataattcctttgaacatcacatgtaggaaatttggggtgaatttttaaatatttttaaatgtcatagttttatgacctcttctgatttagtcattctcattgttttaatgcacttgggctgttgttcatttactctaggattgagcatagaagctcatagatgtaaaatggaatttgatttgtaaacaatcaatttaataacttgaatttcatgtaaatatattttctcatgattaaacctttgttgacataatatgtcagtgtttccaaggaagcattcacatttaggagtaactatgctattagctaaaaatttcaatatagaaatattattgtgacacctcttaaagttttaagttaaatacttatatactattagaatagcactacctgattattttctagataatatttaagaataatattttatgtatatattaaacagtagttttcaaagcacacacagattatttcatttagttttgacatacaccctgggaaagacagaaatgaggaagattatttaaaaattaggatagtgagattagtgacagactcaaaatttcatggctgttatttgatagggcaggcctagaacctggtgcttgcccaggattatttctgcttatcttttaacctctataaatgaagacatataccctagaattgtttacagcttaataaaaagcaagttgcagaattgtacatatgttctaaagcaaataatataaacaaaaaataccaaatattttccattgttacctaaataaatgtgtagaagtttacatataaactgttaagattggttatctctggggtatgtggggctggaattgacactgaggggtgtttcaaagggggttctagccttatctgaaatacaatctaaatatatttctgtatggcttgtgaagttaaaaatttttcatttaactttaaggaatatacaggtagactatgagagttactgagctataccaggaaggagtgggaatggatagagaggtacatggaagagtcgctgctgtttcatgaataaaaacaggtcattacactgtctttggaatccctatgtaattattttatgtcttgttgtaacctactggttgacagaaataaaggaatcaaaagagtgtcttttcagaatcattctaatttgttcatagttttgggaaatattccacaaagataaactggccatggtgccatattgtgcaactaattaatatcggtcaagggggggttgtttgtttcattgacaatagcactggtaaattaaaagtaataaattcagttgaaaaccacgtgtaattctgagtcgtatatgttctgatcccattggtaactcctttgggctttgttcagcggggcggaggcatggttcatgattccctccactgtcacttcaccctcctggaatgtagcaactgattttcaaaagctgaaaccatgacttttcacaggagcttgttattccttttttcaaagtttatttgaatcagagtgggattagtctaagatatcccctgtgcttggcatgtgttcctttagaaaagctagctgatccagcccttaattcctggttagtaagataatagacatagctgggtgaggttctaaagatggaataatttggcacaacacatctctgactgaaatctaaatgtgactcttgagaccaatggactgaattggtctgtctgcgtgaatttcactttcctttctcaattaatcaacttcgtgtctgaagtgtctaaaagaagctcttctctaacttttctggctcacacatttacttttctgtctgacagcttgtcacctttattctaggcccaaagcatccaacaagtagtttttgcccttgcttagtggctctctgatacaattttccaaaatgtacactttataatccaggaaatcctctacattcatgatagccataacagtgatggcaataataagagcagctaacatttatttagccccatgtgattatgggggctggcaagtctgaaatatgtatggcaagcaggctggctggaaactcaaataggagttaatgctgcagtcttgaggcagaatttcttctcttggaaacctcagtttttgcccttaaggcctttccactgattggatgaagcccacccatattttctaaggtaatatcccttactgaaagtcaactgattgaatatattaacgacatcaacaaaatagcttcatagcaacacctagaataatgttttattgaataactaggtactcttacctaatcagatgacacataaaactaaccatcacaagctaggaacacaaagtacctgagaagattgagaaggaatgttgagagaggtggacaatggggggttattgcaataatgcaataactgacgatgtgcatgtaaagtagttgaggactagatgaaaattatgggacaaatctaaacaatgtgaacgaggtagagttgacggtatctggtgaccttttggacaaataatgtaatcagtagtaggagactgccaccaataataaattcattgaccatcagttttctagtctggcctgtgaaggattaagattcgtgtatgttgtgtatctaggatttgttaggcatactgcctcagtataatgacacagagtttttgaatgactcttctccagcccattctcctgccctcttaccctgccttttcacatcaacatattttgaggaaattgaaaaagaagggcatgaattttgaaaagatccattagtaggcttggcattctgcccattcataacatttcagggacaatatgagaaaagaagagaaacatcttttgtacaaaatcattggccgaagcttagccatcttggtttacaaacaatctaaaacccaatatcctagtgtaacagagagagaatagcacagctttctatgccttatttcacaaatgttaatgtgaaggagaaaaataaagcaagttaattttattaatgttgatatttgactatgccaaccagaaaacttactattttataatttacaatagttttatttgcttacattataaatgatccagaatggagatggagagaggtatatagaaatctaatcgtaaaatcttcatgatacatttccatccatataatattcaaaagactggacttgctctcaatgttttgaccatctgtatagtgttaagttcctcccgaaaatgtgtaattttttttactggaacatattttaaatgaatgaataaatgcatgtcatatattcatcttttcaaaaaacagttttttggtttgttgattttctcaattgttttcaattttattgatttctgccctaatatttattatttattttcttctgcttgctgtaggcttaaactgctcttctttctctagtttactaagttgaaagcataggttattatagaccttagaccttcttttcaaatatatgcatttaaggctataaatttcctctctaagcactgctttcgttgcatcccacacacacagttagctgacttgtattttaattttcatgtacttcaaagtgttgagtgtcttcttgacccatatgttcagaagtatattaatctccaaatattttgggatttttctgctgtctttctagtactgatttctagtttcattttcattgtggcttaagaacacactttttatgatttctattcttaatttgctaaggtgttttttatggcacagaatgtggtctgtctctgaatgttccatgtgagcttgagaagaatgtatatcatgcaggtgttggatggaagattctataaatgtcaattaatcaagtttattgatactgctcttcaggacaactatatcctttctgattttttgcctacgtgaccatatcagttactgaaagcaggctattgaagcctccaactccaataatgcatttgtcttattcacctttcacttctatcagttttgccttgtgtattttgacatgcttgttagttgcatacaggcttaggattattatatgttcttgtctattatgtcttatttgactgaaaaagtctttatttctccttcactattgaaggataatttcactgaatatagaattctaggctggtgggtttctttctttcaacagtttaagtatttctctccactctctttttgtttacatggcttctgatgtccactgtaaatcataccttgtttctgtgtatgtaagatattttttaccctctggcttctttcaacattttctatttgacttgggttttctgtagtttttaatatgacatgcctagggatatgttggttgagtttccgctatggtgttctctaggcttcctggatatctgaattttgtgactggcattatttttagaaaattcttgataattattacttcaaatattttttctactctgttttctttttcttcttctggtattctaattatatatataccttttgaaattgtctaacagttcttggatattctgttctattttttcattcttttatctctttcagtttatatcattttttgttgacctgtttttaagcttactgattatttcattaactgtatttattctactgatgagcccatcaaaggtattctacatttctgttacagtgcttttgatttctagcatttcattttgattctttcctggagtttccctgtgtctacttacattacccatctgttcttgcatatagtctactttttccattagtatctttaatatattaatcataattactttaccgtgtctgatgacttgaacatctgtgtcatatttgagtatggttttgatgcttgtttctactattaaactatgttttattccttgctttctggaataccttgtaattttctgttgaaagctggacatgtatcaggtgataggaactgaagagaatagacttttagtgtgaagatgttcatttgggtaagaattgtgctatatttaatgtttgttgtagctgtaggtgtcagaagcttcaaactccctcctgttgtccttgcttttgtctctgctgtgaaattttggctttcctaaattcttctcagagatagtctgcatcttcagctctttcaactgcagtccactgttataatactggagtcctgttggtgtggtggtatgatgtgggagaaaagcattcttgatttttgtgattgaatcttagtcttttagctgacctgtaccttggggactgtgacctctacaagtatttctctggtgttgtacctttttttcccttcttaggtgaaacaagttggtagaggaggttgaaacatgagcaatatacatatcccacgtgggatagggttcacttctttcctagagaataggcctttgttatggagaaagacctgggcatatttcacaatgatgactctccccctggcagaatcaggagaagctctttcttggatctttaccatgaaaatctggtggtgttcctggacataaactgtaggaaaggatggagactccctaagactgtggcctccaggagtttctcactctcatgctagtctacattaagtctccagcagttcattaaaattcccctttgagtgttcctatcaatttttggctccagtggcctctaccccaggtaaccacatctcagttgtgactctctcgatttgtctttctccagatttttggatggttgtttgccctgcaacctcagttatctaattggtataaaaaaagtaattgactttcagtttgttcagctttttcttgttagggtaggagaaaagattatctttacgtattgaatatctccttcatataataaatttatttaatccataaataaatggaaaaccacaatattcttattttgacttatatatacattgtatagaattatatataaagtggatgcccttttattaattctatttaagaaaatagaaacttaaatatctatattttattcattttataaatatttataacattattactattatatatcttaagtattctgatcatattctgcactatgtgatttgtaaagattatctgctaaaaatcaatctttagtagttggacactgtaaaacatactagtaaggcccaacctggtgttgcttgtctgaaaaataatttaaaagaatctgtttcactttatctgttactcacttaaagggaaaattttcattctgacttcttgtttaagagttcatgcagcaatttggagagtttagggattttctaaattagtatgaaggagttcaagttctccacaattttttccctaattaaataaattgaatttttatccttttgtcaatgcccactatgcagagatctgtaaagtgctgtgctacaaaattaccaccctttatgaatattggcaggtaaagacttactcttccttaggcattataatgtgcctttattgcaggggaaatgtagtatacccacaaaatcattactttgttgttttgttgggttttatatttttattcagcttacatagattattcatgtgttttcaaaactttaaaatcaacagatgaatgtgaatacattctggtagaaaataaagtgaactttgctggtatcttgtaatctctctaaacatttacatatgtaaatatttgtgtatcttttttttctgaaatgtatgacagttctcaaaagcaagacaaaagaaacaaacaaaaatcatcggaggcaccccagtgaactggaaaacttaaaggatgagagtttaaagacatattctaagccttgatttgccacaagtttgtgtgactttgagctcctttaccacctcatcccccttttaaagtatcaaccataaatgggaatactacactaggtaattagtaagagcactttcagctcataaattgtataattctatgtcacaatccacactgagattattatctttaaaaaattggtcatttttctataaaatttgcctgtttcctttgtatattttttctttattttgagttggaaaggataagaaagaacaatgaaaaaaatagtagcaatgcttttcttagatcaaaatctattagtggacttacatgtaagccaggtaaatagatgcttacatagaatagctggtggagcagcagaatagaatatattccctcacacttcatctgcttttgtgccacagtgctatgtgtgctctacttctttaggttaagacagctgggcctgtttttttcaaattcatatgtacctgactacttaccgactttatcagccaagtcatcttaatttattaggtgctttcctctgtaacagctcatttggaggcactatatgttacaacttttgatttggacatgatgataagagaagacaactggattctgaggcactgctcaggcagggtaaatgttgacttcagatatagttcagatggatggatggatggacagatagatgagttatatatatgtttatatttatataaatactatatatgttatatgtgtatttctgtgtgtgtgtgtgtgtgtgtgtgtgtgtgtgtgtattttatggtgtagtagaaagtgtaggacttgaggacatcttataaatgagatatcaagaaaggtgaagtaaaaccagcaagctttgtagagaaaaaaatgtaaactttattatttcttatagagcagcatctcatagagtttgttccttgatatagtgaaaattgcctggcaaataacaggttcccttgtcatatgcttttgggaaacttcacaggctatagcccttgcctaagattcacggtgcacattgtcatgttggcattattgaaccaacattttccaaatgtgtttgaattgagaaccccttttactgcagtgtttcatggaattttggaaaacaatggcctgagcagtttctgattataattattatagtttctgctaagtatccgtcagtataattgggattgactaaatgtttttctgctgaagaattcagtgtttcatgttattccttacccacaaacttaagctcaaaatctaatttaaaacaaatctttaaatatacatttgacttacccactgtttgttttatggtaatgaaatagcaatattctatttcataaataaaacattttgagtagtactatattccccaaattaatgaaattatttaacttttgtaaataaaattaatgaatagttctgcaagttaaacaaagcagtaatttttctttattctcactgttacaggctagttaatatcccagtagactgaatacacaagaaactctttttctttttctttttcttttttaacttagttgtttgagcaatagcatattaactaaatgattttttataaattcataatttaatcagatatgcatttttcttatttattttctagattggatgacaaaactatattttggatttctcttagtttttatgaaaagaagaagttaagtcttaatcttatagatgtgatgacaggataaaatactcttaaatctctgtatatggtaatctaggtataattagtcacaattgtcataaacaatagaaataacagatttattatagaccttttttttacttaatgtaattttatttaacaattataattttacatgtaaataaggatgtggaactcgggatttgtcagctgactaagcctaccttcccatggttttattcccaggccaccacaccagagactgtgtctctagctgtgaaccctgtagtagacattctttactctttcttatttactgccagtcatatttctcttatgtatcaccataatgtctttcttcccttccaaaggaaatgatattcttttctatgaccaaaagtcagcaactaactcctagtataatactacactatgcttaacctatcagtgcttttctcaagttggacgtatagaagttactcacatatatctgtcatctcatccattcatcccttcacatttcttcatgtttcttttttcctcttttctttttctttcttttttctttttttgtttaaactgctccctgtttgaaaattcttattccttcacatcttttataatttaacccatcaaaagttacctcttctaatcagactttcttggaaatcatgagaacaatctctctttcctctttgagcttgtaggctgctaagcacatcctctaatatcgaacccattttgccctatatttatgtatgtgtcttccctccattatcagtttgtaaatttcaggcagagatagcactcctgcattttctgtatttcatggcacttagcatgatacttgtacattgagtgataggtgtgcaacagatattttttgaattgataaatgagtgaatgaatgtgtgtttatgtcagatcctataagaaaaagaatatacaagtacagaagcaattctggttttgaacagagcagattgcaaaagatacttttaaattaaaactataaaaataactgatgtatcagtattcttttaaaagttggttttattttaaaaattgtagataccaatgacattaatagctaactaattcttctggtttcttttaaaatctcttttccaaaatgttcaaggatgtttgacttttgtttttttttctctctcttttaatcataaataggtataaacagtgctttaaatactctgagtactaaagaacaaaattatgacaaaaagaaaatgaccatgactaattttcaatactatctgttggtagcaaccagatacacttgcattctaaccagtggcatgtatttgtacaaaagtttctaagtacacaagaggaacttgcaggtcattttttgccaaatagtattttgtgccaaagaaatataattgaaagacaatgaggatgatagattcagttgttgaatttctagaaatttaaaatgttggtattttgaacaaaaaatataaagttatgaaatagttcaaagatagaatgataaaaatagctttaccgattactttagctgtattgtgctctgaaaagtcatgtgctccaattactcatgactgtcagttaaacttcggtgaactggctaaacaaaaatgttttaggagcattggatagctatgtaacattttactaaaaagaattagtgtgtcttatgagaattatggttgcagattgccattagcagcaaattctgtctacctcaatagctttttaggaattaattgagaagacttctggttgccttattagttcataggcaaataataataaaactaacatagttatggttaaaagatcatgtatcaaaaataaaacatataaaatacaatatcagggatgaggcctgaattttaggtattcataatttactagtgatgtattactagttcatgtaaatttagttagcttttatgataatgctttttttctagtgctcactttttaaagtgtgattttatggaacaagaggtttcttggaagcaccctgtggtgatatgataaaaatccttgaatccatttagataggttaatagcaaaattagtagacaaataatgcttccctggagttctggagcatcatatctcaaagttttttatgttaagcattatatcttagaagattagtaaatgctaaataaggaaaagagtgaggagtttgcagactcttcaaatataggaaacaatggactgagtaaaagtaaaaggattccttcttaaatctttttatatactaatgtgcatcatgaactctcaagagggacatatagtgagcagcactttcaaaaattatttgaccaccagaccactttttaactgaacatcactaccagtatggaacatgttttctgaaacactgtcctcctaagtgtttctaagtgagaaaaaaagaaaaatgatatgcatatagaataatctaccttacatatctgtcataaaatgttgtatataataagatgccatgagaaaaggcacccacgtcgtcatcatagagcttacatgttaggggaaaaactttataaataagctgacagatacaataaataattgtactccatgatatgtgctatgagggaaacaaacagggagttgagatggagaattgcagaatgaatctgccctaggtaagatggtcaggaaggactccaggcaggtaatatttaagctgcatgtaaacagaaagtactcatctttttaggggtgaggtattccatgaagaaagaagaacatgcagaggctccaaggtgggaagaaactggccatgtttagatagaagcatacacaggaagtaacacacacacacatgcacgcacacgcacacgcacaaacatgcacatgcacaagcctatctagcatggagaggtaagcaggatccagatcatgcagagcctggatgccaaaatgagagagtttggaatttactctgtatactttgggaagcttttgcagggttttaaagagggaactgtgttatttgatttacatcgtgagaagatcactttttctactctaaggtagattgattaaaagtggccaagagtagaactttagaggaccagttaggaggctgttgtaatccagatgagagatgaaagggatactgtgttaatagactgaaaatagagtttgatgctttccagtgggagataagagggaagcagcaaataagcatgaccttgatctccttttcttcctcgtctctcctttccaaatagcacaaccagagatatttaacaccactgctttatgccaaagtattaagtatgtaagttacatatctctcttgagtttgactttatttgatgtaatgtttggaagacttccaaaatgatcaacagagacaatgtgtaaaatctcttgaagtcacattttccctttggcctgttttattcatcctattctgacactttaatttatttcaacacagtctttcactttgaataaacctcatttgctttcaccttaattatgacagtcttgcataggacatacaaatgaacaatacattgattctataagaaataagaatttctttgacaaggatatgccaccatggcattctctgccatagctgttcttattagtatcatttacactagccagatgttatttcccctaaatttaaatcatgcttaataccatttatggactttaactcaatgataaaaaaatttatttattttattttttgtggtacatgaattatattttattagatggaaggaggttgtgaaagtgagagcagaaattaaagtaaaaaacaattaaagaagagcaataaattaaaaatttggccctctggaaagattaaaaacattgttttggtgagattttgaaaggaaacaaatttgaaatatgggaaaagtaagtaatattagtaagaaaaaagtaacagagattaaaattataaatagagattactatgaccattatataccaatatatttgagtctaaacagaatagacaaattactagaaaaaaataagtgaagaagcagtttaaaatattcccattaaatagaaacaattcggtgcaatcttacagacaattgccaacagacttgcaaagaatggatcattcagattgtacaaaaaccttgagcaaataaagaatgaacatcttggataataaagggagataatattattaacagaaaggaaaattacagggcaatcatatatgcatataaatgcagaatttcctaacaaaatataagtaaactgaatatggtaacatttcaaaaaataaaacatctttaccaatttggaattatactaaaagtgttagtgtcattaaatattatgtaacagatcaaaatttaatgataaaatatttaaaacaagactaagttattgaggaacctctttcatattgagtgtttgtgctacacagaagtattgtgaagattaattttaacttcacctattgaaatttaaattacacatacttttatatgttagccaaattttatgtatatgaggattgtagagaagttagagaagtttgtttagtatttgccacatgtgcatttacaaactgaatttcttcaaaacgcaatgcttaggaacattttctcttgagttttctatgattattaaatgaatacaccaatacatattttaaatagctattaatatcagttaacagaaataacaagtatttttgttttggagcttggtcgtgaagaagaaatacctaatagtgaaatttattaaattttaaacaatattatagagtaagattatataatgctttaaaagtaaacttagatatatgtgacttaagtataatagtaggcctagtttttgttatttctctttggtactgaaattgttaaataggaacatgaatatatgtgaagatatgtcttttcatgcacgcttcaagttctcattatttctcatcttatttattatcttttactcctaatgcagctctctgctcccatctctaagcaagtctccaccttgctgccaaaaacagcagattaacagaatcattaacaaaagattttgtctttctaaaaatttatgccattcccatttgaaatgtattcagtttaaaatacaaactttttctcttgctgtgtaggaccttttaatgcatcatttctttatgcctctgccttacacagcagaagcatattatcattatcattaccattttgcactttaggagattgaagcttagagaggttaaataagttcaacaaagtcgtaaagcacataaatgacagtataaattacacactgtatgaatccagtcctttgaagtttgttgaaaaccgtctatggcaccataaatgttctatgtgtgttgaaaaaaaaaaactgtctacaattgggtggagttttatatatatatgtatttttttcagttgatcaaatttattactcttgttattaagattttctgctttctacccatttccctctgtttatcctatgaaaagaaatttggtaaaatcacccttatctctttatagttgtcaatctaaggctgtataatttgatcacagagttttatcttcctgaagaagagaatctttcattattataaaatgactctcagtatttctcatgtttttatctcagtctgtttaatctgatactaatatagccacatgagcattcttttgattagtgtttccctggtatatctgtttattcacccttgttacttttctactttatgtgtccttacattttagaaatctctctggcatagtacattaaatggatttttttttaatctcatctagtagtttttatcttttctattttggaggaaatacattgtttctcttcttttagtatctactcttaaattacaacatgttctcttaacttatgaaagtataaagtcaaccaagtaccctttgctcttgtcagacaacaaacaggagtcttctgatttggaagacattaattcctttaaatgttagctcccttaacttcctttaattccaagtaacctgctaacttttatgttatttttatgtccttggagaaagtttaattaattctgtctgtttctaaagaataagacattcttattgttattttatatagtcaatgctcattttaatttatctgaaaatttatagctttcattttttttctccttgctttttagccttattatcctagattattttacatttgcatgaagtacattctctagagtttccttcaatgaagttccactggaagcaaacttcccaatcttagtgaactgaaaatatttttattttacttttgatttttggaaaaaattctactggagctagaattctgagttatttctttcagcattcaaagatttaatttcataggaagttgagaagttggccaacagtttcacaatcactcctttggcggtaatccatcttttcttactggctatttttaagattgctcttatgtctttggtgttctgaagcttcgacatgatacaacaaaatgtaggtttctttttagttattttgcttgcaatttgtgatttttgaggtgaaggtttggtgaaattcatcagttctgaaaatttctcagccattttttgttaaatagcccttctgcctcattctctctgtcccttcctttgtaactccaattagacttatgttatatcttctcactctgttttccatgtattttaacctctcttttatgtttgttactctgactttttatgttgaattctccataattcttctagcctttctttcagttttctaattatctctcaaatatgagcaactaatctctattaaacttgaccattccattttgaatttcaagtatcatgttttatttttagatattacgtgttgttttcaaatgtgctttgtcatttttatagtttcctgttatcattttaagcttatcttttatttctttaagtatcatcaacatggttattttattgctgtctctgttagttataatatttgaaatcttcaccaccaacttttgttgcttttgtttctactattcttacttatgtgctttgcctctttatgagtgaagtgattatttattatgtgatagccatttcatggaaaattacttgtggagattctttgaggcttagtatgaagatgtttttcctgaaaaatatttgtctttgctactgctttgtacgtacactatgggaccacttcaatgatttgaggttgttttgttttaaaactacatgaattatattaatttgggctgcaaacatatccaagtgatttgcaaacatactttttggttacaaagtgagtcagtagtgtcccacctttatagatggtctcctattagactctccactttagacaggccctaggctttgtctctccctgatgtgcttcccaagtctgtaaaaatacctcactagctctccagtgctattaagaaaaaaaaagtgtatgtatgttctctttctctctctctttctccaattttagatattttaagcaggagatattagctgaacacctaaccttttatataattggatgcaagcattcaatttcataagcttctgaaacttagcaagaatagtactaaaagtataacatagaataaccttatgggcaaagtttattaaatggatatagctgattatgacacactaattttatcttttgtttgtgtgtgtgtgtgtgtgtgtgtgtgtgtgtccctttttttttttttcattatactttaagttctgggatacatatgcagaacatgcatgtttgttacatagtatacatgtgccatggtggtttgctgcacccatcaaccggtcatctacattaggtatttctcctaatgctatccctcctcttgccccccaccccccaacaggccccgttgtgtgatgttccgctccttgtgccatatgttctcattgttcaacttccacttatgagtgagaacatgcagtgtttggttttctgttcctgtagtagtttgctgagaatgatggtttccaggttcatccatgtcccctgcaaaggacatgaactcattcttttttatgactgcatagtattccatggtgtatatgtgccacattttctttatccagtctatcattgatgggcatttgggttggttccaattctttgctattatgaacagtgctgcaataaacatatgtgtgcgtgtgtctttatagtggaatgatttataatcctttgggtatatacccagtaatgagattgctggtcaaatggtatttctggttctggatccttgatgaatcgccacactgtcttccacaatggttgaactaatttacactcccagcaacagtgtaaaagtgtttctgttttgccacatcctctccagcatctgttgtttcctgactttttaatgatcaccattcttactggcgtgagatggtatctcattgtggttttgatttgcatttctctaatgccagtgatgatgagctttttttctatgtttgttggccatataaatgtcttcttttgagaagtgtctgttcatatccttcacccactttttgatggggttgtttttttcttgttaatttgtttgagttccttgtagattctggatatcagacctttgtcagatggatagactgcaaaaattttctcccattctgtagtttacctgttcactctgatgatagtttcctttgctgtgcagaagctctttagtttaattagatcccatttgtaaattttggcttttgttgcaattgcttttggtgttttagtcatgaagtctttgcccatgcctatgccctgaatggtattgcctaggttttcttctagggtttttatgattttaggttttacatttaagtctttaatccatcttgagttaatttttgtataaagatataaggaaggggtccagtttcagttttctgaatatggctggccagtttttccaacaccatttattaaatagggaatcctttccccattgcttgttttttcaggtttgtcaaagatcagatggttgtagatacgtggtgttatgtctgagccctctgttctgttccattggtctgtatatctattttggtaccagtaccatgctcgtttggttactgtagacttgtggtatcatggctttgtttaccctgtgaggggaaaaccgcctactcaagcctcagtaatggcagatgcccctccccctactaagctcgagcgtcccagatggacttcagatgactattctggcagcaagaatttcaagccagtggatcctagcttgctgggttccgtgcgggtgggatccgctgagcaaggccacttggctccctggcttaagccctttttccagggaagtgaatgattctgtctctctggtgttccaggagccaatggggtaccaaaaaaaaaaaaaaatagcttggtgtctgctcacatgaccacccagttttatgcttcaaacccagggccatggtggtgtaggcacccgagggaatctcctggtctgcaggttgcgaagaacatgggaaaagtgtagtgtctgggctggagtgcacccttcctcatggcttcccttggctagcggagggagttccccgatcccttgcgcttcccaggtgacacaatgccccaccctgcttcagctctccctctgagggctgcacccactgtctaaccagtcccaatgagatgaaacgggtacctcagttggaaatgcagaaatcacctggcttccgcttggtctcaatggaagctgcagacaggagctgttcttattcggccatcttgcctggaaaccctcaattttatgtttaatagaaaacaaagattttattcacggagaacagctcattagggttcttgggatgaggaggaataacatcaattacaaatataataatagctaacactattaaggatttgcagtgtaacaatttctcaaagtgctttacatttgttacgttttttaatccttataataattcaatgggatagttaatatttgtatccccattttatatatgaggagactgaggcacagagtcacaaataataaatagtacaaaagatgtcaggccgggcgcagtggcttacgcctgtaatcccagcactttgggaagctgaggcgggtggatcacttgaggtcaggagttcgagattagcctggccaacatggtgaaaccccgtctctgctgaaaatacaaaaatcagctgggtgtggtggcacaagcctgtagtcccagctacttgggaggctgaggcaggggaattgtttgaacctgggaggcggaggttgcagtgagccaagatggtgccactgcactccagcctaggagacagagcaagactccgtctcaaaaaaaaaaaaaaaaaaaaagatgtcaaacttgggtagtaagaatctaaagtactctatattaagaatctaaagtatattgttgccctagctgtaaaattaagtgaaagatatttttatttatgcgcagagaaaagtttcaaatatatcttataggggataggattaaaccaaaacatttgtacatttgtaagaacagttatcctgtagtgtgggagccatcacataagatcacataaatgttggttggtgaatgaatgcttttattatgagaaatactaatgacaattgtggtggtataataataaattataaggaaagtagtaacaacaatttacaattcttccaaattgtaaaagagagagattactcttatagtaaatctttctaaaaatgagtcaattaaaatatatttaatttcatgcctctataacttccaaaactcaaatactgtataatgtagtaaaaaatacaaataatacaacagcaaattcacttagagaggcagcaccacatagactacttatatttaggtaatgttatatggaataaactgaggaagaaagatctaagataatgatccaaatgagtgtaatttctagctcaaaaaatggttacaaatattattatagaaaacattgacaatatttgtagatgcatggcaaataagggaacagtttttgaaaatatggtaaaactaatgactttgcactcaactacagtcaactcttaattaactggcctaattagggtgaggtgaggaatagataaacagaaaatcacagattacctagaagtggttaaaacaaaagtaatttaaaatatgacataagtaaattttttaataatctagtattttggaacacagttcacagatatgatctgaaactgtaaaagtaatacaagtacttttatttaagatcacatgaatcatctgcccaaaattactgggctgttaaacaactttttttttttttttttttttgagacggagtctcactctgtcacccaggctggagtgcagtggtgcaatcttggctcactgcaacctccgcttcccaggttcatgtgattctcctacctctggagtaggtgggattacaggagtgccccaccgcacccagccttaaacagcttcttggtaaagatcttcgtattcatcagacttgagttaaccagacacatgactcttttctctttatttgctctcttacctgaattctaccaaaatcctttgctctgtgatattagaatacacctataaggctgtattaggcacctctgtgtcatctattggttactacaaatgtcttttgacatgtgggtattttattgatgtatagaattttaatgtgttcacaaatctactctctgtgattattactttagttatcttctaccagaaaatgaagatttgagtatccatacaaacatgtagtcatttagagaaactcttggtcaaatttacctttgctttgcttctgtaaaatttatctataaattttccatgttattgattttttcataagtttaatagataagactgcaatctaattctgtatttagttggataggactaatttgctttgtttcttctaaagcactcaaattggctagtatatctacctaaaaatatctgctaaattgaattactaaactgaagttgttgaatttctgagttacaaaataaaattagaagcaaacaaactctcatgtcttggtaccattttatagttattgggaagaaaaataaagtttcagtaatttagttttagttacctgagcaaggtctcccagaagcaactcagtagagctaagactagaaatcaggtaagaactcttatgttagtgttgtttcatatcctatcggcattttcaaatttttttataataagctttatttttagaacagttttagatttacaaaaaagttgagaacatagtacagagttcccatatacctcatactcagtttctcttattattaaaatcttacatcagtgtggtatatttactacaattagtgaaccaatattaatacactattgttaactaaagcccacagtaacttcaggtttttttttgttttatctaatccagatcaattttacaagatgtttatgagtgttgttggggcagagggagaaaaatgtatcttgtggtaaaataaatttaagaaatgctaagtaaaaattagacatatttcttacctgaaaaattcagagcctttaagatgtataatttaaatctcaaagtagagtctaaaatgtgttatgtttcccaaaatgcttgggtaactgaacttttattatatagaacacttcaaagaacttctgttctgaggaataccctttggaaaattctgcactacactatggcccatgatattaacttagactggattaatttagatataaaattggtaaaactcaatttcattaagataatctcttaaaggatggctgagaaagtgtttagttcctagaggtggctattgaatgaaggttaaatctactctcctgacccagctccatggtaactaactcttcttgatgttttactctctgactgtagctagagcttaattatacaaagtctcaacaattaaacattcaaacataatccattaaaagagagaaagatgatatcaagtattttttaaacgaaaaatatccatggaattttagaataatctcttcagaatcacagcacaatgagaactcattctcaggatggtcaccaaagatgttacattttgatctgcagcttctgtttatcaagtcaggaaagtataaggatatattttgcaatagtttttaggcaacagtttttgctcagttatccagttttaaaaaatactgttaactataccaaggttagcccagaacattttagtgaattctctactgaaggttgcagatttctagtgaatagaaacatgtggtcctcatcaagtagttatgatacctatgtggactgatgcataatcagtacttttatatatatatatacacacacacaaacagatatacatacatattcatgaagatcacagagcagaaaaatgagtagttacgaaaaaccatagaatttgccatcacattaaaatttacccaatattaattcatcatttgtatgttcatctcacttcaaatacaaagagaaaaacatttcagtatataaaatcagagaacattattgaatttcatgtgagattttctagccacattttaaaatagggcaaaacaatagaaacattcaacttatcaagtaaatctcagaattgtatacttttcccaagaatgacttttaaagcaccaaataattaagatgttatgttaacatgaataatttcataagcaaatggaaaccacagaaatgcagtaatacagttctcagccattgttgtttgataatttgcatggtttaggcttttcaaattaagcaatacatagcattgatgaagagtggatgatgtgagcagagccacacaagcactgtccctccctgactccagcaataagactgatcgggcaacaggaacctgcctcagtgaagtgctttagcccgggcagtgactgcattagagatgctggaaactctgactcatgtttttgtggcttcttttcccctctcttgaggcacagaatagaacagaacagagaacagaaagcagaaagaaaaggggggaacagaggaagggaaatttcataactctctagaatatttcattgttcaactgtggtcataccttatttccatgggaataagtagtctgagttggttgtgcttgggattcagagcctctactacgccagagtaagcacacacttcacctttcccctgttaacatagtctagcctcaccctggccaaatattgaaaagtacaagacttctttctaaagtatctgaatccagtgcacactttcttgctaacagacaaattctctaagtgctgaaggaattctgatggggtttttaattttattaattcaaactagtaatgtttactcatttgttctagacagtgatcatacattgttcctgccaattgtttgatgcttggaggggcagagtcatagagaataggtaatatttctatctatggcccttccataaacagttctgacagattccacactatattcaacactcaggggctgccagctttccctaatatagctccctgaatatacttacagtttagctgagggattaacaaattcacaaaatctatatttcttaaggcaaaataggatttgtgtcttaagagaactataaagagaatgctttttaattgaaagtcttttaagagactcgtaagcagagtgtcacagaccaaggttggaagccacatttagttgtgattatcagaaagctttacatccaagtggtaagaatcttgagttggtgaatggtggaagcaaggcagaatccctgacagagaatgacaaattcagaagcacagagatagaaagaaaaaacaattatttaggagcagaaagcatttatttttagttggaacatagcatgtactgggaaggttgagagagagaactggaaaagtaaggtgagagcaagggagcattttatgtatacacctgtttactacatgtacatactgtaaatattggctttctagaaccatatggaattccagacggaaaattccagatgaaataatcaaatagcttagcgttaacactaaatgattgaactttatattttcagttttgggacaaaagtttttatgaagcacacaatatactctgtatcttaccagaacatattatatattcctcttccatggagccctaaaaattcctcaaatgtattttggaggaccaagaaaaagttgttaaatgagagaatgttcctcctattgcctctccctcattcccagggcagttcaactttttactgttttgcttgttagaagatatctacaatatttcatttgaagaaagtgttccatcaataaaacaaagcttgagccctgtaagaaattcttgtgtagtcatattactaagaaagtacttaatcattctcagcattccatttcatttaatataatagacataaatatcatggagagatgaatggatagaaacaagcacatggatggagagaaataatagtatttggtgtgggatcttttcatgaaaagttgtgtatgcaggaataagttaataacatattataaaattgggccacttttaaccatttatattttggggggaatagaaatcttattttatacgtggatttagccatttacaaaataacttcccaggttcttaagaaagatcagtgccaaattttctctacacttttgtacaggttttgtccttaattcaaaggctccctttaaaaatattcctctttacattctaagaacatgtaggtacttgtaatatttggcatgtgttttacctaacaaacagaaaaggattcttattaaatatatatttcccaaaattaaaataacagtgaatataattctagttatatttttaaaataaaatgtttcaaactaacatttactctttatataatcacaaatcactcattaatatttagattgcacaattatttaatatttgtcctatttagtctcaattcataattatttctgttatctaatatttttaatccaaatatccaaattccatttcaaatttttatactcgtgtaggaattcatgacatgagaaccatatttttcatttattgcacagcaaggaacaaatccttagagaatatcatccatagaaatataatttgcagcccagcacggtggctcacgcctgtaatcccagcactttgggaggctgaggtgggtggatcatgaggtcaggagatcgagaccatcccagctaacatggtgaaacgctgtctctactaaaaatacaaaaaattagccatgcacggtggtgggtgcctctagccccagctactcgggaggctgaggcaggagaatggcatgaacccgggaggcgagccaagatcataccactacactccagcctgggtgacagagcgagactccgtctcaaaaaaaaaaaaaaaaaaaaaaaaaaaaaaatatatatatatatatatatatataggctatgctggcaatcacattaatttaacaaatattgaaatatcgacactgaaattttcactgggctttattaagccatttctattaacatttaagggaatgtggtttccatatgcttttgaacagaattatatgtgggtcttctagaaaatggattaggctgggcgcggtggctcacgcctgtaatcccagcactttgggaggccaaggcgggtggatcacgaggtcaggagatcgagaccatcctggctaacacggtgaaaacccgtctctactaaaaatacaacaaaaaattagccagatgtggtggcgggcgcctgtagtcccagctactcaggaggctgaggcgggagaatggcgtgaacccgggaggcggaggttgcagtgatcgcgccactgcactccagcctgggcgacagagtgagacccgtctcaaaaaaaaaaaaaaaaaaaaaaaaaagggattaaggttttaggaacaaaagggatttttaaaatataccatctatcacatctctgcagttgttgactggaataagtacaatgtgaaagtaccacaagttagtaagattttaaaaactaatctttatgttatgggacatttagagaaaacataaacgtgttcaaaatattcttttatgcttaatagtatacattttcttttagtatattcaggaatgacaaataattaactaccggtgaatataaaatagagtgtctgacctcaggagcttacattcctgttggggataaaagatgtagtcatatttaaagataactgcccaagatcttatatcttatgcggtaaaggcatctggctacaggatctcaaaaatccctttaagctgaagtgatgggggaagattttaggaagcagtaagaatattttttggtcactgcattaatgggagaggactgaagctgtaaagaggaggaggaggccattcaactaagaggagcaagatgagccaaagtagggaggctggatctactccatgtgtttactaatttgtcgaggcttgattggctccagtgagaggtttctctaggagaacagcaagagtcagagctaaataaggaggatgggccagatatggagagggtgatcaagaaaaagagcctcctggcagtactataagtttcattattattatataatattttcacatttattctgtgtacctttctgcggcaaacagaataagcttccccatctccctcagaaaagccatcaatttccatttaatgcctggaatctatggtgacatgtgaaagaggaaggcataatgcgataggctgaataatagtcgccaaagataatcaggagtgactccctagaatctgtgaatgttagcttttacggtaaaacgtattttgcagctgtgattaaattaagtatctgagatgcaggggttattctggattatctggatgaaccctaaatgcaattataactttccttattagagggaggaagaaggagacttcagagaaagaggccgtgtgatggaagcaaaatcagagagaaaagatgctaagctgctgcctttgaataaggaggaacgtgagccaacagatccaagaactgaagctctaggcagtggaaaagccaaggaaactgatcttcccttcgagcctccggagggagtgtagccctgccaacacctttattttagccccataacagtcatttcagacttgtggcctccagaattttaagagaataaatttttattgtattaagccatcaagtttgtggtagtttgtggtaatttagccataagaaactaatacacataaggaatttgatgctcataaagtcataggaaagccagcactgggctctagcaggccggtgagagtgatccacattggctgccattagaacacaagaagccggaggatgaagagaggttgattgatgggtacaagcacacagttaggtagaagaaataagacgtagtgatcaaaagatcaccaggggactataatcaacaataatctattgtaatttcaaaatagctagaagagaattaatttgaatattcctagcattaagaaaagacaaatatttatggtgatggatatctaaattaccctaatttgatctttatacattatatgaatgtatcaaattatcacatgtatacccaaaatatatacatctattacgtatcaattaaaaaatagaaaaaaatccttagaacctttggccacaggaaatgaaatattttaatttcaatttataaatatattttgtggcagagaagtataataatgtcagcaataaaagactttcaaccataaaaaaattaccaacaaaatttatcatctagtcattttggtagagtttctcatggagcaaacatcagaacaaaaagttgtatctgtatctgttttatatatattattaaactcttaaaataatgcataccactattttgtgcacactaatttaagtaggccctttattccagatatagtttctgtacctatttcttctttataataaaggctatttattaaatattcaatataatatcaataattcatatagccttttaatatattttataaaagattcataaatatggaaagaaagtcttttgtgaaactgaaaaatgtaaaagaacgcaagaagccatgctctaatacagtcaccaggaagctcctctgcatggcagcctcaaaattggtaaaggggcctgggaacatatattctgccaccacctctaccacaactgcctcttgccacacagaaagctgaagaataggcacagaaatctgctacagaaaaccctctcatattctatcaagactttgcttgttggggctaaaaaacaaaaacagtaaaatgagttaagaggataccctttgccttactttcaccttcaaaatatctcaataatttcacagaggagactgagaaatacaatttttagctttccagtttctacagtagcaaaaatcatcctagaaagagagtgtaatgaaagaggagcaggtaaatccacagaatttacacaaagagtttgaggttattagaccactctaggcactatcattccctatgtttttatagaattactttctaagcaatataaattaatagaattaaccatggagagatcacctgttgtgtgaggagcatcatattaggtcaagatgggaagatacattaagaaagccttaacttctgctctctaagagagtaccttaatacagaaacagaactgatacctgcatagggttaatacaaattaaattatgtttaggaatgctccgtgataaaaatgagttggaaatgaatttaggaatttttcacatgggaggagagttttgaaagaagaggctttctctgagaggagagggaaatgcatttctgggtggtagaagacagcttattggcagtatggaggcaggagtgaatgtgttcatatgtgtgattatagttggttggtacaggagtcagcatggagaagttgtggaaatgagagtgctaagatgcacgtagttgctaagtagccaagaagctcaaattgaggaactgatttttcttagtgaaattgtcttgactttagtaaagtcattggactaggctctgataaaggaagttaggaaacagaacacttgcaaaattcattttgcggatgctgagttggcactcaaagggcaaaaggcaaaactcttaaatctactgctgatgagatttgacagaaaccatgccaaaaaatgtctcttttttcttttcttttctttcttttttttttttttacaataaaagtaacaatacaggtggtcaaaaaaacaaaaaccatggtatagaaaaaccataaattgaaaagtaaaagcttttcttatattccaccctgcctctgaatcttctgtcctaaagattgctgctattaactttcttacgtatcctttagaaagcacttttctgacataaggatcatgtattaatgtacacagaagggatcatgatatatgcacagtactgtccctgtccattgaaatcttctaatagacaacacatttacatctaacccattcttggtaatgagatttcaaaaaaatctcgttgtatagactttccatagtacatgtaaccagtttactgctgtaggatatttattgggttttttccccccagtttttacctatttgccccatttacctctcctggctcacatctgattacagcatgatttactcaatatattaggcctactgtggagacatactgctcagaaaaaaaagattcctttcatacttttctccccaacactaactctgctccagccacgccaatctcttacatatttgtctaacacatcagctgtaatcctgctttttgcacgagcattcctctgcctggaatactctttagatattgacttgcttcctccttcacaccttagtttctgttccaacttctcagtgaagctattcttgatcacagtatttaatattgtaaccccatcccactcctaatataattccctttaaaatttttctctgtagaccatatcagtctctaaaatattatattctaattgattgtactcgtctcttttcattaaaatataagttttataaagacagtaatgttgtatgttatttaattactacatagctttctgagtaaagaatttctagacatcttgtgtccaaccaagaacacaatctttacatcttattcttcattaatattattttattattatttaatctcattcttgcttcaaatacctcccctttcattctcagatatatcctagcactatagatttttcctttaataaatgttacttcaatatatattccttgtaaagcaaagtaataacatgtggtaggcactaatttaaaaaaattgtatcagtcaaataaataaattataaccctttctctaacaaagggatgtaagtaatgctgttctatactttgataattatcctttaacttgatttttagataattgttgcctagttaaagaaaaccatttggttgcacaaggaaacattctaattgtaggtgaaattgacataggatgtatattagtccagattctctacatccataatggaaagaaatagtaatgactgcagttaaaatgtaaatgatatacatgataacagctttcaataggcagtgttatttaatacaggcataattcattttattgtgcttcacttgtggcactttgcagatatggcatattttataaattgaacatctccggcaaccctgtgttgaacaagtgtgttggtgccattttcccaaaagcatgtggtcactttgtgtcactgtcacatttttataattttcactatacctcaaactttttattattactatatctgttatggttatctgtgatcagtgatcatttattttactattgcaattattttggggtgccacaaaccatgcccataaaatattacaaacttaatcaataaatgttgcatgcattctgactgcttcattgcctggctgtctgctcatgtccctccctctcctcaggcctccctattccctgacccacaacaatattgatattaggccagttaatacccctacaatggcctctaagtgttcagatgaaaggaagagttgcacgtctttcatttaaattcaaaagctagaaatgattaagcttagtgaggaaggcaagttgaaagccaaaagtcaaaaggtacgtctctttcaccaaacaaccaagttgtgaatgcaaaggaaaactttttgaaggaaattaaaagtgctacttcagtgaacacatgaatgacaagaaagtaacacagccttattgctgagatgtagtttgaatggtctggatagaaaaatcaaaccagccccaaaattcctataaaccgaagcctaatccagagcaaggccctaactctcatcaattctgtgaaggctgagagaggtgaggaagctgcagaacaaaaactggaagctagccgagattggtttaggaggtttcaggaaagaagccatttataacaaaaatgcaaggtgaagcaatgagtgccaatggaaaaactacagccagttatcctgaagatctagctgagataattgatgacagtggctacactaaacaaaatatttccagtgtacacaaaacagccttcttttggaagaagatgccatctgggactttcatagctagaaagaagtcaattcttggcttcaaagaacaggctttcttgatagtggctaatgcagctggtaactttaagttgaagccagtgctcatttatcattctgaaaatcctagggcccttcagaattaagctaaatctatgctgcctttgctcaagaaatggaacaacaaagactagatgatgatacacctgattatagcatgatttactgattattgcaggcctactgttgagacctactgctcagaaaaaaagattcctttcaaaatattactgctcattgataatgcacctagtcatccaagacctctgatggatatatacaaagaagtgtgttttcatgcctgctaacacaacattcattttgcagcgatagatgaatgagtaattttgactttcaagtcttattatttcagaattacattttgtaaggctacaactgccatagatagtgattcctctgatggatcttcgcaaagtaaattgaaaatgttctggaaaggagtcactgttctagatgccattaagaacattcatgattcatgggaggtggtaaaattatcaacattaacaggagtttgggagaagttgattccaatccttgtggatgattagggggttcaagactttggtggaagaagtaattggaaatgtggtagaagcagcaggagaactagaattagaagtgtagtctgcagtcttacagtaaaatttgaatggatgaagacttcttatggatgagcaaagaaggtggcttcttgaaataaaaaccactcctaggaagaaactgcatcaactaacgagcaaaatcaccagctaacatcataatgacaggttcaaattcacacataacaatattaactttaaatataaatggacaaaattctgcaattaaaagacacagactggcaagttggataaagagtcaagacccatcagtgtgctgtattcaggaaacccatctcacgtgcagagacacacataggctcaaaataaaaggatggagaaagatctaccaagccaatggaaaacaaaaaaaggcaggggttgcaatcctagtctctgataaaacagattttaaaccaacaaagatcaaaagagacaaagaaggccattacataatggtaaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaacattagacagaacaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaataatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaatctagcagaaggcaagaaataactaaaatcagagcagaactgaaggaaatagagacacaaaaaaaccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcagtatacgcaaatcaataaatgtaatccagcatataaacagagccaaagacaaaaaccacatgattatctcaatagttgcagaaaaagcctttgacaaaattcaacaacgcttcatgctaaaaactctcaatgaattaggtgttgatgggacgtatttcaaaataataagagctatctatgacaaacccacagccaatatcatactggatgggcaaaaactggaagcattccctttgaaaactggcacaagacagggatgccctctctcaccactcctattcaacatagtgttggaagttctggccagggcaataaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtaaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagaaccctcagaaataatgccgcatatctacaactatctgatctttgacaaacctgagaaaaacaggcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggttgtggagaaataggaacacttttacactgttggtgggactgtaaactagttcaaccattgtggaagtcattgtggcgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagtctggattaagaaaatgtggcacatatacaccatggaatactatgcagccataaataatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgttgtggggtcgggggaggggggagggatagcattgggagatatacctaatgatagatgacacgttagtgggtgcagcgcaccagcatggcacatgtatacatatgtaactaacctgcacaatgtgcacatgtaccctaaaacttaaagtataataaaaaataaaaaataaaaaaataataaaaaaataaaaaaaaaaagaaataaaaaccactcctggcgaagattctatgaacattgttaaaattacaaaaagggatttataatatccataaacttagttcataaagcagaggtggggtttgagaatattgactccaattttgaaagaagttctactgaggaaaaaatgctgtcaaatagcatccccatgctatagagaaatattttgtgaaggggtcaatcagtgtcatgaacttcattgtcttattttaagaaattgcacagccacttaatacctttggcaactaccaccctgatcagtcagcagccatcaatattgaggcaagaccctgcaccagcaaaaaaggttacaacttgctaaaggcccagatgattattagcattttttagcaataaacattttgaaattaagttatgtacttcttttttttttttttttttttttgagacagagtctcgctctgtcacccaggctgtaatgcagtggcatgatctcagctcactgcaacctctgcctcccatgttcaagcaattcttctgcctcagcctcccaagtagctggaactaaggtgcccgccaacatgcctggctaatttttgtagttttagtagagatggggtttcaccacattggccaggctggtctggaactcctgaccctgtgatctgcccgcctcggcctcccaaagtgctgggattacaggcattagcaagttatgtacatttctttagacataatgctgttgcacacttaataggctacagtgtcatgtaaacataactttttctgcacagggaaagcaaaacatttatgtgactcactttattgagattttgactttattgttttggcatggaaccaaactggcaatgtatgcaaagtgtgtctgtattcactaaataatagttttgaactttatgattgcagtaagtttatatcagtttcacttcaattttttagggttgcataatttgccacaattttcatcagatattttggaatgatgtagcagaatacatcaagaaaatctccagttcttttgacaatttttgttagagctttttgattcttaccctcatggaaatacttgtgtataaatatagaaaatctcagattaaattattttcttggtagccttgcctgttcctattaagccacagaaaatattaataaggtgaatatgttaactttatttttcaaattattgttaatctcagcatactatgaagaacatgaatgtactgtacacacaaacaacttgatgtctcactaaatgaaagacacatgtgcattagatccatctacctttcaggcacagtcatggggtttttaactccacaacattaactggaattgtggaatacagataagatcataattgcaaagatgtgatattccctgaagaattttttatctatgatcaaaatgcaaaaaatttaatgtgttatggtaatgttccttattatccatgattaagtcacaccaaaatggcacaaagaccaggaaaccagccaagcattcactggaggcattactcagtgtctgagagattcagttgatttatatgaattaaggaatattttactatctagtatgtatcatttaaaataaaacaaaccttctaaagatgataattgtaaacatttgaattgtgtttttaattggaaaagtaatgagcttgtactgttaagctgtttcttattttatgttctatgctttcacaatttacatttacttacttgtaaattgtgttatctgaagaattttttccatatctgatgtctgcataactccggaatattgttagacatttaataggaacctaattataaaacaaatttatttactatgtatgccattaaaaacattacaattagcctgtttaagcctcaatgtatctcagcgctgaactctatcaaatgctatgaactcacaattttccatgactttatatgcaattaaagacctcaatgaaattatttatgtttttatcccccaattatatagtacctactctgtgccaggcaatatgctgtggactgaaggtaccaacatgaataagataactttccctcactgggtgtgataggctgaataaccactccctccatctcccccaaccgccgcatgcgcatgtcctaatttgtggaacatgcgaatgttatcatatggcaaagactttgtgggtgtgatcaagttaatgattttgattatcctaggattatcctggattaccaaagtaagcccaaatacaattacatagatctttataagagggaggcatagagagatttggcacagacagagaagaaggcaaagtgacattggaggcagagattggagagatgtggctcccagccaaggaatgctacaaccacaaaaagctggaagaggaaggaacagattctcacctaatggccttggaggcaatgcagccctgatgataccttgattttattctggtgttactgatttcagacttctggactccagaactataagagaataaatgtgtgttgttttaaacaaccaagtttgggtaatttgtcacagcagtcataggaaataaatgcactgaggaactcaaagtttaatgaaagagacaaacacaaaaaataattgttatagtacagcaagagccctattcgaagtatgtgggagcggatggggagcatgggtggagtattgactctgatggatctagttctttaaagctacttagaagatctgaactgaagcttgaaataaaatagtgttttccaagcagggaagggagtacaaaaatgcagaaaccaaaaaaatatggtgagttttataatgcaaaatggtattttgaaatgcacagtttaaatcaggaaataattagccctaaaataattttcattgattttaaatttttgattactcatatttatcaaaaaaaagtatatggctgtaaagtatccttggaaaatgtaatagtaaatatactacaaataagaaaatgaatattacagcattacaaatgattttctatcattgcttgttgctgaggattttagagaggttgttacacagaaatgttaattaaaccatatcaacagtaccatactttaatcagttggagagaaattatttattctagttataaaaataattaccaattcctcaaattataataaaaataaagcaacagttttaataaaaatatttctcttctcttcattttttttttgattaatacaaatttttgcttagatgtttttggccaagtgcaaaataaatagaggtcatttttcttgtgttctcttgtgagagttgaacagtaaaagtagtaaggatgtatgaacaaaaatatctgatactgtgtttggaactagaaattttgcagactagacagaacttgggtgagttttgaaatatgttttcaaggttaatttcactatttgaggaagagagaatggtaaagaaaagatgttataagccaaatgaagatttactgtggtatagatcaggtatcagtgatttagcaatgaaaccaaaggaaatgataaattataatatgaaggacagtttgattatccagagatgataggataagtttatatcagtttcacttcagttttttagagttgcataatttgccacagttttcatcagatattttggaatgatgtagcagaatacatcaagaaaatctccagttcttttgacaatttttgttagagctttttgattcttacccccatggaaatacttgtgtataaatatagaaaatctcagattaaattattttcttggtagccttgcctgttcctattaagccgcagaaaatattaataaggtgaatatgttaacttttttatttttcaaattattgttaatctcagcatactataaagaacatgaatgtactgtacacacaaacaacttgatgtctcactaaatgaaagacacatgtgcattagatccatctacctttcaggcacagtcatggggtttttaactccacaacattaactggaattgtggaattcctgtttgtttttatcagtggtctaagataactcttctattgatcaaacattaaaaatattttattcatgtaaatatctttgtcaatatccttatccttgtcaatagatgtaagaggaaaagtagaaagtgttgatcaatattttgggatttctttttttaagtacataagatgccattggcttttgccatttctgtagctttttagtgtagctaaaagaaggaaaatatagtttttagtattctaggaagacagacacatacttgaattccatacatgttcatgccagtggggtattcctatggcagcctttgtttcctcccaatacattctaatgattagccctaagactctgctaagattgtgaagtatttgacattaggtagtaccttagggagagtaaagattttgattgactcaagataatatgcatagaatcaccatgcaaattcaagaacaaagccactttataaaagcaaactaaaagtaatttgaaaatagacttactgggaactcagaagatttacctcagtctcaggtgatcatgtagaatggacggcctccccacctttggctactttgggaacccttcaagtgatttttttaaagttccttcctagaacaatgtagcacaatcccatcttctttggcaggtaggtgtctcctattttattccctagtatgagcttttgctagtcaacatttcccttttgcaatgaggctggaaatgtttctgcctcctaataaaagctatcacatatttgagcatgctgttttttagagtccatgaccttatctgctttcagccagattctcttactacttataggcaattttcttccaaatttcattttattttgttattattcataatggaatctgtccttaatttttttcttttttcctataagttttattttaagttcaggggtacatgtgcaggacatgcaggtttgatacataggtaaatgtgtgccatggtggtttgctgcacagatcatcccatcacccaggtattaagcccagcatccattagttattcttcctgatgctctccctcccccaacacccctcaacaggccccattgtgtgtgttgttctcccattgtgtccatgcgttctcatcattcagctctcacttataagtgataacatgttatgtttggttttctgttcctgcattagtttgctgaggataatggcttccaactctgtccatgcacctgcaaaggacatgatctcattcttttttgcgactgcatagtattccatggtgtatatgtacatattttctttttccagtctatcattgatgagcatttaggttgattccatgtctttgctattgtgaatagtgctgcaatgaacatatgcatgcatgtatctttataatagaattattctatttctttagatatatatacagtaatgggattgctgggtccgatggtatttccggttctaggtctttaaggagtcaccacactgttttccacagtggttgagcgaatttacactcccactaacagtgtaaaagcattcctttttctttgcatcctcaccagcatctgttgttttttgactttttaatagccattctgactagcatgagatggtatctcatatgttagttggctgcacttatgtcttcttttgagaagtatctgctcatgtcctttgcccagtttttaatgggcttgtttgtttcttccctgtaaatgtgtttaagttccttgtagactctggatattagacctttgtcaaatggatagatagcaaaaattttcacccattctgtaggttttctgctaactccaacgatagtttcttttgctgtgcaaaagctctttagtttaagtagaccccgtttgtcaatttttgcttttgttgcaattgcttttggagtctttgtcatgaaatctttgtctgttgctatgtcctgaattgtattgcctacattttcttctaggatttttatagtttttgggttttacatttaagtgcctagtttacttaagagtttttcaatacctagtttattgagagtttgtaacatgatgtccctaattttttaaccatgattaaaagaaattttaaaatccttctaaccaagcttgagccatatagcatttaatattctttatgggaaaatttgtttgggatctatatattctactaacatgacattttccaggctttgaactacaatatggtttatttcttgaagttttgcttttacaagtgtaattttgacattgcataatgtgagttttttgtaatgtacagttacatttcttgtattcttatagcaaccaagtcgtgccagaaagcagcttgtaatctatttcttaaagattgttaagagaagtagaaaatctaaagaagcatattaagcatcccttgacaatttgacactagcaaactgccttcctcaattgcttgtccccattcccagaggattgctaaggaattcttattgctgttccgtgaatatatatttcacaatgaacaatacgctgtttttaaaaaaattgcttttttacacctaatggcatacacctgcacgttaatcagagataaaagctcatcatgaatattgaattgctagaaaatgctcttcaggggaaatatttctatctatatttttaaacttgtttgttttgcttattgaagtgtaattaacataaagtaaaattcatgcttcttaggtgtatagttctgtgaattttgacaaatttatatagtcaggctgggaacatttccatcatcctaagtttccttataattatttgtagtcaatcctctttccccacacccagccctggcaactgctgacctgatttctatctcaagagtcttgccttttccagaatgctgtataaaatcctacagtatatagccatcttgagtctggcttctttcatgtagcataatgccttgagatttttccatgtagaaatatatcagtatgtatcattgcttttttatgagtagtagtccatgtggggatgtaccacagtttgttcatctattcattcaccttataaaatggttcactagtaataatttcattattattaaatttagctgttattttatgtattcttatacaaaaaggtaactatatggggtgacagttatgttaattagcttgattgttgtggttatttcatattgtatatgtatataaaattttcaaattgtataccataaatatatacaattatttgtcaatcagttatcaataaagctgaaaaatatatgatgaaaaagtttaatttatttcaggaaggactaaatataccatgatgattaaaggagtaaaacctcaattagtgcaaagaagtttaataaaattcagcactcagacataacaaaatgtctttgcaagctaggatttatgagaatcttctcatgtatacaacacacaaacacaagaaatagaaacacttcttctcaacaagatgcccatgatcactacttccattccatactgtattggaggtcctagccagtgcatgcatagcacaaaaagaaataaaatatataagtcttgaaaagaaagaaacttttcaatatttctattagtccgttttcatgctgctgataaagacatgcctgagattgggaagaaaaagaggtttaattggacttacaggtccacatggctgggaggcctcagaatcatggcgggaggcaaaaggcacttcttacatggcagcagcaagagaaaatgaggaagaagcaaaagcggaaacccctgataaacccatcagatcttgtgagacttattaactatcaggagaatagcatgggaaagactggcccccatgattcaattacctctccctgggtccctcccacaacacgtgggaattcagggagatacaattcaagttgagatttggatggggacacagccaaaccatatcaatattcatagtgcatattattgactacatagaaaattcaaaagaatctataggtaaatactttgaattaataagaatatttagcaaagtggcttgatacatgacaaaaatgcaaaaattactgcatttctatacatcagcatcagagttagaaaatactttcaaaatatacaaggattaaataataaaaagatggagcaaattgtaaaatttaaaggacaggaatattcagtatcttaaagatttttattctttctccattatttgtagtttcacttatttgtcatcaaaattctaacaagattttggcaagctgtttctgaaatttacatagaagaacaaaaggctaagaataaccaaagcaattctgaagaagaataaagtggggaaactttatctaccagaatcatgacttattatataggaataatagtaaagcaagatattagcactgggatagacaacagataaaggaaagaatggagcaagatactcatgcatatatacaaatttggcatatggcaaaagtaacaataaaattcactagagaaggaatcaactatataataaaaaatattatgacaattgagttttttatttttaattttttaaatttttctttcagaggtagggtctcattatgttgcccagactggactccaacaactcctagcctcaagcaattctcccacttaagcctccttattagctgggactgcagacatgtgccactgcacccagcaagttgattttttatttaaaaaataatgaaatttgatcccctcctcacacctacatgaaaacaaatttcaaatgaatttaaaatgtgaatataaaaggcaatagtttaacacttttggaagaaaacacaggagaatatttttaacgtcttaagagaacatattcttaaataaggctgaaagagtgcaaccccacaaaagaaaaatgtataaatttgaccacattaaaataagaagtgttggtacatcaaagaacattataaagaaaatgacaacccatgcagtgagagaaaatatttgtaacccatatagctgacaaagaatttgtattctctaagtcgattaaataaaagccaagaaaacaatagtaaaatgggccagagacttaatcagacaatcccaaaaggaaaagcacaaatagttttgaaacatataaaaatatggccgacatcattacttctccataaaacacttattaattttaaagggtacaagagaaacttttcagtagaaaagcatggtaaccttgtgatcaaaatcaacatcatcagtaatggtacaaattgaaaccatacaccaccttgatcaaatgcaataggaacacagcagcacttctgtaatagtcctaccaaaggtgcacaactttaatcaaagcatgaggaaatctcaaacaaactcaaattaagtacattccattaaattaactggccaattatcatcagaagtacctcaagaaatgactgaggaactaaggaagaagcctaaagtgatgtaactgctaaagtattgtgtgatttgggacattttgaggtaaaggacattagtggaaactgaatggaggttgaaaattagatggcagcaatgtatcgatgttaattttctgttttgacggttgtattgtgcttaagtaggagaatgtttagaaggacatttatggtcaccagataacaaaactattcagaagtaacacgggcatcatattagcaacttattttcaaataatactcttcccataacttctttcaacataaaagggaattttttaattctacaaaaagatataattttaatcattttggcaaatatttaaagttctggcaatatgaggtattgaagaggaattgatccacaggaactcttatacactactaaaggaagtggaaaacagtatgacccaggaattcatactatgcaaagagaaaatctagtacatatgctccaaaaattcatattaaaacattcatagcagcattatttttgcaaaataaaataaactatataattatacaagatagtattacacaacattgaaaattaaaaatatttatagatgaatcatagtttcttaatggtgagtataagaagaacactagctacagtgattccatttttataaagctcaaaaataaagcagcatttatacaagctattatttagttaggtatatgtatacatgtaataaaacttttctttttaaggcaagagaatgattaatgcacagtataagagagggttatacttatgtggagaggcagggggagcagattggatataactacattggtaattttgggttcttaggtggtagctttgcaggagtttaatatactattatgccctataacatgtatattacatattatgtctattataactatatgtatcaaatattacataaaatatttttgagtaattgaaatcattgaggagcaatttaagatagcagttttgggttttcccttttaatgctggtaagaaaacattttaaggctggagagaaaggggaagacatagcaagatctatctgtcaggacatttttttgactaacataggcaaacagtaaacacaagaaaaccctgggactgaaaaattaaaatatttcttggtattatatcccaggggccctggttatttgagactatttaaaaccatccctacctacctcatcattaaaatacagcaggaataggtagatgcaatactctagtcatctctgatgctgtgtgccctcctggtgtagtttaaccaaagttctcaatagaagtagattctgttgtgctgatttttttgtttgttttaaagagtctctctgaagcagaaaaactactccaaaaagtctttgctcttaagtatagagttccatttctatttatcagatggtgctccaacacatgaagaaaacaagcaaattgattatgtaacaaggtagacaactttataaacacagactagtgacccttggagctctaagattcagtgttataaaacatagatgcttcctgacagctttttcatgtactttgtttgcattgaatccatatatatggtattggagaggaattgatcaacaggaactcttacacactgctaaagggagtggaaattagttcagacactttgaaaaacaacttggcaccattttgtaaaagatgttaaacattcacaaatagtatgacccaggaattcatactatgcaaagagaaaatctatgtatatggagtcagtgcaaacatttaaactataagcaaaagaaaaatttcatatcgagctcacattctgaggtactataaatgaatgtttaccctgcagtcattgattaggtagataaaagttgtgtggtcactaaacattttatttcctgttgaaataaaattctttgaaatggaggtgatagaatgtaaactttattggcacaacttttcctagtaagaagcagcaatagatatctgtcacaaagataattgactgaaaaaataaaataatcgcttcatcataaggataatagagcaaagcagcagcagaagagttgatatctgaacatctccaagtacccgtttttgtattttccactacttcaggatggatagtaccaaatgacttcaacagaagtggagtgaacctgttactaataaacctgggactgatgtgtaattacgttttcagtgattcatctgtgaaacaccctgggttattttacatggaagcatctggttcacatgtgtccagtggttattctgtggtgactgacatctgtattcttctaataaagtcccagttgcacagatgtgagctgttgccttcttataaagacagaacttacaattgaaaaatcctaagcttaaactcttcttgaatatgaacatttcaatcttctacacacacacacacacacacacacacacacacacacacacagaaagagagagagagagagaaatggaccacttgcactgtgtctggaacgtaatataaatatttcatgcagtgtctttcaatcattggacatatgtatgtaggcacctttatctctttttatgtttgtttatagcatagcatctgttttagattgtaagctcaaagaaggcagtccatgtcaatttaatattatacagacagtgtctagaaaagcataattcacttttgagtgcttgctaagtatttgtcaatcaagatggtgatgttaatgactttcaggaaaaatggagtttataatctgactgtaaacaccttttgcactataagaggtaaatgctgtacatggacttgcttcttatttcactcattatcattagacaggtaacgcctaaaactttgttgttttgagaaaaatttatttatgttagaataatcctctagtgatgtgtgatatatgagattttaaagtggcagacttcaaggcatgtttcatgagggaagtagcattttagctcagccttcgagggtaaatagaatttggacacataataatgaagggaaaagaaggagaggccattggtgaagagcatggaggagacaggcaggcatgggttcaagtccttccttggccagtaagttatgagacctcagtgaatcagtacgatatctaagggtttgctttctcatctgcaaaatagacacatattattgtgacaattacatacataacaagcttaaacacagcatttggcctaaggagaacatttaatacttgtggacagctgttactcttaggacaaattagccattttgaatagactttcaacagaattttgaatattgaacttgaaaaaaaaaatacttggagggaaactctgggctatgtgtgaagatctaaaacttctaatggaactcttatttgcacagagaaagtcaaggtccacttcttaagacatctttttccgtcttaagttagtcttcaattacatgtgtggcagagtgacatcaaagtatagtcatgtattctcaaattaaaatgtcaataccataatgaataaaatactttcaatgtgtgagttacttttctttcttagtccttttatttatcttctgcatgctagacttgtaagtattgtgggctctgactctgaatcctatgaaaaactcctgtttgccttattttcaagttaataataaccatttattttatgtgtaagaaagagtttgtcctatacacttgcataagcagacacaaaacacttatcatctgtaataggtcatgtgacctcctctaaattcctcaaagagaaattaacaaaaataacactcagtgtataatatttatgaggtccacttctcatgcatagtatcaaaactttttatcactggcaaggaagggggacagtgatctctaaagagaaacctaaagaatttataaccacgttctattttggtaatatgcaaatattttactaaatactctattcctccaagatttaaacctttttttttttttttgggagatagagtcttgctctgtcgccaaggctggagtgcagtggcacaatctcagctcactgcaacctccacctcccaggttcaagcgattcccctgcctcagccttccaagtatcggggattacaggtgtgcgccaccacgcctggctaatttttgtatttttagtagagacggggtttcaccatattggccaggctggtctcgaactcctgaccttgtgatctgcccacctcagcctcccaaagtgctgggattacaggcatgagccacggtgcccagcctaaaccttttttttctttccaggtttatatttataggaacaaccactgtgatagttgtttccattaatgtctttgtatctatgttgtactttaatctttctataggaaaaatcacatcatatcaaaatagaactttcatttaaaaataatttaatttccaggtagtgaaaaagcatatatgctactctcttggttgtaagaactacttcttactctaacattcctaggaataaaaacttccaggaactgtagtgttatagttaactattatccattagaattcaacagaccagttaccttaagaacattacctagaaagagtatattcaaggatgttcattgaaatgtggtttacaatatgggcatttaccttgtttatgatttttgactgtgaataaataatcagttatatttttaaggtacctcaatgtaacggaatagtatgaggttattgaaaatgatcaaactattatgtagacctgtaattattgacaaaggaagatattcaccaacaaattattaagggaaaaaatggtataaactcttttataatacaactacttttaaaaatattatgtacatacgtacattatatgtatgtgtgtgcatatatatatatatataagatagacactaaaatatcaacaagtgaaggcacagatgattatctttattttgtcctttctatttttctgacttttctaaagtttttgcaatgcatatgtagtgatttatataccaaaaaataaataatttttgtggttactgggatctgtataggatttagaatttctgtggtgtttgaaatcttactcttcttaagaaatgataagggaaattcattatttgtttttaacctaatatttattttaagtagtaactgtttcacctaaagaatatttatttgattatgattcaacactcaaaataaattaaggagttgagagaagacagaaaatttaaatttatgactttgggtgaaacctaaaagctgtgctattctcctctgtcctgaaaatacaatagaattttagacctagaatggaccttcaaatgcagaaattggcctgttaacccaccctacctaagttttagatatttgcattgggtttgtttggattagaatggtctatcattattgtaataaaataaaattaaaatataaaactttttccttaaatatatggtggcctgatatagcaatcaactcaattttcgttaagataaaaattgctcaggaaaacaattattattgttagaataataattacttataattattaacaacaaagtattttttacaagttatgggaaattgtcacatagtacacatttaatagtattttatgtgtaacatgagaaattttttgtacatatctacaaatacaaaaaagccttctgtaagagaagatgtgttcctgtcattagatttagaacttgaaatggatttttaatcctataaatcagtactttatacattcttcactgtagcatattataattaattgtttaatatatttttgatcaactagattgtgagattttcaaggacaggagtgttgtttatcttttcatctcagaggctagcacaatgcctgacatttagaaaatattggttgaagtaaggaatatatgaaaaacaggattttacaattgagttgactattagttaaatttttataattgctacctctaatagctcttctatatcatagactaagtagtctttatagaatggtctgaaaatatctgttatttataacatttctgaaaaatctgtcctgagtttaagtttaaaaataagctttttttaaaagaaaaaaagaccatttcttaagttgcaaatctcctgtatgtggaaaactacacataagcaaccatggttcctgccttctgaacacttaatattcttacagatgagttttttttaattgttccttttagtcacttccaaattacattgttacagaaaagtgttcagtgataaaaataggaaatattgaacatcctttttctcttacaatatgacaaattggcctatttttatagaaggcaataaaagaatatactttagccatttaaaacattaagatttaagtttttatcatctgtagaagcccaataacattttgaagggaattttggaagttatgtatattttaagggaaataacgatcagactgttgaattcagctaaatattttctgtgcatatttatagcctgttcagttttcatggttgtcttttcgggctgcatgtgaatttatgtatgacaactttcctaattccagacaacttttagaatttcttggtttaacattttaatttctgtttatgctttctgatttttgaaatctgattctttttcttggttggttattgattgtgagattgagggtaataatttcctattgataatggggtcacatttcagaataaaggatgtctagagctgaagactttatttcagctttcacttacttaaattatcaagaaagaagtatgattgcttatttgccctgttgtttctcaatagccagatataagagatttaaattgactaacattcataaacctttaataataataatttaatgaagcgtaggttaatagaaaactcaactaactagtcttccagtagttgggttgtgagtgtacgtgtgcttagaagttgaccagcatttgttagtgagacttttagccattaggtttgaaacgccattcatttaaccacaactttctcttcccaatcattccagtagggtgggatataactaagttaatggtgttagtgtaaatttgtaaacatttaaatttataaacatccaaaactacttgaaaataaacaattgaagttacctcataatggaaagtgagccaactactgaccagctatagttgtcagaaattaaaatttcatttctgagccaaaaataaggtttaaatctttttctaagtgatagcatttctaaaaagtttataatgttgtcctttgatttagaatggattttattctgtgtaaattgtatatgaaacttgctatagcttttttcacactcaactctaagagaaaaaaggcaaatacccttgacaagaggatttttggtaaatttattcaacagaacctcagttctttattataaggaactattcttaattctgaatgaaacaattctaaatcattgtccctgttctcaagttacttacaatataagtaacaaagatgtccacaattaagtctttggttgacactccttccattgagaggtagtttcaatatgtgtgggattttttgactcatttataaatagtagaatacaggagaagtgatgctgcgtgatttctggaggctacatcagaaagggcaactttgtgcttagagccccaagttgttatatgtcagactacctgagacttccctgtagcaaggaagccacaccagtgtacgctctccagtgggcagccctagtctttgaggccttccaacccatccaccagatatgaatgaaagagcttttggatggctctcagccttgtttccaccccagctttctagtgttctcagctaagacactaacaccttggagcaaagacaagccatccacgctgtgtcctggacaaattgcagactcacagaaaatacaagcataacaaaatggtctttattttatgccactaagtttggagtggtttattacacaactgtgattactggaacaaagacttacttgatttagtatatactatgagtgaataggagataaggaccttctttcctggaggagtcatgggaagcttcacagaaacaatgacatatcaacttggcaagatgatgaccttctctcccggaagagtcgtggaaagcttcacagaaacaataacataagaacttggctttgaatgatgatactactaagacatctactaagtagagaaggtagaagagtcctaaaactgaggaagctgtgtggaatagcctggaggctaagaaagaagagtgtgtttggtgaatgacaagaagtttggtgtggaaagagcaatagatggttagatccagaatggtagtcaagaagctagaagttgtacaataatttttttgttatgccaaggaaatttcagctgtagccttgtaggactagaaagtaataatcaatttgccttgtagaaagataactaattataagctaggctaaaagggaaagaagtgaaagacaaggagaacagataatagttacatacatagttcggatgacagatgattgaggctgagatatgtagctttcttgtaatagcaaaataagatcagttagataacaatggttgtttgaattggtaaattaattatgtattgaattcatatggtcaaggcataataatcaaaggctacagtccaccctgcattttggcaaattaaatcaatgcctttataaaacattaattttattaaatgtattaatattgctgaatgacatctaaaagcttcctccactatgaagtttggagaattattattttttaaactcatttttgtatttctattaagccattgattatagcaggacatttaaagaaatgagacattgtatcagttaatgcactaatggaaccatgtgttataggcactctgttcctcaaaatgaacatcagttcagagtaaagtcctgaaaaaattagtaatttgtgtaatcataaagattttacagtgggaaaatgtatatagtgtgttcagttaatatagttaagtgaacataacacagctgtggtcaacggctttctgtatggatttgattgacttttaaatagcatttgaaattacttcacgtatttttagtgtgataaataaaagttcagtagtgacatataactttttattgaaatcataataccatacatattagagacttttccagggcaaaaaaatggctggataggtctttctccagtaattctgagcgtagactgtgtccccacagcttgtgttgcctcatctacacagcaaattgctgccaattgtggaatacggtgatctgttttaaaagccttctgcctttctgaacattttggttttactttacagtttggttatatttaaaacatcaatttaaaagtttaatatttttaattcaaaatcaaaagtgacagaattttatagattatttccatctgacttcttctagtgctgacccctttttaatatctttaagaaagaacaccttccagaatttgaatagtcttgctttatagacccacttttcattcacacatgagtcttctttaaaaattcaagctgcaaaagtaacacaagaagagaaaaccaaacaccacatgttgtcactcataagtgggagttgaacaatgggaacacatggacgcagggaggggaacatcacacaccagggcctgtcaggagatgggggtggggtgggggagggatagcattaggagaaacacctaatgtaaatgactagttgatgggtgcggcaaaccaccatggcacctgtatacctatgtaacaaacccgcacattctgcacatgtaacccagaacttaaagtataataaaaaaaaaaaattcaagctgtagaattatccttagtcaaccatttcatgtaaagcctagagaaatattcagcagagcattaaaccaaatatgaaggccttctaagcttgtggccctgtgcgattgacagcacaggtcacattcccatgatggttctttaacaaccagccttgctctttagaaccattgtagtgaaacacagcattctgttttgttatcccctagacaagggctaccgtaagtttgtatttaagggaattcagaagttcagcattacttctgccttggattgattgtttgctcactttaaatcccatgtgtctagctcagtctctgacccacaatagacactcaataaatagtggatggggaagtgatagatgatagtggtcgcgagcctgtctcaatgattctagttcagttatctctagataagacccaatgtctgtttctttgagctatagataatattacactaaccttgcagatccctcttccaaccagcttgggggatttcttttaactctggaccttacatgtcttgctcttgctcaacttctttctctattcagttttcctgaaatctatttaattcagcatattggaataataattgggccctaataacaaagttaagactagagtggtagaatagtaaaccacccaccctcttcccccagagatgtctacgtcttaattcctggaacctgagaatatgttagaccacgtagcaatgggaaattaaggctgcagatggaaataaggttgaaaatcagcagaccttaaaaacagtgaaattatcctggattatccagttaggtccaatataatcacaaaggtccttaagtagaaaagagaggcagaagaagaaagtcagaggaagagataagactaagcaagcaacatcagaatgatgtgcagtgagaaggagtccgcctgccattgctggctttgaagttttgaagacaggaagggagtggcctctacaagctaaaaaaaaaaaacaacaaaacagaaacagcttctccactagtgcctccagagaagtatacagctctgccaacttcttgacttttgatcactgagatctgtcagacttctgacctccagaactgtaagatgataaattggcattgttctaaggcattatgttatggtaatttgttgcatcagccataggaaacaaaaacagctcatcccacgctatggtgaaactatcccccttggtcccagtttagaaatcactaacctccatggctagtattattgtctacccatgtgtttgccacttctcttgatagctaaaagtagagttctgttttcttttttgtgtatttctgttttccttaactggaccactaagtttatggtttcagactaatggatgttgttttctcagcgaagaaggtaatacagcctattccagaagacactagtttcttgggatgttaatggtgaagagattgtgagaaaagaggcttctgccaccagattcatttggaaaacctaggttaaacaaggttcttttttcttaaagcacttacaaaaatataatgtatgtataaggtttaaaaaaaaaaaacaacaacagtttaagagaatattcagcaaaagtatccctctcagctaaaattcctctcagcagttaccatttacctgtgtatcctcccatagctattgtagacacatgagcacatacacacacatacacacatatatacatgcacatatggtataatgtatatacacacatattctggttttctgtacacactgttctacactttgcttttgtttttcctaattaacaggtttcccaattaacagaaattttagtgtataatatgtatatgaaagactaagagaacttagtggatggaaataaagattttctgaacatttgggaccatagatttttttagaaaatatcttacagaactaccttttgagacacactgcacacaaccaagctgccttcctcagaagaaaaaaacatcctctggagtagaagtaagagttagtgatgacccccccactcccattagaatggcctagtgtaaagggtatggattttggattttaacctaggctaaaatcctggctccattaccgacttgactgcctgctcacctatgcttactggctgtgtggtttcaggtacattgcttaactttactgagccttcttattaatacactctcatatattcaattatttgttatttggttaatacatgcaatcagtggaacttttatgtgctaaatattgttccaagtcaaataaagcagagtccccccaactggagaggcttctaggctagtgagggaagtttcgtttgtagcacagcaagcggcagtcagctcacagatcacctggcctgtcttaaaggaataactttccaccaacgtgacagttttccactttcataggcatagatcaacagtagcaaatgtcacctatgtgacttcaaaacttggaatgtatgcaggacatttcaggtattgattttttaagtatctgtgtactttggtattgattaatgaattaccataacaattttgtttatctgaataaagtacagctagagtaacaaaatctttagtcattatgaaattataacatttctgtgtaagtggccagcatccttgtagattctggatatgtttaccttagtggttgactttaaaatttgaattctccagaacagataatcttatttttaaatctgtaatatatgtatattttacaggaaaattttagatttctcatcctttcccaatgtctataaagcatgtcaattcattttaacattaagtgtattcactctttattattctgctgattttatttccatcttcttcctgctcttgatgaatttaaacagcaaagtcatattcattagaaaaagatatctttaggaatttaactgaaaataacaaatgcaatttcttttatttgccattttgtctgccagaaagtttcagcttctctttttattttctaggccaacgaaatgacgtgtaggcctagtgaattccaggcaatgttcagcactggttttactgaatctggatgacttcagtctgttaatttatttaggagatggttttggtttttataaggtcaactagaaatttgtaggctacttttcccacttattctaagatcaaattttttttaatactaacatttaaaatttgaaaatacagtggtaactttggtgatgtcaagtctttaagcacattatttaaaacttttccatttaagaagtgtttccataattgagtttatttcataatgggaattctgttaaggtcaatctgatagctgcttagttacttaatatcagcaagtacctgatattttgatttggctgttttttaaggtcatttcgattaaggtttgatttgatatgtcctaaaaacaaaccgtaaaatatttgacttttttttttttaaccaaatgatgtgtgccccagccagtgcttaggatggattctcaatttgtacagtgcccttaccttacccctcatcttcatcccttgccccatatctgagctttaccctcgtcgtcatcggtgatgaggaggatgaatgccagggaagtttgtgataaaacaaagatgtatatacttttgttattttaacatgagtaaaacagctgcctcagaatgccctgccatggtggataggcaggaattgaccatttgctggatttttgctgtgactgctgcagtccaagaatttgagacttcattctccccaaaagaaaacatcgcctgttcttcttgtctgtaataaatcatgaacatagcagtattcttccaggctattcttctcaactccagataatttatagtgggtgagactcattagcctaaagtgtatttacaggtttgtcagtcagagttgaatagagagccagtgtttgggtggcaagtggaaacagcacaagctgtgggcacacaaagtaaacttggcccttggcttctgtacaacactcctccctggttttactcatttttagagtcgttccttttttgactcatttctttctctagctgtctgtccctacaattttaatattctccactatttcttgctaaaccttttctctctgatggtctcttctctgggtgatcatttcaactcacccagttgccttatagcaatgactgctgtcttggttcatctagtccaaacatctctcctgagtcctataccttggtatttgttaacctactcaaaatatatctgcatttggatatccttcaggcactcagacttacccgttatgtctgaaactgaagtctttatgcctaatactaaaccttctcctcttccatgtcaccatcttcacaatagccaaagctacaaaatctagaattctgagaatattgtcatggaagagaaataataagatccagaaccattctctcatgaaatagcagatcagatccaaaagtattatgtatgtacatacacagatacactgacacagatctcacacacacacacacacacacacacacacacttcgttgttcaaagagtaatattgcatagttttgcatggttttgaaatttaaataaatataatcatttatttaaatgtgtgtattttttttaagagatggggtctcactctgtcacccaggctggagtgcaatggcatgatcatagttcactgcatcctcaaactcctaggttcaagggatcctcctgcttcagcctcttgagtagctagcactacagatgtgtaccaccacacccagctaatttatttttcactttttttttttttttttttttttgtagagacagagtctcactgtcttgcccagtaatatggtctcatacttctcatactactaggctcaaatgatcctcccgcctcagcctcccaaagtgttaggatacaagtgtgagccttgctcttttgctcaacattatgcttaagattcatgtatgtgtataactgtataatctagtccattatatgaaaatttaataattaattcccctattttcctttggagagacatttgggtagttcttgcttttcactgttgcaaacaatgcatctatgattgtgtacctatctcctgatacacatatgcaaatgtttctcaagggaatgtacctatgagtagaattcctaggttataggtacatataccttcatataccttgacagttactaccaaattgttttataaaatggtttcaaacatttgcactcctaccagcaagaatttatctagttattccacatcctccaaaatatttgatattattgtacattttaatttttgctaatctggtgtaaaatatttcacactggctttaatttgcatttccttggtcgctaatgaagttgagcttattatcatatgtttctttacctccattgtttcctctttttggaagttcctatagtctttggcatatgttttggcttttaaaacattgttaataggagttctttggatattctttgttactagcatatgtcgcagtatctcctcacagtttgtgacttgtcatttcattctctttaaggtatctgttgataaacagaagtacttacttcaaatgcaattcagtgtatcaatctttatcttaatggttttcaatttctgccttgaataaactttcttatttcaaggtaataaagacattcccctttattttcttctaaaagctttaaagttttgcctttctcacttaagtgtttaattcacctggaatcatgcttgtttgacttctgacacacaaaaaaattgaattgtatatgtgttgtataggtagaaatatagttaggcctcaaaaaattagttatttaaaataacagttgagtttttaaatttaaaatcattgtttttgtcaaaagtcaaaacaagcatgattcttcaagtgttatggcgccatcaatcactattcattttcccagatctctctgtttgcacaggttgacaccttgacgtatttcagaaatattactctcagaacatgttataaaacataagtcactctaaacaatactaatgcttctcgtttgaataggaagcgattgctattccggccgtagtgataccattttaaacttggctgagaaaatgtctttacaaaatgagataaatatcattttaaggatgttactaatttaactcctataaagttaaaagagaagtcaataatttattctaacatttttagagaaactttccctggattagactttctttttaataaatctagcttttgatctataatgttcatagttaattagatgatgtagtgcaatttttattcaagttgtagtttgtgtatgtgtgtgcctgtgtgtgtgtgttttaacacagtatgaaattaaactaatagaacataggaatctctgcaactatatttttgagaatatacaccacgttttagtgagagtatcatctggagaagtttcattatattctctttatttgaaaaaagacttaggctttagcctgtaactttagtttcttattctgtcattaatgtttcctctttaattcacattaatcatttattccacaaatatttcttgagagcctgtattttgcaaagtagtctatgctgaactattcaaacataacaaattcagattcaggaactggaagagctctaagatcacttataataacctcaaccttccacaaatgaagaaactgaggtccagcagtgacctgaccaaaatttctattgagattcagaatatctagattcagaatatcccctattgaaccacgttgcccacagaaaactatccgaacatatacctgaatgttaaatattgatataatatttatagagatgtctaaaaggataagtcacgctttgtgaacaaattatgtcatttaggtgttaccttcaagctatttataacatttttaagataaaaagacacacttgaaaacattaggtaaagtaaatgtttaacttaaagctttctgagagcaggagtaacacttatatttgttctattttcctaacacagtgagctgttcatagtgtataatcaacaagtacagtattgattaaataaacaaaactgtatgttgaagtataagatacagatattaggtactgtaaatgaccagaggaaataaaaattacaaatatgaaatgaaataggaacatggaaaaaaagtaagtccttgtggaaggtttagaatttaaacagagctgtaactaatggctataatttcattaagaacacccaagtttctaattatttgtttctctcactttccattaaaactttagatacaggttctctgagttgtttacttcaaattatacctctaagcgtgatttcttggagaaggcatgttcatgaaaaaaatatgataaatatgctaagatatatgtataaggatactaattgtctagtttataagggcatttaaaaattgaaccaacccaaacctctatcagtgaactaatagtacatcaaaattaaaatcaatgatgaatgtagatctaaatttttcaacatgaaaatacatctctaatatattatagagtaaaaatatcaagctgcaaaactataaatgtgtagaatgatcacatttttgtaaaaaaaaggctgtgaatgtacaagtaatgcaaaataggatagtagacatttgtattcgtcttttttcacactgctataaagacatgtctgagactgggtaatttataaagaaaagaggtttaattggctcacagttctgtagggtgtgcaggcttatgctgctggggaggcctcaggaaacttacaatcatggtggaaggcaaaagggaagcagacacatcttcacatgactggcaggagagagagagcaaaaggggaagtgctacacacttttaaacaatgagatctcatgagaactcacacactatcgtgagaacagcaagggggatgtctgcccccatgatccagtcacttcccaccaggccactcctccaacattggggattacacttcaacatgagatttgggtgcagacacaaagccaaaccatatcatgccatccctggcccctcccacatccccttctcacatttcaaaacatgatcatgcattgccaagagtcccccaaaatcttaactcattccagtgttaactcaaaagttcaagtccaaggtctcatgtgagacaaggcaagtctcttcgacctacgagcctataaaatcaaaaccaagctagtttcttccaagatacaatgggattacaagcattgggtaagttctcctattctaagtgagagaaattggctaaaacaaaggggctacaggccccatgcaagtccgaaaaccagcatggcagtcattaaatctaaaagctcccagataatctcctttgactccatgtctcacatccagggcacagtgatgcaaggggtagactcctaagtccttgggaaactctgcccctgtggctctccagggtacagcccccatggctgctttcataggctggtattgagtgcctgcagcttttccagatgcatggcgcaagctgatgatggatctgccattctgtggtctggaggatggtggctgtcttctcacagttccattaggcagtgtccctttgagggctccaaccacacattttctttctatccacactgccctagtagaggttctccaagaggactctacccctgcagcagacttctgcctggacatccatgcatttccatacatccactgaaacctaggtggaggttctcaagcctcagctcttgcactctgcacatctgcaggcttaacaccacatggaagacaccaaggcttgaggcttgcaccctctgaagcaatggcccaagctgcatgttggccccttttagccacagctggagcgggagcagccacaatgcagggtgccatgtcccaagactgcacagtgtagcagggcccttgggctggcccacaaaaccattctgccctcctaggcctcctggcctgtgatgggaggggctgccatgaagatctctgaaatgccttggaggcactgtcttgattattaacatttggctcctgtttacttgcgcaaatttctgcagccttgaattcctccccagaaaatgggtttttcttttctaccatatggctaggctgcaaaattttcaaactttaatattctgctttccttttaaatataagttccaatttcaggtcatttctttgttcatacagatgagagtaggcttttagaagcagcaggccacaccttgaatgctttgctgcttagaaatttcttccaccagaaaagcatagcaagagtgacctctactccagttcccaataacttccttatctccatctgagaccacctcagcctggactttattgtccatatcaccatcagcattttggtcacaacaatttaacaagtctctaggaagttccaaactttccctcatcttcctatcttcttccaacccctccaaactgttccaacctctacttattacccagttccaaagttgcttctatattttcagatacctttatagcaatgccccacttctctggttacacacatactatcacaagaatagcaagggagaagtccacccccgtgatccaatcacctcccaacaggcccctcctccaacattgaggattacagttcaaaaagagattcaggtggggacacaaagccaaaccatatcaacatttttgtgttcttttttatgcttttcagaatttacaaaaagtctaacaataaacatttactacctgtaaaaataataaaacttttttaagagttgtggagagagttctaaatttactctattgacttgccatagatataaaagctcaatgatctccattcgggacaacttttactgagtacctgttatgactaggcactatgaacaggggtcaaaatctatttcttaagcccctcatgacatcagaaggaaatgtaaattataagtggagcaccaggaatctatttatccttcagtctggtcacttcagagtggtcctttggtcatatgctgatttttttaaaacaaaattgatagatctctgtgttctggttcacagtatctaaacaatggacacaattacagagatctttccatgtctgactttttaaatatgatttcagcttttattttagatacagggggtacatgtgcgggtttgttacaggggtgtattgcatgatactgaggtttaggatagggatctcatcacccaagtattgagcatagtacccaataggtagtttttcaacccatgacccctccttcccttccccatgtagtaatccccagtgtctattgtttccatctttatgtccatgtatacccaatgtttagctctcacttataagtgagaacacaggtatttggtgttctgttcctgcattaatttgctctgaattatggcctccagctgcatccatgttgctgcaaaggacattatttcattctttttggtggctgtgtagtattccatagtgtatatgtaatatattttctttacccagtccaccaattatggccacctaggttgattccatgtctttgctgttgtgaatagtgctgcaatgaacatgccagtgcatgtgtctttttggcagaacactttgggttttttgggaggtatatgcccagtaacgggattgctggattggatgatagttatgttttaagtcctttgacaaatctccaaactactttccactgtggctgaagtcatttacattcccaccaacaatgtataagtgtccccttttctctgcagcctctccagcatatattattatttgactttttaataacaggcattctgattggtgttagatggtatctcattgtggctttgatttgcatttctctgatgactagtgatgtgtagcatttttttttcatatgtttgttggttgcttgtgtgtcttctcttgagaagtgtctgttcatgtcctttgcccatttattaatggggtgatttgctttttgcttgttgatttaagttccatatagattctggatattagacttttgacagatgcatattttgaggatattttctcctattctgtaagctgactctttactttgttgatagtttcttttgctgtgtagaaactcttcagtttaattaggtccctcttgtcaatttttgtttttgttgcagttgcttttggggacttggccaaaaattctttgccaaggacagtgttgagaagggtatttcctaggttttcttctaagttttttatagtttgaaatcttacatttaaatttttaagccatcttgagttaatgtttgtatatgttgaaaggtagggcaatatggtttggattggtgtccccacccaaatctcatgtctaattgtaatcctcaatcttgaagaaggggcctggtgggaggttattggatcctggagacagatttcccccttgccattctcatgatagtgagtgagttctcatgagatctggtttaaaaatgtgtggcatcttaccccccgcttcctccttctccggccatgtaagacgggcctgcttccctttcaccttctaccgtgaggcttctcagccatgtttcctgtacagcctgtggaactgtgagccaattaaacctcttttctttataaattacccagtctcaggtagttctttatagcaatacaagaatggactaatacataggggcacagtttcaatcttctgcaaatggctagccagttttccatgcaccatttattgtattcaccttgcttgtttttccatttcttacttttaattgagatagttcagttatctcttttgtctaggaggagcacaagcaactctaagacattttggccagagaaaaatgtttaacgtgttttgagttgacaatgaaaatgtatatatataataattatacttttatcccatactatatcattttctcctcctttggaatatatttttagatatttaattccatgttacaataattatgcctgtatttattgttaattttaacatcgcaaatcccagagggtagtacttgtcatcttgaatgcattaatgcctagcaccttggcactcctgtgatgatgttgtctgaaattggcttgctcagaataagacagaacatgtcccaggtctagtggcagccaactgtagttaattgtctctaatcaagatgccaaggagaactcatttctaataatctgtgcaactaggtaagggtgcaggcttttaaaaatactcatcacctaaacacacttgatatttgggggttttcattggttattcttctctgctgttaacgaaactcttacatagtttatggggtattagcaggtaataataatagtttccaaattctttgtgggaatttacaagcatttacatttacatcaactcatttcatctttagaccacctctagacaaatactaatatctcagttttacagtggacagaatagaagcccacttagtttaaatgacttgcctaaagttacatagctaacatgaaatagacctgggttcaaacttgtgtttcctgacttcaagtcccatgctttctcagctataccaaggtgttgtgactctacccccgcctttgaacttggaaatagaggggtattaccaagtattactgggttagctcaacctaatcataattgccccagaggccacctctaattgataatattaagcatactttattaaggttccatagagaaccactgacaaggtttctacaaggatattaacacacactccacagctttacttctgattgagctctgttattctctggcacagtcttcctaagaccaattaatagtgatcatggcagtcagcctgttatcttaggattcaaagaaaatatctacataaatatagcagtcaatccattgaagtagtgactacaatactgaacctgaataaaatttagtttactaaatgaagatatgcagattcaataaatgattatggaccaacatttcatcagcaactgctataaatgtgaaaaatcattatttttcatatatacacatgatcatcagacccactaaaggtaattcatgtgaccaaaactttctgctgctaagagattaaaatgcatgttaatcagtagaatttaagaaagccagagtaaaatgtaaattgtgatgaaatcattaaaggagtaacttgaaaaaccttctatatcctggcataaaagtgattatagcacagaggacagaatattttatttcttgaccttgattatgagtattgttataggttcttgaattttccttaggtcagaatagagacattaattctaaagcagttagagaaattagtctctttatctctttccttatagttaatagcatagagaaataaatctctaaaccaatttgaaacaggatttaactgtcatttcacttatgtgtctcttcattttcttttactctataacagaagtttttaaaaataaaactattttgattttcttttcagttctaggcctgattcttcactacctgagacgtctaaaaaggagcacatctcagctgaaaacatgtctttagaaactctgagaaacagcagcccagaagacctctttgatgagatttaacagtctcaaaaaatactttgatgttcactagactatgttttctattcatttctttaaaatgaaaaaggagaatttcaagtcagcagccgctattaccgtatcttacaatttaattacatacacagtgaattgaaaccattgtgcaaaatggattacacatgtatacaaagatacgatttgatgatgacactggcacattattctaaactattcattcagcatgcctataattacataaattgtatgagactttttgttgcaaaggacacatttatcatattcattcacacatattatatgtgatagctgtccaacatcctgtctgggaagattttgaaaacaggacaaagaaaacatcattttaaaatgtcttcagctttttttgaatagacgtattcaaacatattctgaacattgatgtttgaacattttaatttgtgtgatgatgtagaaaatataattttagtttgtacataaacattgtgaaaatctgataataaaatttttgatacattgaagattttgtgtttttaataaaatgtgttatttaggttaacttttattttagtaagtaacaggtttttagaaactgcttattaatgtaaatgtaaccccctgtgtggcaaaagaaaagcatatttttcagggattattgataaaagatttatcttacacatacaggggcccttcttgaagacaaggaccttgtcatagctatttatctccagtaacatctggcactattatctttgtagtcactgtttctgcttcttaacctttcattctttcttcacttcttacctgtttaatatccattccttccgtgctactcaaagttaacaacatcagagttaaccatgaccaccatgttgctaaatccagtggttgacccattcttagtcctcacattactaagcctctcagcacatttgatatagttgattgattctcctcagtaaacattttcacttgacttttgcaatagcatatgctctttgtattcctcctttccagtcactaattgtttagaccttttggctgatgccttctcctttgcccaatagttaaaagtttgagtgtgctgggtttaattatcagccgtcttctcttcattacccacattgtcaccctaggttattctaggtcgtttgtgattttaaatgccatctatatgttaatatctccaaaattacgtagttttctttgtagccaaattttatatgtacatacatatacatggatatacatgggtgtatgtataatttatcattaacttgtcacaaaaggagtttcttaagatttcttaaaaattgtttgtattaaatcttgatacatcttggcatcttttataaaatacagacgagtatagctatctacttatacctttctttagatgttttagcatatccaaagcagaaatttgattatccttaccatcatttcttctccagtcttacccatttgggaaatttcactaccacaatgcagttgcttcaagctaaaaacccaggaatcttccttggtgtctttgctttcttctccttgcacatcctgttatttttacttccaaaatacaaattgactctccctttgtgtctctctactgcagctgctgcagctacactccttcctcactggtctccctgcttaattttctattctcctacaatgaggccaaactgaattttaaaatcttagataagattattttcctacctggattaaaacctaccaataatgaaccattgccctttgaaaaaagtctgcacctgtaccttggcctacaaagtttgatatgatggcacccctgcttacctccccaacctgatttcccacccctctctctttactccccttgcctctcaagtaggccagagctcagaaccattgtattgctaatctctctgcctggaatgctcagcttcacatggttggtttctttatctttcagatttagaaccaaatgtcatctcctcaggggtgcattccctgaaataccctttttagggttgtccaccctcccagtcactctctgtcccattaaaaggttttttccattatgcatatcactctctcgaattactttttcatgtctcctctcccggtggaacataagccctatcacagcagaaacatggccatctgctttacctctctatccccagtactaagagcaaggttcatagaagcttaattagtgtttgttgaatgaaagaatgcatgtttatcacatagtaggcactcgaaagtttctttacttactaaaccattttgaaaggattgaaagattgaaatttagctggatgacttgatacaaagaaataattattcagaaagctcaagtactctttgtgaataatggtaaataataggtatatatatgcatgcacataggtgttttgttttgttttgtttgagacagagcctcacaccatcacccaggctggagtacagtggtgtgatcacagctcactgcaacctctgcctccctggttcaagagattcttgtgcctcagacacccaggtagtttttacaggcatgtgccaccacacccggctaattttttgtatttttagtagagatggggtttggccatgttggccaggctggtctcaacctcctaacctcaagtgatccgcccacctcggcctcccaaagtgctaggattacaggcatgagccactgcagcctgccaggtttgacagtagagagagaataagaaaaaaattacacacatacactattaatcaggaaaaggatttgactaagtcaatgggatagcaaaatattttaaatagaaattttcctacattttaatttatttgatggcttatatgcaaaaggaaaaaaacttttaaatatatgaaatttaaatatataattataaactatcaaattctactcagtcactttggaacttcactgtaatactgaacttagcactatcctagatttaccctgtatctttccaaagtgattttgtatgtgaaataccaaaatctcaaaataatattatctcacctgaatagaccacaaatgactaaccaaaattagtatacaactgtatatgtgtgtatatgtgtctatctatctatctatatatatagatatagtgaaagagaagaaattttcttatcttttggctattaactccctggtgataagagatgtagggaaggtatttcccaagtaataataacaagtctataaaggtcataatatttagaaaatgtttgtttatatttttctaaggcagctgatcttttcaatcattgctgtgtgtcagattgattgagttggttagaacagaacataataagcctataatcttgggttcctatttatatctcatgtggagaaattgaagacgtggttttttatatttcttaccttatatagacagagatctacagatctggtgtaaacatgtccagatcctattattccataccacgttttctcctcacatttttttaattgtctatactctaaacattgttgcagaatgctgaaatggaaggcacagaaattgagttacaatgcagcatggcttttttgaccttatcatcctcacctctaagataaggagattacatttctgaaggttttttcatcttaaaatgtataatttttggcccttgcatcagatggtatggctccagcctcattacagaagttaatgaaagaaaaaaaaatcccctctcaagagatgtctttattatgtggttttaaaaggtcaagaaactactttggaaaagtttttctgaatggcctataactcagatttgtaaaatacaggaccctgtgtttttgagccaagcagctctttattgggcaagtttgattcaacaaatgtttattaaggatcagctatgcacaaaatacagaactgggccatgtgaaaaattaaaggataaatcgatcctttcaacaaatatttgtaagtatttttgccagtctctgttctggacactagatgtggcagtgaatagcacagacaagtgtcctgtttctgttgaggttatattctagaaatgaaaagaatggagtatatgggaggggattgcattgagttttacacatgaaactactatgtaatgaactataatatgaaggagtggtagtccagatggtataaaaagaacacaaaatttaaaggtatggataagaatccataaaagattcaattaagagattatgagaaatcgggggggttggagagtgggctgaggatgcgactatcttcctcggatcacatgagaatacagaaggtactggggctgggtttgggtgggtacatggcattaatgcctaaatttgtcactgtgaatcattggaatgaaggagacaagttacaaggtattccagaagcaatgttggccaaaggtattttagtagtgtgaacagtgagcgacgttatgtcaagaagacatgacaagaattgagctctgcagttctaactggcacttccttgggaaggtatgagctgccaaaaaatcgaaggtcatagggcccttcctgggtgtccggaaattggaaaggaaagccaaacaagaggtctcttgatagagctgccccggagaagcaagcaacccttgccttttcatgtctctgtcattcttgcactcagtattatttatagaatcaatttttaataaaagtgaaactagctgacatctaaattcacaaaggcctcacgaatttacttataagacaagaaatcccaaaaataggtagttacattttgtattcatttcaatgattttgtgagggaaaatgatatagtaacaaaagaactattcatgcatccatttgtagctattgtctgaatttaacattttcactactgatctgacagcttctaataaacgcttttcgggaaggtagacttcatttgtaagtgttctatgaactaacctaaagtggttttctccgtatcttgattactggaaatggataccttgagaaatgcattagagcaagcattttatggttgcttcattaactgaccatccaccatcgctgttcctgactcccaactccctttcttatctgctcaaaaacactctccagcttacattaaactcaggttctttctttcatatatccacatatcttctcatttagctgctattttcctcttttttttcttttcctctcctctatttaaataaaattcaatatgaattttatgttaatttttcttccctctttcaaagggctttcatttaaaactctcatttcacaatctcacaagcagctaaactttctaaatgagagtctcaatgcccctaaaggctcttggttctgcagggaagtaaagagagattagagccctgcacccatcttgatactgaattttcttttaagggcaggagcaattttggtagccgctgttccagtaaatggaatatagaccagtcttgaacaacttacttttgatttagagaaaatctctgacttaactgcaatcttagaaataacataactagtcaaattaatataggtggattaaacaatttctataaaacctgttcatacaagacccttctaggaatctgtctttccttgcattcctccaaaaactgggccagagacaagggcatatataaaagcaatgtggtgggacagtaagcataaaacaggaaaggcggagaagcgactgcaaggatgccttatcaagatggccaccctgttgatgacatatgcttcatcccaccaggatcttccaaggaaccttttgaaagttttctcggaactgtatatgcaggggtgaaaaggaaaagcctttatccatcacttgctgtttcctagtggtcaagggtagcctggaaacattgttctccctacttcgggtttcccatgtgtgaatacacaccaggtcttgcaaatgacccacgctgcagtctcagagaagccccagggcaggaaacaagagaagcaggggtgccagttacacctacttatagtaggggaaagactacctggaactgagtgccaaaggaatggctgctattgatatagggctcagaggagtttgaagtagcgtacagaagagcccaatacagtacccatgctttataccacatgaccctgccccacttcccacccctagccagagttgattagatcaggggaagaaatgttctggctaacttgagttcttggcctggctgaacttgggtttgctgaagaagccaatctataaattaccagagaatgctgttagaagagagaaatgagcaaatttgcacacagaagcagagcaccctggggaccgacaggggaagtagccagtgcctggagtggccttcatccttatatatttctggaccaattctgatatacacatatccttagaaatcactgcctccttttctgatgttttattagtcgaatggttctttgaaacaaacaagaaattacctaattaataaggaaacagaatacattctccagagaagatttcaattaatttccattagcttcaattaacaagtttgtcgcaagttaacactaccattaaaagaatatttcagaagaccttcaatcaatactggtagagacaattaaacttctcgatatgataggaaaataaaatcaattttataattaaatatgtgtaattttcctaatataaatgtttaagtttattaaaatgccattacatgcagctatggtcttatctacattagatgtatcttctaatcactgacagattttagtaatagagtgaaatgtctgtgatcttcggcaacagcatagtactatatattttataaataagaaatgtcaaatacgaagaacttcacaaagatggccaccattggtagaataatacgtatattaatccttgagacaatacaaagcaacctattttacttcatcttatcaaatagtcaagagactacttcagagttatagcatttttatgttacgacaaggagttctctctgtcactctctcatataagatgtgtttgaagtccttagtagagttctagataatctactgggacaagatgattgtagtgatgatgggagatgtatgcttaaaggtgatggtttcatcattatactttgcaaataattagggaaattcaaccaggtgaaatttttcagaaacacctactgatattagaaacaacctgtttctgtctgctgaaagaggtataatacagtatatttctctgaggaactaagtttacagtggtgtaattatattactaccaaagattaaatgattctcatgaatatttgctctttaatgccaaaatccattaacttgctttggccaataaaatgtgaatgaaataacaatatgccagttttgagccttgaactaaagaggcattacatgcttctgcttgccctttgggagagtcaaatctctgctatgaggagaacatgccacaagtagctgctgcctctcccacctgggcttctgaagagttacagagcagaacagaacctgattcacatgctggagccacgcccactcccctgaaacctttagaagagccgtccagctgagcccagtctagataagctgaaccacagtcaaccatgctatcctgtgaccatgagtaatgcttgctaccaaaagccactgagctttgggatagttagttacatagcagtgttttgacaataactgactaatacttatatggaataacaattttacaacatttgtagtagcttctagtatattcatgaaacagaaatcaggtattttctggctggaacctggtaataaaataaataggaattaggaatgtgggtttggggaccagatcaagccaagtttctaccatgcttctgacagctattgactgtgtgacttacttattttctctgaacttgagttttcttatgcatacaatgagaaataagatgatgcacataaagcagcacagtacctggtgcacagtaagtgaggaatatgtggaagctcttttgttactatcatactataaaatcaacacagaatggatctgcaagagttatgtataaccagattatccactaaagtgatcctttctttcaaacaccctatccttggaccttcctaagtctgatgctgtcctaaagatttttatgagtttctgtaggatatattttcatagccacttctgctgtgaattcctgcttctacaggattctgagcctcattcatgttttgacaacccttactttcttctttgtcagctctgtgctgagccatcatggaacttatctccctttctttcatttccatgacaactttctgtgtgtagcagaacttattaaaagtttgggtcagagaaagctgtttatcccaaagaaagccagcaatttatatttgatttttaccataactctattcttttttatttttctttttttttttttcttggagatagagttttgctctgttgcccaggctggagtgcaatgccatgatcacagctcactgcaacctctgtctcctggttcaagaggttctcctgcctcagccaccctagtagctggaattataggcatctgccaccatgcccagctaatttttgtatttttagtagagatggggtttcaccaggttggccaggctggtcaactctattctttaaagtcttctaactctttacaagaatttcctattgacaacatatatccatagagtccagactcctgccatgttatctattccttccctctgtccctccttcccctctcctctctgctttcccacaattcctgttaccttctcatgcaaagcaacttagctgcctctttcttttgctcatctctttttatcaaatagtcatgtaacatgtttttatgtaacacattttccctagtactaaatgttaatactttttactccctcatcacacttgcaatgtcatgttaaagatggcatgacttccaggcaaagcaagacctgattaaggtattgacctatctagtgaagtaatatgattatcaaaattaaggagaatttgtgattaaagtataagaagcgaagaattttagaggaaaacattgtctgtccaagtgctatttaggcaaaaaaaaaaaaaaaaaaaaaaaactatctcattgttttaggtatgttcatgtattcacatattgatttatttgtattctcccccaaaagataaaattggaattcttctatagtgaccacaactggttgtctttccttagaatttggaatttcacagtgtggttacgtctgacttggagatagcttttcatttgcaacaatttattaccaaaggctatgtgtatttaacaataattttatgttgcaagacttgtggcatttgagtaaaagaagaaaaaagtatataataaaacaaacactagtgttttcttgaggaattttataccaaatactgccatttctgaaaatcatttctctcttggtttaagttttctgttattgtcctaacctatcatacaagataccagtaactttcacgatttcctacaatcagcaaatattaagttaggggtttttgatgatggcaaaccaatgtattatttcacttttattattctctgtatcaataatcttatttatttcaagaacttaaaatttggactaaatgcaagaacatgaggccttgaggttatacacaaagttaccaactgtggttagaagaacacaagtcctaaagtgtatgtatgtgtgttcacccatttattgaacactttgtgccaggcacgctgctaggcactggggatattaaaatgaagacatcacttttggcttccaggtttttgaaagtctagacaaaggaaggaggcagacgtgtaaacagacaatcaagatacgtggtaagtgctgtaagagagatgtgcccaggatgctcagaggcacaaaggagaatcagcctgctcttattccactgggagaagcggccatgcccaaggaaaatttgagaaggagatagatgaagtttgagctgaacttcagggaagacccagggttttccaggaggcttaggtactctcagccacttgtgaggcacagaggaagagagtgtggcctgatcagtatcttgtggcaggagtgaaccccagggctgagaagatagggtaggctacccactaagagtcttgaatttggcaataagaatttacattttaacctgaataagcatctgtgaaaggatcttaagggcagtaaagggacaagctgattagatttgtgcttttgaaagggaggtttgaaggtaacgtgaaggcacaaccacacgcactcagactctcctatttctttgctgactgtgtaatccgccgatgctattcccagcctgcctgggaaactgtcaaactccacttcatacaaaggagcatccataaatgaaatgttgcaaacagtctttggaagttgagagactactggcagagtgacgcctaacctgcccacaaccaagagagactctttctagtacttggcccttgggctttgatataagcagaagtggttttatcattttctttagaagtgatttggagagaatgtttttaagcctcttgtggaattgacttccttttttgaacattcccaaccctgctttgacatctttatttcctgcagaatgctgctcctgtataccttgaaagtaattgctgtcactgtcgtcattaattcgcttctctttgcacctctttctggagtctgtaggtgcaactatgctgttagaagcagtgttcacatttctttcttaaggcttcagcattttgtacaaaggtaccagatctggatccagtccatgtggaggtttgaggggagtggggttcaatacactggtaccattcaatgaatgttaaataacacaaagcattgtgaaagaggggcttaaatcctgaaaggagacattgtgaactaaccttttattccctgggattttgatcccaggacaactaagagctatagaatatcctttttgcccaagaacaaagtggcagaaatagcactttttaaaaaaaatcaaattatattttgttttcaagtttcaacagaaaatttgagacagtatttctcattgtctttctaatagactctggagaaatagtggctaatatttttaacatgttagccactatttctccacagattttaatggaaaaatgaatgaggagatactttttccacctccctgatgatttttgcaataactgaactttataagaatactaaaaaaaaatcttttatgagtcagtcttccagtacacttgaaaataatcagattttctttcacttcccttcctctccttatcaggagagcacttgcaaccaggccatctatgcatgtggctgaatagcatcatagaatcattgagaatgtcttaaatattaaaatgactaccaatgtccctgaagccctgaaacaggtggcagcatccccacttggggtcacccatcagtcctatgaagaggacacctacagcagccgttccttataaagaaaaacacggttgagtcttcattacacttaattaaagaacagccgaaaatcctgtcttgcattttcaacacatggttccaattagtgtcccaaagcaggacgctgactttgataaaagcattcatgtgcacctttggtgcctgtacaatgtactctttcattttacaaggtggctgaagtgcagttttaaatatctttttttaaatattaacaaaaaacccaggagtataagtttagaaagaggtgaagagaagtgaaaacaattttgttagaatggcttgccataggcttctagaaccctgtatgcagagggcggtttatttggtaaaatctgcactgctcatttgcagggctgtgtgcaagaagcattacagctcctgagagttgcactcagaggccattcgatgggagttccgttacctcaggaaacaccacttactgtactgtaaatttgcttcatatgactgatctgctcaaaaggccctggaaagccccattcaaataaattgtttcagaccacgctataactgatggacatccatcttcagtggactctctgggtaacttctggagggtggtattttttaagtaggaagggaaaacttgtgtcctagaatctgggaattagatgtggaaatgcttaatttcggtcatcacttctcaccttttgccaaaataaagggaaatagcaagaggaaaaagaaagataaaacaagtaaaatgttttacgactgcttcacatggtgagtgttccacactgccccaagaatagtggaatgattttccactttgggtcatgggaaagcgtgatgtctttagtcccagaagggtgagacacatacggttatacagcccttcgtgaaagctgaaaacaatcccctttgtgcctggctttcattttcagagataccattcaatttttggcagataatacacaagttagagaaatgtgcccagcaagaacaataaaaatcatcccctagattcattacaaatttcattattaggaaatagtctctaaaagtgccaaggcaagaacaaaaatatgagcagagtaaaactgagcaaatggatttcttcagaccaattacaacttcagtaaataaataattaagatgatctttccgatagcttcattcttggagacttggtgacaatagatatactatgtcttcccttggttttcaaaattataaaatagagtttgtcacttttctaaaagggatcccaaatagtgacggactgaaactgtgcaaacctgttcttcttacaggaatcaattttcccctccttcagcttatgccccctagtaaccactggtgatataccttcatcaggcaatagagagaagtatgccatcttcaatgagtccctttttaacagccccattaactcttactgagttgacttatttatacataggtgagtattatacatcattaatgaataattctagacttcaaatatctctaaatctccaaatcattattcaaactgaactgtgctataggcacatttcctattcactcatgaaatcttggacttcccaacctccagaaccatgagccaaataaattcagttcattgtagatcccctacgctgtggtgttctcttacagcagaacaaaacaagacggatccttgattcatctatgtctctcccaacctacatccaattcataagaaaaatacacccagaattaaattttttttctatcaacttgagctaaaacaagttagtatcctatttcaactgggttatttcaatagcatcccaactagtcaccctacaactcttcaaataggaggcagtgaccattttaagatgttggattcatattccttctctgctcaaagcttttccatgccttcttggcacactcaagtaaaagccaagagctttactgtggcttacaagactctgagaataatcctctaccactccatttctctggttgtatccactaccctgccctgttttcccctctttttgcttcagccacactcatgtcattgccatactttgaacaaaccaaaccactcctgcttttgaacatgctgtgtttcctagcaggaaagctttcccttagatacccacagagttgcttccttgcttttttcacgttatcagggaggccttcccagaccaccctatgtaaaacagcaccctcctactactacctatcacagaagtattttccttgccccgattagttattttccacaccacctattagacctagcatactatatattgtgtttatttgtttttttggccatctgttctcaccagattttaaacaggattagaacagggatttagtctgttttgttctctcctacaactttgttgcctagaacgatgttgggtacacagtagattctcaatcgatattttttgaattaatgatctaaatctacattactgattaaatcagtatcatgatgattacaagagcaataagtcatagaaagctttgttgattggactcattacaattctagtacaacaaaccctttactaaatctcacttgagaggttgtctaaagtacaacatcagactctcttagcattgatagtgttcacatattacatgtctatgtgcaaatcatatgtccaagccccaccaatgtgaggctgaaaataaaatcacattaattttaaatattcaaaataaaaccttagccttcaccctatgtgactgttgtgttcttctctttacaaacccatcctgctcatcgtttactgtgtcagccagccatctggctcagaccttaggcctctgctccttgcacgggccactctgctcacttctcaagctccctgaaagagcttcctcaggctgctgccactgccaccatactgcctcatcccaaaagtgggcatcaagctttctcttgaaacttgacatacacacagcacagtggaaaccaggctgtcacttaaataagtccttatcaagctctccagtgatcttcatattctgaatccagtggagaagatgggagaggctgggattacaggagcccaccaccatacccagctaatttttttttttttttttagttgagatggggtttcactatgttggccaggctggtcttgaactcctgacctcaagtgatccacccacctcggcctcccaaagtgctgggattacaggcatgagccactgcacctggcctcttttagtcaatattttagtggccctcaagtgtacaacataggcagctctgtataccatacacaggtgtggaactggttcagatgctgtatggagaaaacacagctgatgcaagtgcttcacactgtttttaaaacaggctgtggatgcttatttcaatgatctctacactgaaccccaataagaaaaaaaaaaaaggagttgctgtgattgggtaggattctgtagttgtgttcccttatgttttgtaaacaaaattaattttgcaagctattgattaagagaatacacttaagagtcaaagaattgagttcaaaccccagttcagggtgacccttggaaagcgtctttctctccctgaactacagtttcgtcatctccaaaatgcagtcaatcatcccaggtggtgctgaggactaaaggagatgacatgaaatggcaatgagcacagggcctggtgcacaagaatggcccatgtgaagtgtgaggggttgttcacgttcatctgctgtcacttctatcctagcctaaaactgttaggaggggaaggatgagtgtggtgtgatgcccaaggcaacaaaacctggtgctggtgactaactaaccgctctcccaagggtaacagaacaactgcttttttgtaaactgggttaaatcactccctggtgtggctaacgatgactaatacagcagaagggagtgggctcccctggtgcaaggcactattgggaagttggctgtgctctgcttacaaaaactgtgggtcatcagcgagctctaattcttgtagatcctacgatagtccttaatttgcaaaaagtttactcatttgcagaaaggatttcaacccttacgatatactaaatataatttctgggaagtccttacagacatcctaaagagaaatacactccattaatggtgtgttaatagccttttgacaaggcaggctgtgttagtgtataagacattagaatggatagagacatagaacttggtagatgataggtaacagggaatattaaccagaaaactcatactgaaaacagaaaaatggccccttttgaccacaatattgaaattcttttatttttgtctctctaatagcacagcaaggcacaatatttcaactagaggtattagaaacgttactagcattaagcaaatatgtagcaacttgcataacttcttagaagtgagtaaaatccagttcctcattttttcaagattcctttttacatagtactctagataggattgcaaaagcaatgatcttgcaagaaacgggaccttcactgcaaatgggatacaccgttaaaatacacaagagaaagcattttactttctttgttttctttttaagcttttatcatagaatcagagggcgcatgggcaggattgttacagaggaattttgcgagatgctgaggtttagggtatgactgagcctgtcaccctggtattgagcataatacccaatagacagtttttcaactcttacctccatctctccctcccccgtctagtagttcacagtatctattgttcccgtcttgtgtccctgtgtacccaatgtttagctcccacttctaagtgagaacatgtggtatttggttttctgtttctgcattgtttgcttaggataatggcctccagctgcattcagattgctgcaaagaacctgatttcattctgttttatggctgcatagtattccacggtgtatatgtaccacattttctttatccaatccactattgatgggcacctgggttgatgccatgtctttggtattgtgaatagagagctgtgatgaacatacaggtgcaggtgtccttttggtggaataatttactttcctttgggtatatacccagtaatgggattgctgggtcaaatggtagttaactcttagttctttgagaaatctccaaactgctttccacagtggcaggactaatttacattcccaccatcagtgtgtaaatgtccccttttctttgtagccttatcaatatctgttatttcttgatgttttaacaaaagccattctaactggtatgagatgctatctcattgtggttttgatttgaaaatatgagtctttttcttcccatatatttaatcttctgtactcatttcaacctggtctaatttgctaacccaaacctagactatattgccacatccctgccaggattctgagagaggacaagagccccaaactcaggtattagctatttcagaggtgctcttagttctcctaaactttccttgacaactgtgaggactttggccccttaaatcatattattgagaactagacaatgtagtcacaagacctctgatgctaagtgtttgattcttgttgcagattccccaatactccaattctccaagcagtggatcttgagctgtgacttctgtctgtcataggaagt

SEQ ID NO: 134 - DNA, 56580 bp, Homo Sapiens
tgctttgaaacttgaaagttttaatttacttcatctatttgaccaaatatgattaaatgtagttggcagaactctattttggatcaacatgaaagatactatatttatgagttttgtaaaatatacacaagcatttattgcatccataatctgtaacttacttttgaactgtgaagaccattctcaaaactaccatacaaatactagcaaatttatttgtatacaaatcatatatatgtatatatatatataaatgtaaaaagtatttgccgtgtgtcacatactattctaagcacttgatgtattaattcactaatcctctccaaaactcagtgaggtagtactgtttcttttttttttttttttttttttttttttgagaagtagtactgttatgtccattattgtagagaaattgagtaccttgcccaaggtcacacaggtcacatagtaataagaaccgagattcaaagctctaaaatcagtagtcttcaccatggcaccacactgcttcaaactgaagggtaggttgagctgtgactagaaagacacaagcatggctacatatctggagttgtcaactctggattttttagttggaattgggtcacctataattatctgtattcatctataattctgaaactaaattagatggctgttttgattcttacacttttagacagtggtagattattataaattattcagtatacaagatcttgtataatcaaattactctttttgttaaccaaaattttttaagttgcattcttaatgagtgcagcagccaaatttggttggtaacataaagtactttagacacttttggtttcttaagccgagcgtgtcataaaacttgtgttcttaagagcagaactgtagatgacgatcttagacttacagaattgcatgaaaataacatattctacaaaaacaaaaccttccattccaaagttaacatagcttctcccctgtatttttaacaattttccatttgtaactgcatatatataagttataggaaaaatgtgcctggatcatatttagagcatatacttgcagatttagtccttaacattcagttgtgtcctgtagagagctatagttgtatagctttttgaacatcctaattataatgaaagtaatgcagtgttccaatgtactgctcaaatcctgtttaaaaagtcataaatcaaccagttacagttaatcccagcacttggggaggtcaaggctggaggctcacttgagcccaggagttccagaccagtgtgggcaacatagtgagaccccacatctctataaaaactaaatcattagctgggcatggcggtatgcacctgtgatccagctagtcaggaggctgaggcaggaagatcgcttgatcccaggagttaaaggatacagggagtcatgatggcaccaccgcattctagcctgagtgacagagtgagaccctgtttaaaaaaaaaaggtcatcagtcttttgcattatcatttttcttcccctcattttcccacctctttgcatctgagtcttagtttgtgtgaatgtttgctttgatgacacctgaatttcttactttttaaatatttgtaggtattcgcatattagtagataggtagatgaatgcttctttggttcagtagctacgtaatatacttacagttttttctgtttaggtaatcacaagtgaagaagctgaaagacgaggacagttctatgacaacaagggaatcacgtatctctttgatctggactatgagtctgatgaattcacagtggatgcggctcgatacggcaatgtgtctcattttgtgaatcacagcgtaagaagacatacgtaaattttagacacgactaacaattcaacctagtactagtttccatagctaaagaataattccctttaaactacatatccttttaacatttccaaaatatgtattttataaggagggcagcttctgttaagttatggtattattgctgtattaggaaaattaaacattgaggtgcctaccaaatattaatagggtgtattttacaagagtctttacatatgttacttcatttaaactttctagtaactttgtacggtaggtattactttcatattacaatgagcagagcaattaagaggtaaaatgtccaagaattacacagaactgtatcttaatggaagttaacacgactacattttaggatgtacaactgaaggtaaatgtattttcttaaaatgtaaacatgttaactttttataaaatttaaagatttgtagagtatttatgtagggctatttttctaaattataaattagtattcttccttaccttttaatgtctgaaagctcttagaatacagctggcacttaactgcagaattctggactctaaataatttccaaaaattagggaagttaataattttgggttacctactaagtagcaagtggacagtaaaacattaggcttgttagggtgacattatctgcattttgtggataataaggacagtgtgtgccacaaagttatatagctgaacatataaaggaagtagaccatgttaaacttctgatggatttcatagtaagaaattggtgtatgattagcagagagcttctgggcccttgtttgttgattaaacattgaagaatttttttcttaatgataaattcgagatactctcaaaatagagatattctatccagggccatcaaacagttttgattccttagtatgactcactacatcttttttcttgcatattccgtaagtttactgtagtattctcaaaacattgaagagtttggaccaaaaattcaagcagtgaaactccatgcagtgtaaaatttgagttctgtagtgcagatttgattttttaaacacagttgttctagttattttaaagtgtatgccttactgaaatagttaccagtgaaataataatgttatctgggatttgtattgaaattctccaggaaaaaaaaaagttgggactagaggaataagattggcaagcatgttactaattgttgaagctgtatagtggatacatagggatttcttattttctctattttatacttgtctgaagtttttataagggaaaaaaatctttttaaatgtgcatgcctcaaagacctctaagcaataagcaacttaatttccagtggaacttaaactaaatctctaggaaagtaaacattttatatggcatgtagaagggcttgtttacaccgtttgtacttaaatgggttctaatgttcctttttagtgtgacccaaatcttcaggtgttcaatgttttcattgataacctcgatactcgtcttccccgaatagcattgttttccacaagaaccataaatgctggagaagagctgacttttgattatcaaatgaaaggtatgcttttcaagtacagtttcattggtgtcagtttcaatatgaagaatcaaatcagactaggaacagaccttagatatttgaaccaaacctaatactaaagatgaaaagttgaggcactaagtttgtcatcctaaggtacaaagctaatccaacagctaatactagaacccaggtctgcctgagcttcagctgaggaatggttctacatcgtaaattttcagaacttccattttggaaactgatttatttattatagcatcttaatactgtactacttgtctttttttttttttttaaattgtgggctaagcatgctggctcctgcctgtaatcccagcactctgggcttgagcccaggaattcaagaccagcctgggcaacatggtgaaactctgtctctacaaaatatgaaaaaactagccgggcgtggtggcgtgtgcctgtagtcccagctactcgggaggctgaggtgggaggatggcttgagacagggaggttggggctacagttgagctgtgaatagcaccactgcactccagcctggacgacagagaccctgtctgaaaaaaaaaactataagcctacatttttgaatttttactgagagatgtatattcaaaagattgaaaatatttaaatcacatacaaatttattctattcctacttgaacctggcttttaaaaagaacatttaattctatttgctttattgtgacaatataaatgttttctttcctttaagaatgatggcctttacatattgtcattgcttaacctcttacatactgtgcttttatatacggtgtgaaatgaatgtgtattagatattcccagtaagtttcatcatttcagaaatcctttctgacaaatatgggctaataacataaagtttacctattattaacccacaccatcctttcaagacaattcattatgatttgacgctgaatattaacatttatttgtaaatatttcaaagggaactaactacatttccttgggagttaacttactctaagggtcttgaccatgtaagtaccctctatcactgataataaagctaatataatagaaaatttgaaatttattctaaattgtcttaactctctttctcctatatttctttttctgtgtcttcaggttctggagatatatcttcagattctattgaccacagcccagccaaaaagagggtcagaacagtatgtaaatgtggagctgtgacttgcagaggttacctcaactgaactttttcaggaaatagagctgatgattataatatttttttcctaatgttaacatttttaaaaatacatatttgggactcttattatcaaggttctacctatgttaatttacaattcatgtttcaagacatttgccaaatgtattaccgatgcctctgaaaagggggtcactgggtctcatagactgatatgaagtcgacatatttatagtgcttagagaccaaactaatggaaggcagactatttacagcttagtatatgtgtacttaagtctatgtgaacagagaaatgcctcccgtagtgtttgaaagcgttaagctgataatgtaattaacaactgctgagagatcaaagattcaacttgccatacacctcaaattcggagaaacagttaatttgggcaaatctacagttctgtttttgctactctattgtcattcctgtttaatactcactgtacttgtatttgagacaaataggtgatactgaattttatactgttttctacttttccattaaaacattggcacctcaatgataaagaaatttaaggtataaaattaaatgtaaaaattaatttcagcttcatttcgtatttcgaagcaatctagactgttgtgatgagtgtatgtctgaacctgtaattcttaaaagacttcttaatcttctagaagaaaaatctccgaagagctctctctagaagtccaaaatggctagccattatgcttctttgaaaggacatgataatgggaccaggatggttttttggagtaccaagcaaggggaatggagcactttaagggcgcctgttagtaacatgaattggaaatctgtgtcgagtacctctgatctaaacggtaaaacaagctgcctggagagcagctgtacctaacaatactgtaatgtacattaacattacagcctctcaatttcaggcaggtgtaacagttcctttccaccagatttaatatttttatacttcctgcaggttcttcttaaaaagtaatctatatttttgaactgatacttgttttatacataaattttttttagatgtgataaagctaaacttggccaaagtgtgtgcctgaattattagacctttttattagtcaacctacgaagactaaaatagaatatattagttttcaagggagtgggaggcttccaacatagtattgaatctcaggaaaaactattctttcatgtctgattctgagatttctaattgtgttgtgaaaatgataaatgcagcaaatctagctttcagtattcctaatttttacctaagctcattgctccaggctttgattacctaaaataagcttggataaaattgaaccaacttcaagaatgcagcacttcttaatctttagctctttcttgggagaagctagactttattcattatattgctatgacaacttcactctttcataatatataggataaattgtttacatgattggaccctcagattctgttaaccaaaattgcagaatggggggccaggcctgtgtggtggctcacacctgtgatcccagcactttgggaggctgaggtaggaggatcacgtgaggtcgggagttcaagaccagcctggccatcatggtgaaaccctgtctctactgaaaatacaaaaattagccgggcgtggtggcacacgcctgtagtcccagctactcaggaggctgaggcaggagaatcacttgaattcaggaggcggaggttgcagtgagccaagatcataccactgcactgcagcctgagtgacacagtaagactgtctccaaaaaaaaaaaatttttttttttttttttttttttttttgcagaatgtgtcaacaaaaaatactttcttaatggcatttgtgttttaagaaaaatcagtcacatagtgtcagtgttaagaaaaggttgtaggtttacaggttgcccccagtggccatactttgaattgtgattctcacgggtttaaagatgtgatttttaaaaaatcagtgttttaccatctagttatttgatcttgtccacttttttgtgttcaacaaaagtgtaaaactggaaagcaaagaaaaaaagactattttcagtaaacatgtagttttgttttgtctttattgatagaatgtaatgggcctttgggatcttaagtactacttatgttacctttgttattcagatgctgaacttaagcagtgaaataatagaaactaaaggatgttattaaggggtttaactattttaagtcaacatttagcttatccatcatattggtttcctgaagatgtcagaatttttcagtgtaagacaaatatcaaaggtaatagatccagtttaaaaggtgaatccactgtatgtattatattgataccatcattttcaggatctacattaagaggatggtgatacataattagtaatctcagggttttttcccccatatctaaaatgtagacaatagttgtttctcttttagttcatcagtttctcttagcaaaataaattaggttgggcatttaatgttctatttaccatggcttagctttgtttctgttttacagtcatttccagtaagactataaaaggggcagaaaaatactgatgtattgactacgtgctagcaagattaaccgaaggtttatattcaattcctttaaatgttactttccttttaagatagctttcatggttcatgcatttgatactacacttgatcttggccaaaaggccaaggagtgatggttcatgcatttgaatattaaaggacaatttgacatttcgctagcataatgtggatgaatacttcagaaatttttgagcattgtcactcaccaggtacgtaaacatactatggtaagtactgcctagaaatgcaaaggaattttagaattcagagctcatattcattgacccagtcttttatgccttttatatgtattcatgtgcttctaatgaacctgtcaggttggtgtaaggtaacaagcttagactgttaagataatgtcaacatgccaagatcacccagtgaactttttaaagtatttaatcttcggcttcaggcagactttttaaaaaactagtttatactattcaaacatttaagtcctggaactcttctccaagataaatgtggctgactgctgagtgtcttctgtgatacatcttggcattttgaaacttcatgtttcggctggacacggtagctgacgcctgtaatcccagcactttgggaggccgaggcgagtggatcaccagaggtcaggagttcaagaccagtctgaccaatatggtgaaaccctgtctctactaaaaatacaaaaattagccaggtgtggcacacacctgtaatcccagctacttgggaggctgaggcaggaaaatcacttgaaccctggaggctgaggttgcagtgagctgagatagggccactgcattccagcctgagtgacagagcgagactccatcttgaaaagtaaaaaacaaaaacttcatgtttcctcttgtggtttatgattcttgacgtaaaaaccaagtagctgctacaattaaccctgctcatgtttatacttttttggagagacatcagagcatagcagttaagatcatggtctctgaagccaaactgcctgtgtttgaattctgcctgtgcctcatagctatgtgaactaacctctgtgcctttgtctcatttgtacatggggattagaaatgtatctacctcaaagggtggttgtgaaaattaaaggagttcatatagtctgtaaaaaacttaagagcatcatcagagtaagcaccaaatataatttctggtaatcactatcggtttcttgatcacatctgttgtagttgtcttagcccaattcattcagccagcatttataatgccagactcacatataaaacaaacgtaacagtatgtaatattaatgtgattataaaataacaggaatatattcagaggaatgtttacaggcattttttgaacaaccactttcgatcataaggtacactgttaaaactaagttttagttaacagtgaatatatacaaatgtgtatagttatgtgtatactaactctgagtcttgttaccctggttagtctggtggatccaatactttttggtcggattgccatgcagcatcatgataatgcatatcaagtgttagtttaactgatctgcaaattgttttaagtggtgtctctgcttttgcttccataatctatgaaatgtcacaataactaagtgttcctgaatatctgttaaaacttgttaaaaatcctcatacataacacaaaagcctaacacattgatggacttcaagaatgttgaatgactcacagaataacacatatactttagttttttttaatttatttttcttgagatggggtcttgctttgttgcccaggctgggcacaatcagctcactgcagtttcaacctcctgggctcaatccatcctgccacctaagccttccaagtagcgaggactacaggtgcacaccaccatgtctggctaacattttgtggagacagggtctccctgtgtgttgcccaggctggactcaaaaccctgagctcaagcgagcctcccaaagtactgggattgcaggcaggagttactgtgcctggccaccatttaattcttgagcattttcttttatattctaattgtccgcttctaatttggccaccgtattcacatcaaggttaagtgacttaacatctttggggataaataaggtgctgattttgtctatagccatcagtttatcatactagatccaagtttgtcaatttaaatcaggtgtgtttatgagcaaagatatgatcatgctgaatgttccatgtgtacttcaggagatacattctgctagtttggggtggtgtgttctataaatgtcaatttaatccagtcggcttatgattttcagttctatattcttactgattaatgtgtatatactagttctgttactaaggagggatgttaaattaatccctagctgtaattgtgcattagtttgtctcttttcagctgttctagcttcataaatttttggagctgttaggtgcatatacgtttaggattattttgtcttcttggtgaactagaccttttatcattaggaaactgtccatataaccactccatttttaattgtttacatggtttttccatccttttaacctatcaatcacttgaattgactttctttatagacagcagatcactgggttatgttggttttttccgtgtctcttgtcattgatgcacttagaccatttacatttaatgtaatcattgatacgtatgggtttagttctaccatttttttttctttttttttttttttttttttgagacagagttttgctcttgttgcccaggctggagtgcaatgacacaatctcagctcactgcaaccaccacctcccaggttcaagtgattctcctgccttggcctcctgcgtagctgggattacaggcatgagccaccgtgcctggcctttttcttttttaaacagggtcttgctctgtcacccagactagaggtgcagtggcacagtcatggctcactgcagcctcaatctcctgggctcaagtgatcctcaagggcctccagagtagcccaccaccatgcctggcttttttttttttttttttttttgtaagtagagacacatttcactgtgttggccaggctggtgtcgaactcctgggctcaagccattgcccacctcaaagtgctgggattacaagtgtgagccaccacacccaaccaggttatttgaacatttttaagtactgtattttctctattgtaatattgactgtcatctctgtgcaggttttttagtggttgctctaggttgaaacgctttgaattcttaggtatctaagagtgagcattttctttttttgactgctatactctcaccagttgccagcttctcatataaatattgtaaatgctctcgtttaggtaactcagcttctggagttgagggaacttcaaaatcagaagagctctgggaatctgcatttgtgctaagatttagcaaacttttttcctcgggtatatgtgtctcactgcttagagtagttggttctccagtactaggaactattgtcacatctttatctctgcttttcaaatcagagtaagtatcctttgggcaaattacattttgttccatgagagaggcaggaatattctctttgattgttggtctgtagtcagctttgtccaaggaagtaatatccccactgtttctctcttgggaagataacaaaacagtatcagattggctgtcccagccttgacttccttgttctgttatgtgtgttgactgggaagaattctgggaggagatgtgagttgattctccatcagagtcactgaaaagctttggtgactgagatccccctgccactgtggaggaagggaagttttccaaactctcatctgtgatttcatcatttcttttaaagaatacttcccactggggtacatccccatcagccttttgcaggtgaagtacagagcccagatctccttgcagtgaagctgggattcctacttcttcttcactttcactgttggattcttcacaatctacaaagtttgtgaaacgagagctctgcatacactctgctctgcagcatcctggggtttgtctcagtttttcaggctgcttttctgatactgcagtcattgaaaatacctcagggtgaaaagtttccgggtatggaactttgtgccttaaaggtattggcagaggatcatcaaagagatagtcatcttcctcctctgtgggacaaacaaaacaggtttataggaaacaaggcaaagggagccaatttgtagtatttatctgtacttttaattcttggaattgcaaagaatagggaggccactcttcttcaaagggaaaagatattcttgggatatgctgaacaatttaactgccatccttcaactttttataataaatgccagagtatcagtggagaatatagagcagtcactctgctctatatgtaagcctggctgatcattacgatcatatgcaaaacttcaaaaaaagaaaaaaaaaaaaaacaggtttctgtatctcattccagacctactgaatccctgaggaagataggaccaaataatttgatttttaagttctacagctgatatctgttcagccaggtttgcaaagcctgtgtgctctgcaaatagtagatgctcagtgggttggctgacttaggaaaattaaattgctttttattaaggtttttcttctgtgagcatcttattgacatgttttatgcacaaggttgcaacaggttaaatcaactttaaagcaaaatactgaataatcaacgtgtcaagaacttaaaattcaaaacattaataagcatgctgtgtcaacaaatgttcttaaaatgaaaaaagccttacttagaaaaacaaatattttcccatcttgtaacagtatctaacctaggaagaaagttaaatgcacccaagactactgtgtatggcaacttcttgttctactgctgaatctggtgttataataatccacttaaatgatgtggctaaacactgcatttttaagacactaatataaaggaccatagagaccattatccagctcccatgttccccgtgtgaagctaggcccagagaaaagggtgtgccaatacacacgacccaacctcattcttaaaggttcagtgttatgacttgtaactgaacttagggcttaaggtcactaagatatctaacgactgtatttggaatcatcctagactgcagaatgtagattttaagccaaagatcatatgtatgttttaggtccctcactactatgccaaagttgttttttgagttttatacagtcacagttcagcctctacctctcaggctcaggagatccacccccatgcccagctaattttttttagacagtgtttccccttgttgcccaggttggttttgaactcctgcactcaggcaatccaccccctcggcctcccaaattgctggaattagaggcatgagccactttgcctagcccaaaattacctttttatgaaatatttttgtatgatctctaagttgaacagttctgcattccaaatcagtgactatgcctgatcccaaaagacatttatcaaaaaggagtgtggattgggtagatgcataaaaggcacaaaagattaaaggaagaaaggacttttgcttccaggtaagatggagtaacggactagatttaacctcccacttgaaataacgaaaaatcagaaactatctctcaagaaaatggacatcgagcaattaaggacaatgacatgagaaataagacacagatgagtcctatgattgcctgactccctgcttcataacagattccagtcagggagggaacatctggatagagcccatggacatccttgatgtgaggtggaagtggaacattgaagaaataaatgtacctggagtttacagagcagaagaccagagaggagagtgctgcacagaaactctgaaaagctgcagaggcgtccccaccacgtgttcagtgcactaagcagcatgtgcttgtaaggaaactacctgcagccaggcaacgaatcactcaaacaaaaggaaagaaagtgcccagaactcaccgtgccaggaacagtgtcttgtcctggtcccaacagccagagtggaaaacctcatgatccatgggcatttgtaaaagaaccaagaagagccttgcctcagtagtggggaaaattaaccatatactaaatgctactctgttcctgcataacaaaggtaaaagacacgaaaagatcaaactataaacatgctaaccacatgccagaacaaagctcaagaatgtttttagaaatcccaaaattatgcaggacctaaaaaggtaaaattcagaatgtatggcattcaaaaacaaattatcagaaattcaagaagcaggaagatacagtcaaaactgactgtaaaattatgtaacatgggagtcaattttcatgatcttggatcaaatagtttcttagatatgacaccaaagcatatgcaataaaagaaaaaaatagacaaatttaacttaaaacctttacgcttcaagacaccatcaagaaggtgaaaagacaagtctgagaaaatatttcctaatcatgtcagataaaggactgataccagactttaactcttacaactcaatacaaaggtcaataatccagttgaaatgggggcaaaagatcagaatagacatttcactgaagaagttacataaatggccaataagcacatgaaagaaagctcaacattagtcattagagaaatgcaaatcaaaactgcagggtaccaccatacactaggatggctatactaaaaaagacggaagtgttggctaatatgtgaaggaactggaatctttacatattgccggagagaatgtaaaatgtattcagtgtgggaatgtttggcagttccttggagtgttaaaacagattgaccatatgttatgaactgaacgcttcctgtcaaaattcatatgtggaagccctaaagccagtgtggctgttatctagagatggacctctagggaaataattaaaccatcataaggctggagacttgatctgcctaagtgctagaattacaggcttgagccactgtgcccagcctaatttttactttttttttaagcagagacaagttttcaccatgttggccaggttggtcttgaactcctgatctcaggtgatccatccgcctcggcctcccaaagtgctgggattataggcgtgagccactatgcctggcctcctgtttaagctacctagtatgtgttattttcttagggcagcccaagccaactatatgactccaaaattctaccccccacaagaaataaaacccaacagaaagatacgtaaagacttgtactcaaattttcatagcattattatttaaaaaggagaagcaacccagatgtccatcagctggtgagtggataaataaaatgttgtatgcctgtacaattgaatattggttggcaataaaaaggtatgaaatactgatatatgccacagtatagatgtaccttgaaaagataatgcgaaataaaagccaggcacaaaatagcacatggtgtataatttcttttttttctttttgagacagagtctcgctctgtcgcccacactggagtgcagtggtgtgatctcactgcaagctctgcctcctgggttcacgccattctgcctccgctgccctaatagctgggactacaggtgcccgccaccacacctggctaattttttgtgtttttagtagagacggggtttcaccgtgttagccaggatggtctcgatctctctgaccacatgatccacccgccttggcctcccaaagtgctgggattacaggcgtgagccactgtgcctggccaatagctgggactacaggcgcccgccaccacacctggctaattttttgtgtttttagtagagacggggtttcaccgtgttagccaggatggtctcgatctctctgacctcatgatccacctgccttggcctcccaaagtgctgggattacaggcgcgagccactgtgcctggccatatgagttctcttatatgaagtgtccagaaaacacaaatctatagagacaaaccatagattagttgcggcctaaggccgggaatagtaatggggagtgactggaaatagacataaagtttcttttttgggtaacaaaaaatgttccaaaattagatagtggggatgattgtacaattctgttatactaacagtcgtggaattgttcacctataatggatgaatttatggtgtatcaattatacttcaataaagcttaaaaaataattttgtattgtggagtttataaagttaataacagagaatgtatgacaataacagcacagactgggagaagaggaatggaaatatactgctggaacattcctataccatatttggagtaatatatcatttatcttttcactctgatatgttaaagatgtatacggtcagtcctctgtatccacaggttccacatctgtagatttgactgaccacagatcaaacatatttggaaaaaagcaaaaattaaaatacaaaaaacacaaaaattgatacagtataacaactagttaccaagcatttacactgtattaggtataagtaatccagagatgattttaagtatatgggaggatatgtgtaggttatatgcaaatgtaacaccatttaatatgacttgagcatctgcagattttggtactcttgggggggtcctggaaccaatcccccaaggatactaagggatgactgcattataagccactaaaataagaaatcagtgagttacacagccaataacccaacaagagattaaacagaatcagtcagtaattacttgacctgaaagaaggccaaaaaagaataaagaacaaatggaacaaatagcaagaggataaacttaaacctgaccatatcaatgggtaccattaaactaagtggactaagcactgcaattaaaagccagaaaataccaggttggccataaaaacatccaacaacatactgcttacaagaaacccactttaaatataaagactagttaaaaatacagagatggaaaaagatacatcaagccaatattaatgagaagaaattcaaatggctctagtagattgtagaactaagaatgttaccaggggatagactcatttcctaaagataaaggtatcaatccctcaagaggatataagaatcttaaacttgtgtatacctattaatagtgcctcaaatagatgaagcaaatgccaatagaactaatcaaggcaaaataggcaagtccacaattacaactggagattgcaacacccctctctggcaataattgatagaacaagaatgtagaagacctgaacaacattgtcaactaacttagcctagttgacatttatagaacacttcatccaacaacagtagtacatatatttctttgaagtacacattaaacatttaccaggtttaatgtgtaaattggtccacaattgatggtccgtaaatattctggaccataaatttcaaaagtaccaggccaggtgtggtggctcacgcctgtaatcccaacattttgggaggcaggtggatcacctgaggtcaggagtttgagaccagcctggccaacatggcaaaaccctgtggctactaaaaatacaaaacattagccaggtatggtggcgtgagcctgtaattccagctacttcggatgctgacacaggagaatcacttgaacctgggaggcagaggttgcaatgagccaagattgtgtgactgcactccagcctggggaacagagagaatccatctcattaaaaaaaaaaaaaatcatacaaagtatgttctctaaccacaataacattaatttagataacagaataatccctgggaagtcctccaaaattcagaaactagtaacaaatttctaaataacccatgtgtcaaagaaaaaaagtcaaaggaaaaatttaaaaatgttttgaatgacaatgaaaacaagacaaatttatgggatgctgctaaagagggaaaattatagcactaaatgcctacattagaaaataaggtctcaaatcaacgacctcagcttccatattaagaaacttaaaaatgaaaagcaaataaaattccaagtaagcagataaagatcagagtggaattcaatgaaatagaaaactaccccgtgccaaaaaaacaaaaaagagagaaaatgaaaataaaaccaaaaacttcttatttgagaagatcagtaaaactggtaaacctctagctagactaatcaagaaaaaaatgagagaagacacaaactactaatatcaggagcaagaggattaatatcagtagattctacagatagtaaaataataaacattaagaacaagtttatgccaaaaaattaagcaacatggataagacaaattctttgacagattcaagttaccaaagttaactcaataaaaaaaaaaataacctgaatagtcctgtgcctattagagaaatcacatttgtagttaaaaaaaaaaaaccttcccacaaagaaaactcctttcccacccagatggcttcactggtaaattctaccagtcatttaagaaagatataatgccaatcctcgaaaaatttttccagagactgagaataaacacctcacaacaatgaggccagcagtatcctgataccaaaaccacacaattacaaggaaaagacaaaactccagatcaatatcccttctgaaagtaaatgagaaaattcttaccataatacttaaaaaggataatatgccatgactaagtgggattagagaaatgcaagtttggtttaacactcaaaaatcagtgtatgtcaccatattaacagagtataaagaaaaacaatatgatcatctcaacaaatacagaaaaagcgttagacaaaacccattatccattgttgatatctctccacctaccaagaacagaagggaagtaattctgcctgacacaaagcctatacttatcattatacttaatggtgaaataatgaacttaatggtgaaacaatgaatgctttctccttgagattgggaacaaggcagtgacacccactcttgccacttgtttcacactgtagtggtagtctagacaagaaagagaaaaacatcctggctgaaaaggaagaagcaaaactgtctatatacacaaacaatgatgatcttatatagaaaccgcaatggaatctacaagaaaaggcactagaactgatacttgagattagcaaggttgcaggatacaagatcaaaaatcaattgcacaggttgcattgcatatccctaatccaaaagtctgacatctgaactacaaaggaaatccttattgcagcattttagattttctgattaaagaggttcaaccattaaatgcaaatgcaaatgttccaaaattcaaagaagtccaaaatccaaaacacttctgctcccaagcattttgaataagggacactcagcctatatttctatatactaacaacaatcaggaattgaaacttaaaaagtaataccatgtgcaacagtatcccccaaaatgaaatacttagggattgatttacacagacttatacgctggaaatcataaaacactgctgagagaaattagagcagacttaagtaaactgagaggtataccatgttcatggatctgaaaattcagtattgttaagatgccagttcttgccaaattgatcaacagatttaaaacaatcctcatcaaaacctcaggagaggacatttttgtacaaattggcgtatgattctaaaattcatatggaaatgcagaggacctaggataaccaaaacaactttgaaaatgaacaaggctggagaacttaaagcacctgacttcaagatttacaaagctacagtaatcgagatgggtgatattggtgtcaagatagagattatgaaacataagaaagaatccagaaaataatctccacatatcttgtaaattgactctcaagaaaagtgctaaagcaattcagtgaattaagatagtgtttccaacaaatggtttaagaacatttggatatccatacagacacacacacaaaattacctgggatctacatttgaaccatatttttaaaaacaaaaatgaatcacagatctaaatgtaaaacctaaaattgtaacaacttctggcagaaaacaggagaaaatatttatgcctttgggtcaaagatttcttagatatgatacaaaaaaaagtaaaaattgataagttcacttaaaatttaaaatttctgctcttcaaaatactctgctaaaaagattgaaaagattacctacagagtagaagaaaatctttgtatacacctgatatatttaaaaaaaaaaaacaaaaaaaacttgtatccagaaacttaggaaaacttagtaatatgatgggtgcagtggctcatgcatgtaattccagcactttaggaggccaaggcaggcagattgcttgagctcaggagtccgagaccagcttgggcaacatggtgaaactccatgtctacaaaaaatataaaaattagccaggcatggtggcatgtgcctgtactacttgggaggctgaagtgggaggatcacttgagcttgggaggttgaggttgcagtgagctgtgattgtgccactgtactccagtctgggtgacagcaagactctgtctcaaaacaaaacaaacccaacaatttaaaaatgagtaaagatttgaatagacacttcaccaatgaagatacatggatggcaaatacgcacattaaaagatgcacaaccttgctagtcattagagaaatgcaaattaaaaccacaaagagctatcactgcacacctattaggatatttaaaattaaaaagtctaaccataccaagtattggcaacgatgtggagcaactgaactctcatacacttctcctgggaacacaaaatggtcaaaccactttggaaaacattttggcagtttcttaaagatacagctaccatatgacccattcttaggtgtgaaagcctacgtccatacaaaagtttgtacatgaatgttcatggcagctttctttttaataagaaagacactggaaacaacccaaaaatacatcaacaggtgaatggatcagcaacttgtagtatatccctgaggtggcctactccttatcaataaaagagggtgaactattgatacatgcaacaacatgaatgaatctctgatgcactgagtaaaataacccagacgtactatatgattctatttatatgaaattctagaacatgcaaactatagtgacagaaggcagatcagtggatgccttggcatgggtgagaaccggagggaattacaaaggggcataagaaaacttgaaggtgataatttcagtatcttaattgtagtcatggtttctcaagtatatgcatatacaaaaaatttatcaaattgtacaccttacatgtgcagtttatatcaattatacctcaggaaagctgttttttaaaaaaaaaaaaaaagaaaaaaaccttagtaaatttgtaaggattagaggatgcattacataatagagttaacatctgaaattaatggaactgtttttctaaaaccttttaattattgaaacaaaaacaaatgtggttttttttgggcaccagttataggcttactatatcagtcttggaattgtcatctaaatgttttaaaattagattctccatgagcagaaatgcagaagcagagatgagacaggcctagattagaatcccaggcccatcacttacttcttgctagtccttagggacttaagtctctaaacttcagtttcctcatcattataattgggatggtaccccttgtaagtttgtttagaggcttatctataacatatgtaagggacctagcacaatacctgccattaataggtgttcaaaaaatagtatcatcattatctcgtgtgttttggtcaagtatttactgcatggcagagtaactgactttccaccaaaggaatgaaaatcaagaatcctaaccacgaaatagggctgctggaaagccccagagctttgctcagaatctaacgttctgattactactgcagagcttgcctctgtccttcactagaaaaatcaaagtagcaatgaaagaaggtacaaagtatagagaaaaatccttctgtataaacactactgatcaacttgatcagaaatgatgatgagaaaagtctattatcagcatttactagtatcttaagaaaatgttcaaggataacaaaccagcctctctatgtcctaagaaaatgttcaaggataacaaaccagcctctctttatggcctctactgatcttagggtgtatttccagaaagctgagaacaccacacacgatggcaccgttttcaccacttgttttaacccagagaaggagagcagactcctgattttacaggctgaagacaggaaggcaaagtacttcctgagaccatgtgtcaagtctgacctgtggtgggtcccaggtccactctgcccaaggccacttctcccagacccaagctccctggaaagcagtgtttgcagggagcccacccctctgaacccaggaccatttttcttacctgagtctcggtgaactgttctagctctcttcagttttcccagtggtttatactttggctccgtactttgggaagaccggcataaaggctttaagctgaaatgaatcagaatatttgatttttccttttgaggaagttgttagaaggtagacatcattgatagtattacaaatttttttgattttgttttttaatttcttggatccctgtttttaacaaaatcttgaccataagggaaatcacacaactactttggaggattgaaaagcagttctaaactgatttcatagttaaaaatcactttgatgtaataaagtggcaaatataagcaattaaatgcaacccggttgatgtttatcttattgttacatcagtagactaaggtaaaacttagatctttgctcttggaatgcaaaaaaagcaggtccctatcctgaaaacctatgaatacagtgacatcctctggcattcgggatacaatataactagctgcttctcctgccctgttcagtagggtttacttatatctcacaggaatctccacaaatttatcttgtcattctaggtccttaggctgaaagctaagacaaagtggagataaaatacaaaaaggcagagaaataagatttgaagacgtcctacccctttcgaaggcctcactgccaactgcctcctcctggcagattccgggaagcctttaggatgatctacaacataccatttgaacagggccatgaggtgcccaacctgaaacttctttacagccacccccattttacgtcctcacccctgttcccacagctgttctctggatccatccccttcaacctttccaggagttctgatccattactgtgtctctttacatcatttcagctattctcctgggttaacttttcaaagtaaggttgtcttcccccacctacctacaacagaattgtctgctagaaatgaaggatgggggccgggtgcggtggctcatgcctggaatcccagcactttgggaggccaaggcaggtggatcatttgaggtcaggaattcaagaccagcctggccaacatggtaagaccccgtctctattaaaaatacaaatattagccaggtgtggtggtgggcgcctggaatcacaactactcacaaggcttgaggcaggaaaatcgcttgaacccaagaggtggagtttgcagtgagccgaggttgcaccactgcactccagcctgggtgacagagccagactctgtctcaaaaaaaaaaaagatgcaggataaggaatgaatatgcattttaacaagcacctcggctgggcacggtggctcacacctgtaatcccagcacttggggaggcctaggtgggcagatcacgagaggtcaagagatcaagaccatcctggctaacatggtgaaaccccgtctctactaaaaatacaaaaaattagccgggcgtggtcgcgggcgcctgtagtcccagctactcgggaggctgaggcaggagaatggtgtgaacctgggatggggagcttgtagtgagccgagatcgcgccactgcactccaacctgggtgacagagcgagactccatctcaaaaaaagaaaaaaaaaacaagcacctgaagtgattcctaaacacatccaagtttatgtatattcaagtttagttctacaggcatatttaagtctcagctattttaagatcaagcctcctgattctgttgcctcctgttgccatcttgtctctaactttcccttcactgtcaaactttttatatagtctgtcctcagtattttccatttcctcactttttacctatttctcgactgaaatctggcttgtaactcacaagtctactgaattgctctcactgagcacacacaaatgacctaattaccaaggaaacgggacacctggtagtccccatattatttgacttctcaagacactccatgggcaccctctgcttacccttccctttgctctcatcccgctgtctgggccactctctccatcttggcccagcttctcctccttcacttctaccttgaatgtgctgcccagggttctggcctcagctctatgatccctcctcccactcctggtgacttcttcttttctcatggttttagttctcacctgcactgccaactccaattctgtgtctccaacccagacctctctccagagattctccatcctcctttccatcgacatctgcaagcctggtcctgtctgtccccatcggggtctgcgaagcagattccctgacacggggcctcattccttctgcacccattgagcttgtgtgctgcctttgcacccggcctctccgtgagactggagctctgctaggacaggctgtgtcttaggcaaattggaacccaagctccattcccaccatatggctggcactaaagaaatcattcatgggccgggtgcagtggctcatgcctgtaatcccaacactttgggaggctgagacaggtggatcacttgagctcgggagttcgagaccatcctggtcaacatggcaaaaccttgtctctactaaaaatacaaaaattagccgggcatgatggcatgcacctgtagtcacagctactcgggaggctgaggcaggagaatcgtttgaacccaggaggtggaggttgcagtgagccgagatcatgccactgtactccagcctgggtgacagagtgagaccctgtctaaaaaaaaaaaaaaaatcattcatgaatgcataaatgaaacccaaagaagaggtaagaaaatggtaatactgtagtaaaagacatccatgaatacgattgcacctctcctttggcttcagttatccattcagtagacacttgacaacctacttggcatggtgctaggtgcttttcttacactatctccctgtatcatctctttcttttttaagaagaccaacaagtaggcatcaatattcctattttgctgattcagaatgactagctcagagaagtgatctggccaagctcacactgcactgttagtaagtggcggagctgggttgcaacccaggagaagctgacaacactacctataccttctgccacactgtggaactaaaggaaacactccaggaaaaaatggaaatgagtatcagttcagaaatgtcccaaaacaaacagattctagacttgtaaacattcaggcaaactctcctttgtgtcctagccaagagccaccaagggggacaccaagtcccacaaccagtgactactcacatttcgacaactttatccatagttgtgccaactggaatgacatttggatatgcgttcacaggacagaggtagctcaagaaatctttaatctagaaaaaggaaaatcacatggatcaacaatctctacgatgaaacaggttgttaggggagataaagggaggctggggaaagagaagcagaactctcttatggctgtggttctcaatgctggctgcacgtggggatcaccagggacctcttgggaaaaaaatatccaatgcctgggcctcactcccaaagatctcctgaacactgagtactagtgggcctagaaatcagtacatttaaatattccccaggtgattctgatccacagtaagagctgagaatcaccaatgggactcaaagattcttttttttttctcttttttaatatattgctttccttgtccaagaaggtcagttgcttatgtttaacaaatcccttttcaaataagttagaatttagctgggcattaactataatatacacaaaaacccaaggtctcagaattgcatttcttagctgggcacagtggtacatgtctgtgatcccagctactcaaggctgaggcaggaggattgcttaagcccagggatttgaggccagcctgggcaacacagagacacctcatctccaaaaaagaacaacaaaagaattgcacttatttactcctaccaataatcattaacgatgccaagagaattacacctttgaggttacttgatttgttcaaatggttcattctcattgggcagaacaccatgcattcgtcactgattccagggaaggatccaaacactgcccattgtaccttggtgttggagtcaccaaggaaaacacaatgcagtcaagcactggagggagcaatgcttcacttactgagaaaagaccaagcaagatcaaatccaacaatgtgcactggtctccagtgaccagtgtgtctctccctgcagccaacacagggcaacctgcctacatgcaaccctctcctgccacacaggaaggaacccccatcatgctgtctgaaataaggacagctggggtgtgcctaagggccattgacacacaggcttaagtagaacaaagggacacacatcaagtacgaagcagagaaagatgtttccacacaaggtactgagctgccgcaggctgtgtgctcacgctaacgggagtgcttgctctctctcactcgcgtgcgctctctctcaataaggaagtgtcccattcttatgtggccagtgagggttgaaagactgtgcacatagactgcctctcccaatgattaattctaaacaaacaattacatgcaaaaacttcatgaataccttgactttttgcaaagttcagaatgctaaacagaggaactctgtcactattcctcaaaacatctctacaacctagaggaacttcagctttgtctcttattagacattggtgagcttgtgatctcagtcaagttacctaatgtctctaattttagattcttcatttaaaagtataaatgagattatgcatgtgaagtgcttagcttggtatctggtgaaacagtcaataaaatcatccaggccaggcgtggtggctcacacctgtaattccagcactttgggaggccgagccgggtggatcacaaggtcaggagttcgagaccaacctggctaacacggtgaaaccccgtctctactaaaaatacaaaaaattagctgggtgtggtcgtgggcgccgtagtcccagctactcaagaagttgaggcaggagaatggtgtgaacccgggaggcggaggttgcagtgagccgagatcacgccactgcactccagcctgggcaataaagcgagactccatctcaaaaaaataaataaataaaaattaaaaaattaaaaaaaaaatcatccattactaagttgataatgagaacacaaagacttttatgcccttctgcaaatggacagactagaacccaatgtaattattagtatcccaccaaactgaaagaggcagaaacccaagaattgccaataactctacataaaaataaaagggctactttaagacagtggaaaggcaggaagatctattctttaaatagttttcacaaacagtatcttttgtaccttcacaggaggcatgcaaatagaaatcattacctgcccgcccaacaccgatttgatttgcacaaagctgaggctggtagaaatctgagacttttgaagggaataaaggatttaaaaaaaaaaaaaaaaaaaaaaagtaaagtcaagcctataccagaaatggttcactactacttctcagagatgaaatggccccaaggagataagagacacccaataaaggagcaccccctctcatttatataagttgactcccttttatcaaatgcctgccttaaaataaggcatcaatagcgccaattctctttattcacagtagttatactctataaattatagtcaccataaatgctgaattagcaaatactgagccattgctgctagggaaaatacagggttcctgccatcctttggtgacatcgttttcaccagccaattaatacataaccttgttttatgtgtgtttctgttgaaagacaccttatttaatagacactttgatccattaacattgaactcatggtcaatagccctataacccatgcctatctaacatacatattttctctagaagccacgttacagtcctcccgtgcttaggaacactcgataggacttcagtattatgactggtcaccatttaaataagatcaccaacaaaaagcacaaaaatatgaaaaacatggcacttaatagatggcaaaaaggaaactttcgatatggtttggctgcgtccctacccaaatttcatcttgaactgtagcttccatcatccccatgtgtcggagggaccagtgggaggcaatttaatcacgggggtggctacctccatactgttctaatgacagttctcacgagatctgatggttttataaggggcttttccccactttcactctgcacttcttgctgccgccatgtgaagaaggatgtgtttgctatgattgtaaattccctgaggcctccccagccctgcggaactatgagtcaattaaacctctttccttcctcatacccatctcgggcatgtccttagagcagcaggagaacagactgatacacttgttgacagagtaagagctgaaagaaggcagagcattgccttgttctacctgagccgagaacgtgcacgtcaggtgattcaaaattttcaccactctccacaagtccacaaaggatcacaaaagcactgtaaatattgatactgaggtcacaggtcagtttcagtgagtaggccaacacataaaaatagaatccatgaagccaggtgcagtgacttacacgtgtaacccagcactttgggaggccaaggcagacggattacctgacgtcagttcaaaaccagcctggccaatgtggtaaaaccctgtctctgctaaaaatacaaaaattttagctgggcatggtggtgggcacctgtagtcccagctattcgggaggctgaggcaggagaatcacctgaacccaggaggcagaggttgcagtgagccgagaacacaccactgtaccccaacctgggcgacagagtaaaacactgtctcaaccaaaaaaaaaaaaaaaaaggaatccatgaataatgaggatgaactgcatttaggaaaaaaaaactaaaaggaaatgaaacttacatagaaacagagatgcttctgagagtcaggggactacctgtcaactaccaaggctgcagaacactgagcgataagggttatgagtatatgggatcctcttacctcactgtaggaggagtgaaaagaaaaacaagctctgtatgaactctctccagtcctaaagggaagtgaaaacacaaaataaaaagatcactgagcaaaactaaaactaagcaaagctggcccttctcatttaggctattctagcatgaaaccactctaatgggctcgcttcagcagcaagtgtcgaaatcaccctaaatcaggaatttcttcttgggatagcagggaaccttttccagaagtggaaacctgttgtagaccgcgtgtggtggctcacgcctataatcccagcactatgggaggccgacgcgtacggattgcctgagctcaggagttcgagaccagcctagcaaacatagtgaaactctgtctctactgaaaacacaaaaagttagctcggcatggtggtagtacatgcctgtaatcccagctactagtgaggctgaggcaggagaatcacttgaaccgggaggcagaggctgcagtgagctgagatcacaccacttcactccagcctgagtgacagagtgagattctttctccacacaaaaaaaaaagaagggagggagggagggagggacctcttgcagatattctgaacagccaaagttaaggaaatgttgctaaaatattaagatcattatagtcactcctctattccaccaagggttctgttctctctgacatcagtttttcctcttagccaagcactcagatgggagggagggagtggggggggagaaaggagagggagggaagaagggatggaggagagggagggagggagggagggacctgttgcagaaattttaaacagccaaagttaaggaaatattgctaaaatattgtgatcatgatagtcactcctctgctccaccaagggttctgttctgtatgacatcaatttgttactctaagccaagcactcagatgccttcagtctccaaccatctcatcaacctacccagagggaacctcaggatacaccagctgatgggagtgtaactggtttgggagtagcatcccctccatttaaataaaatttaaatttaagaaattaattataatatataattatattcttgggcttaggctagactgtgcttaaatgaaattaaatcagacaatttactcaaagtttctctcagaagacctatgatattgctctcttacctcacaattacatttgtttttctgctcctttctccaaaccacatggtggatggcttaatgctgattatgtggagtggaattctatttctggaagtaattccacagggtaatttgctccactgaaaatattcctctgcctaaaaaagataaaaagcatagaaaaacagttctacattttctacaaatctgttgtaggcagagtctcaaaaacaaaagtagaaaagtttccagacacgaaaaaataaaaaataaaaaaaaagcagcaaaacaatgtagacatgaagaaacaatcagataattccaaattggggaatattgtgcaaaacaactgggctggactcttcaaaaccatcaatgtgaagacaagcaaaaggctagacaaacgatctatatatcaaaggagaccctttagacctgactgaacgcaatggacgaccctcaaataaatcctggatgcccctgtccccctattctacaagctataaaggacactatgggaagaactggggacatctgaacacggactgtgtaacagctaatagtactatatgaacacaaaatgttctgaggaagggtattgtactgtggttatataggaaaatgttcttattctcaagagccacaggctgaaggatttggggtgacgtaccatggagtctgtaactactctcaattggtttggagtggggagttggttataagtacagagacagaggaagagaggtgcaaagtgttggcaacgcagcaaatccaaacgaagggtgtatggtgtttttttttttttttttagacagtctcgctttgtcactcaggctggagtgtggtggtaccatctcaactcactaaaacctctgccttctgggttcaagcaagtctcatgtgtcatcctcccaagtagctgaaattataggcacacaccaccacacccagctaaattttctatttttagttacaggatttcaccatgttggctgggctggtctcgaactcctgacctcaagagatctgcccaccttggcctcctaaactgttggaattacaggcgagagccactgggcccagacccttgtaccagtcttacaactttactgtttaagaagttttcagggccggttgtggtggcttatgcctataatcccagcactctgggaggctgaggcaggtggatcacttgaggtcaggagtccaagaccagtctgaccaacatggtgaaactctgtctctactaaaaatacaaaactagccaggcatggtggcgcatgcctgtaatcccagctacttgggaggctgaggcgggagaatcgcttgaacccaggaggtggagattgcagtgagcccagattgcgccactgcactccagcctgggcaacggagcgaaactctatctcaaaaaaccatttttttttaattaaaaaaaaaaaaaagatctcagcctgggcaatatagtgggattccatctctacaaaaaaatgtaaaaattagccaggtgggtggtacacaactgcagtcccagctattcaggaggccgaggcaggaagatcacttgagcctggggggtcgaggctacagtgagcaatgattgcaccactgcactccagcctgggtgacagagcaagactctataaaataaattcattaattcaaattaaaaagttttcaaaataaatttggagggaaaaaaactaacaaatacaagtgttttcaaaaggttgaaaaaaaatgggacaacttttccaaagtcattattttgaaatccagaaccttccaaaccattaacgttccatcccactcaaatttctttggggtgcctttggtgctgtttcttaggaaggtgcagattagagttaagagtggactctatgagctgtggacctacctgttaatattctaaaggagtgcgtgacctaaaaaaatcttttaagcggctagaaatagcatctcaaggaaagtagccctgacagcaaaggaattactaactaagctactttgtgggatgtgagaaaattcacagcaaaaagaaatttgccaattcaaggatttatggggcaaggggcccaatactatgagtccaacagaaaaagggacaaaaaggtgtatgttttatttatttacttgagacggggtttcactctgtcacccaggctggagtgcagtggtacaatcttggcttactgcaacctccacctcccaaactcaagcaattctcccacctcagcttcgtaagtatctgggactccaggcatgcaccaccacactcagcaccttttttttttttttttttttttttttgtattttttgtagtgacggggtttcaccacgttacccaggctggtctcgaactcctagactcaagcgatccacctgccttggcctcccaaagtgctgggattacagatgtgagccactaagtttatgggttttgtttgttttttttgaggcagagtcttgctctgtcacccagactggagtgcagtggtgacatcttggctcactgcaacctccgcctcctaggttcaagtgattctcatgcctcagcctccctagtagctagggctacaggcacacaccaccatgcccagctaatttttttatttttactagagacggggttttgccacactgagcagactggtttcgaactgctgacctcaagtgatccacacgcctcggcctcttaaagcactagcattacaggcatgagccaccacacccggccggtttacgttttatgtatacatttttatccatccaagaatccactggacgtgtctgtatatgtgaatatatatgtgtatttatatgtgcatacatgcacacaaagtgaagaaataaatccctgaatgcaacatagaatatgcagcttaccaatcagcaaaaataatttacactgcagctctcaccgtggcctacaggaaaacattccatgctgtggatcagaattctctcttgtttgaaattatgctttatcgtaagggctaggcaactaggcttttggctaatggaaccattattactacaataatagtgatctaaatgaataaatgcaatgtttactttaaaaattacacaggatttaatgctaaggtattttaaaatttagagaaaaataatgatcactcaaaccactacatttaaagatcactaattagccttaataattttaattgaaacaatattttttaaagcaaattcaaaatgaaagtcttgtactcagcgtttgacaagagaaggaggttctgtgttggcattagaaaacgaatgaggctgggtgtggtggctcatgcctgtaatcccagcactttgggaggccaaggtgtgtggtcacgaggttaggagttcgagaccagcctggccaatatggtgaaaccctgtctctactaaaaatacaaaaattacccaggtgtggtagcgggagcctgtaatctcagctactcgggaggctgaggcaagagaatcgcttgaatgtgggaggcagagcttgcagtgagccgagatggcaccattgcactccagcctgggccacagagtgagaccatctcaaacaaaaaaacaaaacaacaaaaaacaaaagaagacaaatgacatgtgacttgcaaagacactggaaacatccattagaaataggaccatcaagacatgaaactattttaaagtgtgaaaaaaagttatgtctagatatttatctcaagtagaagaaaaagtttataaacacgctcatgtcatgagtctcaaaaagcacaggatgggcgcagtggctcatgcctgtaatcccaacactttggaaggccaaggagagcagatcacttgagatcaggagttcaagacccccctggccaacatggcgaaaccccatctctacttacaaaaattagccaagcatggtggtgcatgcctgtaatcccagctacataggaggctgaggcaggagaatcgcttgaactcaggaggcagaggttgcagtgagccaagatggccccactgcactccaacctgggcaacagagcaaggctcgtctcaaaaataaataaataataaataaatcaataaaattacaaaaattagccagaagtcatggtgcatgtcggtggtcccagctacataggaggctgaggcaggacaatcacttgaacctaggagatggaggctgcagtgagccaagagtgggccactgcactccagtctgggcaacagaaggagaatgtctcgaaatatataaatacatatataaatagcacaaatgtttaagttataagctataatatattactgatttcattacaaataaatttgaattatcaaacgtgtatgaatagatttcatcagaaaactataaagatctggttgggggtggtggctcacgcctgtagtaccagcactttgggaggccgagggaggcggatcacgaggtcaggagattgagaccatcctggctaacatggctaacctcgtctgtagtaaaaataacaaaaaattagccgtgcatggtggcgggcgcctgtagtcccagctactcaggaggctgaggcaggagaacacgtgaacccagggggcggagcttgcagtgagcctagatcgcaccactgcactccagcctgggcgacagagtgagactccatctcaaaaaaaaaaagtacagatctgtgtctatttactagtgacgaaaagtgtggtcatggaatatggcaatgtacagttccatgaccttgagctaacaacttaggattgcagcctcaggttttacatttgtaaagcgaagagcctataaatggaagccctgacctttcttctttttcatagattacacaaacaatacgagaggaatcacttgcacacgtaccttgggatgccggcatgcatggatctgagtgttgcggtctgttgtgagatgatgaaggatctcaggcatgttcctaaacatgtctagcttattcacatgaacctaaggcaaataatacatacatgcaaattatgtgaaatgtatttcctataaattgttcaaggttaattactcagggcaaaacacccagttagtgaattaaccctctcttctttcttgaaaagtagtttttggctattcagtgcactctggtattccgccagcatgtcaacaggcacaaggctgactggccaggatcgctgccatcactgacgtcagtgaacaattatggacactcggctcagggatgtcatttaatgatgttaatgttgtccttcagtccttcaagagaaattcagttaatattcctcgtacacctactatgtgtcgagctttattctaaatgctgggaataaagcagtaatccacacagacaaaaacaatcaagaatcatctaccctcagccaggtgctgtggcttatgcctgtattcccagcactttgagaggcggaggccggtggatcacttgaggtcaggagatcgagaccagcctggccaacatggtgaagccccatctctactaaaaatacaaaaattagccaggtatggtggctcaggcctgtaatccaagctactcgggagtctgaggcaagagaatcacttgaacccaggaggcagaggttgcagtgaactgagaccgtgccactgcactccagcctggacgacagagcaagacagtctcaaaaaagaaaaaaaaaaatcaagaatcaccttaaaggcatatacatgatgtacaacagaggagcatgtactgcaaataatccactgccatatctccttgttcaaatttattttcaatgctggtcacaatcactaaatttatttcatgacccaaagtttgggaaaaatactttgtctatgcggcatttcactgaaggctcttgtaagccattttggcttctgtcaattttctcccaggaggatgtgactgaactaagatgatatattccttcagagggcccgcgaacctctgctgcagacacgtcttgttagggtgcttccatctgtccctgtttgcagttatttagcaggcgaggagggggaggaaaggtgagctgggaggatggaagggagcaagagaaaagaatgaacagactgggaacactggctcaggcctataatcccagcactttaggaggccgaggcaggcagatagcttgaggtcaggagttcaagaccagcctggccaacatggtgaaatgtcgtctgtgctaaaaatacaaaaattagctaggcatggtggctcacgcctgtaatcccagctactcaggaggctgagccaggagaattgcttgaacccgggaggtggaggctgcagtgagccgaggtcgcgtcactacactccagcctgggcaacatagcaagactccctctcaaaaaaaaaaaaaaaagaaaaaagaaaagaaaagaatgaacagtcaccatacctggactcctaattcttcactaaggttggtgaacagatattcatagccataagccgctttgcagttcagccacacaacatggtacgggctccgagtgatccagcttcggaccagctctaagactccacttaaacactcctcctagacaggattttaaagagacatttaacaggtggagagccgcacatagccttttccttcccaacagtcccaggtactcacacctacggggacagttaggatatgacctgtcaccctacaaacttcctactaaaaacacgggcacacccagatgataaccctgttcctccaggcagacttacccgacttggaatttggtaaaatcttggatcacagaacgtagtatccaaatatacactttggatgtctttgactctgaaaagaaaaaaaattgatgttagccatccaatgtgatataaattatgtgtaactttttttgttttttgagatggagtttcgctctgttgcccaggctgaagtgcaatgtctgctcactaccacctcctccacctcccgggttcaagcaattctcctacctcagcctcccaactatctgggatcatgggtttgtgccaccacaccttgctaatttttgtattttttagtagagacggggtttcaccatgttgaccaggctggtctcgaactcctggcctcaagtgatgcacccacctcagcctcccaaagtgctgggattacaggccagaactcccaaagtgctgggattacacccggccagagcaataaaactttattcagtcatacacagaagaactgtacaagaggccaggcacagtggctcatgcctgtaatcccagcactttgggaggccaaggggggcagatcacctgaagtcaggagttcaagaccagcctgcccaacatggcaaaaccccatctccactaaaaatacaaaattagctgggcgtggtggcacgtacctgttatcccagctacttgggaggctgaggcaggagaatcgcttgaactctgggcgacacagcaagactccatttcacaaaaataaaataaaataaaataaaacctatacgaggcccagtacctgcccccggagtgcagaagctccattctagcagcttctccttgcgccaatctgaagtctcctgtgtacaggacagttccattattgccctgaaataaaaacctgaaaaagaaatatatcccagtgacttctgagtctcatataaactcccaataaagcaaatacatgtgagctgcatactaaatgcttcctgcaaacatatccattacaatacaatggtaatggaattccacagtaatttgaaccacaccaggcactcagctgtcacctcttccctcgggtagaaaataacagaatggagatgctacccagtttgtaatagatgttccttgtgatatgttagcactttcaattatatgttgagatcattcttgctcatggagagagaaatacacgtgatgataaaatacaaggtcactggggaaacagctgctgaagacttccatttatttatttttattttgagataagagtcttgctctgtcccccaggctgcaaggcagtggctcaatcttggctcactgcaacttccaccttctgggatcaagcaattccccagtagctgggactacaggggtgtgccaccacacccggctaatgtttatactttttgtaaagtcaaggtttcaccatgttggccaggctggtcttgaattcctggcctcaagtgatgcacctgccttggcctcccaaagtgccgggattacaggtgtgagccaccacacctggccatgaagacttccattttataagaaacgtttcaaatctgatcttcacctcagtccccctagttcaatttgggaacaaatgtgttttaaatgactagaaaaaaaatcaaatctccctctatgtattctttctttctttttttttttttttttaaaaaaaaaactcactgcagcctccaactcccaagctcaagcaatcctcccgcgtcagcctcccaaagcactgggattacagacatgtgccactgcacccagccccctattaattttagaccctaaaaatttatttctacaaatacaatatgtgtctacatataataaaatgacaaaataaatgacccccttacataactgatcccggacagtgaccagctggtaagagagtcacaacaatctcttccttctaaaaagaaaataaagaaaaaatagtaatggaaagcagttatcattaggacctagctcaacaaagccctccttcacagaacacatttatgtaccttttaacaatgtgccttttctcccaatttcctcacactccaaatcctagaaacaagtggaatccttgtccactcaacaaacagaattcccatgggactgagcaatttcaccactagttatagaaccaagataagcgaaaaccgatggccacacaaaaatgtgtgcctgactgttcacagcagcattcttcatactagccaaaaggtggaaccagttcaaatgtctatcagctgatgcatcaatcaggaaaatgtggtctagccatacaatgaaatattatttggccataaaaagaaccgacacgtgctgcaacatggatgatccttgaaaacatcctcagtgaaagaagccggataagaaatgaacacatgttgtatgattccactcatatgaaatatccggaataggtgaacccatggagacagagagtccaatacagtagtggttgccgggggttggggaaggagagaatagggagggattgcgatcgctaaaggcttcttcccttggggtgctgaaaatattctgaaattgattgtggtgatggatacacaagtgtgtgactcgatttctatctcaataaagctatttacttttttttttttttttttttttgagatggagtctcactctgtcacccaggctggagtgcgatggtgtgatcttggctcactgcaacctctgcctcctgggttcaagtaattctcctgcctcagcctccccagctgggattataggcgcctgccatcacgcctggctaattttttgtatttttagtagagatggggtttcaccatgttcgccaggccagtcttgaactcttgacctcaagtgatacatctgcctcggcctcccaaagtgctgggattacaggtgagagccaccaagcccggccactatttaacaatttttaaagcctgagccaggtgcggtggctcatgcctgtaattctagcactttgggaggccaaggtgaacgaatcccttgaggtcaggagtttcagaccagtctggccaacatggcgaaaccctgtctctactaaaaatacaaaaattagctgcgcatggtggtgggcagcacctgtaatcccagctactcaggaggctgaggcaagagaatcgcttgaaaccaggaggtagaggttgcagtgagccaagatcgccctactgcactccagcctgggcgacagagtaaggctcagtctcaaaaaaaaaaaaaaaaaaaaaaaagattaaagcctggatgaggcctggtcccgattcacactgcacatcatactgttcggcaagggcaagacctgcaggcactactgcctctccagccatcagtaagtggggagagctctgcacacaccaggtcactgctcagtgacagggactcctcatggaagtctccattcattctggaggaccctttcgagtgggtctccccctggttggagctggataaacaatgcataaaagtcatggcacacaggaagaaacataaaaaatcaaagtggtggcaggactgctcaaaagtcagcctgctgtcggcccccagttcagggaatgcctttcaccaatatccctgattgtgacaaggccacagaccaccacagtattccccggaaaagcagttggcagagtccaggatggcatttacaaaggttcacctattttttttttcctttttaatcctcactaaactggctctgtagtcctccctcaggataatttgatgggaagaatacttcaacttcaactgtctgatcttcaccaaagaagaaatatctgaaaaggtcagtttctgttcaacaacacaacacaccctcaaagttaaacacggcaaagcagtgtgctataatcaagcaacaaagccaatattaaccaaaataggaaaatacctaccagctgtaaaggttaaaaaaaggggggctgtatgtctatagtcctacttattaaaaccatacattcacaaaagtactacctcaaaatttaatgatgaaaaataatttttttccacttggcagagccccttttctgaataagggttcagaaaaaaagtacaatattcatgaattacctgcaaaaatattaatcaccattttaaattctgagcattataaaactcagtaaatgtgacaataacatcatgtagtaatatcaacaccagggttcccatcattagcatgtaataaggaacaaatgtgacaaaaaataagccatgcccaatcctttacaacatgggaaataaatacatcactgttaaggactaaatgttcgtgtccctccccaaaattcctatgttgaaatcctaacccccaaagtggttttattaggaggcttttgggaggtgattagttattgggcatagaagccttgtgagtgacatcagtgcctttataaaagacacccaggggagcttgtctgcccctttactatgggaggacacagggaaaaagacagcatctaagaaccaggaagtggccaggcacagtgactcacgcctgtcaccccagaactttgggaggccaaggcaggcggatcacttgaggtcaggagttcaagatgagtctgaccaacatggtgaaaccccttctctactaaaaatacaataattagctgggctctggtcgtggtggcaggcgcctgtaatcccagctactagagaggctgaggcaggagaatcgcttgaacccaggaggtggaggttgcagtgagccaagatcacaccactgcactccagcctgggtgacggagtgagactctgtctcaaaaaaaaaaaagaaccaggaagtgggccctcaccagacacgaaatctgctggagactggatcttggatttccagtctctagaaccctaagcaacaagtgtctattgtataagccactcagtctacggtagttttgtgagtccagcccaaatggacttacacaatcacaaagggatttttttgcccctaaaaccccactcaatgactagatttttatttatggttaaatgagcattcaaaatcaaagagaaagattgagggtatagctgaggggtggagcatctgactgcaaaatcaaagagaaatataaacaatcattttagcaccacatttttttaaaaaaatcaatatttaatatttagttacctctcctgatgcttcatccactaaagatatctgggtaggagtctcgatttcaatagatatctataaaaataaaataagagaccatgtatatagcagtttttcatggctttatatgcctttgctgtctgaaacacagaaatggggcaaagagaagtttcagactctctatataaacaattccgattacattgtaataaatattttaacagttagaaaaaattgtaaagaaaataatacctgtcttgaggcagatttggtaatacggagtaaacgccttgtaaatgcatataatcctctgacacaattctgtttccatgaattcatttttcctccttcatctccccatccctaccactcccattcccctctctctctgaattctgagtctttgtaaaaacgtggtcctgtgtcctaacttttgtgcctcagaacacagtctggatgggtctgtgacatggatgcttcatacacggttcttttattttttttttttttctcagatgcattctcgctctgtcacccaggctggagcgcagtggtgtggtatcggctcactgcaaccaccgcctcctgggttcacgcgattctcctgcctcagcctcccaagtagctgggatgacaggcgcccgctactacgcaaggctgagttttttgtacttttagtagagacagggttttgacatgttggccaggctggtctccaactcctaacctcaggatcaactgcctcagctttccaaagtgctgggattacaggcgtgagccaccacacccagcctcatgcactggttctaagtgctgccgaacgctccctggtacatttccccctgccatcaaaacagagactagcacataagaggcattcagtaagtatctgatgaatagatcaatgtgatttttcacctttttagtccactaatgtcctaaaacttacagtgtctaaggtttgggtgttaaagtatttttgcatttctggaatgaaacatcttattcatgatgtactatttaacactgctagattcagttactgtctttatgaggattcttacattttcatgtatgaaatgggtttttccccatttattatttttgagatagggtctcgctctgtcgcccaggctggggcgcagtggcacgatctcagcttgctgcaacctctgcctcccaggttcaagcaattctcctgcctcaccctcctgagcagctgggactacaggcacccgccaccatgcctggctaatgttttgtagcagagatggggtttcaccatattggccagactggtctcgaactcctgacctcaggtgatccctccacctcagcctcccaaagtgctgcgattacaggtgtgagccactgagctagtcctcttttctaatatatctatttaatgctatcaatttcccttcaaggacaaatttagctatgttccacacattctgacatgccacatttccattgtccatcagctcctttatttatttatttattttgagacaggctctcgctgtgttagccagcctggagtgcagtggcacagtcacggctcactataacctcaaacttcggggctcaagtgatttttctgcctcagccttctgagtggctgggactacaggcacactctactataccaggctagtttttaaggtttttttgtagacatggggttttgcagtattgcccaggccggtttcgaactcctggactcacacaattgtcccaccttggcctcccgaagtgctaggactacacatgagagcccccaagcctagccatatcagttctacatattgtatgttttctttatcgtacaatttcctttttaaccaaagggtcagttattgtatgcatttagtttccacgtgtatgggaagattttagctgtccctttgtttctgatctccaacatcattgccttcttttgtgacacagtacatggttagtttttgtaagtgtcatgagcaccccccaaaatactattttcttccttgggtttaaagttctgttcattagtccacattcacacattttctgcatcctgtttcctgcctccttctttcagcatctgggaggggcatgttaagctcttcagtgacaattgttgatttcctatttcttgccctgattctgccgtggccttgtttgtactatgtcaactcacctaagctggaactgtttcctagaacccctttccatgttgttgcccacagtaaacattaagaaggcagatgtgaactagtagggattttttaatgctctgaagggcgccagaaatggtaacagctagtgaacattgctgaccttctggcttaactcagagtctggggcagggccgcagcaacatcagcttctgctgggtgcccgtgtgcagctcctccgagtcctggggcaggtgcatgtgcttcagagccaaagcgggagaccagcactattgaggccagaggaagtgagagacagaagtgggtttcggtctgtcctagtgggccattctgccttccagtttgtctctgttcccctccacttctcttccagctttccttcctgactgctggccgggctgacctgtagtaacttcaagctgaatgccagagacaacaggaacaaccctgctgttgtgactgctctgcagagggaggacaaatccccttctcaatcaaaggtcagatgtggaggtggatgatatcatgcacacaaacacacgtgcacacactatgtgtgcatactcacacacgcatgcacatacacacacgcgagcacacacacgacagagaatgagaagaaaacttcagtcacatcacaggactttcggggagggcagtgcagtccctgagctggggacagaagtgtttcctgtggcttaagagagagtaggagcaagtagccctggtttccactttggtgcgggttgggcctggacatgcctggtttgaacttcgccttagtgctaaggcaggcatgggcctttttgtcagcttgcccaaatgtgggtaggagggaggcactggctgcaagcagcttaagagcaaacagaagcccggcatagtggctcacacctgtaatcccagcccttgggtggccgaggcgggaggatcacctgagggcaggagtacaagaccagcctcgccaacatggcaaaaccccatctctactaaaaaatacaaaaattagccaggtgtggtggttcaggcctgtaatcccagccactagggaggcggaggcagggagaattgcttgaaccggttagatggaggttgcggtgagctgagatcacgcctctgcgctccagcctgtgacagagtgagactatctcaaaaaaaggaaaaaaaaaagtaaacagactctttgtgacactgggacaaattgctctgccaactcccacaatgatttaagaactaatccatgtaatgaacccacattctgttaagtcattgtggttctcctcagatcaagcactgggtgacaggttctcgcagtttctacttcagctggatgctattttgtcaattgcacatacgtccatatgacccatggctccttttaacagtgacaccctcttcaaaccttgtctttctttgccttctagtctactttctgatattaaaaactgccactctgacattttggccttctgattggttagtaattttttcttcttcccccaaaatttcaaatttcaacctgtatttatccttctgttttatctatgtctcttatagactaatactcatgaatttgtctaacttttttgtttgtttttgaagatggagtctcgctctgtcacccaggctggagtgtagtggcacgatctcagctcactgcaacctccgcctcccaggttcaagcgattctcctgcctcagcatcccaaggagctgggactacaggcaccgccaccacacccaattttttgcatttttagtagacacggggtttcgccctgttggccaggctgttctctatctgacctcaggtgagctgcccgcctcggcctcccaaagtgctgggattacaagcgtgagccactgggcccagccagatttgtctgatttttttaacttaaactgagaatttgtcttttgaccaaaggtacaattaaatcctttcctatatatagtcatatataattggactttttctgccttctttgcattttctattcaccagactttttcctccccttgactacctcatattggacagatgcattttattctgccagaccgaaagttacccattctatctgtattcttctagctgtcatcccttccttatgacagcctgtaatttgtttatttttcttactctatcccacaatttaaataaaaggatttagcaattatgttaatgaacactttacactctaaaatattaaaatgtggccaggcatggtggctcacacctgtaattccaacactttgggagtggatccacttggaaccaagtgggtggaaccaaggtgggtggatcacctgaagtcaggagtttgagacctgcctgaccaacacagtgaaatcctctgcctactaaaaacacaaatattagccgggtatggtggtgggattctgtagtcccagctacttgggaggctgaggcaggagaatcacttgaacccaggaggcagaggttgcagtgagccgagtttgagccactgcactccagcctcggcagcagagcgagactccatctcaaaaacaaaaaatagaaaatattaaaatgcatcttagcaagagggtcaatgagattaagcaaacaaaactgagacctagatctcactcttgaggaagaaggaaaacatatcaacaactaccaaatgttgacttctgccatattgttcaatgccaacagacttaattttttttttcttttttttttttttttttttagatggagtcccactctgttgcccaggctggagtgcagtggcgtgatctcagctcattgcaaccattgcttcctgggttcaagcaattatcctgcctcagcctcacaagtagctgggactacaagtgtgtgccacgacacctggccaaattttgtatttttagtagagacagggttttaccatgttggccaggctggtcatgaactcctgacctcaagtgatccatccgccaaggcctcccaaagtgctgggattataggtgtaagccaccatgtccggccagagactcaatattctaattaatgtggataactgaagtatgttacaaactgaggcaaagtttttgtcaatctacctctaaaaatacttcccacttaaaaaaaattaagttattaaaaaaataaaacttacaattcgtttcttccaaaatctgtatttcgggctcgttaacaacaactccttagtcacaggtgaacagtatagataaaccttcaagctgaaaggaaaaaagaaaaaaactttcagtacaatccaaaatgagccatcttggtgactaagaaatctatttcatcatacatctaataatttcatttgagaccagtctgaccaacatggtgaaaccccatccctaataaaaacacaaatactagcctggcatggttatgaaatctatttcatcatacatctaataattcagaaattacgctggcacaaaatctgttagagtcactctcaacatacctatgcacaccatttcagtgccaccaagagcacaaggtgggggtggaaacacggtgtccctggacctcctccaacagtggtccctcaccattgttacttggaaatacgcgcttgtatgtgatcaggtgtgtctggaaagataccgccacacattacactacctctggaaaaggtgtgttgagaacagaaacttctgctttttactgtataagtctattctttttttttttttttttttttttgagatggagtcttgctctgttacccaggctggagtgcaatggtgtgatctcgtctcactgcaaactccacttcccaggttcaagcgattctcctgcctcagcctcccgagtagctgggattacaagcacgcgccatgatgccggactaatttttgtatttttgtagagatggagtttgaccacgttggccaggctggtctcgaactcctgacctcgggtgatccacccacctcggcctcccaaagtgatgggattacaggcgagagccactgcgcccggcctattctttttttttttttttaatgaacagaaattaatttcataataaactttttttttctttttttttgagatggagtcttgatctgtcactcaggctggagtgcggtggcgcgatctcggctcaaagcaaccttccgcctcccgggttcaagcgattctcctgtcttagcctcttgagtagctgggactacatgcgcaccaccacgcccagctaactttttgtatttttaatagaaatggggtttcaccgtgttggccaggctggtctcgatatcctgacctcaactgatccacccacctcagcctcccaaagtgatgggattacaggcatgagccaccgcgcccagaccataataaacttttaaaacttaacgctatcattttgaggttaggaatatagtctacggtagattgtattttccaaagatggccacacaatgacatacaccatccatacatgctctccttacaaaatagatactaaaattcctccactgactggcggggtctatgttccctccccttgaacctgggcagttttctgtaattaccttcaccatagaatgcggtggaagtaattgcatggcttttgaggttagatctccaggtagtacaacttcctcctagctctctcttaggacatacgctttttaaccctgagtctccatttaacaggtctggccatcctgacagactcacgctaaagagatttttttttttagggggaggggagctcactgtcacccaggctggaatgcaagctatcctcccacatcagcagcctgagcacctgggactacagcacatgccaccacacctggctcatttttcctattttctgcagagatgaggtctccctacgttgcccaggttggtttcaaactcctatgctcaggtcatcctcccacctcagcttcccaaaggcctgggattataagcctaagccactacgcctggcctaaagagacttttagagatagagatgccgcacgcctgtaatcccagcactttgggaagccaaggtgggcagatcacttgaagtcaggagtttgagaccagcctgaccaacatggtgaaaccccatctctactgaaaaataaaaaattagttgggcttagaggcacgtgcctgtagtcctagctgcttgggaggctgagctgggagaattgcttgaacctgggaggcagagattgcagtgagccaacatcacgctactgcactcctgcctgggcagcagagttcgactctgtttcaaacaaacaaacaaacaaacaaacaaacaaaaaaacatgccaaatggttctagcccctagctgtgtgagttttcccagcccaggtatcagacatggataagggagtcttcagatcttaaggggctgacatctgaagactctgctcactgatgtttgatacctgggctgggaaaccattcccattctaccctgtcaatccctgatccacagaaactgagcaataagacatgatcagtgttaagtcactccattttgaagtaatttgttacgcagcagcagatgactgatacataggctctgcaatcagacagacctggctggaatcctggtcctgccacttactggctgtgtgacactgggcaactaatttaacctctctggttcctcagtttcctcatctgtaaaatagaaataatagtaggatctattcaaaaggttatcaagaagctctaatgacaatgtcaggtacaagtgtgcagagccttgcatctgtgtggctcactaatgcattctccacctccagtacaatgcccgacatgtcacaggtgaccaaaaaaaattactgaggccaggagtggtggctcatgcctgtaatcccaacactttgggaggctgaggcaggcagatcacttgaggtcaggagttcgagaccagcctggcgaacatggtaaaacccctctctaccgaaaatacaaaaagtagctgggcgtggtggtgggtgcctgtaatcccagctactccggtggctgaggcaaaagaatcactcgaaaagaagttgcagtgagctgagatcgtgccactgcactccagcctgggcgacagagcaacaccctgtcacaaaagtcaataagtaaatacaaataaagtaataaaaaattattggccaggtgcaaaggctcatgcctataagcccagggctttgggaggccaagatgggagatcacttgaagccaggagtttacaaccagcctgggcaacatggtaagtccccgtctctacaaaaaaaaaaaaaattgttgaacaaaaaatacacagtgccaagatacagtaagtattcaataaacgttagctatcattatcaagaagacagagtattgctatcaattagcagagaagcctgacatccactggcccttttcaaatatgtatcttgagaagggggaatttagatgtaggcaatggctgcaagagaagcatctaacagttcagctttaagaaaaaatccagtattatatgatcctttacaatggaacagccattctctctcatatactcttacagaaataacatggagtgagttactgctgtacctagcagcatagataaatcacacaaatacaaagttaagtaaagtaaaacaaatataaaagggtatatttggggccaggtgccagtggctcacatctataatgccagccctttggaagaatgaggcaggaggatcacctgaggccaggagttcgagatcagcctgggcgacatagcaaaactccatctctgttttttttgttgctgtcgttgttgttgttgttgtttttagagagtgtatttggtaggattatatatatatatatatatatcaagttcacaaacagccaaagctaacccatgatgacaaaagtcagaatagaggttacctttgggaggagggaatgagttgggaggtaagaggggtctgggatattggtactgtcctatttcttaatctgggtgatgcgttcattttgtaaatgactatatgcttggatgtatatacttttctgtacagttgttatctctcaattaaaatgtttgcttaaaaacacaagtagcaaaataaattacctgcactccaaccttcttttcaaggtaggggctcttaatcctttcatgtgatctaaaaacaaaagaacaaaaactcatgaatatgtttttccagaggattccttagcccaagggaaacagtcgtcttctttttcagcttcaagagaaaacccatgaggtttgcttttataagaattgattcacatgggctatgagctctttcttctgcaagtgaagaatcctcctcagaacaggaccggctgcccatttctgagccatccaagtcaatttaaaaggagagtgattctgtgcatcataggccagagtttaaatcactctgggcagccacagaagaatgagaactgcttctagccctccactcttacttcatttcaatccaaccatccttcgagccaagctctatgggacccattcactttctgccacttaaatcagtctatctagaaattcaagttcgtggtcatggagtctgctgggaaatcactcaggttcagagtaagtgtttcgtcatcttctcagcctactgtgatggattgaaaggggaatattactatccacaaagacttgctccacagcgctccacattaacagacacagacaacagaaaggtagcaattagaccgactattacattaagtatatcatgcattccaatatattctgaatctttagcaagtaaaggcccagacaacaatgatcaaacagctctaaattgtttaactaaaccagttggacatggtggctcttgcctgtaatcccaacactttgggaggccgacgtaggcggatcacctgaggtcagaagttcaagaccaaccttgccaacatggtaaaaccccatctctactaaaaatacaaaaattagccatgaatagtagcacacccctataatcccagctactcgggtggctgaggcaggacaatcacttgaacatgggaggtagaggttgcagtgagccaaggccataacactgcacttcggcctgggcgacagagtgagacttcatctcaaaaacaaacaaacggctgggcgcggtggctcatgcctgtaaccccagcactttgggaggccgaggcaggcggatcacctgaggttgggagttcgagaccagcctgaccaatacggagataccctgtctccactaaaaatataaaattagctggggctggtggcgcatggctgtaatcccagctacttgggaggctgagataggagaattgcttgaaccccgaaggcagaggttgcggtgagctgagattgtaccattgcactccagcctgggcaactagagtgaaactccatctcaaaaataaataataaccaaaaaaaaaaaaaaaaaaacaagaacaataaattgcttagctaaaccaaaccaattctaattaccacgagcaccaccacacacacacacaagcaccccctcaatttatatgtcgtgtggccatcattagacccagtgaaagcagagcagtcaccacatgtcacttggcagcccttgattgtatatatgcctccaggagagtccacctgtctcccactgggtaaattccctcaagggatatctggtccagtcttttagggcctatgggtatatccctgggcagcattctccgtaattggagtttccaaagagtttgcgccatggcaaagaggaggctgaatgcagactctgcatcctgctcccacactgactaagcaggcagcaccctgcatggtgcatcatggtcccccatcctcaccaccctgaggccccttccagctggtagtcacaagaactggatgggtttgctttgtgtggctggaactgcacccaggtctgcttttccagggaggttttccttttccttggcaaccatcataaattgtcccctctaggggatttccccaaccctgggccactatctcaggtctcaggggtcggggggccctctcatctttcagaacttactgatgatgcttagtaaagcccaccctgcacacagcattggcttccagatggcccacaaataagcatcaggtgggtccatagcctactccgaattatatcaaaatgtgatgtggggctgggtgtggtagctcacacctgtcatcccagcactttgggaggctgaggtgagtggatcacctgcacccaggagttcgataccagcctgggcaacatggggaaatcctgtctctctataaaaaatagaaaaattagccaggcatgatggtgcatgtctgtaatcccaactactcaggtgggagtacttgctgaggtgggaggattggttgagtccaggaggtgaaggctgcagtgagccgagatcgcaccactgcactccagcctgggtgacagagcaaaaccctgtctcaaaaaaaaaaaaaaaaaaaaaaaaaaaaaaaaggaagtgatgtggatgggtttccatgcattttttctagcaaaagagtccatacagtttctcatgtttgagctgctatcacaagataccatagataccatagttggccttcacaccagcgctgtaaggaaaggtagtgttttggttgccttcaacaccaaaaaggtatttctcacagttcaggaagctgggaagatcaagatgcggggcgatttggtttctggagagggcacttttcctaacttacagacagccgccttctcactatgcactcacatggctttcctaggccccgcatgaggacagagcgccctctctcttccttctcttgtaaggaaactaatcctatcagagtaggacaccacggtaggaccccacttaaacttattttcctcctaaaagccccagccccaaatacagtcgctttgggggttagggcttcaacatatgaattttgtggagatagtccatatcataatcaaagaagcctgtgtcccaaaaaggtgaaaagccaacagaaggcaatgtgagaaacctccaaaagcagaagttgtgttttcacccttgatgagtttatgtcctggttgactaagcagatccacatgtggtcagagaacagaaaaagttgttatagactgttcaacagtagggaagagtccatttctggcttaatgcacaaacttatgatgatttcaaattcctttagatttattatttctccaaactcagccatcctaaacacgaagtgcaagtttcggaagtatactttaatcctggctagcccattttgagttcagagactccagtgcggctctacacaaaaagtaaaaataggcatatcctcgtccagcagtggattctcaatgaaaaacaaaaccagaaatgtgtcaggcacagcggctcacacctgtaatcctaacactttgggaggctgaggtgggtggatctacctgaggccaggagttcgagaccagcctggccaacatggtgaaacatcatctctactaaaaacacaaaaattacctgggtgtggtggtgcgtgcctgtaactccagctacttgggaggctgaggcacgagaatcgcttgaacccaggaggcggaggttgcagtgaacagagatcacgccactgcactccagcctggtgatggagactccacctcaaaataataataaaaatacaaacattagctaggcatggtggctgactcctgtagtcccaactacttgagcagagagcatgtgccacactgtactccagcctgggcgacaaagggagaccctgtctccaaaaaaaagaaaaagaagaaggagatgctcaaagacgtgcacgatgcgaatacggcaacgcacgagaagaggtccagattttcccattaaagagaaatcactggtggctttgtggaaaaaaaaagcagagacatttcgcagaagcagtaacttcaacgatttatagtccaagtgattgattccacacacaaaacaacatagctggccttcacaccaaccctgtgaggaaaggctgtgtttggatacctgtaatttactttaaaatactttcctactgcgcaggtacagataggtttgttacgctgattgactccacagggtagtgggagcttcctgctccagcacgctgcaaggccacacagcaggaggcagcaactccagtgattccgtttatcattttctccaattaacactaatggctgggcgaattagcacaatgagcattaaaactgttttccctggtaaaagttagtgacttgttagcacaatagaagtgaaaatgaacaatggttgtcaagttagcggtatttaaactctggaacttagctccaatctctgcttggagcatcagcgacactctaaccttaatccctaaatcggcccagctgtgaaaggatccagctgtgaaatcatagtagcttttcaggttgcctgataccatctagaagggaaacatccctccaacctaaactagaacgaaactttcatattggatacggacagaacacccaaaggccaaggagcttgcacttcgtggagctcttaggcgggctgttccacagttgtgtgtgtgtctgagtctcctgcttgctgaccaatgtttgagggtgtggtcaaatggatctgaaacttgttttcttcatacatggtagcgaggctctgagggaagtactaaccctcgccaatctctgatcatcggccaccagcaaagctaccaagagaaactactagcagtgcttgaccaagccggcccggggcgcaactggcaggcgccgttacgccgcgttgaccacatccgaaaatagatgaagcctttgagaggctgaagagcccgactgggacaaggcgtgtgctggccgccccctcgctggcttcccacaggctgcagctccttgctccagggccggccccctcctgtcctctctccagcccccagcgccccgggagcgggcgacgcgcagccctcactcacctttgtggcagtgggacaggaagtaggcgcgggccctcaggttctccctatcgaagcggtctatggagatagttggatactcggccatctgcccctcgaaagaactcatagcgccgccgatcccagagtccgggaccccaaaaccgcagctgaagccaaggccagccctgaccgcgccgccacttccgggaagccgcgcgctgcctcgccattgggcggccgaacgcagccacgtccaatcagaggagtccggagaccgggggcaaagtcaaggagcatccggtcgggttctaggcgcccgctgcttgggtttaaatcacccgcgcttcgctgcacgcgatgggccctgagccctgcccagtgcaaggctcattcccgcccaacaaacacaggtgttgctctggtaaggcgttgcccatgtctgtggaggtgcagtcgcgggaagggaaatcgaaactcccagagcaggtggccccagccgacgaggtgagtgggctgcggaactgcgcttagaaatcattcttcgttccg

SEQ ID NO: 135 - DNA, 85542 bp, Homo Sapiens
ttgttgttcttattataattattttattattgtttgatcatcttctctcgagacttgacatcaggacagaaacgccagtatatatacaggatatttgaataaggaggcatttaaccatcgaaagtaaataaaccagaaattggataggcgtggtagctcatgcctgtaatcccagcactttgggaggttgaggtgggcagatcactagagtccaggagttcaagaccagcctgggcaacatggcaaagccttgtctccacacacaaaaaaatacaaaaattagctaggtgtggtggtgtgtgcctttagtcccagttatgcagaaggatgaggcgggaggattgataaactaccccacgtggtagtttaacctgttgcctatactttggaaacaaagagaaaaatgcatccaagtttggcaaaggaaagcagcaatcacctatctgtcttgtgcccaccatcaagagagttcttgagatcaaagtttccaaatggagacttagctctggcaactgcagaaaagtttacgaagaatctgaaggaccagactgatggctagacttcatccagagacaacaatggggtgggacccagtgaaggaagtgaattgggttatgagttccacagcataagtaatcccaaaagcagggactgtgagtgctttttattccatgcaaaagagagaagtgggtctctgaggagtatctggggctggctggctagagacgctagggaaaggtagacaaggcttcctgagtgtgtggtgctttcttgctgacttgccctatatacctaaagtccatggtagaaacctgaacctacagaacctccaccaaaagagaggagagcacgggattctcagagactggcttccacttgaacagggaaggccaattccctgtgggcctgtcaacatcaacttcagttctctcgcccttacaggaggcctctgactgtatcactattttagaaatattgctgccatgtaagcttctttcaaggtgaagcttggaagctgttctccaagtccatcctcagcagctgaggccacaacagattaactgaagagaccccttggcttcttcctcttgacctttgacagctgaggtctctgcagagggcctgaagtaccctagaaaaaagggaacccaagttagtaggggttttgaaatagttccactgaaattaggaaaggaactttcttcctctcatggctcctggttaggatgaggcctttttttttttttttttttttttccacccaggctggagtacatgggcacaatcagagctcactgcagccttgaactcctgggctcgagcaatccgcctgtctcagcctccaaagtagctgagaccacaggcacatgctgccatatctggctaattttgttttttgtaaagatagggtttcacttggttgcccaggctggtattaaactcctggcttcaagtgatcctcctgccttggcctcccacaggttgtgataacaagcatgagccaccatgcccagctacaaagaggaggcattcaggaagtgtctgacataggtattttgaagtctatgtcagacagcaaatgcgatataagaccctaagcaggagatgtagattcccttctcccccaaggaatagcctcgctgactatcactggtcatcactggccatcaccggaagtgggataaggtgaaagaggagtcaaggcacatcattcgtacaagacctacagagaagggacaccaagggaagatgtgcaagaccatgactctccatctagacacctacaatttggagcctggtcacaaatatccctcaatatttttgaggcagtgccaatgaagcagcaattccagggaccactggcttgggggctataggtgccaactctcagaacaccatccaggaagctgctcatgactcaccgtggactctttctcaggtgctgagagggttggggctgaggagaccagttgttctggctggtttacacattggctatcgattccttgcagggaagcactgtttgaggtatgaggatctcctgaaatcagaaagatcaagagaagatagtgataaatgccttcttcttaccaggaagatattagcattcaccaagcattctgataaaggccagggtttggtacaaatatataagcagacagaagtagccacaagtccaacttccagctgactttcagaaagtcctgtttctgctatgaagatctccccaggcccactttcagcaggtaggatgagagtttcctcgactcaaaacagccagctgttcttctacatattccctcacatgtctcaggtatggagattaattttttttttttttaaagagatgaggtttttgctgtgttgtccaggctggtctcaaactcctggcctttcccacctcggcctcctgaagtcctgaggttactggtgtgagccactgcgcccagccagggaaactaatctttctcctggttcttttgctaacccttctaagtacctagaccagtgccacccaatcgaactttctgcaatgatggaaatgttctgtgtctgcattaacttggtagccaccagccacatgtggctactaatcacttgaaatgtggctactgcaaaagagaaaatgcatttttagttttatttcatttttattaatttaaacttaaatagttatatgtggctagaaaactatcatattggacagcataaacctagatcctaattgtatcctcacacagaccgggtacctctggagggctcaccagcgccttgatgcttctgtcccacttggacctcttgtgtggtgactgccatatacagatcctgcagattcatgacaaagggctttccatcaccaatgctgcatgcctctggcagtttctgtaagagagaggagatactgtcattggttacactgtattgctagagaagcgatctaataccccacatgcagaaccggcatcaaccccaaatgaattaatataaagcagttagatccaatagggggcgaccatatccaagcctggtggcaaccaatataaagatttcttgggacatctcctctgaagggcaactccaaatgtatatcttatttcccctaatccttaggtctattatgttttcccatgaataccctatagatttctaggctctttttccaaagggatgatttcttagaaggctattttaggaaattatttcccctaaattttccctgagctgaacaaattactattttcattaaattcattcataaactagagaaaaatgataaaattcaggataaaggagagagagcaaaatggtaatgacagactgagaggcaagaaacaattatggagctgtgatgttcaggcagaggagacaggaaaaacaaagctgacaaagcttttgaggcccccggccattttccattccccactgctgtcccaccctcctttactatcacccacatgctcacagtgggctggctgagattcccccaagggagtgaaaactgttcttgaggggtaaaaaaaactgactcttttaaagtataaagcgtgcacacacacacacacagtacataaatagattttttggtatacctgtggcattaaaatttcctgatagggagtgattaggcaaaaaatgtcttaaaaggttccttagggaagtgataatttttaaaaggctgagaaacactgctatgattacattatatttatctgtttccttcactacagaatgaactgtggacttacatccacagcaaaatactttgcctagttgtagtttcatacacttggctgaactgcgttgaggtaatggctgaagactgaacaaagtgcgataaaaatgagatgaaagagtagagtgtctagtggtcccaaacctggctgcacttcggaatcttggaaagggcccagaactatttcacctgtccctaggcgtgcaaatcaccatggttcccagccaagttagcaggtccccaagagcagccatgccagcagctcacatgagaaccaacccaagaatcctggattggcccataccttgggtcaagggcacctttttgtgctgtaagggcattcatttctgaaagccctctcatgggagaagaatagaagagagaaagtgtgagaagcaggaaagcaggtgctgaaccagtcaggatagctgaaaaccttgttgattaccaggaaatgtcacatacatttctactccaaccctatccccacaaagactatatcaggcctggactttcactggaaaccacaggcaatgaatcagagccccgagtccaaactttgcctctagccagtaatcacactagagtctaacagccctctggcagcattccctgaggaatgaactgaaacagggaaggtaaactatcaggccacaccacctctaccctacctcactctcaggagttcagctctctaactcccaagacaccgccttcaaaagagggttctctcctccatagccagagagccctgatggtggggaggcaaacagctgccctccttccttatatattgacctctagcatctcccttcatactacccaagaaatgatgcctctcttagggtcactcatacatgacttggtaggcactgtgctgtctacataaatgggttaggcagaatgaggcagtccagagtcatttcctcctgccctttccatggaatcaaacagattcatcaatttttcagggcgaccttcactcagctcaagtatttaacctcaaaacgaagtgctagaaatgctgcacctgggtctaaatgtggaacctaatctaagcccttccgctgtccttccccttctcagagagatctggtcctgcagttgctggcaaagttattccacctgactattctcagaaaagtcctaggaacagcatattgctagaattgtcgaatacttaatatatgctagacatggccgggcatggtggctcacacctgtaatcccagcactttgggaggccgaggcgggcggatcacaacgtcaggagaacgagaccacggtgaaaccgcatctctactaaaaaagacaaaaaattagccgggcacggtggtgggcgcctgtagtcccagctgctcgggaggctgaggcagcagaacggcgtgaacccggcaggcagagcttgcggtgagctgagattgcgccactgcactccagcctgggcgacagagcaagactctgtcttaaaaaaaaataaataaataaataaaaatatatatatatatatatgcttttatatatatacgcttatatatatatgctaatatatataagcttatatatatgctaatatatataagcttatatatatgctaatatatataagcttttatatatgctaatatatatgcttatatatatatatgctaatatatatatatgctagacattgctctaagtacttaaaatgtattaaaccatttttgtgttttctactactatttccctggcatctagaagaaccctgagctcacggtagaggctcagtactatgtgtgaatgaatgagcatggtaggcactagcatgaccccgtttggctgagatggtcccagctagtaagtggtggcacagggttagaggccgagcagtctggcttcagggcccacacatataattactatcctatttacttccctgaacagcagaattttggtcaaaagagcaatccagcttctcccaggatcacaacctgcaatccttcacatcccagatcacctgccatccggctgaggaacaagctccccaaggtgacaagaaaagggagcagataaaaaggagacaggtggaccagattggaccccttgggggctgagagaccatactcttaatcccattctagccattccccattatcacggattccttgggcctcattctcagaatatactagggaagagaggtggagaggcaggagcttgggaaagagaaacattagctcctggggcaggacaatggtagtggctacctggggcaggcggcagagatcaaagggagaatgctggagtcaggagtaagtaaagtaaatagtgccccctgctataagtgcgactgagccaggagcacgatgtaccggccacaatgcgggtcactgcccaaagtggggagggaaagaagagtcaggtcagcctacctgtagaacgtgttcatctgattaacccagaatcaattctagtaagcaaaaaagttactgagagtctactatgtgccaggcattacaggattcaaggcaggggaaacagatgcatcaatccttccctcataacaggtctgagttaatacaaagatagtaactcagagttcctacttcaaagagttcatatttgcatgtgggagataggcagacatatgttgttttgtttttcaagtgatttgctctaacagaattctcaacaaagggtaatagggaaccagagaagaagaaagggatgaattttgacacaagagttctgcaaaaagcatcagaggtggtgacatcaagacaagccttgcaaagttagactttggatgtgctggaagtaagtgaagcataaaggtgtgaagacagggtatgtggatgtgtctcatgggaagcaagactagaaggctaagttcacattcactagtttgcaaaggacttcattttctgaattaaggttatgcccatgggaatttctttttgtttcataaagtggctttctctactctacaactgtttgccaaagcttccttggctccaaactagtattgatggaacaatgaggaatccagagctgcttccaggcttccctttttagactctctgttacatttacctaaactcttagtacttcctcattacttactcatagtagtgtgattttttcaacagccacaagagctatattactctcccatctccaatgcactgggactttggaccctggtatacagccatatcagaaactttaggcaaaccaaagtgacagaaaccctgtagggcattttatttccccttcttgtccctactgcagcccatcttggttctgagggtccaacctcccctctttagaggtaactctcatcttcatggggtctaaactcactcccagtggtccagaaagcccaagactctctcaggatttgctggagagcttccaattagcattttcaactacaaatacgtaatctgcctctcctccctgcctcacccctcctttcctctgagactgtttcagaaaagaaacttctagaatcctgggtaagaaaggctagatctgatctactgctcaccctataaatatggacccacagtctgaggatacaggtttaatgaagaaaaagggaaaatgagctaactggagctctccagagtcagcctttgagcatgtctttggttctggcacccgccccagaaactggcacagccccaagcccctcgcactgaccatcacaacatcacaagggcagggcccacaacacgtgacttccctaagagtaagaattccgctcctccctcttgcaatgtggtaaacattgctggtctagatacaaacttccttcccttgggagcccaggtctccattcaaagggaatcatggcaatgttcaccatcagcttcccttaggaataagagcatattagaaaactcttctaaggtctcaaatggccagagggtttgccagaataaagagaaaggaacaagaaacgtaatttaggaagaagactctaatgagaaggactcttcaagaaatgtaactcccccttcgccaatccattcatatttaacaaatatttgctgatcatctactgtggtgtttgggattatttagatgctgggaatatggtagtgaacaaaagagataaaattccctgccatcttgaagtttacattctagaggggagatcaccaacaaatatatagctaattaaaatgtatactctgtgaaatggtactattaccatccaaatgaaatccctaaatcaaagataacctgaaatggccctgggtccatgacacagacccaactgcagtagtaaaaggctgagagtcagaaggaaagatgaacccaacatgcgaggatagtataaaggtttaaaaaagaaagtccaaagtaggttctcactcaaagaggaagaagcaaggctattcaggaattagaaaaaaaattactagaaaaaaaaaaaagaaatacactttaagttctggccttaaggtctcaaagatgtggatttgtacctaaggtggtcttctatttgctagctgtgacactgtgggaaagccatcatacttaacggtttattttgagagagagaggagggaaaggagagagacattgggagtcaggcactgagggatcaagactaacaacatttacatcacagaatgtgtgaaaggattaaatgagagaatcgagtaagtgcccaagaaatgtctgttccttccctttgcaaggcacattgagacttctcttgcctggccctactccaatgagtgctaagtggactcaagaagtgccctaatgataaagtacatagagaaactaggtctgatctaattacagatggttcctgacttaggatttttctattttactgatgatgtgaaagtgacaggcattcaatacactccttgacctatgatggggctatctctggatagtctcataagtcaaaaacgcactttcaactcaggatattttctttctttgctttttttttttttttttgagattaagtcttgctctgtctcccaggctggagtgcagtggtacagtctccgctcactgcaacctctctctcccaggttcaagcgattctcctgcctcagcctcctgagtagctgggaccacaggcacctgccaccacgcctggctaatttttgtatttttagtagagatggggctgcaccatgttggccaggatggtctcaaactcctgacctcaggtgatccacccgccttggcctcccaaagtgctggggttacaggcatgagccaccacgcttggttctgctattttcaacttaggatggatttattgggatgcgaccccatcataagttgagaagcatctgtattaacttctcttcactggcgtcccaaagcatactattatctagtaatacagtgaccagtcaaggtccagatcagggagacacagaaatctacccagtaacctgtgggtaattcactgtcccccatcaccacactagccaactcctcggtctctagcaatgactgaggcagcatggcttttgcatcagaaggtcctgggtttaaatcctggctttgccagttaccaggtgtgttactaaccccttttagcctctgctcccttaccagaaaaatgaggagaccaacagctactttgatgaggctgatggaaggattccatgggatgatatgttaaagggtgcctactcagtaggtattgtcttcctacctccccaaaatagcccctgcttctcaaagctctcctttactctccaattcttcaggacctacccaagaagccaaggtttcatcttcattctctccaccctcttttttgggtggcaagtataacagtgaagagtaaagctgctactctctccagaagcacacaaagcacaaacagcttgcttccaacaacattttagcaagagtattctgcacagcccaactgatcctgcaatgcttgaaccaagaactctctcaccaccatttcctgcttcctaatgtggcttgtgcaaatgctctgctatgtcatttccatttttaagtaatatacactcaataagggctatctggaaaacacaaaaatatgacctgcagatataggccataaaaatagctaacagtcaaatggtttttgatgggattaatttcacagtttcctcagagtctgagagaaaaaactactaggacagagaaaagagatagggtggtgatatctatatttttagaagacaactgtttcattctcctttctcctcatttcaaattttccacagctcatcacttggatgagctacctctgagtttcaggcaatatccaacctgatacggggtctctctctttgtcctcacagaatacccctctatcagttcagtgatcagaaaccttggtgatctgggagaaaatatagtaccctaaatacacaaggcacactgcccttgaaggtccgaatgtgaaactgaagacagagctaacactgccctgtgtttggtctgatttagctttgtttgggtctgtgcctgcaacaaggtcttccctgatcattctgccctgctgctgccgacctcgccatgctctatgattagcctccagctcctgagcatccactcagtgctgggctataaggaaaaagaacacagagaaacccaaacttaatcttgtgtttagggaccttgcaaattaattaaatcatagtcaactcacccccacccccgccaccttttaaaacaagatgggagaatagatgcagccatacagtcatatatgcaaacatctatgtatgcaatctagtcaagttactgaatcactttctttgtggcctcccttcaaaatgagataattttgctgcctctctctcacgatgctggacatgcaatggagtaagataggtgcagagttcaaaacagtttgagacaaagtccaggtcctacatatactattcagatttttctggttcagtctgaggtctggctagctctctggactgcagggtcagaagaggagggagatgtgaagaaagactataaaaagaggtccaaacagaaggcttgaataatattagtaaaattaactttgtaaatgctttctatgtgctaggtactaggctatgcattttgacacattactgcaattaacctccactgttaccctatcagttgggctctaaaatcattctcattttatttattttggggtttttttcttatttacttgtcatgacttgaagcccaatctcattttatatacaagaaaacaaaggcttgaagagattaagtaacttgactaaggtcacagcaaaatggggaaacagaaggcccaggaagttgaactctagaacctacacttgaatctctacactataatgcctcttaccaatgagacatccatttctccctcctatctcctacccctgtaaggaagttggtccctgttctgaggtctagtggtactagaagctggctctcacttcccttcttaaatctccaaagagctcaagaggctgaaagagggaaaagacaaaatgccctctagaaaaggaaagccttacttcaccccttgagtgtcctccaagtatagtggaaaataggaaaaatgaatctctggtatgggaagtctctagacttgaatctccttttaaaataagtacagcccctcagagtcatagcaggaaggcccctcagctctgcccccaaagaaaaataatggtaaagggagtggaagtgaaggtgggggcggggcagctgctctcataagagccctttgtggtggctgcctctgaaaggaggttttgctagacaaggtggaacttctcaaggtgacaagcaaatggtacagactgagctgtgaccctctgcttgctctataaccaccccctcccctttggagggccagagcctaaactgtccctggagccccacccagccccagcacaaaccatggctttctagtctggagggcaactaacgagcagcagaggggctcggggaacgcaagtggtttcctgggggggacggatcctcagagcccctcagaaagtgtaggagcaactctcattccttcttttctctactcccactcctctaagaagaacaagcagctcctgtcagctctggctcagggaaggggctccgaccagcctagcaggggaacaagcagtttgaacattattttagcacctctctcaaattcagccacctcaacatcctcttcccaaatggaagtgaaacaatgtggtagaaactggaaagaacaaaagcatcagatttaataacaaaaagaaaatcacagctataaggcagatagtctggctctgaaagctcttcatccctgccctgtgctactagcactgtgcaggagtgcagattccttttttttttccctgacttggtgcgaagagaggacagtcaactgggtgtgtagggcacaaagttgatttagagtaccctgcagtattctctgtaggacctccaccaccaaaaggattctctttcactccagattacacgcttgacagctgggaacacagcccacagcagccaagttctcatggactccctgcccccatcccgcctgctgcctgcctctctggagggtgacagtgtcttctctgccctgagaaatcgtactctatagggtgacgcaccacctcccccacctgccacacacactcaaaataaggtactgatcttcatgaccttgaggaggtaaagatttcttaacaggacacaaaccataaaggaaaaggttgataaattggactagattaaaattaagaacttctgttcatctaaagagacacttaagagagcaaaaaagcaagctataatgtaggagaaaatacttgcaatacatataaccaacaaagaactcatttccaaaatatattaaaaactcttaaaaatcagtaagaaaaagacttagtcatacctaaggcttagtcatatttaaatgactgataattacataaaaatgtacagaatctcattgagaaaattaaaaccacaaccggatatctctatatattcatcataatggctagaaggaaaaaggatgataatatcaagtgttgacaaagacacagtacaaccagaattctcctaaactgctggtgtggttataaattgatacagtcattttggaaaacagtttggcagtatctattaaatctaaaaatatacacaactatgacctagccattccacttctatgtatttccccaacacaagtaggtaaataagttgtggtatagctttacaataaaatattatacagaagtgaaatgttaaaagtatggctacaaagagcaacatagatgaatttcattaatatttcgggccaggtgagtggctcacacctctaatcccagcactttgggaggccgaggcaggaggattgcttgagcccgggagttcaaggctacagtgagctctgatcatgccactgcaagccagcctgggcaacagagtgagaccctgtctcaagaaaagaaaaaaaaaaaattaacattttattgagtaaaagaagtcatacacaaaagagtatatattattccatttctatgaagctcaaaaacaagcaaaattaatgatcatattagaagtcaggatagtgtagtggtgttaccctttggaggtggtagatattggtagataacaggggggtacttttgagtactggaaattttctagctcttgatttgggtgctggttacacagctatgttaattttgtaataattcttcaagctgtacacttctgatatgggcactttcctacatgcattttatacttcagcttttttttgtttgtttgttttttgagacggagtctcactctgttacccaggctggagtgcggtggcgtgatctcagctcaccacaagctccgcctcccaggttcatgccattctcctgcctcagcctcccgagtagctgggactacaggcgcccaccaccacacctggctaattttttctttttgtattttttagtagagacggggtttcactgtgttagccaggatggtctcgatctcctgacctcgtgatccgcccgcctcagcctcccaaagtgctcggattacaggcatgagccattgcgcccagcctatacttcaattttaaaagtttattaataaaagatgaatcactatggaaaacagcgaggtagttactaaaaatgttaagcatagagttactatatgacccagcaattctactcctaggtacatacccaagagaacggaaaacatagttaacacaaaaatgtgcacacaaatgttcacaatagcattattcataagagccaaaaagtagagacaacccaaaagtccaccaacagatgaatggataaacaaaatgtggtatatctgtacaatggtatattgttctaccataagaaggaataaagtactgatattcgctttaatacatgaaccttgagaacataatgctaagtgaaagaagccagacacgaaagaccacatactgtatgattccgtttgtatgaaatatgctgaataggcaaatccataaagacagagagtagtgatttccaggggataggagacagggtgaatggagaatgactgcaaataggtatggcatttatttttggggtgatgaaaatgttctggaattagacagtagttatggttgcataaccttgtgaatacactaaaaccactgaattgtatatacttttggtatatacttttcggtatatttcatggtatgtggattatagctctaattttaaaaacaagttttaaaatagataaagtctctattctccccatcttttttgcctattctccactctatttcctcttttaggaatagatgcttaggctcccaaaaggcttggacaacttttaaagaactttaaggcagtcagtggagcagatacctaccagtggctgagagactggaggtggcatggaatgttgaaagaccacaggatctagagtcagacagacctggttttgaaaataagtccaccacttacatgtttgttttatgatcttgatcttggccaagtgacttaattttttgagcctcaattttctctccatgaaatgagtaaaggaattcctactaatgagggctgtccaaggattgttaaatgagacaacgtaggtaacatattaattctgttcccttgagagttccatgcactctcaactgtttgaaggcaactgggaaaatcactttattccagcaaaaacagtgtgggctctggagttaaattgcttacactcaaatccctgatccactacttcatcttcatctctaagccttagtttcttcagctgtggaatgggaatgatattactgcctgcactatggagttattatgaggattaaatgagatcatgcatgtaaagttctccctatagtgcctggcacataggaagggctcaataaatattaactgttattattaattcaatcattaaacaaaattgccaaggatatgctatagcatgctgtgtcctaaggataagacagggttcactgccctcaaggagctcatagtctagatgaagagtgagacacataaacaaataattgttcctcacctctagccacacacgggagcctttgattcccagtcaacagcactaggtctgaggccttactaaacaaagctggatatgtaaggaacagcatggggtggggacagcagttaacagactaaccgtgaatcaacagtaggcccttcttttcccacaaatagcctacaaaaatctagataggcataaagactttctcctctgaattactactaaggggccatctgtgtcccccaacctcttcaagtgactggtttcttctcatctttcaagtctcagtttaaatgtcacttcttctggcctcctgaccatatcatctgaagtgcttttacagcactctattcattttcctcaagtgattatactttttagttattcatttactcatttcctgtcttccccattaggctgtgagcccctagagttcagggaccattcatctagcaaatataagtatctactatgtgccaggcactgaagtatgtgctgggaattcagtttgggggtagagacatggccactgccctcatagagcttacagtctgtatctgtggaaaaagttttgggatgcaggtttatcccaattccagctgaggactctcttaggactagcccagttagataggagcctttggctgccaatctctcactgagttcaaaaagccagaagctgaaacttgggcgacttctcagttcttttttccgcagtcctagattcctgtggagtttaagctagggtaaacagcataacctcagagccatttctgcaagttctttccttataaagctatttctatcagcattctaagggcaagcatggtcggtatcgggcaagaaacacattggctggggtggagggtggggtagggcatggggatagggaggcaagagtctccctaagtcctgtagagatgaaatgactgaactggaagtgctgagccctcagcgcctttcaaattctatgccctgaatttctcagatggctgcttcccacagtctaagcttctctaccattgagtctgacttcgtcctaaaggctacttcctgctaagctagcctgaggtctagcaatgttgaattcgactctaggaaatatattctgctgcaaactctctgaggaaacgccaaggggacactgttttccaggactgggagataacaaaattcaaaggattgttgaaaaagcttctttaaatttgttattaaatgaacaagggtatgtgtatatatgaagtatgtgtgtatatatgaagtatgtgtgtatataaaattaatgaataaatctttgcttaatagcaggagataatgtcctgagagcagaatccgggacaaagtttcaagccacataagcaaacagacctattcattcaagaactttttacttgacaccctctctgagccagattattctaggtacaaagaaataaatgactgattgtgggtttagcaaaatatgttcagttctatgatacaggtctatgtacagtctgctttgagagaagagcagaccagcctgggcaacatagtaagactctgtctctataaaaaatgaaaacttagccaggtgtagtgagtggcacatgcctatggtcccagctactcagaggctaagaagggaggattgcttgagcctgggagttcaaggctgcagtgagctgtgattgtgtcactgcactccagcctgagtgacagagtgagacactgcctcaaaaaaaaaaaaaaattataggattacaaaggaaaccaattaactgaaatgttattcaaatattttaaaactaatctgtaatattataacatatgagcttctttattaacacattaaatcatgagatctagcaatgagtctaataaccataatttcaagtagtaatcagcaaaagctgtatttcaagatatctgcagcagtataaaatgatacgaaagtatctgtgatttctactggtgacagatacttctaatatacagtgtcttttgcttacatttacaattgaaggaaatgctaaatttcagttacaggttaatgaaataaagatgcaactttccctctcattccattcacgaaaccctgaactcacgaacccagggtaaaaacccctgctgtaaagatgtaaaggctctcattgggtaacagtggatgcataatcagaaagaccacgtagagccagttcagagttagcagtaaggggagccaaagccacatgccagtcaatggtctgcaggagtagaaacaaattggctgtggggggcagagataagagatcttgagatcccagagaaagaagctgcctgtccagtttctgtgaggcatgggtagccatctgaaattaggtaccaagagacctccctgtgcctattcagtaaaacccgtttttacttaagctaattaaggggatttttctgccttacaattaattgctgagataatactttaaacaaaagtgctcactgaaacatgtttgtaatagactatgtatatgtgtgtatattaacagccttccagatgagaaattccttaatttataatcggttcagggtacgtatactctagattctgtaaagcccacagctgctgatttccataaacctgctgtagaaggtaccactgtcgaataccttagggaggagggaaagccacctgtcctctacatagagggctaccctggcaggcagggcgactaatcaacaggtagacagtgaactcgtaggagccagaggaaacggagcaggatgaacaatcagtaaagaagtcagggcactatctgaaactgtgcatctttaggtttaaggaggcaaggacaagagggatatataaatggccagaagaagaatcctaagctatcagaggtcctcttgcaaaatgtgtcttaaacagatttttgatattattggcaggggaaaattgagagggataaactgtgccctgaacacagaatggtcagtgcctaaactcccacaagacagatgtagatctggggccacttctgtggagaagggaacagaatgaccttccaggcctctccagctgctcttcccactgtttttaataccactaagggcaaacaggaaaggagaagtgactgggaaaggaactgaatgttactattaattaaatgtttaaaaatgcagttgaatagtgggtatatagtgtttgctttattatatgttctattgtgtgtattaaatattttatagtaaaaatattttaaaaagacacagtgaaaccaaatcaaaccaaacacacaaatggaaaatgaaattacttaacacaacatcagcagtgactactgaagtccaagcacggaacgtgtgtggaggaaatctccagcctgtgtcaatgcctggtcccactagactccaagtttaaagatgggcaaggattctgaggagaggctctagagaaaaattagtaagttctggatacaaagtcactttccaggaaatcaagactggcaggttttgaggtgaggaagtcgaagggacagaaggtcaactgctaggcttgagttatcggccaccagtttaacttaaaagactcattctcaacagggtacctgcctaacccatggctggggtggtgatggagggatctgatctgatctaaaatgttaggatgaccctaacatccagtgcctggggaaaattaagcaggacttactagccattaaaaagatcccagaaaaagatggagggtagggagaaaaaaagaactggaaattaagatatacttcaattcagacctcccactcagagcaggagtctggcagtactgtggaagcggaggttgtggctgggtgctgggagaaggggactggaaaaagagagaagtacgaatctgcagaggagtcaagataggcttgatttggaagaagttttcctaaatggatatgatcaggcttgaggctaagagctacttcctgagacttctagttccccggttcagaatctcttcatccctgtcctcactcctggctatagtccaggtactctaaaatgcccagatcatttctaggtgtagtacatctcacactcttttggatctaggtttcactaagcaggagagaatgccctggttactcaatttagcatttcctaactgataatctctccacttccttgcaggaagttatagctgtgggtgtaggattcccactgagtgtgctaaccccctatcctcaggctcacttaggaggcacaaacaggcagccctgacaccaggctgaccctacgcaacagaacagcactccagggttcatctccaggtgaggggatgaaggaaagaccaaatctaggctctggttacagggcatcttgaacacctgctaataataaaacattatctgtcaaggccttgaccctccaaaccaccaaaacagaggaagagggtgggagaggaattttagtccctctgatttttaccccaggtaataacaacaccccactccatcccaaaggccactagccagagtagaagagcacctaggaggatctaaagaaaagactgaccaaggtatgtggaagactgtattggtcccatcctagaaggtgggcagtgggtgtggctaaggaaacacttggctaaatcagctttcttcctttcccacttccattcagcctaactaccgacgtggcttttgtaagatctgtgagacagtatgtcagggaagacaatggaaacaaaagcttaccatgataaaaagagaccgatgcagcatgtagagttctaggccaatatgccgggtctccagttttgatgggtatatcttttaactgagagatgataaattatttagttagtagtagtcctgactgttaaaagatctcaccatcaagttcttagcatgtgtttctgggtgatattgtacaatgctttaaacctaatggtcacttaatagctgtctccttcccatatcattccccatataactgaaacctaagttaaagactccttagcctctgccaacttcttgtggccaggcctggactacttcaaggaagcccttaccacagggatgagagctcacagccaatggggagagcaccatccatagcagggattagtttcttgattaaattcttaagagcctaggatctagttcagggaggaggggtatgggtactattataaatgcaatcagagagctaaggggcaggtttcaaagtacacaggaaattcaaaacattttccaggaggtaatgaggaggactgaaagcagaaaaccagataaaagctggcgaagcaataaatgtatccatttgacaacatctgaattgggcctaggtagagaagctttaaaaaaaaaactggcaaagggtaagaggcttgataaaccaagatttagattcagggaaagaggtggagactcatattaaggggctcctagatacaaagcattctacatcatcaagaaacatttcctaaaactcaacatcaaagcccagaaatcaaggaatcaaacttagagagggccacttggagaaaggatacatggttttctaagatttccttctttctaaataattcaaggcaggaggaaagtgagaggacctatctcttgctatttacgtattttttaattctttgaatttttattgtataaagttgatagaactttgcaagactaatccctcaggagaagaatacttgaggacacaggagaaaaagagttggcaatgacctgggaaagattctgtaaacataaagtgctgtagagatatatgaaattactactcaattgactcagattttcagtcatttttgctccgcaatcatgcctaaaagtagacaagtattaattcaacaggtatttattgaggccctgctatgttccaggtactgttcttggctactgagaaacaaaagtcaacagaacatacaaaaatccctgcccttgaggagcttatattatagcagtcaaacaccatcaatattacagttatgttaggaaatgttcaatgcaatgggggaaaaaaagagtagggtgaaggattgggaatgtagggatgaaaaggtgggatgcaattttaaataaagtgatcagggtaggctttgatgagatgacatttagcaaagatttgacagtatgggaattagcctatggatatctggggcacaagtgttgggagcagagggcataagacaggagtgtgcccagggtgttaaacaaaacagtaaggtgaccaatgtagctagagtgaagtgagggagacaaaggtggtaagagatgaggtcagaaagattatagggatcaggtaagaaggggccttgtgagccactgtgacaactgtttttacttagagtaaaatggaatcccttgcagagttctgagcaaggaagtggcatgaactgactgagaactttaaagaatcactccagcttccaggttcagaagagattatagacagttcctggcttatgatttttttggctttacaatggtgtgaaagtgatatgcattcagtagatattcagggatattcaacatttcattataaaataggctttgtgttagatgattctgcccaacagaaggctaatataagtgttctgagcatgcttaagataggctaagctataatgttctataggttaagtgtattcaatacattttcaacttatgatattttaaacttacgatgggtttatcaggatgtaaccccatcataagtcaagggacatctgtataggagaacaaggatggaaacccagagacaactgcagtcccctaagcaagaaatgatggtggctcagaccaaggtattagagcagaggcagattctgtatttattttgaaagaagggccaatagaatctcttgatggattggatgtggggtatgagagaaagacaagagtcaaacatgactccaagatttatttgtttcagacacagaatcttgctatattgtccatgctggattcaaactcctgggctcaagagatcctcctatcttggccttccaagtaactgggactacccatgtgctccgctatgtctggctcaactccaagatttttaacctgagcaagtctgaaaggatgaagttgccattaaccaaggagaaggctatgggatgagcaggcttgatgtgggggttgggggtaggggagaagaaatgagaagttcaatatgaatatgttgagtttgacctattagacttccaggtggaaatgttgaacaagtagttgaatatacaagtctggggtttgggagaaagaactgggctgaagatacagggataaagatgatgtttaaagccatgagactgaatgtgatcaccaacagagcaaatgtgggtagagaatagaagagggccaacgactgagccttggaggtagtgcagaagagaagagatcagcaaagaagattgtgaagaagtaactgatgaagcagaaaataaagccaggaaagtgtattgctctggaaaccaaatgaaagtatgtcgagaaggactgggcgaccaactctatcaaatgctgtttgaccaaataagatgagagatgagaactatttactggattttgcaacgaaaaagtcattagtaaccttttcaagaacaatttcaatggagtgatgggacccaaaaccccatttaaatggttttaagacagaactggaagaaaaggaaggtaagatcacagtaaaaatagacaacacttgtaaggagttttgtagtgaaggggagtgaagatgtagggtggtaactggtgggcaaactggggtgtcagaaggatttttaaggtggaagaataatagtacatttgaatactaatataacaatcttatagaaaacaaaaacttagggagaggagaattaccagagcaatttccttgataggtgagatagaatctaatgcacaaatagagagacagcctttagacagaggcatggctactttatctttgcacacaggtggaaaggcagtgtctgagggtacatatgttagtaggaagtagaagtatggtttaagtctgcaagagttcatttctgactgattcttcttttttagggaaatttaactgcctggcagcattaaggctgcatttgagaggcagggtcaagaacttaaattgaaactaggcaggctgggtgcagtggctcactcctgtaattccaccactttgagaggccgaggtaggaggattgcttaagcccagaagttcgagactagcctgggcaacacagcgagagtctgtctctaaaaaaattttttaaataaataaataaaatgaagaaactagtcagcatggttttatgttttgctttctgactacatttgactgcataggtatggaggaggtagaaagttgagtttaactatacacaagaaatgggcaataaaatcagaagtgtgtgcaagggagtgattacaattgaccatagatgctgggtaaggaagggaggcagaatatcacaggagtcaggacaatgaaaaggaaggtaaggtcaatgggctggagctctctgtaggattaaaggaatgttgagtcaaggtagaggaagaaagccggcaaaacaggatggggatgtgctcggaaagtggcatgtttaaaactgagaatatggagaagtgcaatgattggtgattacaaggcctagagcagactctagaacagagcttctcaacagtggcactactgccactttgcgctggacaattcctcatgctggagggctgtcctgtgcactacaggatgttgaacagtgtccctggactctactcactacaccagatgccagtagcacttctcaagttatgagacccaaaaatgtctctggaccttgccaaatgttctctgtgggcaaaacctccccttgttgagaaccactgctctagggtatgtccagagaagtcactgaatgagatagggcaagagtcaacataattagagaagtactggagaaggcaatagtgagtcaggagctaaactcctcaagaaatgagtaggaattactcagagtcagtgcatttcataacagtgaagagtcctgggtgataggttcagatgcatcagactcaaagctgggctttttaaagaagagggaggagacatggtcagaaaccagcaattagaaataaggaagacgtgcatcccagctccatactcactagtaagaggactatgaaagaagaaacagccaccgtgtgagagtgcggcagaaaagacatgggaaaaggcagaaaagacatgggaaaagtctttaggggaaggccaggtttctcatcaagaaggagaaagtaatgctcgaggaagagactgaagataaagaagattttgctgattataaactatgaatttcagaaggtacaatggtagggcccagaaaccggggaagggtaggaaaagaggacagaatggggaaatgcaagctgtatttctgaaactggtaggtggcatccagtgggaggtccactgaggggaggggtggtatagtggaggcagatctttaatacaggagaagaaggaagccttcggttattatggcaagaaggtggacataaagtaagaatcttctgggaacatggcacatgacatattcacacaatagtcaggaatcactctgtaattaccaaccctaggctagaactagtttagaacaaaaaggatagttttctaaccttcaacagctttaatatgaggaagtcgaccaaacagatacaaatctatcaggacgtgagaacagggtcttcgaaggtccaggagctaaggaaaccttcaagaatggtgaaacttggctgtgcatggtggctcacacctgtaatttcagcactttgggagtctgaggcaggtggattgtttgaggccaggagttcgagaccagcttagccaacatggcaaaactcgatctctactaaaatgcaaaaaaaaaaaaaaatagctggggatggtagtgcacacctgtaatcccacctacttgggagactgaggcatgagaatcatttgaatccaggagtcagaggttgcagcgagctgagattgtgccactgaactccagcctgggcgacagaataagactgtctttaaaaaaaaaaaaaaaaaagcagcaatgaaatatgactaagaatacagagaatctgatctagtgcttatacacgctggaagagaattagaatgcagattcccacagggaccaagaatcccaccaagccagacagggttgaggaaagtaatctggacccacgaagctaaccaactgagctaagaagtagcaaagaactctatcaagataaagaattggtgctgggaaaattcatccattcatatttcttcctctatgggcattttacaaaattattttttaaatactaatcaatgtaaacactatagatgtatataaataaaagacttctactctttaactccaatccccccctcagaggaaaccactgtgaacaatttgatgtgtatcctcccagactttttttctatttggtataaacatcccaaatgggatcacattacatatattcttatgcattttgccttttttgggtaacagtgtatcatggctatcttttcaaggctatttatttacttatttattggggatggagtcttgctctgttgcccaggctggagtgcagtggtaccatcttggctcactgcaacctctgcctcccgggttcaagcaattatcgtgcctcagcctcctgagtagctgggattacaggcgcgtaccaccacatctagctaatttttgtatttttagtagagatggcattttgccatgttggccaggctggtctcaaactcctgacctcaggtgatctgcttgccttggcctcccaaagtgctggaattacaggggtgagccaccgcgcccggcctatttatttatttttgtgacagggtcttgctcagctgccaggctgaaatgcagtggtgggatcatagctcactgcagcgtcaaactcctgggctcaagcaatcctcccatctcagcctcttgagtagctgggactacaggaacttgccactgtgcttggctaactttttaattttttgtagagatggagtctcgctatgtttcccaggctggtcttgaactccgggcctcaagtgatcttcctgcctcggcctcccaaagtgctgggattacaggcctcagccaccgcacccgaactacctcattcttttttttttttttttgagacagagtcttgctctgtcgccaggctggcaggctggagtgcagtggcgcgatctcagctcaccgcaacttctgcctcccgggttcaagcaattcccctgcctcagcctcccaagtagctgagattacaggcatgtgccaccacgtccagctaattttttgtattttagcggagatggcgtttcaccatgttggccaagatggtctcgatctcctgacctcgtgatccgcccgcctcggcttcccaaagtgctggaattacaggcgtaagccaccgcacccagccctcattctttttaatggcttcattgtattatattatatggataagccgtaatttagtcatatttccataatgatggacttttaaaccgtttccaattttctgtattataaacaatgttgctggtgtttttgcatgtttaataattttatagagtacattcccactggctagattaaaggatatatttgacactgccaaaaaaacgccctcgaaaaatgtactaatataccttccaaccaaaattgcataaagtacccaattcctcatactctagtcaaagctgtaataatcttcatttttgccaactaataggagaagatcaactcattcttgttttaatgtgaactctttttttggttttctatattttagtggcaggggatatttcagtttaagaatactgaaaacttgctgggtgcagcgtgtgcctgtagttccagataccaggaggctgaggcaggaggatcgcttgagcccaggagttctaggctgtagtgcgctacgccaatcaggtgtccgcactaagttcagcatcagtatggtgactcctgggaacgggcgaccaccagattgcctaaggaagggtgaaccaacacaggttgttaacagagcaggtcaaaactcccatgctgattagtagtaggattgtgcctgtgaatagctactgcactctagcctgggcaacataaaaaaaaaaaagctgggcacagtggctcatgcctgtaatcccagcactttgggaggccaacacaggcagatcacttgaggtcaggagttcaagatcagcctggccaacatggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaattagccaggcgtggtggtgggtgcctgtaatcccagctacttgggaggatgaggcaggagaatctcttgaacctgggaggcagagtttgcaatgagctgagatcacaccattgcactctttataaaaaaaagcaaaaacgggaaaaaaaaaaaaactgaaaactgttttcagattaggttatatgcataaacattgaaccaagaggatactatttttatttatttatttatttttaacttttttattttttcttttttctttgagacagagtcttgctctgtcgcccaggctggaatgcagtggcgccatgtaggctcactgcaacctctgcctcccgggttcaagcgattctcctgtctcagactcccaagtagctgggactacaggcacacaccagaatacctggctaatttttgtatttttagtagagatgaggtttcaccatgttggccaggatggtctccatctcctgacctcaagtgatccgtccgcctcggcctcccaaagtgctgggattacaggcgtgagccaccatgcctgaccaccattttttttaaaaacaaaatgactgctaaatggaaagaaacctaagaataacaacattacacatataactaatactttcaaatgcttctaatgtgccagacactatgaaaagcactcaagtatatctcattgagctctcacaactctaaagagaacattatccctattttacaccaaaataaactggagccaggtaggttaagtaagtttctcaaagtcacacagctagtaactaagtagagccaggtttcaactcagatcaccagactctggagtccccatttagaccaaagtcagctcaactgaagtcaaagagctagcaagtggtacagtcaggattcaaacccaggtttgcctaactctagagcacacatatgtaaggtgtttaatagaatttatattatctgtatgaataatgttatgatagtgttgggaagaacttattcttacccaaacatttttttttggttctggttttgtttttttttgtttgtttgttttgttttgtctcaggtttaaaaaacaaaatgacattgccttggttgaacaaagtcagggtcaccgcactgcatgaatccaggagcatcctactttatgagaatggaactcactggagctgtgccatgcacaacctgcagggccaaacatggtggccccaggaccaggtacagactgaaggaaaaaggggatttctgcctgcaactatgccaaaagagctaagggaaacagtgtgtcccctagtggttgagaacagtattgacagctgcaaatgtctagctagagagctccagaactgacagaattagggtagttgctgcagtgagatcagcacacatgaaaactttaatcgctgctctctctacccagggtgttcccttacaagagggtgcaagatctatcaaggctactctttgaagaatcagaggttccctaggaaacaaaggggaatagaggagaagtatcacccaaaacttaagtctcaagaataagatgcctacataataaacgaagagaacaacttttactacatgacagaaggtggtagagaaagagggatatacataaatagactcaagactagataatcaatgctggaaacttcgcagtaatcttccaaaaggcacccccccacacacacaaaaaagaagaaaccactagaaaattaagaaaaccttgaaaatgttctcaagagggaaaatgatgctaaaagaaacccagatgtggtgaatataaaatgaatggaattttggactcattcctactgtcagcctctcttagaattgaggcaaaggcaattgcagacttgggaagaaaggcttaacttgaccaaattaaaatggcctaaagccatgaagagaccatgggtaaaacagaaacacacatcagctggggtggcaggcaagaactcagatgtatcacaggaactcagggaaatgaaaaggactcaccaaggtaaacctgattatagttgagtgctgtcactgcttgattgagagggggatattctggttaaacacatcttctagtttagtatttaccatttgttctgtaagtagattactaattttcaaataattagaaagtatattataaaataaaaataacacacctcataatcttccagtaacatagggtgttaatcagaagtatcaactgtcactatagtctaaggtttgtgcagaatctggtctgttattgacttgtcaaagatatttctaagaagaaatatctagaaagatgtaggtggcaccagatttccactggccagacaggaaagagactttttttagttcaaagaacttgtacagtaagacatgtggttaattatcacagcaatgggacagaagggaaaccctgccacatccattttgacagctcactagactgcaagctctatgagaacaaggactttgctttggtcgctgctctgccactgcctctagaacagtgactggcacataggaggtgttcacgaagtatttaaagaagaaatattaacaaatgctgttccatttaatatgcccttttctcattctttcaaaaaaacctcttgaaataaagaatgaattctgttcattctgtctaatacactgtcttcctatcctctaattagggaaatctcatttatgaaggtccaactcaaatttcttctcttccttaaagtcttccctgatccctttctactgcctacaatcctccctccttcaaatggccagaattaaatcttccttattcattttcccatggtacgttacttggacctatatttgctctcatttcgttctatactgtatttcaattcagtatttacatgtccaattcttccatggggttataagctccttgaaggcaaggtttcagtttcagttttccttgaagatccatcttctaacataatgccttgcaaatagtaattacttaaatgtcttttaagtttaataaaatagaattatattcttggtgtttaataaggcaccagcatatactaagtgctcactaaacgttcattccatgaatgaatggaaagaaaggtaataccagcaaaactaagctgcctcagatcccaggactaggaggcatcatgccttgaagacagagaaatggtctttttctcttgggtctaagaagaccttgcctggctcctgcgcccaatgtcaggcaccctggcaccaaaactgtagagataagtttgaagaagttccagggagggtcacataattgacttggggtgggggaggaaaggataaaaaaggagcgattaggggctcaagttagacagatggcctaagtgacgtctgagactagacatgataaccttctgctaacactgggagagtgtaaacacccaagaggggaggaattgtttagcctggtccagtgggctcaaagtaggagaaaggatgagacaagggacgggagatcaaagccctgtgacagaaagccaagcaaaagagacactgctctccttggactcagagaaaacaaggccatatacattttcacagatatctacaagtgttatatcctcatcttcaggcataaaggaggcctacaacagatggattattgaaacctaatacaaagagcctatgcttggaacagaaagcccttttaccattatgcaaaatgtagcgccatactcaatgttattaaacagtgcccaaaaaacccacagattcagactgtgctcatcttcaagagaagatgagaaaagaaaaagtacagacagtcagcaaagcagtgaactggaatcccacagtttggtaaaatgcatgaaatttctaacctgtgttctcatttgctgttttccattttactctaacaaaaacacctctcaaactggcatttgctgaaaaaatattcattttttcctatttcccattctactccaagtcggcctacctgccttctagtacacttgagtgggcttcaatggtgcccacaacattgataatgagtgctgagagagcgatatagaagatatggtgtcctgcttcaacaagcttctaatctacttgaagagaaaaaaggtaagtatgtgaaaacagcaagaaaataactgcaaagaaacatatgatatatgcaagagaaaggaggataaatgagctatataactgctaatgatctgtcaaatcaggggaagataactgaactgatcattcagggagggcttcccagcagaagtgaaattttcttcctgaagaggaaaaatagaaatcgattgattgaaaccaatttatggtttacaaaagctagaaggaacctcagggtgtatctgatcaaaattgctcgtctgacagatgaaccccagggagcataataatatgcccaggtgacaaatcaaaaaagtggaagaactggaattcaaatcaaagtattctgatttcaaaacccagggcagatgacaggaacaaatgcagagaagcaagaaacagcaatgtctatcaggaagaaggtaagcagactggcatcgtggggacagaggaactgtttcacagagtaaggagaaataagaagccccaggctgctcccaaataatcttagttgctccatatggaccccacttctctctctgtcttcaggaacatccaccataccttaaattagtggcatgtgccctgcaggtatttcccataccacatgccctgctctggggcctaatctccctctaagggccacaattctcactcccagagtccatactggttctaagggctctagaagctccaagatatacatatggcaaaactaaccaagaagttactccacatacgaacttcttgttctgcttacagccccaccctcctcccttgccccaccaacactaggaaaccagatgtacaaatggttaacagagaaaaaaaaaaaatcccacccagaccacttgaaacgcggctagtctggctgggcttcgagtccgctcagcgactgcgccatgactgctatttatagcttctgggtgcccagcccagcttccaggtcactaattgtggcccagccccgagccaacccccacacctcctcccctgccctgtaacacagggaacaagaagaaaatctagctttgtccagcccaggaagaacagccaggagtgagatctgaatccaagaccctgtattatatgccttgtgaacagtatcaaaactgtcagaaggctctgccctccttccacacatcttgaagagctgagtgtccgtccttccacagcagcctcctttcctgaattctctaagttcatccagagttgaatcctgagttcagtctaatccatccaaatgctagagagtgaaagataggttttggctatcaaggacaccagccaacagttaagtaaagagcctatgtctttgagcaagcatctaagcacccttggattcatgtgtttgccttttcctagggtctatttgttagattatctgtccatttatttgtgttactactctagtcatccacaaaaaagtacccaggcaggaggcacgctcagaactaaacttctaaaaattcttttctagcacttaccaaatacattttaagttccacatattcttagtttcagacagaggacctgaataagatagttttatgagagtgctataaataatcccttctgattccaagatgctattatttgagtattattctataatactgttttccccctagagatacagattactgagatgggcaatgacccttttttggcatatgaggctttgtgaagttatcctgggtggaaaaaaaaaaaggtttttctaaggtataagagttaatggcaaaaagactcagtgaagcttactctgttagttctatacctgtgctacagtggggaaaccaccatgggccacattcccctgtgtattctacatctgaacccttgttcccatcccaattaaacttaaccactgtcaatgacatctatattcagaacaaaggattgggactagagatgaaagaagagttaagagacttagaataagagtgagatatctctttctttttccagtgccccagcacctaaactatggttaccattctcagacagaacaacaagcccccaaccctctacatccttgactgatgctgcctaagactacacatctcaatgccagtcttttccttctcattttggggttcatttgggcaactggataatatgccagggattctggttattggagccagaaccagaatgctgctgtgctatctcatcatcactcacaaataccaattcccagccccaaatggtcccaaatctttcctcccaagaccacaaaggataaaaaaaaagtttccaaattaaaaaactaaaactggcaacaaaggtgccccatggcagtaacctttaaaactggccattaaagtttataagtcagacgggcaccaacgtgaaggatcaagaagagaaaaacagccccctcccttggggacccagagccacagccttccccctaaagccacagagctgatgtcacaagaagcacttgctgcatcaagggctctctgtgtcccaactacaaccattcacaatgcaggcagactctgcgtgctggaggcgggctggtgtctggcagagaataaaggaaaggggaggggcaaggaggcgtgggttgggagtatatatgaggtaggcaaaggtgagaaaggagagaaaaacatcaaatctcctcctagccctcaggactgcctgcaattcacaggccaggaggaaacaggccctgtcagactgcctaagatagtggttctctttttccacctaacacataaaaggcataccacagattttcatcagtaacgacagtatattatgcaataatccttaactatcttggggtggatagttttttgatatgtgcatatcaaaaattttttggtaagggtatgaatagtttgaaaaggcttccaaataattctaaccatctccccgattgggtatgtaccccctatgaagaatcatgagcttaaagagcctacttttccttccctcccttccttccttccatgtattcaacaaatacattttgagagcttacatgtgccaagcattgttctattgacactggagagacagcaatgaacacacagacaaaaatccctgccctcattgagaatccatgtcttcacatggggtaaaatcaacgtaattaaaaagcagaatctaaggggtgcccactgcaccctgtaatcccagcactttgggatgccaaggcaagaggactgcttgagcccaggagttcaaaaccagcctgtgtaacatggaaaaatcccgtctctacaaaaaatatatatatataaattagccaggtgtggtagggtgcacctgtagtcccaactactcgggaggctaaggtgagaggatcgcttgaaccccaggaggttgaggctgcagtgagctgtgtttgcaccattgcactccagtctgggcaacagagtgagatgctgccaaaaaaaaaaaaaagtagaaatgtgtggtatattgggttatggtaagtgctatggagaaaagtacagcagagacagagacagaaagtgctggtggggtgggggtggaggtggggctgaaattttagatggggtggccgggaagtcctcaattagaaggtatcacttgaaaaaagacctgaaggaagtgaaggaatgaatcatgcagatatctgggaaggaccattcttagcagagggaacggcaagtgagaaggtcctgaggtggggcaccggtctcagatgttcaagaaacaggaaggaggcggccaccgtggatggagtccatatgctactgttcatcacagcgctcctcctccatttcagatcctttggctctgaggagtctgggctgactgcatgttggactgaactgtccaagccaggaacatgctcgcaagcagaaagaacttaaatagcttggtgaaaagggacatgggtagataagatgagcttagttttaaagtatttctctttactgaaacagctcaaagttcctttaaataaaacatcacccatcctcacaaaatccttgtaaggaacaaaggtcatattccttaactaaggaccagaggggggaaaatcattttaaagatgattttagaactggaatagaatttactcgtgatacccagaccaatgctctattattcataaaagcatagactactaaaaggtggaagccagatttatctcacccattctcctcatttactcaaaaggcagctgacaaaattagaacccaggtttcttggataaggggttaacactccttaaaaagcaaagtagggggatggtacagcttttaaaagaggggaccagctctcaaatcctgcattctagaaactctcctacaagggaaagatatggtgatgacattagcattacagaatactaataaacagtcttctctgtcccctgacccctagaaaaaatctagttatcccacacgcttggcccactccccttatctagatccctttagccccaaatgtctttcatgagacagtgtggccaagccagtgggctgcaggttctgaagaccagaattaagtctacagtgtgaatacagacacacacacacacacacacacacacacacacacagagagatacatacagtcagtgggaaagaaggggaaaggaaagcacacacaacacaacacaccagggcagctgcagaaaacaactgcttgttaagttaaaattaaactctgtacaaatattgacctttggaggggacagaaaccggtcccatatttaccagctttataaatgggactgaccacagctgccccacgcgcttggccagcatcatggcaggatggggcgaggccatgctttaggggtggggggatgaatgagaggggcaggagacattttaaacactctcttaaatgtagttactactggtaggtcaaagttcccaaaagccttaaaaggggaatttctaggaaagcaaataaggcagtctctgaaagtgggggtcagagaaataggaatagagtggaaaaggaaagcttcggcaaggaaaaattgctaaaaagaatgagaaatacaacagagattgtaactaaatggtgaaagcactggggagcttatccttttgaaccctggcccttggtcaaagcaagagtcataaggtagaagaccaggtgaccaatttaagtaacctaatggaacaatttaaactgacctggtttgagttttggctctgttgcttacttgctatgttaccttgggaagctcaaggaaccccagtttcctcatctataaaatagggataataatacaaaaatattgtcctaattcacaaagactaggaccaaccataaatatcacgcatatataaatcatcattataattaattccattccagctaactgtgccttttacactccaaactggccaagaaactgcagtctctccaggaacaaagtcaagggctagaaaggagagcttgaccttgccttgaacttgtaaaagtctcctaggggcacacacctagacccttctcttgttgcaggataacagggaggccaacctgctgaaacaggccccaaaagtcatactcaggttgcaaaaggtccagatatgaaggaggagaaaggactcatcaatactacttccctgaaagctgatctctagcaacctgaagtttttcaggaacaaacatcacagatgctgggcaacttagttctgttccaaacccctgaaacttcgccctcttttacgccctcctttacactcatgactttcacaatgaataagagtaagcagaaaaagaccagatccatctccatatgataggacatgaaacatgcacacacacatacacgcactgtgccaccaagaatcacaattctgaaagtatttccagtaaaaacacatgaaaagattttgctgaaattagttgcccagatttatagaaatctcttatgcctttatgtggtatattgtttatgctatacatcttaaaatcatggggtaggcaggcaactatcacggcatatgaaaaaggcaacgactaagtcaaagtactttacctcctcagtgctaaccaaacatgtgtcaccagcatctctcgactctgcttcacttgttcaatgttttaccttaatatattacagtttatattgttaaacgtgtgtcataaaatataaacaatgtacagcagaaccaggtcagcaattcaggaagaatttccaacgctgcagtctctgtggtcacagggcaagatgatttgcatttggtgcaccaaatacgtgctgaagcacaaactcaaaacaaattgaggagggagagatggacaggaatagaaaaggggaggaaaatggagaaactatcctccaggtagggaccagcttccttgaattctgattcaatatatatatgtattttttgtaatctgacatttttaccatcaagaacttatcttaaaatgtaatcattatttatctctataacctgctttctctggctttgtccttcttcagaggctccagataagtgataagcctccaagtttagccactcagagcctccaaggcttttgtcctgacatagaaaagagcccttacctcagtccactctcatttttctccccctccataagtcttcgtgtcaccttctataaactatagagaagtggagttagctggccttacctgtatgagcctaagatccttggcaaacctattaagctacagccagaactgctatcatttccaaggtattccatacttggaatacctttctagaaaagggagatttatcataatgatgaccatcacccatttaatactccaaaaaaagttcgtccctctcattctcagcaacaacgctcacaggagaagcctgaaacagaactcagtctatcacgcttcaggatcctcttcccacaatattctcatccaaacaaaaccaatgccttagacagggaagtttctaggctaggaaagtggggcaggggctgaaaacaagcatcttccaaagcaaaatattcttagggagaagttcacggctttgagcatgttaaggaaatctctgaaaacacacacacacaagcccacaaggggacaaacaattgtcatccagcaattagaagtgacatgtccaaggacactttgcttatgaaggggtctcctgactctccacccatagctccatctgtgagaccctgctgattacctcccagactaaattcaggctgcctacattcaactcgattcagcaaaatgcaaccccacagaggatttctagttgaatattgtttgtttcagtgatctcataatctctcctagccaaacttgtatatcaatctcagagaagtccctaagcagatcatgtgcctggactgattccttttagaatgtcttggcctaagcaagcaaaatgtcattctcaggggcttccagacagaagggcactccaacattgaagatgacagcagcataagtactccataggcctacaagaggtaatgcttacacaggcctaagaaatagaaaatggaagccaagatcccaggaaaatgctctgatgcagcccaacaagaaggacgagaaggggactcttacacagaaactgggtaaggctgggagcagactgcaagcacgaagtgacccacagacctggagaccagtgcccatctaattctgtatctggggcccagacatggcagaggtttctgattttataagaactatatctgtaatccagaaacaactaaatttcaagcatgctaggaagcatccctctactgtagtctctgaagtccctagagaggcaaataaggaaacattgctaccgggtaccagtgagtgctgccgacttaccaggcctaagaaatgtctgaacagagtcttattcaagccaagggaaaacgctgttaaaacacacaaaactcctttgactaatgtgagagggggaaagagcctctataattaacagaaactgtcacaggcattgggggcctccgacgtgttcaatgctaaccacttgaaaagacccggtcttctaggaggttggggtttgtgagtggggctccaacagactggggacagcttttccaaaagaatcccaccgtattttaaaaagaagaagaagaagaagaagaagaagaagaaagggggcagggggaggaaaaacccaaacctcagcttaatgtttttccaccagtggaactaaaaagcaaaaaagaagaagaaaagtccaaatgtaaccagttttcaattagggcctaattagaaagaaaagtggccatgctattacagatctaggaaggaagaaatgcagtcaatgactttagtttgggctgagccatccacttgaaagctatgatgattagagggataatttatggtgagagacggtagaggggaagggaggaacagaagaagagagcctggggggctgactgatcatgcaagtcaagagcctgagcaaatagtcaaaaatatgtatcgatcagccacaatctgcaaagcattacacaaagggctagaaggagaaacaaagatcacaacagatataactctgacctaaagaggcttataaacactgtccctgcaataagcacccacctcttaacactcagccactgtatacacatgcacaagtcttcagagaaaattcaacctcaacttcttttcatacacaaagtccactccgacaactcatgtgggctgtctccgcattttacccagctccctactcgtttgcaattatgacatacagagaccccataagaaaaagatgttatcacatcaaatataattcctggcctggcccggtggctcacacctgtaatcccagcactttgggaggccgaggcgggcagatcacgaggtcaagagatcgagaccatgctggccaacatggtgaaactctgcctctactaaaaatataaaaattcgctgggcgtgggggtgtgtgcctgtagtcccagctactcggagggctgaggcaggagaatcacttgaacctgagaggcagaggttgcagtaagcccagatcataccattgcactccagcctggcaacagagcaagactccaactcaaacaacaacatcaaaaatatataattcctgaatgaagtgattggatttgcctctgccctcaaaagaagccagtcaaggcctatgccctggctcaggcaggctgagacactgaatcaaaacggagaatctgagaacagctgaaagagcatttcttgatttcttttttctttttttaattaaaaataaaagagatccaagtaaggtttacacattgcaattggtggatataactcttaggattttttttttctttttgaaacagggtctcactttgtagcccaggctggagtgcagtgacgtgaacacagctcacagcagccttgacctcccaggctcaagcaatccttccacctcagcctcctcagtagctgggactacagacatgcaccaccacacctggctaatttttgtctttttttgtagagatggggtttcgccatgttgcccaggctgtctcgaactactgggctcaagcgatcaacctgccttggcctcccaaagtactgggattacaggtgtaagctaccatacccagcctttctgctttctttatgatcccaaaggattcaggtccattttctgtgtaaaggccataatacatgagaacaagcagaaagaaaatggggatgggcacccttgtatatggctataggaaggaaaggatcagctggttccattccacatttgcaataaacaaaccagtttgattgggagaggcatggaatactttctaccccttgctctggggtaccctctcctttgttgatttagttcaggcaacttggaggagggacaggaagggctagggcaaacatgtcacagcctgcagtgaatagagccaacagaaaggagaggcaaagaacagagctgagaggagaggaaaagaggagaggcctctcttcccatcccacaacctgggctccatccaacacaaagttaattcctaacctcggcttcaccaccctgcccactgcttgcatgatttatccccctatctgcctgcatcgcctttacaagcctcccagccctgcagaccattataaaagctgtctgtgctactggctcgacctggcctggcccaggctcctgccacggtaacccttctccaccccttcattttacaagccttccaccatcatggaaatctgaaatcccacgaaagaacagtaaacatcgcagggaaaagaaaatacctagccaggctactctggacagcagagtcccaaacagactgatgtctctaagccagggatgaaggcctctaggcaacagtgagctaccttcttgcctggactcacctggtcagtaacaaagagatgcacacacagatgccaattcttcatggggcacagccaagaatcctggtgccctgggagttcccaggctcagagaatcagccagaatgttggggaaacgcacaagtaaacacaggtgtcaggttcagagaaccatgtggaaatgtgaaattttaaataacagaaagagactaaacatttttcaaaccacgaactcagaatcagatctgtcgccttcttatgggctccaaagggaagtgacatggtgtagtggaaagagcataggctttcaattcagctgactgggtctgaaagctggcttcatcacttatttattagctgtgcgactttggacaactcatattttctgaatctcagttttactctgtatcatagaaaaataccaacttgtaaaaaggttgtgaagattaacgataagatttatagccaggatgcctggcatacaataggtacaaaaagttgtagctattactgttatttgggatgttagacatcctaaaatgggggtgtggtaagggtggacaggtcctattccttctccatgcaaatacagcctttttaataggtttcccctttattctatgcagttccctttctacaccagattccactgtttgatctcctggctagggaaagagccaaagataatttcctaggggagtattctttcctacccattgccatgaggacccctgccccttcatgactttgaactcacataacctagctctactcctggcccttcttactaggcccacattggcttcttcagcctcagtttataaaggctcttctttctcttcagactcctcaagagaacctgccagcacccaatggatttcattcttttcacgaaatgttgggctgccctactacaacagaccctaagccagaagtgagggttcataccttcctgaactaacatagtggagaatggacactaaggaattctccagtctctggggtccaaaatgctctgccaaggagactgagtgctccccagagctccgttattcacttgggggtaggcagtgggaagatggagggggagggacagggagggcaggaagagaagagagccttgattcagggggccagactgagtctgctacaggccaggctccgctgaggtttctcgggtgaaacacgcctctgtgatggctgtgtctgtaaagcggatggaaatgcccataaagccgtatcaaaccctgtgcagagaaggacagggatatatatagaaccaggaaccaaaggggccacaggggattcaggcggacagctccgcccagcccttaaacccgccccagggaagggggaggcccaaggaacaagctgaaggaatgaaggctggagacagcccggcgggcttatgaagggagtggggaaattaggggcgtcagagacaatgctggaagagagctaatgactgagctgtgggaatcaatggcggctggtgggagctggggcccgctccagcacacagacagatgctaaagggcagactctgagtttcagcagatcctggggggacttgaaccatctgctttggtgtcccacagtcttgacagtgctctgcttccttctcaggaccaacaaacctctaacaaaccactttccctgtcttcctctgcatcccaaccagtacctgcagtttaaattagtcgaggagccgatgttctccatgcctcactcccttaaccccactcccagtctcccggagaaataagagttgggggcaagtgaaaaaaagaaacctatctgtaaagaagtgtcctgaagcaagaaaagtatttcaagatggaaatctgtcaaaagacagaaacaaattcacagaaaagaaaaagaggctcacagaatgagacaatagtgtagaaactatggcatctggtggaattggccctaaaggagtcttgccagggacagaaagtgaactgtcttccactctggattgctgggatccccctctccccatcaaccttcctgtcaaatcaagacgttaagggtagagattccagtgatggggagctagaagacattaagcccacaataatttcttacctgagcaacagccagggtaaccaatcccccactcccccatccctatttcagaagagaatccctccccctcacaaacctgagtcctccccgccaccctgcccctggcccagcacaagtaggacaatgttttggcgccacctgctgtcctttcatgacaactgagtagaacagatctttgaattgagtggacctcaagctaccttccttaattcaccataaatcctaaaggaatttaatctaagagaagagaaaccataatttctattaaagagagtattcctgtggagcacactggagaaatccagtgctccaatcttctcctgtttccttggaccctaactagccagaacattctcataggatttttatatccagtcctacagctctttgtgacgttccttctccaagagtctggccgatttgagaaagacaaatactcaacaaaccctttctctacttaatagagtccacatattttgaaattactatatcacactgttttggctttcttggtttggcacagaaattcgaatttagcaccgagaggacatgatctagtgtttgtcatcaaacactaatgaacgcagtatcacccaaaaagcaatgacttagatatattatgctgctgtaccattcctatggtcttcactctgggcaaacattctaatatgtagtaagttcactgagcagtcacttcatctcacaaagatactttttcattcatttaacaatttctacagcccctattatatgccagccacaaactggaggtacagtggtgagtgagtcacacaaggtccatactctcagaaaggctacattctaggatcatttatctgactcaataaggtagtgtagcaatttctcattcatcttaaagaaaatgtaagtgaatagcaaagatcaagacaaaaatataaacaggctttggaaaaaggcaaaatgaagaaatataagaagaaggaatcagaatagggggcaatgaatgagtatataaaaaagtgttaatattattctttctggctatgttttttccctaaaccccattcctggacctaactctaggaactgcatgccagtgtccaaggtcagcttcctcagacctcaagatttacaggtctttgtagaaagaatgaagaagaggcgatatttattcaatacctaggattgctagcttaaattatatgcaagtatttcccccaaatgtcaacttgggaaatatgtggggctccatcaagtatactgccatttgtagaagagagaaaagtctctgatcggccctagtatgagccaataaatctagggaaatagagagccaccaaatcttagggctagccatgtcctctcctaacctcgtcctctaattgttccaagcaggactctactatactgatcattatgtaaagaatcttaaagaaacagctcaggtacagtggctcatgcctgtaatcccagcactctgggaggctgaggtgggtggatcacttgaggtcaggagttcaagaccagcctgaccaacatggtgaaaccccatgtctactaaaaatacaaaattagccaggcatggtggtgcatgccggtgcatgcctataatcccagctacgtgggaggctaaggcaccagaatcacttgaacccgggaggctgaggttgcagtgagccaagaatgcgccattgcactccagcctgggcaacaagagcaaaactctgtctaaaaaaaaaaaaaagaaatctaggaaaggagttcccaaagcttccctagtaacataatctagtcaggtaaaaattctctctacttcaactacatccttataattcaagtttatcccttcttgtactatcttgagcaaaatgcaggaaagctatttactatcctatatgtgttaattttccatatttaaaagaatgaactaccattcaatctactctctgaattaaataattccattgtccttggatttttcttatttatcctatgtccacctcttttattattgttctgattttttctatgggcattaaggcccccgtgcatctttcacacgtgacatcaaaacctcaagagcagctggacacagtggctcatacctataatcctggcacttcggaaggctgaggcaggtggatcacttaagtccaggagtttgagaccagcctgggcaacatggtgaaaccccatctctactaaaaatacaaaaaatcagctggacatgctcctagctacttgagaggttgaggtggaaggatcagttgagcctgggaggtcgaggctgcagtgagccctgattgcaccaccacactccagcctgggcaatagaccctatcttaaaaaaaaaaaaaattaaattaatgaaaattgtttaaaaacctgaagagctcaactaatgctaaatacaatagtagggtggcttggggttttcatgctattcttttaattatagtctggaattatattcatctttttaaatacccaaaatataccaagaactatatcgcaactgggagctcttactagttaaatctttcaagaaaaaaggtggggcaatatctcccacctaaggagtagaagaccactttataagcaagaagttctattcaacaagagactagaccacaggggaaccatctgacagcaggagcagcagccacggctggtaagtagggagcccaggagggtatttacagccttgtggagggttattcaagaagtcacaaaaattttactttactttccttagatccacgcacctttcaagagctccctggggatctttcactaatttccccaccagggaatgacttcctcatctgtcctcactgagcacttcatgtttgtctttattacagcactcttactttggtaagataagtgtgtgtacacctatctatctcattttctgagccatatgcttcttgggggcaggaatcatgttagttatctctgtacccttggcacagtaagtacttaaatatgttagtttcctatcccccatagtactggtacaagaacctaaacccagtggtattcaataaatgctggataaggatgataacattaataacagccattcagcacaactccactaagttgtcagaccagtttaggatattggcatgaaaaatgctttttctcctggcccagacatttactcttaagatttgcctcctcctcaatagactccaggaaatagggttagttttaagttctagaaactctaatcattcctgttttctccaaactaagggcctgaaggaagactgcagatacctcatgaatattgatgagcctctgcggtcacatgaatattaacaacaccctgtggctttcgggaacagcagcccagctagaaggtctaatattaaccttggctaggcccaaaaagtagaaagcgcatatgcccatacatccccatggggagtaaagagtggatagcggaggccagtttggagcttggcccctatgcaaacactgggcacacaggcagttaagaaagaactaaacattgtgtcctacgtccctggcactggggggctctgttagtagctacccaggcaggaatccccaattctcaagctttggagaagttaggatgtagaggctaaatcatactcaattcagaaaaacactggtagggatacactgacctagttcaatagctacagtagaggggtaggaaaggttgacagtcagatcacataggacaaaaaccagaatcaaattacaaggctcaattaggcaacaaagacatattttgtagatcacacattaacagtaagtaaagttctatagactggagtttccagccccataccctcccatgagactagtggacacagaaaacaatgactgagacttaagcggaaagctattctacgactgatgcagtgagagacagaaggagtcagaatctttttccacctacagatcctcaacccaggaaacatcagaaagaatgatgatcattattaaaaacaaacaaaaacaacaaaacaaaaagtactgtgaatcaaagttaaccaaagaaacccatgtacgcctagccctgggtctaagttcaaaatctacttctatgtcacatgacagaactattaaaaggaaaggcaggttaagtaaccccatgcagtggctggaattaatgctaataagattcctgctgtactcatccaccaagacagactacatttaaaactagaaaagtgcgtctttactcctctagcctgatcctactcaaaggccttcaccccttagctctgcctgaaaagctgatccgaccccctttacccacactcaagaggaacagagaggcctgtaggcctagcccaagctgaggtggtgagaggccacacctaggaagagggtgggggctactctcaggcgctgtgttctgtcacacaattaccatattatgtagctctaataaaaagaaatacttgaagttttattagtgccatataataaagtatttatagaatcctggcggtgggggcagaggtagagagagggagaaggaaataggaggaatcgaaattgttagcaataaccctagcaatggcagcccccagcattcgccaccctgggtaaacctcaaagacttcagcctgggacatcaggccagctgtcatcaacctagatcagcatggcttactgttcactccctctacaacagtccgtctctgacttcttcctggttaacaaagaaagaggtgaggaactgggaggagtagggaagaggaataaagaattgatatcagcaaaactgtggagcctaggcctgaaaaggctgggaagcagaggaaagcgggcatcagttgaaagaatgagtggaatgtaagctttaaaaggttccattctggagctaaatttgagttctcaccatccagcatatctgaccgttttgaaatttgcccaaacagggttttccattactgcactggccccttctgcacacctctcatacacccactccaaccacactctctactcaccaccaccaccacgagaggagtgcaccccacacctactccaaccacatgacacacacccacaccttctcccacaccgcccctcctcacacatggtcctcacagccacagtgcacacacatacaacacactcaccacagcacactccttcttaaggctaccagctgcctgcatttcctgggcatcttcccaacttaagacacatcctagataaaaacattttcggagtctacaacactctttaacattttaaaattttctattacccagaaaatctccccaaagagagagagaagtgagggctgtgacattattacagagaagactataaacagaacaaatatagtgctgctttattacaaggcagtgtggggttggtggctggctgattacagggccactccccagagctctctgcagtcccagacctcaataaaggccagacttgagctgccttcaactgaggggcccccttcagattccagtccaggatgtgctatctgccttggttgaagataaggaggaaagcaaacacaatctaagaacaaccatgcttggcaaagagccacttgaccatcttctcaaaggcaaacacaattaagatggtttgggtttcttggaatcaatagattccaaactttggaaattaaaaaaaaaaaaacctagagagatcaagaactgatagacttaaaaacccatacacatcatagatagtgcagagtaagggggaggaatggattagaggacagaaagagaagcaacgcagcttgagtgactaaagcaacccatattacgcataaaatcatagaaggaaagagtgggaaatccacaagtcctctcttctgggctctgggcacacagcgtcccttcttgggtgactcacactgggatcaccttcacccctgcttcatgtggtaagggcctctttataaggagacacaccacgagccttctcctcctccacccctgcgagccagggcaattgcgtcactgacctccacacacactcactccctcctctttccagccggccaccacacaagggatcttgtcttgtggtccctgcgatcctttcatctgggctccaaacccactgtcaccttggccctgaatcactccccaggagacactgggaaaacagagctggacaaagagtgtctgggtcctgtatggctagaatttactgatccctgccggtgagagaacccaggctatgctcttctctgcccaaaggcagggcacaggagtaatttttaacttggccttgtggccagccctgcctacagactaggtgtccactgatttgggtgatacccagcccccaacagctaaaggataaaaagggctgagaggcagtcctaaaggttctagctcctctgccttacttgttccgtggctgaggaattgctagagttggaagagtgccagcaagtatccccccagttctgctctcatcccacttggctattctgttctgagggtagccccaaggaaaatattttggcagctgaaaatgtcactgtttcttagatccttctccaagatagaggattccctccaactgtgtcttagctcatttccatgtttcatggtcctaacatttttccttgaccttctgtgtaatgatattccactttgggactttgccatttttctgtaatttcagaacctgtggttcaatgggcagattttaggatgagttacaggaacgctatttactgagttttctcccttttcaaatatatttcattacaacaaagcctctaagatagcatgggataatggggaaaagctctgcactagaaagtcaaaggacaaggttctgttttctacctattacttgtgcaactcgaggccgttcaatttctctgagccaacccatcgtacctcctcatccttaagtggccctagtgggctttcaaaacaaacaaacaaatcctcaaaataataattatgtcaatttggtcttctttttatctgagtaggtgatcaatatatttgtgttgaactttacccaaggaagcctgctcattttaccaggcagttatgcgaatcaaatgaaatcaaaaaggcaaaagttctctgcagaattcatagtagtacaaacattcactgagtgtttacaatggatcagacaagttaaacaagacatcatatccctgcccttggggaacttaccacctagtaggaggagccagaaaaaccagtaattatagtacagtgttgatatggcctacgatagagcaaacagaatagcatataagaagggcaagtaaactgaactcagagggccagggagaattccctagaggaagtaacatattcactgaaatccaaacaatgaacaggagttacccaagtgaaaaggtggaagggggtttccagagggaacggcatgtgccaaggactagaggtaacagaatgacgggctctagcaactgatagcagttcactgtggcagaagtgtagatctaagaagcaaggtggagagtatggatggggttggggaggagggggttagtgtggcctagcagaagagtagcagacgaagctgaagatgtaagtagtggccagatcataagggccttaataatctttttaagaagtttggactttatcctaaggacagcaggaagccactgaacagttttaagcagggacacatgaccagatttacgttgatcagcaggttccatttggcttcttttactgattgtagatccctggggctagggaggtgtcaaaaagaaaagaaccagaggttcagacgtggcctacttcttttctttccatggaacccagcaggttcccactcccttcctcatgggactctccagtcctttaagtgcttagcttactttccagtcttccctctcagtcagtccccttactcctccctctttctctggcaaagaaaaaccttttatgatgtggcaagtcctttccaatcagctgtcctattgacctgggatattagcctcttttcttgaatattatcccctcaccagcaacctccaaagagggctgtcaagtaaccctgccagtaatccacatttctaatccaaggcccatttcttatctcttacttaaattccaccaactctgccaatatttacttttctcctcaatccaagatctctcaacctctaaaaacaatttggtggcctcctaacagaagaccaagatatgctgaccaaacaggtgatcaatctgaaaggcctcataagaaagaccttatatctagatgataatgataaactagcaaatgaactctatgaaaacattcattccttttctttcttccttatctcctcttaaactgcagtttaaggtttagaatcaatcccatacaggaaaatcatcatggtcattaattttatctcttggcattaccatttaaccttagaatcaaagaaccttggcactggaaaataaacctttagtccaatcttctacctcagtgtcagagctctttggtatgacttggcaattgagatcagattgctttttactgcctgaaatttcctgagaattccttttcctactcatccccactgaacaggtttagagcaagacctctatatccattaggaaatagctcaactcatcaggtcttaaggttctagaacaatgctattcaaagtatgatcagcaaactggtgagtgctggtctgtgaactctttgtaactagcccatgatgcggtaagtatagaaattgagtgtaagcattttaaaacttttaaagcaacttgacattaccaggacatcaaaacatgtattcagaggacttatctcaatgaacagcgtatcaaacagtttgagtactattgaacttgtatggtaagtcacatatggtacatgctgcatactagttaggcacattaagaccatatgtcagattactttgaaaagcactattctagaaagttttcagaagggaagaggataggtctggtggtaggggggctagctctcttctttttttcccccttctgggtacaatagatagtgaatctgctacctcggatgaggaacaggaagctgctcccaccaagccactgactgcatggggtgaagaggagggcaggagttggcggccaggttatcaggcaataacaaactcagcatccaagcacgcgacttccagcaatgcaaggagcttcctttgttttgggaaaacaagagctgcaagaagcctctccttgacacgttcttgcccggcctcaggagaagcccaaccacccctgacacacaaataggagagtcctggccaatgaccggccagccagaatcctgaccacaacccctgtttgcttttccttttccaccacttcctcagttcgagggccactgtggggccataggtagctgccagcctaggtcacccttcaagaacttcacccccaatgacccagtacctagtccatacaactcttccaatgcacttcctatagcctactttctatcccccatatggtttggtctaaaagcaaaggcttttggccccttccctagagttgtaggtaaaattaagtcttggaataccactctaacaaaggccatggtatgctgtaccaaactaaatccaagaagatcatcatctaaccaagtgcccaagaagaacaatatttgaggcttcaatagaatattctgagcaactatttttacctaaacagacttacttgattgcattagatcctcaacttcaagaatccagttatcatcaagactaaaatatgtaaaacagtgcacctatgcatgatgcagaatgtcaaaactaaacttccaaggagttagctaggaagtttagaaccaaagatcaaaaatccaacacctgggagcctagttcttggaggtataaacagagtaagagtctcaactctcagactcacatgaaggtgccatctaatctaagatgaaagactttgggacattttctccaagagctctgagaagtgggactagcaagtcccacctatgactttactctgataaatcaagaaccttggggaccagcaaaccttcctccctctctgattaatcaagggagcttactctttatcctgacggtccaagagcccaagtttctatgaagactaatttgtcctgtaaggggagggatgtcggggcgggactccccccactccaggcctccttcatgccaaagaaggaggaaacagaataagcaaaataaaattcataaagcgaagcagtaattatggtgtggtcaacaagaggctgctcctcaggcccatcattatgtggctaaatttaacgccctgcgcggccaggggagccgtgcgccccgggcaccgtgtgtccacacagacgccagctccgccaccttcacccgttcgacagccgccagggctgccagaaagcaggtcacaattttttttatagtctgtttaccaagatgctgtttttactgccgaggtttctctcattttatctctttttcccttttccccaaacagactagcctgtattttctgtcctgttttttttttctttctccctctctcagttctattttcagaactctaattttatatggtatgtcccttcttttttttttttttggtaaatatttgccataactaagccaggcacatccagtttaaaaggctccgtcccacaaaacatcaggcttttaatgatatgcatctcattagcgtgtcctatgaaagggggtatagaaaaaaaatgcaacttacagactttctcactttttatatctagagagacctatatttatatatgaggacaagctgaaaactgacattctgagccccaatacaaggctagtacaatggtcatttgattcaggctttgagacctcagaagcagtttcaggagagaggggctgtaatactgctggtcctcccaggtggttctgacaaggtaagtacagctagaaccagtcctcagacccagaggtattagggctctcaagatcagaggaacaaaactctgggaagtcctctgacacaaaatttccaaaaacggctgtaagaaaacagagcggtaaatagggcatcaatatttccctccttctctggctgataagttaaagaaaagaaagttatgagttacgagcgcttggagagatcctttccaagctagaacttccacatctcccatttactgtccaaaggcttctccagctgtgcaaagccccagaattgaagggaagatttttctgtacatgttaggttggatgaaatgggttgtatggttgagtccacttacggtactgaacaaaagacacagcatcaaataagcactctccaaataatagtctgtgatgtgcttttaaatccagtgtgaggctggttgcagtgcctcaggtgtgtaatcccagcattttgggaggctgaggcaggaggatcgcttgaggccaggagttcaagaccagcctgggaaaaacagtgagacccaggatctactaaaaataacaaaaacatcagctaggcatggtggtacatgcctattgtcccagctactcgggaggctgaggtgggaggatcacttgagcctggaacatcaagtctgcagtaagcaatgatcacaccactgcactccagcttgggcaacagagcgagactctgtctcaaaaagaaaaaaaacaaacaaactgcagcttgacattctaagatggtgttagaggagcccccagcattcagtgtttttgataagacatgttgggggagggaaatagatacatgaattgaaagaccctgcatggctgttcaggtagcacctcctggggactctatacattgcgggggtcaccaaaggtccagagtctctaactcagtttttattagttcatttagggatgttcagagtttagaagactggctgatgttaactaaaaattataagagactaatttcgaaattaaaatgccaatttattagtttacaaggtgaagtctagtccagttaccaaaatatcttcggctgctttttcctgggaagctgaataaatattgagagtgctacttgttaaacacaggaaaagggcaaaaatcggcaaatagcttcagggggtagtttacatacattgtgcaagctagatattcatcttgttctactgtatcactgttttggcattgtgctagataaattaataaatagttactccttggtttttctttttttggattctatacaactctgttcctctgttagtacatttcctcacacatcattaattaattacataaaagtttttctttaattgcttgtaagagtctagaggtgtacaagactaaaagtggcaagaaaggaatgtggaataagaaaagaggcagtacttggggcagagcgctctagctttgaaccattttcctatattttaagttaggtctctatactgctcacaaattggtctcaatcttgcctactgcccagaaaacttccaacaggtgtaacacgtggcaaggcaatctgacatgatggaagaatactggaccggaaggtcagagtcctgggctctggtgccaaattccacaattgtttgtctatgtagagttattttatccttatggaccccaatttccacataagtaaaagagagtggcttgatatagccttagactgataaagtcacttcaaaattccgtggctctaatctggacaaaatatttcagaggctataatttccttcattgagctactggcccaggcccttgagatttgtaatctagtttcatgagcaatgtatttataaactgttggatagattactcagtagatagctaatcttatccattttatattgattcttctttatatctcagtatgagaggttaccccaaatttagggggggatactctgcttaagacttgcatttcctatgtactcactaaactcagcaatttcgctatgctcttcccctagctgctgggggctgcagaaaacagaatgcagttgccatcaactattccttctttaaaccaagcagtattatcccatctcaaaatttatcttcattgttagctttacccatatcaaattagaaggggttctctggagtaaaagattctaagagagcaatccatagcatcagaattgctcaggcttcaagcataagattaacaaaagccaaagagcttttaaaggattccctcaaaccatcacacttcaggaaagccccttagattgtgtaactcagtgaaagatctagctgtgtcttttccttcagcagccactctccatacaatattcctctgaactcttacctcaagagtaacttcttccaaaaatacttttcccaaactggcctgctatgaaccccagatcccatccaaatgaatccatttcttcctcctctcaggtaccatatatataaatatattatgtatttagaatattctttgtagatatgtaaattccagcagtttaatctctatcaaaagtccattttttaagggcagaaaacatgttttaacttttcagtataattccatcaagtttcgtatcttcaacgggcttaataagtactgtccataaacagtttaaacttctaaatagaaaaacaaatagaccaaagatctcccacactgaatgaaaaaaattcttctgggaccttctggcaatttctcccttcataatttccttatggaagataacaaggatgtccgtgaatcctgcagtctcatttcctaaatactggacagctaagctgccaacctacaggactcagcctttatagatctctcacttttcaatgtggcccactatgcaaaagaaatatcacccgtaagtgaaggatataagagaacgctttgggtatatggttaaaattatgaagccaacagaccaggtaaaacttagaggtcagttgtttgatactttcttttctcctaatttctaaaaccagagacaacatgtcccaatgtgagagagtcctctcatgacacgacctttaaaaaggctacaaccaggtacctcctgtctacaaggccctgagatagagttagaagaagaaacaaaatgagcaagacagttctgctcttaagaactctgtaagctaacagggagagaagtatagcaattcttagaatacaaggcaaaagtgataagtgacacaggaaagagaaagcgttgagagttcagaagaggaaaataatatagcttgtgcttttactactgtccctttcactatttctgtcataacagaaaggtcattgtaaccatctgactctctttttaagtcagggaaattaaatgcccttggaaaagactttaaaaattattggatgaaaaggctgcatctcctgggggaaagaagctggaagtatgcagaaatctactaatctatcttcaaaatatcacccatcccttcatgacatccacaaatcccacagaaagaactaatccttccccttggctcaactccacaggtccctgcttccacaccattcctttcccttcatcggcataagtttttccttttccgctggtttctcctttgccttcaaacacatatgcatctttccatcttatttcgtttaaactacttctagctctccagctatctcatttatttccttctcattgtgaaacttctctggtgaagagttctacactcattgtctccattgccttatccattgatcgttctttaacagcctgctttcttctgatattgcccaagaccatgaattgcctaagggtctttcctctgtcagtcagttaccccttctctttggcctctctcctgcacatgactgtggccacccttggtgacggaaatagcacaggatttgagtcaagacaaatatgggtaaatcaacgggatggccttaggcaaattagttcaccactgagcctctacttctttatctttcaaatgaagatatcacctagctcataggtttgttgtaaggattaaattataacttagataaagcacctgtgtctagcacacacagagtatggactttatatttgttagttaccctttcttggctaatctactatgctattctgattatcttcctgtctcacatttccatcactggctattactccttccagttatgactattccccatatctcaatctttgggcctttgttcttttttccatactcttcccagctaaagatccatccattctcatggcatcaaatatcatttctttgtagaagattctcaaatctattttctgtagacccttttcttcgacctgagcttcaaccctagtttttcaactctttcctaggcattctcacttgtacgtcccataatcaatttaaattcaacatgtggccaggcgcggtggctcacgctggtaatcccagcactttgggaggctgaggtaggtggatcacgaggtcaggagttcgagaccagcctggccaacatggtgaaaccccgtctctactaaaaatacaaaaattagccgggtgtggtgtggtgggctcctgtaatcccagctactcgggatgctgaggcaggagaattgcttgaaaccagaaggcggaggttgcagtgagccgagatcgtgccattgcactccagccgggcaacaaaagtgaaactccgtctcaattaaaaaaaaaaaaaaaattcaacatgtatgtgaaaaaaatcttcatcttatgtttttaaattaactctaattataaataagccactgattttgtaaaaaataggctaaggcattgttaaattaccatactgtaacaaatggatttttatgaaacccttcttctactaggggaaagaggagggagactcaactgtgtaaatcttcacaaaaagctctggaggtacatgaagcttataggttaggcccaaaagggctaggtatttgtcagaagtaagacatcaaggccgggcacagtggctcacgcctgtaatcccagcactttgggaggccgaggtgggtggatcactcaaggtcaggagtttgagaccagcctggccaacacggtgaaaccttgtctctactaaaaatacaaaaaaattagccaggcgtggtggcaggtgcctgtaatcttagtaattcaggaggctgaggcaggagaattgcttgaacccaggaggcagaggttgcagtgagccgagatcaccccactgcactccagcctacaggacagagtgagattccgtctcaaaagtaaagaagtaagacatcaaacatcatcactgcctcacaaatcaaatctgaaccaaatggatttcttagactggagatttaaagcaagtaagtgtggctcatgcctgtaatcccagcactttgggaggctgtggcaggcaaattgcttgagcccaggagttcaagaccagccctcggctacatagtgagatcctgtctcttttagaaaacaaataaataaataaataaaccaaatgagagactaatggtggatttgatggagcaaaacagaggaaaaaatagttttcactttggcagagttggtaacttcctttgagtaaagtaagatatacaaccccctggagcgcagtctgttaaactgtgctagcctatccaggtctagatacagggacatgcatgatttcgttttccacaggcccctacaactctctgttgtcttctatccagcctgatatacatgtttatgtaatatgactggcccctgcagatatctgattttgtaatatctggttttgagattttttaggataagagaatttgagatatgggaaactcctttgctattgggattcttagaatcagaaacccaaaatggataatttttaccccctttgtattctttctttctttttctgagacagtgtctttctcataatgtattcccacttggtttctttttttttttttttttttagagacaaggtctcgctttgtcgctcaggctggagtgcagtgatgcaatcttggctgactgcaacctcagcctccagagttcaagtgattctcctgcctcagtctcccaagtagctgggatcacaagcctgtgccaccaagcccggctaatttttgtatttttagtagagatggagtttcgccatgttagccaggctggtctcgaactcctgacctctggtgatccacccacctcagcctcccaaactgttgggattataggcgtgagccaccacacgtagcccctacttggtttctttatttgtttgtttctttgagatggagtcttgctctgttgcccaggctggagtgcagtggcacaatctcggctcactgcaacctctgcctccgagattcaagcgattctcctgcttcagcctcctgagtagctgggattacaggcacccaccattgcacccagctagttttcttatctttagtagagatggggtttcgccatgttggccaggctgatctcaaactcccgacctcaactgatctgcccgcctcagcctcccaaagtgctgggattacagacctgagccaccgcacctggccccatttgtattttctatattgatttccttttttttctctctcaaaattttaacaatttttttaaaaaattactttaaaatttttaataaatttccttttgaaaacataagcccttataagcctttgcaaaaggaaaataaagaaagaggtctttttagctcttcttgagaaaaaaaaaaaaaaaaagaagtggtaacccctggttactacaggattcacagtgagaaaaccccaaagagaaggtgaaattcagaaaaaacaaaatatagttgagaaacatgcacagccataccttcctccctggagattttcattccagagctcaaatactggtacattcatattttcagtaaggaaaacaattcttttatatgcccacggttaaaccgaccccacccatgatcttcctagtctatcaatggcatcactattcttcaaatcacataagcatatgaccaagagcctaatattcctaaagatcaccttcatatgtcaattctccagtcaaaactttcaatggcttcccactatctgcaacagtaattaataagtgcaaggagaatgtgccccatctccctcctaggagatgtgtccccacttgagaatcacagcacataatgacagtcgttaacaattgaactaaatggagaaataaatgtgttacaggcaaaaaaaaaaaaaaaaaaaaaacaaaaaaaactgaaaaccaccttcagaataaaacactaatctgccagcccaacatttaaggcccccacaatttagcctcaagttattatcttgctaactttattttctactaatcctcatccattcttattcttattttccatcctttgcccaagtgcttcccacctaaaatgtcttccacatagttttcaatcaaagcctaaatcaaagcccagttcacgtcctgccatttatagaaagctttttctaatcactccactactatggcccttattatcattcactaagcactataagctctttgatggcaatattatcataccttatatgctcacagaacctcattcagcccgcatgcacctgaccgaataccgaaaggatgaattaactgcaagtttttctaggtcggagaactgacacacataataggagggagcatattctcatgcatctagacttatccttttttacgatgcccacatggacactaaaaaaaaaccaccctgaatcctatggctttctctacatattgaacaacaggtacatggtaaaagggtagcccttctaactgtggaagtggagcccttgtgactctaagactaattttctttccaggattttgttaggtacttattcttttgacttttgaggtgttagtctcttaactggctctaaaaaaagagaggttctgggatttctcaataataaaagattcaaggtttatatacacttcatcccgaagttgggactgcctttcagaaaacataaatgtcaaacaaataaggcaggtggtagaatgggaatataggctactcatctatttacatgtaaggctgcctatgtctaaggctaccaataggtgattatttgctggcctattcataagaggaggaaaataaaaaagagtgggaagatatgatttcttcttctattcaacaaacacttatagagtgcctactatgtgtggaggcactgttctaggcacttgggctagaccagtgcacaaaacatacatctttgtccttgttgagcttacattctaacagacaggagatagaccataaacagtaagtataataaaataagtaaattttatggcaatatgttggaaactaggtgctatagaaaaaataaaaagtagaggatggtaagatgaaatgggagtgctaaggtgcaggggggacaaatggagcttacaactttaaatgagtagtcagggtaaactctattgggaaggtaacatttgaaaaaagacattgttgtagtccatgtagatggatgtagtctatgtagatatgtctccaaattctttgacacagctccccttaagaggtgaagtttaattaattaccttccacttaagtgtgacccagacttagtgactcatttctaataaaaagaatacagtgagatagtgatagaatgtaacttctgaaattaggttataaaaggactgcaggtccatttggtcttggtttcgtttctcattttcttttctttttcttttttttttgagacagagtctcattctgttgcccaggctggagtgcagtggtgtgatctcagctcactgcaacctctgcctcccgggttcaagcaattctcccacctcagcctcctgagtagctgggattacaggtgcatgccaccatgtccagctaatttttgtatttttagtagagacgaagtttcaccatgttggccaggctggtcttgaactcttaacctcaggtgatctgcccgcctcagcctccaaaagtgctgggattacaggcatgagccaccccacctggccttggtctttgtctcttggatcactggctctggaggaaaccaggtcctgtgagtagccctatggacaggccacatagcaagaaatggcacctcctgccaacagccacatgagaaagcttggatatgaattatccggatgttacaatgactgcgttaccagctgacatattgactgcaacatcatgagagacactgagccagaatcacacccactaagctgctcccagattcctgaccctcagaaaccatgcaagataataaatgtgtttttggttttttggggttttttgtttttgtttttgttttctgagacagagtctcgctctttcgcccagactggagtgcagtggcacgatctcggctcactgcaagctctgagacctcccaggttcacgccattctcccgcctcagcctcccaagtagctaggactacaggcgcctgccaccacacccggctaattttttgtatttttattagagacagggtttcaccgtgttagccaggatggtcttgatttcctgacctcatgatccatctgccttggcctcccaaagtgctgcgattacaggcgtaagccaccgcacccagcctgttattttaagccattaaattttgggacaatttgttacacagcaatggataactaatacagactttaaggaagtgaggaagttggccacacaaatatctgaagaaagaacattccaggcagagggaacagccaatgtaaaggcctaaaggcagtgttagagtgttagaaaaacacttaagagtgttagaaaaacagcaagaggccagtgtggctgcagtggagtgaatgagggaggaagttgtaggagatgaggtcagaaaggtaagagagttctataagatcatatagggttttataggccatggtaaagtctttggattttactctataaatgaagtgttaagccagtgaagggctttgagcagaagaatatcacgatgtgccttgcaacttaataagatagctttgttgataataggccaggagggggtaggagtagctgcaggatacaaataaggaggcttttgccataatgcaggtaggagatgatggtggctccagtatggtagcagcagaggtgagattacgggcatagttttaaggtaaagccaacaggatttcctgatggactttggctgtaggaagtgagaggacagcagtcaggatgactccaaggttttttcacccaactaaaagtgaaagaatgaaccttccatcaacttagatgggagggggttgttggaaaagtaaatctgggcatacgactggaagttcaattttggacgtgttgaatttaagatattttttaaacttcttcatgaaaatgttaaacaagcagtctggagtttcagggtaagacctacagtgaagaataaatgtgagattcatccacaaggtggtatttaaagatgttatagtggaatgccagaggagcaggctgaagatgtcaaaaggatcaaatcataaatgatcacgtgtggcgtgcaaggagtttgaactttatcctgtaggaaaccgggagccactaaaggactctgagcaaaaagtgtcataatcaagtttcagtttcaaagacatcactctgacaaaactacaaattcaactgcaggggaataagaactgaccaggagacaagttaggaggctgttgcatggtcaagccaaaaaagggacagaaaggccaggaacagtggctcacacctgtaatcccaaaactttgggaggccaaggcaggtggatcacctgaggtcaggagttcaagaccagcctggccaacatggtgaaactccatctctacaaaaaatacaaaaattagctgggcgtggtggctcaagcctgtagtcccagctactcaggaggctggggcatgagaatctcttgaacccaggaggcagaggttacagtgagccgagattgtgccactgcactctagcctgggcaacagagtgagacttggtctcaaaaaaaaaaagcagggggggagtgggggaaaagggagagaaaaatggctaatttcagacaacgggaggtagaatagagaagataggcagattcaaaagacggtcaataaattaggctttgaaagtaaggacaaagaggaaagtgagtgactcccaaatttctagcttagaaaactgaatggatgatggtataattccccaagataaggaatataagagaaatagtctgggggagtagataattcattttggacatgtttaggatgtgctttatgtgggacatccaggtggaaatgccaaacatgcagaaagaaatatgggcctaaaacacagtggagatataaaattggtattcagcgatgtaccaacaatagttgacactggggtctagatgagatgacccagaggaaggaaagtgaagtctcagaggatcagggacctgatcctgggaaacactaacctttaagaggcaggcagaagacggagagccagccaaagaaaccaattagaagtgtgaacaagcttaacaagatggcaattttcaagttaaagcattgcccatcttccccaggcgatataagctctagcttcgtaagagcagcagtgactctcttcatagtttaaagtatctgctctagaatcaggctgcaaccagacaggagctgaagacagtaactaaaactaggcagaatataacaaccatggctgcacttaggatgctaagtcaaatcaatgttaactatagccccctaatttcttagctaaggtattatactgaacagattaagacttataaggcattcagaatgcagcagtaagaacgactgcagggaagagaagagaagagaagaggagagaagagtagagaattgcaaaatctccatctctgctaagggacccctaccaaaggaagccaacttcaagcaactgcccaggttttggtgtcaagggctgattcctagccaggggttgccagctgtagagggcggggctctattttgggctgcctgctgtccctgagcctggccgcgtctggtttgagcagcatgcagccccagtgactcacacacccatgcaaactgcctgtggctcagtggcatggccttggaatgccagccttaggccagctccctcctcaccccattacactgggataaataaataaagagcccgccagcagccacacagcctgatggcaaccagatggagagagcgaggcatggacagggccaggggaaggaactccctccagtggactagactgagagtgggctctgcccagtcatcctaaacttcctttttcatatagttcctactgccgtgtaacaacagtccctaagtccctgactcttctttcactcctaaagatgcctctcaacccccagtcctacaaaatgccctatatagggttcttggcctccatgaagatcatgccaacaggcatcccacccaggcttgacttgagtcaatattgtcagtatcaccctctagttaggccactatcaactggctccttgggttccccagaattgagaaatcagaggctcttagacagagtggaaaaacaaaaggaccaaatagggagaagtaacccctgttcaattcttattttcccgagccttagtatcctagccacctgcctggcctactgtcccctgtgccttattgtctatagcctcttgcctagtaataatcccaatgagaattttaaaaactgaccccaggcaatgaccgcatggccctctgacaccagccctggcccccctgcgccttcatcttgagctctctccctggtttgtttatcttcctattccatcttgcttattttgatggcacatcctttcagttcagtcttgggtgaccccatgacccttctgtgtcctgtttgtaggaccccgggcaagcagagtaactaaaaagatgcagtagtcataagaagttctacagccccagtaggaaacctttcagttccagcagctatacaggacattctgaggacagtgcaatgaccccagaggtcacaagaattccatattaccccagcccttatgtctcccctaacaggtgtgtacaaccagttaaactagcaaaacaaaacagggataatcctagactatgtgtcaagaaatgtgagaagtcctaaacataaagctacagctatatgaccttaggcaagtcacttaacctctctgaggctcaacttcttcatctataaaatagaaagctgtaactacaactacctatctctcacttcctttccagatataataaaattctacaagtctatgaggttgatccacccagaacctacaggaccagtattcttgaagtagctggttccaaaacactgatactcttcctgtgctgccacctaaattctgtatgctttctcattcaattccgcagggctcctcccaaccccatagtatgaaaacgatgagcctctaattttataaatgagaagtgatttatccaaagctgcaaaatgagccatgagaataactgaagaccccaaatataggtctaataagcaacactgagccaggtgcagtggctcacgcctgtaatctcagcactttgaaaggccaaggtgggcggaccacatgaggccaggcattcaaaaccagcctggccaacatggtaaaaccctgtctctactaaaactacaaaaattagccaggtgtggtggtgcatacctgtaatcccagctactcaggaggctgaggcacaagaatctcttgaacccgggaggcagagattacagtgagccgagatcaccccactgcactccagccaaaaaaaagcaacactgtatccacaggccacagtgtcataatctgtataaaatccccctagcatagacttatcaaaatattaatccaaacttattgaagacttactacctgtaggcaccacgcacagtgctggggatatagaaatgcattcagcatggtccttgcctcaaagagtccacagatcagtggaggagaaagccatagtcttgcaggcatacaaacagtaatattacaatgttataagtggtaaaacagaggtataatccaaggtactatagtagcagggaagaagaatagtctttacaagcagagtacagaacggtctcccaaacaaggtgaagctgacatctagaagattaatagaagtttgcaagttagataaggccagaacattggacattctagatcatgggaagaatgtgtatctaaagacaagatgaaacagcattggggcaaattaaaagtcattccatatagctaaggcataaagtacacagagaaaaatgtcaagaagtcaagctggagaggtatgcaggcactagatcaggaagagacctctctactgagctaagaacaagccttgcattgtttaactaaggggatgaggcagggaaccagcatgttatccccagccttgatacctaaacttatagacaggggaagctatctaagagaaaaacggcctaagaaatctctcttagtcacaagtttaggtttaacggtctctctttacccataaaaacttgaaaccttttctaggctaggcatggtggctcacatctataatcccagtactttgggaggtcaaggagggtggatcacttgaggccaggagttcaagaccagcctgatcaacatggcgaaaccccgtttctactaaaaatacaaaaattagctgggtgtggtggtgcgcacctgtaatcccagctacttggaaggctgaggcaggagaattgcttgaacctgggaaagggatgttgcagtgagccaagattgtgccatggcactccagtctgggtgacagagcaagtgaggcttcgtttcaaaaacaacaacaacaacaacaacaacaacaaaaagacttgaaaccttttctctttcaggacttagcaatacaagttttccttcttcttcagacttacaattgcttcagtacctggactgagcacctacctcacattttttgcttttagtgtttagaccccaagcattgtagctcagtcaatgcacagaggcagaacaggaggttccaaataaagaatacctgctttatgcctagccctttaaaaagtgctaatttagggttcaaaagaggtacgggacacagaccctgtccacaaagagcttacaaattaatctagaagacaataaagaaatacaaataatctatacataataccagattataatagcattatttacttacatgataaagtaccaacttgggtaacatatataattagaaaatggggcaataggccgggcgcagtggctcacacttgtaatcccagcactttgggaggccgaggtgggtggtcacctgaggtcgggagttccagaccagcctgaccaacatggagaaatcccatctctactaaaaatacaaaattagctgggtgtggtggcacatgcctgtaatcccagctactcaggaggttgaggcaggataatcgcttgaacccgggaggcggaggttgctgtgagccgagatcgcaccattgcactccagcctggacaacaagagtgaaactccatctcaaaaaaaaataaaaaaaaaaaaaagaaaatggggcaataatactaaggtactaactgtacaaccaacaagtcacagaagagggagggaaggagaagatcaatattgactggcattatcaaaggtcactattattaatactttccctatttggcatttaatagatgtttcttttggctgagctcaatccttagaagggaaacctaggcaggagcttctgacaggccacaattatctactccccattcattcctttgccagtccccttgtataaacactgtgattttccacaacctactgtgcccacaagacagcccccaaatggtagccctaagctttttaccttcctctcctgcaggatcctgaaagggcctagacaagtaatgacgcctacccttctcctccacagtccagaccttacgaccagatctcaacaagcaaaaatttaataactggtcaaccaacctttccaaggttagagaattccaaatgaaatccctggtactttaacagagatgttttataaatatcaatcagtccacttccgcctcttacgttctttccccgttttttccctcatcttccctaagtacatctcaagccttatcagactttctatgggcaactttttcagacaaagggcattccaaccacacaagccacctaacacccaaaacacaaatggccactcaggcacctggaaagaggaagtagggcaaagacacacaagaaaatgacaaataccttacctctatcataaattgttccaagaaggaattttcttcaaatggttctgtcttcaatcgatctgtaataagaaggatcagaaaaaagaaatatgagtcatacaggatgagtttcttacctgatggaaagggaacagaacagggctacttaggaaagaggaggaaggtgcatcatgcagagacacctagttcagtgggagaagaagggctgagagcatgtgggcaaaaagtagtgggagagggtgattagcaataaatggcaggtttggtggcagcatctgctctaggagtttttcctgccacaaaaacaaaggccaaattgaatttttattctgaagttggagccatgaagcttcctaaactcccaagtccatgttgctctggtacaattctgtatagctattggctcctttccaaagtctttccctgccattgcctagggcatgtctggactcggttacagcttctattggccacttgggctccagccaggtactcgaggcagagaaaagtgtcacctaggccaggcacggtggctcacgcctgtaatcccagcactttgggaggccaaggcaggcagatcacttgaggtcaggagttcgagaccagcctgaccaacatggtgaaaccccgtctatattaaaaatacaaaaaaattagccaggcatggtggcgtgcgtctacaatcccagctactcgggaggctgaggcaggagactcgcttgagcccacgaggcggaagttgcagtgagctgagatcataccactacactccagcctagctgacagagcgagactccgtctccaaaacaaacaaacaaaaaagagtcacctaatatcaagactccagtttctggttagtattcagcacccatcctgggggaggcacttctctaatgcaaatgagtctccctctttgctaagaccctttgactatttttaacacgccccacccaactcctccaagaatgtcctcttacctcgaatcagcgtagccccactctcctggtagtcttggatctctaggtctttcatatgaagtaacgttgctagctccctcacttggcactgtaatgccagactcatgcccatcagaggacgaatcaaatgttgggagacctttgagggaagagatatcaattagccaaaagactcttataaagtactttccaattcagtattaggtaccagaaaaaataccgaaaaataaatgttcttacagaaacttatagtttcataggcaagtaacccatttacatgaatgtaaacacaaatacaataattaaatatattaagaaggtggctggtgcagtggctaacgtctgtaatcccaacactttggaaggccagggcgggtgggtcacttgaggtcaggagtttgacacaagcacggccaacatggccaaaccctatctctactaaaaatacaaaaattaactgggcttggtggcagaagcttgtaatcccagccactcgagaggctgaggcacaagaattgtttgaacccaggaggcagaggttgcagtgagccaagattgcaccactgcattctagcctgggtgacagagtgagactctttctcaaaaacaagatcccaccagctgagatggctcatgcctgtaatcccagcactctgggaggccgaggtaggaactcacttaagcccaggagttcaagagcagcctgacaaacatagtgagaccccatctctaccaaaaaaaaattttttaacattagccaggcacagtagcatgcatctgtaatcccaactactcgggaggctgaggtggaaggatcacttgagccaaggaggtcaaggcttcagtgagctgtgatcatgccactgcattccagcctgggcaacagagcaagactgcatctcaaaacaacaagaagaaaacaaacaaacaaatgagaaaagctgaagatccaagtagccctcaagaaaataagtgtggcaaaaacagagtacactagctaaagtgtaacagaagacaaaaatcaacagaaggtaaagacccttgaagatcaaattagatccagacactaagagccatttcagggctcatgatagcccagaaggaccctggagtttcaatctgttcccacaaatgcagcatagtctaaggttattgttataatagaagcaagccagctaccaagaactagcctaggaaggtataagccaacgcactctacacacaacccccccttttttttttttgagaaggagtttcgctcatgttgcccaggctacagtacagtagcacgatctcagctcactacaacctccacctcccaggttcaagcgattctcctgcctcaccctcccgagtagctgagattacaggcatgcaccacgatgcccggctaatttttgtatttttagtagagacggggtttcaccatgttggtcaggctggtcttgaactcctgacctcaggtgatctgcctgcctcggcctcccaaagtgctgggattacaggcgtgagccaccgtgcccagcccacacaccccatttttaacaagaggtaagaagaatgcaaacgcagccatactgccgtacaaatagggtgatactctcatatgataatgtatagctatatagaataatcatttaattcacctacacaaggtgtccattaacctgtcaaaaaaaataactaggccggctcatgcctgtaatcccagcattttgggaggccaacgttggaggattgcttgagtccaagagttcgagtccagcctgggaaacgtgatgaaacccagtctctacaaaaaatacaaaaattagccaggcatggtggcacatgcctgtaatcccagctactcgggagactgaggcacaagaatcgcttgaatccgggaggcagaggttgcggtgagccaagatcatgccattacactccagcctgggtgacagaacaagatcctgtctcaaaataaaataaaataaaataattcaaattaataatctatctgtgactaagggaagttatcagacttcctttccctttccttaaggagatgaactaaagaaggcactaaaaagaagaaatgccctagatcagaggtcagcaaactttttctataaagggccagatagttaacatttttggctttgtggcctatccagtccctgttgcaactactggactctcctgttgtagcacaaaagcagccacagacaatatgtaaacaaatcaagtggctgtgttccaaccgagctttacaaaaacaggcagcaagccagaattggcccatggccatagtatgccaacccctgtcctagacctgaaaaaggagtacttttagacaagataccccaacaggcttgaaatgaggaaaaggtactagagtatcccataacatgtgcaagccagactcatctggatccagattagacgtctggactctttcagacctttgtgttttcattttccattcattttctaggtaaaatttactactaaaagttctaattgtgctttggctcaaattaagaggaaaagacttttttccacatttctgctagattagaaaagactggatgtggggaggtgggaagaaaggaagttagtggcggcagcttttgtaccaaaaccaaggactaagaaatggaagggttctggcacagaggggaaagccagaaataaagtccagctatagatactagagtcttccttctaccacacagcacatcccaacctggcactgactcccaattgaggtccttagcaaaaacttaaccctctaggaagtactgttcagaatgtggcagaagttcagctttggaaaaatttatctgctctacactcgatcttctttcctaggaattgttttgttaaatttggtcctgctgggcgggcatggtggctcacgcctataatcccagcattttgggaggccaaggcaggcggatcgcttgagcttaggagtttgagaccagcctgggcaacatggtgaaacctcatctctactaaaaatacaaaaaattggccggacgcagtggctcacacctgtaatcccagcactgtgggaggccgaggcaagtggatcacctgaggtcaggagttcaagatcagcctggccaacacggtgaaaccccgtctctactaaaaatacaaaaattagctgggcatggtggcgggtgcctgtaattccagctactcgggaggctgagacagaagaatcgcctgaacccaggaggcggagggtgcagtgagccgagactgcgccattgcactccagcctgggtaacagggtgagactccatctcaaaaaaaaacagaaaaaaaaaaattagccaggtgtgctaaagcatgcctatattttcagctacttgggaggctgaggtgggagaactgcttgagcccaggaggtggacgttgcagtgggctgagattgcaccactacactccagactaggtgacagagtgagaccttatctcaaaaaaaaaaaaaaaaaaaaaaagtttggtactgtttaaggtagatcaggaggaaaacaggcaaatacttgtataaatgacagtgaatatttgatgagttgaattgaaataattgtcattactacccaagcagcaacaccatccaattggcggcagcactgaaacaacagaaactcctaaattaataaccagcttccctctggatggctacctcaatagcaatttcctcgagtgacagtaaatattgtataaaaacatgaaacatgacaaggaacagcttttaattaatgtcatgtctaattaaatatgataatgccacatcaggcaactgaaattatctatcagaccccaatgtctatttggtttaaagaaagtttttttatcagtaaatattgtaactgctaaaataatttcataggattgggttacagcattttgaattattgaggtataattcatttcaaagttagatgaacaccaaaatgatttctcttagaccagatagccttaaattaatgctcagtagaaattttgaaaatatgtgttaatgggcatatgagagactagataaaatgtgtaaaaaagtcccagcactttgggaagctgaggtgggcagatgacccgaagccaggaatgcaagatcagcctggccaacatggtgaaaccctgtctctactaaaaacacaaaaaattagccggacatggtggcacgcacctgtagtcccagctactcaggagactgaggcacaagaatcacttgaacctgagaagcagaggctgcagtgagccgagatcatgccactgcactccagcctgggtgacagagagagactccatctcaaataacaataataataataataatgtgtaaatagttcaaagcaaatccacagacactataaggaaaaatcttgaagggctttaggatgtcagggacactccccgtaatttatagacagcaatatatgaagatatacagttcatcagtcaattcaacagatatctactgggttcctaatatgtactctgaccctatgaggcctctgccatcaaagagcttacaacagttaaggaggttaggaagtgtaatagatatacaaacaggagttgctaatctttttccgaggaaaagctatttataattttctccaaagtcttcagattttccacagaaatgttcataagtcatgagcaggggagcagaatgataggtctcaatctcaagatgaatcaagctggaggctaaagcgggagaatcacttaggcccaggagttcaagatcagcctgggcaacatagtaagacccccatctcataaacaaacaaacaaataaacaaaaaagatcaagatgaatcatatcaggagatccagtgaaggctggagcacagtagcacaatcacagcttactgcagccttgaactcctgggctcaagtgattctcccacttcagccttccaagtagctaggactacaggcacatgccaccacacccacctattttttttatttttttatttttttgtagctatgggtttcactgtgttgcccaggctggtcccaaactcctggtctcaagcaatcctcctgtcttgacctcccaaactggtgggactacaggcatgagccatcatccccgggatctctttcatttatttatttatttttatttatttatttatttatttatttatttattttgagagagtctcgctgtagccaggctggagtgcaatggcgcaatctcagctcactgcaacctccacctcccgggttcaagcaattctcttacctcagcctcctgagcagctgagattacaggcatgcaccaccatgcccggctaatttttgtatttttagtagagatagggtttcgctatgttggccaggctggtctcgaactcctgacctcaggtgatccgcccgcctcggcctcccaaagtgttaggattacaggtgtgagccactgtgcctggccccagcatctcttttaaaacgaaaagttatggagttgaaatatttgccctcacaggtccactataatgctaaacataagtaatattacatatgttcttttatttaatccttacgactagacagtaaggttgtggttgatttattttacagatgaagaaactgaatcataaaaattcagtacttatccaaattaatacaagtagtctcaaagaggtggagttgagttacaaattcgagtctgctggttccaaaacctatctctttcttacactaagaaacctttggatatagctcctaggaatcataaaatgtccaaagatatcacaaatctgaaagctaaaatgtggaatatcaagaattatattagatattagaaagaacagacaacaggaaagagtaagagatgaagtctgtcctaaatgaagatggactcagtgttagaacccagagacctggggccaagcacggaggcttacgcctataattccaactctttgggaagccaaagtgagaggatcacttgagctgaggaattcaagaccaacctgggcactatgatgagacttcatctcaaaagaaaaagaaagaaaagggggggggggtggagagagagagagagagcaagcaagcaaacagagacccaaaacccaatatattccataatacccttgcagacttagaaaccattagcttgttaatgtgagtatgttatgctggagaagtatgaggaacaggtattctcctctttcctgtacagctggaaggagttaagctgcataatgtctctgaaagacaatttggcattatgttatgtggcaagattaaaagatacaaatattccttgacccagccattccacttatgggaatttactcacacatttacatgcaggaaaagtaaatacaaggatagtaactgtatacaacaacaaaagacttaggtgtctactgacagcagatcaattaaatatatgatacattcattaaatacaatgctatgttgcaattaaaaaacacaaaggcaggtcctctgaatgtgttgatatgaataatctctaagttcttttttttaaggctcatcaagtgaagcagtgggtaagttctacaattaagtgaaaaaaggaaggtactaaacagtgcgtacagcatgatactatttgtcaaaaaatacacatatacatagatatatatttggtcgtatgaagatatatatacagtatatacatatatagctttaagaattcacaagaagctgatattggtagttgctttgcaaaaggaaaaggagggactagggaacggggtagaaagatctattttttcactgtatacacttaaatgctgtttgaaatgtttgcctttttcaagaattactcattcaaaaaaattaaatgaaaacgatcacaagaatgagttacaaacaaaaattatgactgtgtgaccttacagacatacacacaagcctgaaatagtatccacctacatccttacccgtgtccactggctctaactttttccatataaagctctctcaggttcaggcgtttccctaggagggcattcttcttttaatgatgagtattttattttaacttaaagcacaattgttcatgaattgctcaaatctaatttcttcctatggcaaaccaagactcatcccttcctaaacactgttgtctctttcctttaatgtagttccccaattagagaaatttgcctagaatagctagtttttctttacatacttttatattatattgtattatatatattatataatatataatacattatattataccattacatattatattaatatagattaatataacatataatatatgttaatatattatatattattatattacatatatttatatattaatctataatatagatatactatataattgtaatatcattatattagtgttccttactgtattcttttgaaagaagaaactattagagcccatcagcctccaaggagaactgtctccacaatcacactacatattccgcatttctaggtccatgtaatgcaaaatgagattagctattgctagggattcccaaaggccgcccaaatggtttggtcccagaacaaacattattgaggaaacactgccccctggtgttacttagaaagttgaaatgttttaaacgaaataaagtatgggatggggccaggctcctgcttgtaatcccaacaccttgggaggccaaggcaggaggattgcttgaggtgaggaattcgagaccaccctggtcaacacagagagaccccccatctctacaaaaaattttttttaattttatttatttttttaattttattttttaaatttattaaattttatttatgtatttttatttgcaagatggaaaagttcacaagaaattaatttaaaataaacaaatgtgagtatatgctaagtactgttgatagaccttagaagttaataaatgaataagtaattctctcagcactcagttctagttttactgggctccagatcaaaaataaacatcagggccgggcgcagtggctcacgcctctaatcccagcactttgggaggccgaggtgagcggatcacgaggtcaggaaatcgagaccatcctggctaacacgatgaaaccctgtctctactaaaaaatacaacaaaaattagccgggcgtggtggtgtgcgcctgtagtcccagctacggggggcgctgaggcaggagaatggcatgaacccaggaggcggagcttgtagtgagctgagatcacgccactgcactccagcctgggcgagagcgagactccgtctcaaaaaaaaacaaaaaaaaataaaattaaaataaaaataagcatcaggccgggtgcggtggctcacacctgtaatcccagcactttgggaggccgaggtgggtggatcacgaggtcaggagatcgagaccatcctggctaacacagtgaaacctgtctctactaaaaaatagaaaaaattagccgggcatggtggcaggcacctgtagtctcagctactcaggaggctgaggcaggagagtggcatgaacccgggaggcggagcttgcagtgagctgagatcacaccactgcactcaaacctgggcgacagagtgaaactccgtctcaaaaaaaataaataaaataaaataaaataaacatcagcaaacaatttctcaagaagtctttctatccagtcatctattgatgccaaagcatcacatcccctgtgggaaactaaagaagagagaaaaaaatgatgtcctcttgtcttcagatccctctgctaacaatctatacttttaggcttcccaaagaagaccctgtcccctaagtgctactgactaaaactgtgtctgttattccagaaaactagtctttaacgtccactcttaatttctaataaaatctcctgggaaatataaagctatgagtgagtagaggatattatccccctagtctctgaaaatgaggctttggaccagactaatctgggattcaaattccaactcatttattcataagctgatggctttggacaagttattttcaatctcagtattctactctgaaaaacaaggataacagtacttatcctgaaggagagttgtgaggattaaatgatgagataatgtttagaaaggtatctaacactggtacatattctattctgttgccagaataatcttgataaaccacgaattggatcatgttaaattcctgtttaaagtttttcagtgaatcctgttgcctttgagataaaatccaaactcattagaatccttcaagatccactgcctccctcatttctcatgccttcctatctacacagcagtcatgaagttcccgaacttgctcctcacttacacatctctacatctcttgcctacaatgatttttctatttattttctcctactcatcttcaaaacttagctcagtaacagtctcttcaaagaggttttctccaatcctcaaccatccagggtctacctcaaagaacctatcatactttatcataatttcctgtttgtctgtcttctcactagattatgaactccaggaagaggctatattgttttaggtctggataaccaacaattagcccattgtagatgcttttaaaatgctgaataaattaattaatgaataaagacactcagtactctgctccttttgcaaggaaaggatttaacagtcaagaatcctttttgccttctgtttagtcaaggaaagttttctgattggagaagaatttcaaacaaggtttgcaaaaaaaataaaagcacctaaagcttcctctcaaagcaactggcatccctcccccaaccccacattcgaattacacttaccagggaaggactagctagcatgcagtggaaattccaatagaaggggaggccagagagctcacttcgcacccgtagaatcagtgcatctgccacacaatcacaggagaaggtagcttcgctagggtgagcagcgtccttcaacaatgggcgaaggagattatccaaatgacagaggaaagctgcaggaggagcagtgagccgcttgttcagctcctaaagagagagcagtggtacagagtaagggtgctaaaaggaaactaattccctcataagtaacagcaaaggaaagccctggttaacacgaaggcaatggacatgagaggaaggggagagaagataaaaacatcacaaggggaaagaagaaaacaaaaagaagagagtcacaaagaccaattggcctacttcacaattctgccttgggcaagattaaatcacaaaaggcctatctagatcaaataatatattcattatcatgcatagggtagggaaactaactttctttctctctctctctctctctcacacacacacacacacacacacacacacacacacacacacacacacaaagattccaggcagaagtacaggtagaagtacaggacattaactggaattgtctcaacccgattcaaccttccttgggaaactacaggccagcaagctggttgatgttcacatccccgacacagcagtacttctcctcatacttaccttggctcgctggctgaccacactagtgtccacctgttcatgccacacctgttgaagatctgaaaccaacaaggcatagccctgcttggtgataaaaaccttggccaagagggagttctctgcaagctgtagccacgcccatggctgcatcaacaggccttgctccagttcttccatctgcaaaaaagtcctcatttagtaaagagcctcagggtcatgctggcctagggagggcaccacccaaaccagtctgtatcaactaaaatctcatgaaaatcctccctgataaaatagaaggcatggatttacgttctcccagtatacaaccagctgagcactgactttactacctcctggccactaaaagtatatttaaaatcttgagggttttttttttcccatattacattcctagaggacagaaaatctttcttccatagtgtttaaacctcagcatattgctgttagtatttctgctttctaatactataacataacgtggaaacctaaacccttcttgttccatctttatcacattcctaataaatatgtcactcctatcctttcccagaactagaagagaaggaatagttcttgtcttataaaacatcataagtcatagtgtcagggccaggaaattcgaagtatttgatcattatctaaaaacaaagtttaggaagctctcaggatttttttaaaaatccctaaaacaggttcttaatctagagtcaatgcatgtgaatcctctagaattatatgaaaatgttatgtgtacacgcatatatgcatggggagggggaagaggtctacagctatcatcaaactctcagggatcgatgacacaaaaaagagctaagaacctgtgtccaggagcaacagaaaagacctaaatttcatttcaacaaaaaccagaatgactaggaaatcatgaatacaaggcagagcacatcacagaggtaaagactgaattaacttccacttaactcatcctccacattcccactccagtgcactgccaccaatgacaacatgcccagcctggaacccctgcaaaacaacttttctatctcagcagctaaagtagtaggcttaacctagtagacaatcagaactacggctgcttgacagagaatgtgattgtttttcctgtgggggagaaaaaaatatgtcaatttccttcattattccagtctacaaatataaaatgaacagaagtaccaggaaggaaaaatttagaatgtaaataatgaaattccttattaagtctgattaacacagtcatttcccctagcttttgaagtgtgcccttgtgacttgtgacataactttatatatatatgcatatatatatgcatatatatatatgcatatatatatgcatatatatatgcatatatatatgcatatatatatatgcatatatatacatatacgtggtgatctttctttatggcatcctcaaagccttgtgtttggaggatggtgtttccgtcacatttcccacatgctgctcttatggggacagaagtggtcatgggatgattaagctagtcctagccggacaagagctccacaatgccaaaggtcacaaacgcgaataaagtcgccactttcatctcccttataggcactccccagtgtactcttaacagttgccaaaattgggtttactattctagcccattccttcggaaagcccggaagctcagaaccctcaaattgatgggttttgtttgtctgttgggtaaagggggaggagtttaaaatgtggccaggagtaacgggccctataaaaaggcctgacacattgggcaccagaccccggctgcctgctcccaccacacgcgtcccgttctgcgtccgaagcttctacacttcatccttttcttttttccttcaaggctgcctctaacattcacattaacgagattcacgggtttatttctcttgagtggaggggcgctgagcggcatcccggcggaggggtcccttgagaacctttatctgcaccgagtccgctcctcagcagtgacccctctgggcagttcctccgacgccctgcagagggcagtagaggcccagagagcatcccggctgggccccgcccggtccccctgggacagcgcgaaccctaggtcccaccacaaccatagccccaccccaggagccgccaggcgtcccgcttccacccgccccagctataacagccttcgctgtccgccttcccatttctacagcactggctgcactggggcgcggcttcaaggggcaacaaagccggccaccagcggcttcgtcgcaccaaacaggcgaccaacgagtaccttcactcgagccctaccatccacgccgggcagcagccagcggactgcgcacgcgcggccccgcccacccctcccccggaggcctgccctggaccccggcagcgcgcgctccctccagggagaaaaggccagcgccagggccaacccgcagcgtctgagcagcccctcgctggcttgctcctgcccggactcgaacgcgattccacctaccgtcagcggccgcgagagcgcccactctcttagccgcacgcacgctttcctgcccgctcgcgcaaaccgaaaggcctagagtaagaggccgctttccccccaccgcaagaggaggcagggtcttgggatacaggggcggggcctat

SEQ ID NO: 136 - DNA, 12356 bp, Homo Sapiens
ctacaacgtctgacactcggtgctgaaaggaaatcgggcgcggtgtcttgcccacagcttggggagcggccccgggcgcaataactgtcaccggcgccgagatgcggttccggcgcttagggcgccgctaaactcagagcccgggagtcatggctgcgggcggtgccgccccaggtaaatcagtccaggagcagggcccgggcctggcgtacactctcggaaaaatgggggccagagcaaacaagaagagcgaaagcaagagggctaggcagccagaggcggcagcaagactcaagacgccaacggcgccgtcttcctggggccccagggcctgcgccatccctgggctgccggggcaccgcctctccacgcccctcgtccggcggcggctgcgactgcttccgaggtcatgttcccaggacgggcgcgtcttcagggtggaagcctggcgcacgtccggaggtgccgaggacccaaccagcccaaactctgggggaaatgactcccctctgccctcgccccgcgctctgctaccatttccttacgtctctgcttcgctcagcgatgcaaaacgcgcgaggcgcacggcagagggccgaagccgcggtactctccgggccaggcccgcccctcggccgcgccgcgcagcacgggattccccggccgctgtccagcgctggccgcctgagccaaggctgccgcggagccagtacagtcggggccgctggctggaagggcgagcttcctaaggcggggggaagcccggcgccggggccgggtaggaaaggcgggggaggggctccggccgtctggaaggaatccacgcggcttgaggctgtgggggaagtagggtggcgagcggtccttctgcgcgcggggggcggggggggtggggtggtccattagggtcccctggcgagggggcggctttctagtgtgtgagggcgacgccctagaagctccccttcaaagttggccccacgcgctgaatgtggaaagttgactgggacccagtagtttcccatcccaaacctgctttccgagaagggcttcaaacccaaaatgtgaatcccgcctcccctctcagccagaactgtggactcgtcccggggaggggcggtgggtggggcggggctggcgggaaatttcggttttggcgcgctccctgcggcgacgctcatcgtgcgctctcctcttcccccggtggtctcctcgctcgccttctggctctgccatgccctgctctgaagagacacccgccatttcacccagtaagcgggcccggcctgcggaggtgggcggcatgcagctccgctttgcccggctctccgagcacgccacggcccccacccggggctccgcgcgcgccgcgggctacgacctgtacaggtgagcggggacctgccggcgaggaggctgggaagggccggccgtccgctgccacagctagaaacagtcaccggagagatcacaggaacacactagctataaataggatttctgcctttttcgtgtttaaaattttagctttcatctttggcataaattaaatagagatttgggcaaagactgcagaataagtaaaatagctatacggtgtctagcaaggcgttactttgcaacgtttattgtgcccttcctaaatagaagatagagaggaaggcccatggtggctttcgagtggcccgagggtgatgctgtgctcaatagaaaaaccaaggtgagagcctagatgtgagcgtgaaaatacctaagaaggatgaacgaagatgcatctgccttaaaaagttattttctatacattcatccggcccagggcggaatttgagaaggcatctgaaaacgaaaggcagagctgcctgtaatctaccacactttcatctctacagcacgttttacctgtactaaaaactttccgtatgctgttgtatttagtcctcacaacaatccttaactagataagtgttactttttacacaggcaggagtttgtgaagagctgaattgatttccccagaggcttgaagatgatataattttttatcccgaattttgggctttttttttttcatctgactactgtgcccagttcttagaaccattaaggtaggagaaaagtaatgctgagagggaaggagattttatactaaatcccaagcattgggatttattttaaagtatctcagataattcaaacatgagaactattagtctaagcacaggagaagagaaagtagtgcctgatgatagcaacagaaaaaaaaggaaaaggaaagtaggtatggacaattgtagctggaaaaactacagtctcttaattttgatgaataaaagtagagtgatatagtttgactagacctttccaaagtatattttggagcactttcttgagtcctaggggagtccttgatttaagataccttaagtagactcctaataaacacaggtgactttctgtatactgaaattgacatggaaataatggatcagcaataaattagggcttaactgtttaaagagggatttcagtgaaagaaggggtagtactgctttaccagagttaattaaggtctccaaagtaaacttccggttctgctcattgtaaaatctcttaaatttctacccaggagagggccacagtaatatcaagagtagcagcatttgctatgtggactttagaggaattctgttcctaagcaaggtccatctccaggggccgttcacggtgatcagctgtctccctcagccaggaaattcatagcctaagcttggtaaactaccaagccctgcctgacagatacaacacagttctttatctcttattttgtccacccgtttttctcctttccttctgcatattttccctaatcacacagatcattgtgagaataaaatgggttaatatatgtaaaccaattagaactgttcctggcacacagtaaaggcttaatcaatgatagctagtattattagtagtatttggccttttttctttgttctttcttcatttttttccttttcaaactatggttgtaaagcatccaccttttgaaagtttgcctttctgccctttcacgctgataagtacctcagtttccaataaacttttgttcaggggcaaacatttacaatgttgacatctcttcacaccaccaaaaatattcatggagaattattttatctaaagctgtctttttaataataaaatagccacctctaccttcttcataaacttttaagatgaattggtaattcatcatagcaaggttgattttagaaactaaagttgcattaattcattaaatacactgaaagtaattttgtatgcttggtcacaaagaaaatataaaaacaattttataaatagatttgcagttattttctttcaatattttcttagtgcctatgattacacaataccacctatggagaaagctgttgtgaaaacggacattcagatagcgctcccttctgggtgttatggaagagtgggtaagtcatttaagaaacaggtaactatttgtcaagttctcctttgtgatagattcttcatgtttcatttggggtaataagcaggcaatattgcttgggctgtgtcctaaaagaagcaccatttgtgatagcaaatgcactctttgaaaggctttatttacatctctgctttgcctctttttgacccttttatttttctccttcctcactggagcttttaggctcacactggcctagaaggctgttctcagaacatggcattttatattatgagagtaaaacttctgacctgttggtcccagaatgtgtaagcctacttaaccttttcttgtttggccatggggttagggtaagggatactcttcagtgttgtagaggcactgggaggagctaggacaaaatggagtacacgtcaacaggtttgatttttctggagcggatcagttgttaccagacagttctttgcaagagcgtaagttctttttgactaacttcagagtaaacataaaggaggcaatggagctgtgacgccctcctccagggaaaggagctagactggcactatattattagccatgagtgaggaaactgccagtacttcagcccttaaaagataacaagatgggctctcatctcatctcttgagcatcattgactccattttttagaattttttcaggggaaggggcaggagatggagtgaaataaaggttagtacagaaagaggcagcattattgacaaagtgcctgatttaaattattctaaaataaaatgctggaagttaggataattaattataggcctgatgcttgagtctgcaataataaggtgtaaccttagctttttatttttttcattttttaggattaaaaagtatactagcattgaatcattgagacttagtttttggcatttttacttaactgatattagcccatttatcttactctggttcatgtgtttcctacaggcatgtcttttggcatctgaatcatgaatagtggggtcccaagttgtaggctatggtctgctactatttggttaggtttgtttccctctcccttcctcttcctttcccttcccatctgcattgtacatgttgtggtgtcccatcttaaaaccaaagtcttcttcctcagtagtgtgttcctgctggccatacttctctttcttcccctttgaggcttaacttcttgaaagagcagcctacagttgttcccgcttgctcacctttcagctcattctagcagtccttctcccctgtctgcagcaccacaaattctgactgaagtcacatgggagtggtttaagttagttttgaattaaaaccttgtggaatttttctaaactagtctttccaactttggtaatgcagtatgatgaatatatattctttaattcaaaaccatgtgctaaagttaagatgaagatatagatattataggtgaagagaatgacatgcttaaattgcatcagttatctctgatatagcccttcccccttaaaataaccaatgtctccttttttgttttttagctccacggtcaggcttggctgcaaaacactttattgatgtaggaggtaatatatttccttttttattctgtaaatgtttgcaagtatttactttgtctttaaaaggtaatattcaaatgacagattttatttttaagaaaagaaaatgattagaggaaagcttgttataataggaggaaaagctttgtggttattttaagtaattatattttgtttaactactaacttaatttttaaaataatgattacctaattaataatgacagatttaatgatataataattaagtaattatttaagcaacaaaagttctagaaaacacaggtctatcttgtaagaattttcttcataagagagctatctgtctttagcaaaatttaagaagaaaatctttccctgaagtcaggagagaaaacacttttctctaaatttgttaagacagtcctctgtgttacctgtttcccttataataaagcctttctcatgtttgtctcaaagttaaccctacctcatgtggtacctttcatgaagaaccctcagtgtcctctgctaactactcttgatacagagctactcctcttattgtaaggaaatttctactttcctgatgtggtttccttgtttcaggtccgctccaactgggattcagaccccacttatgtggtccttacatactgaccctttatcccatcagtagtgaatctttcacttaacaagataccttggcccccacataagtaggtgtgctagatctcctcctccacccgtttttacagagctgctttatggaggcttgttaacagatcaggaaaactggcttagaaatgagcccacatggatatgtggtaaaaactggagtctctgtgtgattccagcctccttgttctttccactgcaattaattgtggagattaccctgctgcatccccctcaccaactaaacacgtccagaattagctcacttttatgtgccactgcaagggctaactaagcacttaatgaaacctggctatcctagacctgccccttagtctaacatttggtgggtgtggtgtctctccatagtgtcaccaggtggtgctgtgggacaagacaggaccccaaaagtacaccctttagggactaaaggggagctgagttttacatagcagggtggacattgacagcccactcttgggttgaggattccttgggctctgtaagttatgcccgatgttcaaaaatgcttttacaaggtcaactgtggtcattttgggacagtaacttaaggatataaataattgtatatattttcaatgaagtttcaaatgattgttcaaggaacgggagctttggaataacaactggatgtaggtcccagctctgtcattaactagttattacttaacctttctgagcctgtttcctcattttacaatggaaattagtgtgcctgcctctagaggtaggaggattaaatgataatgtgtatgaaatacctaatatagtacttggcacatattagattctgtgagatataatttctgtccttagggacttcacagattgtttttatgtggaaactttttcttttattcgactttgttactaatttttgctctgtttaaaacaactttctggaaaaaaattcatgtaaaagaatggaaagttagtttgcctagtggttggtatggtgttattcataaaatcacattgtggtgtgttcttggatgcagagaatcttaacaatctcccttaggcacaagtttatcatagttggcaacagtttttatttctgaagagagatgttgttagaaatcccaggctctaaataagggtcaaagggaaaagttgagcattcaggattctgttcagaattcacatctggtaggtgtggatagtttttcactaaaaaaggtttccaacaaatgacatgccaaactcttgacacagtaaaacttttgcctgaagtcagttaatcactctgccagttccaatgcatgatttttccagtgataacttcaagttactttctgctttctctgaggagaaatatccctgatacttatatcctgtaggcagagaaggcttttcttggaggtcgaatggcaattgggtggtaaatgaatttggaactactgaaatttttataccgtcaacattcatgcaaaaaaaaaaactattgagggcctttttttctgccatacatttgaattgacttcaaacttcttaatttcttttagtcacttaaaggtttttcacattttcgtggcccaagcataaagatcacctatctgcaggattcaagacacccaatcatttgagtagttctgataggactgctttacagatacgttagcagaggcctttcaaaaagggagtgtttttgtatgttagaagatactataaagccaacaagcaaatatttgcaacttatatgaaaaagaacaaatgagaaaaaaacatacacaaaatatagacaaggacatgcaaatgtccaacaaatgggaggaaaaaaatccagcctcactagtcatcagggaatgaaaagtaaggcaatgagatagccattttgtactcatcatattggccagaatgtaagagattgttgccatcaaatattggcaaggattttggaaatgggcattctcaaatattgctgatggaagtttgagtggctacaccttttttgcaacctatttgatgaaaataaaaagcattcatatacaaggatatacttaaagggctgcttcatttattatagcaaaatgtaaaagcagcctgtgtctgatattatgcaagagaatagttacatagaaacaatggtacaggttgggcgttgtggctcatgcctgtaatcccagcactttgggaggctgagacaggcagattgcttgagcccaggagtttgaggcttatttgagcaacatagggatactttctctctacaagaaatacaaaaattagccaggtgtggtggtgcctttgtacctggaggctgaggtgggagaatcacttgaggttgaggctatagtgagttgtgatcataccactatactcctgcctgggctataagagtgagaccctgccaaaaaaagaaagagaaggagagagagaacccatatttccatatcttgtatctaaaaagaatggctaacatttacatatattaatctcaaaggataaaaagaaaaaaataaagtagtatgtaagatatatttctgtaacattagctatctcagggagggtaagagaatattataagcttttactttatatgtatttgtattgttttagttatttaaaaatttttgaataaagtagaaacaatagttcagaagtcagtccatgtctttctctaactcattcaagatagatgaattattagcttgtacctcaaaatctcccagcatggaagttctctagcctactgtggccattttttctagcatggaacaacatgctatgttgagggatttcttcattaaatctaatttaaattgtccctgcagtcaaaattttttccatatagataatatggaaaacagctggtttcatctttatatcaaattttttcataaatattaaggtgtaaattaatggtcaactgacggtggagaaataaagcagggtttggtattggaattggtcaagttcaataatggattgtttccttcaggcccgacaggagatgaactgcctttgctgcttttctgcccagttttatactcactcttctcgtaaaagtgttgcatcaggaaccttttaagaagtgcttaaattcagattcacttgtccctagtaattcattcataaagcacaggggttcatttaaacgtatgttgtaatccattcggaaaatctaaaatgttgtttttgctgaatatttttccccgtggtggacctaagggtttgcttttttccccccattatatgagaaaattgaaaggatatgcttaggaattacccttgttcttaaaaaatggggggtgggtatgctttggggtttttttgtctgttttctcagctttcaaataatgaggagtatgggcaaatagcattactgcccattgagctgaacacaggattatttttatttccatattttttccttcatcagggcttttgtttggggtagagtattaataacaagtaagatgtgacatggagctgtcttcagttagattcacgtgagtcttatccagcctttcacaaactgaggagaaagaattaacgtgtatagcaggaaattgggggtgggaggaggaaggggagtgactgctaataaggtaggggatttttggagggagggtaatgtaaatgtgctataattgactgtgacgatagttggccaactctgatacactatgaactgtggaattgtaacacttcaaatggataaattgtatgctttgtgaattatttatcaatataaaaaaatgaaaaggcccggtgcacctgtattatctgtgcttgtgcttatggaaatattttaaattattggctcaaagataaatgctagcaagtctggtaagtataactctctgggctatgtcagggacctggctcaagtctcccctgcaaagatcttctccccctgtgttcataatcttaaacaagtattaattacacaaaaaaagttgtactcatgaagcctatgtgctacagtcttctgagaaaccatgctctaagaaaggatggtggttcagattaaaaggagaggaagattatgaactgaaaaatacagcttcatttttagtgtaaaaatggaatattctaatatttgcaagactgctgcttaacaatgtcagcgttgatttactccactgcagagctttaggctttttgacatttttatttatgactcaatcgtatttcaatctgggtattagcgggaagctgataccaggaaaaacctttaaaacccaaatcgtaattttctcctagtctttttggcaagtgtgccgtgggtagacagtaggttggagatggccattgctactgccagcttaaaataggaaatggtcgccatttgataaagagtgacaggttggaaaattaggacctgttttctaaatttttatttgtattttagtaatgtcatttcttggttttgaggctttacatagtaccagggcaagattcacttattcaattgtaagaatacaaatctcagagctacatgataatgattttgagataatcttacacctctagtattccaatagcaaaaattgagataatattacttttcttttctctagctggtgtcatagatgaagattatagaggaaatgttggtgttgtactgtttaattttggcaaagaaaagtttgaaggtatgttaaatatatacattcacataattttagtgaattttcagagtcatgtatgtgtaaattaatattgactcctttaattctcattgaataagacaggatatggcgaatgtgtcagtaacgtcagtaataaactattctttctttgaagtcaaaaaaggtgatcgaattgcacagctcatttgcgaacggattttttatccagaaatagaagaagttcaagtaagtattacaaaggaagatacagaataagtaatataacatcttaagtgaagaaatatatataatcttgagaatttaatatgctgtttgtaactaaatagtatatatgactaaacttattttaagcaaatttaaaatactagttttagaatttctttaaatgtttttcatgtagctattatgtagtattactttggataataagttatttaaacatactgtgaacttctaatattttattagaattttttaaagttatccagtattctaatttatggagctttttagaatttaattttctttctgtaatctcccttttgaaaagatgatatagcaagagtagaattctggctgtatttttcttaggagctggagaggaaaactgaaagaggctcttaaaaaaaactgtgaagcttactacctttctatctttcaggccttggatgacaccgaaaggggttcaggaggttttggttccactggaaagaattaaaatttatgccaagaacagaaaacaagaagtcatacctttttcttaaaaaaaaaaaaaaagtttttgcttcaagtgttttggtgttttgcacttctgtaaacttactagctttaccttctaaaagtactgcattttttacttttttttatgatcaaggaaaagatcattaaaaaaaaacacaaagaagtttttctttgtgtttggatcaaaaagaaactttgtttttccgcaattgaaggttgtatgtaaatctgctttgtggtgacctgatgtaaacagtgtcttcttaaaatcaaatgtaaatcaattacagattaaaaaaaaaagcctgtatttaactcatatgatctcccttcagcaacttattttgctttaattgctttaaatcttaagcaatattttttattcagtaaacaaattctttcacaaggtacaaaatcttgcataagctgaactaaaataaaaatgaaaaggagagattaaaggtattccttgttcttcccttctcttcactagtctaaaaacttctttttaatcttaagattctttgtgatgagggtgagaaaaagaatcctcagtttatttttccactattaatctttcttttgataaatcctctattgactgggtagaggtatgtttgtgaaagacatgtaacttggggatttgttactttaggtttgttcccttgaatttcatctcatcaggcaaattgtactagttgtagttacgagttttccctcagtgaagtagcaataggctgtaatcaagaaaatatgccatttatagagataagataaatgaaataatacttcagccaccaggtttttctgtctcacatacataagcagcatttcattgcagatatgggactgattctgtggcttaccttgattaacatcttttggaagttttgctagtgtgctttcctttctttactatgtttctcagattcctttgtatcagggttttgggtgtcacttaggttttgtccatcagattctgtgagacaccaggcatcgttttgaggatgtgggttatacacatggagtgcttctggaactatcagcccacttgaccacccagtttgtggaagcacaggcaagagtgttcttttctggtgattctccaggccatttaataccctgcaatgtaattgtccctctgtggctcacatttcattagtgagccatgaaatcaactcagtgggacatagccagcatttttgcataccaggttgggctataaaatatttctgttgtcaataaattttaaatgttttcctgctaaactaa

SEQ ID NO: 137 - DNA, 34618 bp, Homo Sapiens
agtaagtatatacattcctttattagggtagcccttgcacttataaagaaaccttcctcaaaaaggaaatgtacaaaatgatgaagataccatagtttatttcaacatactaagccaaaaaaataagaaaacaactaatttatttgaaaaaaaaacaaattctgtacatgcaggcttggcttgattgaccataatgtatttcagcaaaaaaaatttagatacaccacacataataaagctttctatgtacacagtaaatagtaaataactttgctaaatggccagacatttgaaaaaatgaaaacacagttgtaaaacaaagtatgtaagaatattgtgaccttatttaactgtacaaaaagcaatcattctctccagccttccatcttcacttacatttttttaaacaagattaagccccaaattgaagggattaaatcctttcttcctaatgcctcgggaatatgagattctctttcaaatctttaactttttacaaaggagcagagcacttaaagggaaatggtgggaaacaaagagatttcaattctgtgccattcatccagattctgctggggaagatttcccaagtccactaccaattcactcaacttggtttaaaaacataatacctgattgtaggattaatttggcttttatttagcccatctgcagctttatcattaaaaatcagctcctgacattagcccttagttcagtatctacaaatgaaatttgggaattctatgacagtgatgttagcatatttaaatgtaaaatgcaaaatgattaatttttaaatatgcaaactgctacattttctcaataatcaattcatgcacaaataaaaaatggcaatagaaaaagcagaaaaatatggatgtttctaaatgagacaatgagacaattataaaaatttcatgtattaatatcaagacaaggctggggccagcttagttgtaagaaaaactattattgtatataattggacagcaaaacccagtcctgtctaaaagcaatggatcaaactgtcttctcaagtccttcctggccatatttctatgtgatacaatgaaacatttttaataaatgcaatctatcatagaactgcaagtttttatattcctaatgaacttaactttattatagcaatgatttaaatacatgtactgtaaaaaagagaaaacagttgtaaacacactcttaatttttttctttatctgcaagataatatttttaaaagattacacaacttcttgattctttaagaactaagaaccaaagtattgaacataataaataaatgtgcaacctggaggcctggaaaaagagatagaataccaaataacaaaccagtgcattaaaaatccagtatgtcagtattaagacttcttcatccaaatccagttaggtttattgctattataaataagcttcacattaaggcatctgtcattacctatgaaaaagatttggattcaaaacaaaggaatatacactgtacaattttttttctttcattctgatgtcattacagatattatcagttttaaatgttaagtttttgtatggcaatatataaatatctttaaacatattacctgaatacagttcaaatgtctctctatattttgatactttaatatatatatttaaagtatattcaattaatgaggaaatagacaaaagcaaatcaacatagatggtaaaggactaaatctgagacattacaacctctaaaaaaaaatactgtacagacagtgacgatgagcagatcttggccaagtcatttaacttccctgagcctcattctttccatctgtaatatttcaataacagttgctctgtcaagctgttttgagatcaaatgagatgatgtaaaaacacttggcaaactgaagcaatgcaaaaattaatggtattatcataggccaaaagatctcaagtttctgacagtgtatctaacaaataaagttatggcctgctccttttgcattcacttgagaactcccagttttgattagattgttatggaaagaatggagccaaaatttatgcaaagagaaaatctctaagttttagcatccagaattgtataaagtacagtttgttgggaatgggaaacaactgcttgaaggggtatacagaataccaaataataatgtattaaaaattcagtatttcagtattaagacttcttcatccaaagacaggtctaactctaactaggctcaggctacctcttgatacttactaaaaataaataggggcagacttctcaaaaaccttggttcccggcctttcatcagactcttctagagaaacctccttttccctcaccattggctatcatgttgcatagtcacattaaaagaactatctcttataacagctcaagagttttaaaaccataaagaaacacagcctaagtcaattgctggtacactattcaggctggtataaatttgaaatgattcaataatccctaccatgttctccctttctcagtccataagcccttcctctatgtataaatggttctcggccagctttttccaatctttgttctgaggaacactagctgggtgagatgttaacaggtaaaaaacatctgtgttaagtatgttgggaatatgcagggcgagataaatttatgtaccactgaactgctcagtctttgatgtactgactgtacttgctaaagaagaatgaagtgttcagcatttcccaaactcatctgaccacagaatcccctttttcccccaaaaaaatatctagaggagctaatagctcttagaatattctttggaaaatgctattctagcctgattctaaacattccagagctaaatctggcaatagttatgtttttaatttctgaagaagaatcatttttcttataaggtcaactaccatgataacctcctggtttccactccataagtaggcttcccaaagcaactaacaactaaattttcttcactacatactaaggaattcaaagaacttattcttgcgtgaatgagaattatgttctttttaaggagatacttatattcttcccctaagcattaaaaatacaaagatctaattctagatcctaggacctagaatcacaattattttaaggaaatgagagtattttattacaacatcattgcaattaatattatcaatgaatgataattagtagtggtgctaacagtagtagtgttggttaagcatttatttttgcatcctaatcctaatatccactctatgaatttaggacctactattactcccattttaaagataagtacaccgaggtttaccaagattaactgacttgccaagggtcacacactggagtaagggcagaaccttagactcatgtctgacccctcgccccatgctcttaaccacataatgccatcttttatttcagtgacaagacaaaagcatttaggtcacactcttgttgttaaacaggaaaattatataaatgcaaattgtttagaataggttttggatttccttttgagcaaacccccagtcctttaaaggatatacttaaaattttttttaagcagaggaaaatagactactatttaccaatgacaagtttatagagttttaaaacgagaggttttttaaaaatctgcatccaaggtgaagacgttatctgtggtttctgccataactgcaaaacgctgatactctgaaactcgtttctcaaagaaatttgtttttccttctaaagaaatgttttccataaaatcaaaaggattttctgcctgaaaaacctaaaaaggaaagaaatattattagacattctgaagagatcaaattacatccacaataagagcaaagatgaccaaaacagaggtcaggtttctcaaaacctatctagtcagctacaagatcatatcattcccctaagaccctggaggtactcaaggctgacaaattttaagatgacccaagatcaaccactaatctcctcaagaaactgtactagcatctctggtattctaataaatagaaaaaaaaacacaactatttcaggaattgaaatatttaatactaaccaatagaaaatgttctcacagcttgagatatccaatacaccatgagcatttttcatagatattactattagtcagacatacatgatactataaaatgttaaattagcaacaatccactgtggttctaagtatgtttcttagtttataagagaacagataatcaacaaattgtcattaagggaacatgatcagggaagacagaataaatgttatccatagtgactagatgtctccaaacaaaaagggggactatgctaacaagaagcttttttactgcttcagaattcaagaaacaaggccgagcatggtggctcatgcctgtaatctcagcactttgggaggccgaggtaggtgggatcacctgaagtcaggagtttgagaccagcctgactgacatggtgaaaccctgtctctactaaaagtacaaaaattagctgggcgtggtagcagatgcctgtaatccaagctactcaagaggctgaggcaggagaattgcttgaacctgagaggcagaggttgcagtgagccaagatcatgccattgcactgtagcctgggcaacagagtaagactccatttcaaaaaaaaaagaattcaagaagcagacttggagatacagcttgatggaaactgtgggatatttcagtgattcacaaggagtaacaaaagaggatttctcaatttaggagtatcccagcaaaaaatatgaacactacagataaacatatattcaagtaacccaattttaaatatgggcagagtgtctaaatagacaaactgatacttctttaaagaagatatacaaaatgaaaagatgctcagcatccttatccattagagacatgcaaatcaagatcacaatgagataccacttcccacctactcggatggctataattttttaaaaaacaggtaataagtgttggtgcggatgtggagaaattagaaccctcatacagggtgggaatataaaattgtgcagctgctttagaaaacagtctggtagttcttctaatgattaaacatggagttaccatatgatccagcaatttcactcctaggtgtatacttaagagatatgaaaacatgtccacacaaaaatgtgtaaatgaacgttcatagtagcattattcacaatagatcaaaagaggaaacaacttaaatgtccatcgaatggataaataaaatttggtatatccatacagtggaatattatttatttggtcatataaaggaataaagcactgatacatgctacaacatgaatgcaccatgaaaacacactaaggaaagaagagaaccacaaaaggccacatattatatgattccatttgtatgaaatagaatatgcagaataggcaaatctacagacgcagaataggcaaatctacagacacaaaaattagattagtggttgcctaaggcaaggtgggtaaggggaggaaagaggagtgactgactgctaatagggatacagtttctttatggggtgataaaaatgttctaaaataggttgttatgatggttgtacaactctgtgactacactaaaaactattgaattgtacattttaaatgggtgaattgcatgctatgtgacttaatctttaaataaagctttaaatatttatgtatcttttttccaaaaactcatatgctgggtgtggctgagtgaaattctatgaaattctccatcagaaattgtgtgtaaaaagtgagggaatattggagctgtaatatacagcaagatacagtgaaagggcactgaaccaatagccatagactcactagatgttagaactgaagacttttcaaaaaattagatctaagtcattcatggcatggacaaagtaaccaagaccaaaaaaacaaactaaattaagtggcttgtttttggtgggttttttttttgacacagagtttcggtctttttgcccaggctggagtgcaatggcacaatctcggctcactgcaacctctgcctcctgggttcaagcgattctctcgcctcagcctcccgagtagctaggattacaggcacccaccaccatgcccagctaattgttgtatttttagtagagacagggtttcaccatgttggccaggctggtcttgaactcctgacctcaggtgatccacctgcctcagcttcccaaaattttgggattacaggcatgagccactgtgcccagccttattattatttttatttgtagagatagggtcttgctatattgctgaaactagtgtggaactcctggggtcgagcaatcctcctgccttggcctccgaagtgctgggattataggagtcagccacaaggcccagctcctacaagttttgatacatagtaatcatattgtcatttactttatattttcaattaatttttattttcattttaaatctcattttaaaggagatacatgtatatgcagagagagagagagagagagcgagagagaaagggtctcactctgttgctcaggctggagtgccgtggcacaatctcagctcactgcaacctctgcctcccaggctcaagtgatcctcccagctcagcttcccaagtaactgggactacaggcatgccaccaggcctggctaattttttgtaggatttcgccatgttgcctaggctggtctcaaactcctagactcaagtgattcttccacctcagcctcccagagttctgggattagaggtgtgagccaccgcacctggcctaacggatatatttttaatctctaagtagattaagctttttggcaatttttaaatcagtttctactttcattgcattaaaaatctaaggcctctataatttctgctttttagaatttactcagatattttgaagcctgtggaaaaacaaagttttacattgtgtttagaccttctcctgcaggaggtggcatgttttacatacctacagttagcaagttcccaaaaggaaaattagacccaagggtcagcagttttctaataagcagcagaacatgaacgtgtggatgtgaggatatggtaatgggttaaagaatagcgaattcactgtaaggcttaaataagcaaattcattttctaataacaaaaatattggtaaaagttatgaacaaacacaatttcttttaatatacatagtttataagtttaagagattatattaatatagttataatcttgatttctcattaattagtaaacacagagaggatcttgcaactaaaatgttaaaatgtagtttatcttaccaaaaaaacctacgccccacttgactttttcattaagtacctgggtggttatcagaatataattctgctatatctgctaatacaacattagcaagataggtaatgattaccacagcatcatagatttcataaggattctcattaaagataatttgaacttacattttcatgacaagaaatcaaaatctgtatttctaattaccatggtatagtacatagtgaatttctgtgtttcacttaagtacaaagtgaccatctagtgtgagtttattatgtgtctaatattattttaagtgctttaagtgtatcaactcatcaacaatcctttgtagtaaatattattactatctctaatttatagatgaggaaactgagatagttaagcaacctgccaaaggtcacacagctagaaagtggtggaaccaggattcaaacccagatagtgtggctgcaggctccatgtcttaagtaatgggaaaaccgcactgatgaaattcaggtacattatctctgataaatgacaaaaataacttgaataactctgttcaaagagttatattgtgacagttaatgtcttcctaataactattccctatttaaaagtattaactcccaaaccacaatatagacacatggcgatttatatgagggtgaatatatatatgcatattaaacctaactccttgaaaataatcctattaaatatacagctacaattattgcaaaataatttattgagcttattagttctaatattttaccagcctcctacttcagttattaattttaaatttcaaaggattttgcaaaaccttgttcatacaaaacaagtctctgtcattgacatttaaaaaatagaatagtatgttacaaatgctttcagtaaattatactttagggtccttgctttcctataatattttaactagtagtaacacatttttaaacacattacctttgagaatccaagttccacaagtaatctgtcagctacaaactcaatgtactgtttcatcaaaatgcaattcattccaatgaggccaactggcaaggcttctgttaaaaactcctgggatgaaaacaaaaacagaataaagtacaaacaaaactataaatatgtattttccaaatagaaagaggactttcgttttatttctaagactgattttgtccaaggaaagtatattaggataaattctttcaatgtggcaaatgatgtccgtatatttaaaaacatttggggtattaactattcacattttttcatgttttcgaagagccaaaataaatggaaacgaactaccaaattactggatttcttgaagtagcagatataagactcggattcgtatgctttctcaatagaaaaaaaagatactttgttctaaaatatctggaaaaagattcaaagatgatcatcatgaagaacatgactatggaagggagctgggaaagaaagaaaaactcaattaacaaagaaaatgagaaaaaagaaacaaacagatttgggggttgggagataaaatagctccaaccatactgaaagactatatagtggtaaagcgttaatagaggaaaaataaaaatatattaaccacttggatttagttctcaaaatgattaaagataccaaagtacctgttatgcctttttcctctttcaatatacaaactacgcctgttaaactacgcagtgttaccaaaacaaaagcaatttcagaatgataaaaacacatcctaagtagcgcatctagctctttctagtaagaaatccgtacataccctaacttaattgttacttttcattaacttacttattcattctataaaaatttgtgtatgcttcaagctaggtaccttgctacgttattaaaaatacaaaacaaataaaaaatcatcactgttctccagtcactaaaaatgtaaaaaaaaaagctactataattagctgatcatggcataaaatttgacagagatcaataagacagaaaaatagccctgaaacaggttttagtatacataaaaccttaatatataataaagactgacttactaaagcaaattgtaaactgacataataattgtaatatatcatgtattggtattgtcaggctgaccagaataaaattgctggtatttttattgacctacagaatttcttatgagtcaatataatagtggtacaaacatcagagaaagagagatgtgctaattacacaaacttcccggtttacctgctcaattttgacagcatcaacaatgatctccctgaccctttcttctgaaggcttatttactaagtattggaacatcaggcaagcaaagtcacagtgaagtccctaaaagggaagaaaaatgtcattgtcaaataacttttaatcagctatttgcatatggtgatgggtcaagcattgtataaagtggttctaggaatataacacagaacttctggaaaatggaagaggggttaataggactaggaacttccttctttcaaatctcattaaatgccaatacaataacctataataaaaattttcaatgccagcaaatcttagttcatcaacattatagaaaaattaatttatgaacaaacaaaatctgcaaataaaagcattttggaaaggaaaataaagcaagaaagcctgaaatgaaaattcattaatttttaaatttcaaaaataattaaggaatgattgaaaaataattagtatttaaataacagatgaaactcagatttcaaaaatacatttataattaaataagaaaggctcaagataaaaatgaattcagttctaatgaaaatggaaactgaggtggggctcggtggctcatgcctgtaatctcagcactttgggaggtcaaggtgggcagactgcttgagtccaggagttcaagaccagcctgggcaacatggcaaaacccaatctctacaaaaaaaaataaaaaataaataaataaataaataaatagaagtaaataaaaaataccaataaataaataagaaaatggaaactgaacaatgatgaatatcgcctgaagccatacaaagcagatatgatcttacagataactcaaccaaaaatgaaaataaacttgtgaaatacccgagtatggttatacaaatgcaatagaatcttaagtaattggagaataggtgaaggagagtcaacctacaataatcaggactccaaaacacagaatagatagtatagagctaaatattaaaaaaaaaaaaaaaaaaaaaaagaaaatttcaaaaattcaacatgaaaaaagagagaggtcggatatagaaagatggaattcccaggctgggcatggtggctcatgtctgtaatacagcactttgggaggctaaggtgggcagattccttgagttcaggaattcgagaccagcctgggcaacctggcaaaaccccatctctgcaaaaaatacaaaaattagtcaggcatggtgcacacctgtagtcccagctactcaggaggctgaagcaggaagattgcttgaacctgggaggtcaaggctgcagtgagctgagatcacgccactgcactccagcctgggtgacagtgagactgtttcaaaaaaaaaaaaggaagaaagaagaaattaccatcaaggctgaaagatgttaaagtgttgatgaaaactgacaggtaacttattacagaaagcaataccaatcaaaatcccaatggaattggtgtgtgtgtgtttgtaatttattttaaaaggctttagagcagaaaagaaagaaaagtacacttcaaagagtcccaagcgggcacagaggtcaagtacctaaatgggattgtttttaattcaaaagttaatctggaaggctgggcacgggggctcatgcctgtaatcccagcactttgggaggccaagttgggaaatcacttgaacccaggagttccagaccagcctgggcaacacagtgagaccctgcgtctacaaaacttttttaattaactggatgtggtggtacatgcatgtagttccagctacttaaggaggctgaggtgggaggactgcttgagcccaggaggtcaaagctacagtgagccaggatcataccacttgcactcagcctgggtgacagagaaagaccctgtctcaaaaaaaaaaaaaaaaaaaaaagaatagaataaacggacagaatcttgtaagaacactttcaaaagaaaagtttcgatatttatcctacaaattattaaaatatatgaaactataataattaaaatggtttgttatagaataaaatctgataggtcaataaggaagtaaaaatagccatgaaaccgattttagtctaataaaaccttaatagataataaagaagacagcgcaagtcaatgaagaaaggatgatggattacttaacaaggcaaattggaaaaacttcccaagagtgtttaaaataaaattaaattctaacttattctttattatatttatgctaaatcctactttacaaattccaattgcattacagacttaaaggttaaaaaaccaagaaaaaaaatgtgtaattaatttatctctggaagtggattacataaaatttaaggttttgtatgttaaaagaacaaaaattaaaaagcaaaggataaattgggaaaatatgtgaaataaatataagcaaatttgtattttatattatatttgtgctataaatataacaaatgctataaaggtgtacttgttgaaaggacccaatcagtcactgtacattgggaataaaccaatgaacaagcaagcatgaccccttcctttaagtataatagactactgaagaaataaccttaaaatagtgagagcactcagagttaaataacaaaaatgttaatattgcaccagtaataaaggcaaaagataaaagtaggcaactacagaaaaaatacaaatcactaatatcattatgaaaaaagtgttcaatctaagtaataattaaacaatgcaaataaaaccaataatgagataccaattaaccctatcaaatttgccaaacatttagcaaattaatctaaattctggtgagagtatggtagaaaatgttcatacattgctagatggggctgaaaattgttataaaattactggaaaaaaaatctgcaagtaagtatgtatgaatgctttataacttagtaattctactttttgtgatcaagcttaggaaaataatataaagggaggacaaagcttatatatatgtaaaggtattcattttatactatagtaaaacaaaaaacctggaaataatctaaatttctaattataaaagtcaaataaatgattcattcattagattatacatttaacaaaactactattttcaaaaggtgcttaatgccacagaaaaatgattgcagtattttgccaagtggaaaaagaacatctcaactcctaaatatatgaatgattaaaatatgtttatatatctaaatagaattaaatgtagaaaaaaagtctataaagaaatacttcaacaaaacagtaaatgtagttctctctgtgttgagattaattttttattctctcaattctctataacaatcctatatgacatttctaataaaagttattaaaaatttaaagccatgaaaaagcaaaaagtaattatatgaagcattttatggcatttaaaaaaatactttcacatacactatttcattgcattctaacaaaacggttaagttttatagttgaagaaaccaaggttcagagaagttaaggattagtgtaggcaataaatgttaactgaatggctataatagccaaaacattgagaacagaaagataaataaaacaaagtccctgcactaaggagcttaaagtctagcagaagagagaaagaagaagtacaatacatgctatggactccaagacatggacaggttcaggtttcaaatggatacataaaggaaagagtggccagtttcacctaattgatcaggaaagttttgagatgtctcttctgagaaggtaatccaaaaaggtttaaaaaaaaaaaaaggggtggtaagaaagatggaaagggtagaaagggtatagcaggcagagggagaccaggcttacttactgatcggatgtggctgaaaaagaagaagcaatctaaaatgattcctaaatttaaattagatgattggaaaagaaggatagagacactcaatgaaataggaaaaacagaaggaacaacaaatttttggagaaagatgatgagtttgatttctgaaataacaggtttgagatacctgggggaacttaaaggagaaaatgtctaacatgcactagcatacatgggtttggcacttaggaaagaatatctgggacaaagggtaggttttcggagttatgagcatttagatggtagctgattccattacagtaaacaagatcagccaggagggcatatatagtgaaggagcaaggccagtgcgggaacctaggaggacactgatattaagaatgaccaggagaccgaggagaaatggtaagagacacaggaggaaaatgcagtgtcttaaaagcaagatgacgtgacttcctattttaattaccaggatactcatgtcaccacagcatttttcaggagaaagaaaaataaataggctgggtacagtaattcatgcctgtaatcccagcactttggaaggctgaggcaggcagatcgcttgaggccaggagttcaagaccagcctgggcaacgtggtgaagccctgtctctaaaaaaactaaagataccaaaattaggccaggtgtagtggtatatgcctgctgtcccagcaacaatggaggctgagatgggaggaatgcttgagcccagggaagtcgaggctgcagcaagccatgatcgtgccactgtatgccagcctgggtgacagagtgagatcctgtctcaaaaaaaaaaaaaaaaagatggaaaagaaaaatagatgaacatcaaatatgaatacaaatataactagaaaaacattccattccttacttcatctctgctgatgagttcattggaaaaagtgagtcctggcataagacctctcttctttagccagaatatagcagcaaaagatcctgagaagaaaactccttctacagcagcaaaggccaccactctttcccctgggagacataaaatcgtttcaatttttgaaatatactgcaaacatttgcatatatatatatacacatatataacaataaataccacaactgtttgcaaagaaacaaaatacacaagttagtgccatggccaaagatctccataggagaaaatgcgccacctctacctactggagcagaaaggtatgcctccttcaaatcctctgtcagacgatggacttctgtaggtcttggcgttggacaaagaaggaccttccatactcaaaacaagaggtgatttacgtgtgcaccacacatgactatgagtgcaggtacatgcacatgtgtgcagtatgtatacatatgtgtgtgtgtgtactggagagtagaaggtagactttatgacaagtgtcttcctctgaaaggaggagaggttgcttaagtttatatttttagaaacctatggtatcttacagaccatctgcaaacatttcaaaaaccactggcgtgtatctgcaatttaaaaaaaatagataaacccaactgaggataataaatatatctattagataaaatgtccccataacataagcaaaaatactgttttctgctaaatacaaaatggccaattttaaaggttactcattgttaggcaaggacttcgtagaaatccatctcctattaataaattgtctacagtggcatcatatctgtaacattatgcaggatgatcagagctgtaacccaaaaggtcattcacaaggtgcttatgtcaccacactgcatatgcctgagaaaagtatttatatatgtctaaggaaaaaggtttggtctataagacggtgagatacaggcagctgagtgcttgagtgcactacaaaccgttttcataggtgacatcacggtttatacctcagtacatgtcacaggaccacacccaaagaagtcacttaataaacaagtcctgaactgactcaatggaacctatataagtactagatgagagaagacattaaaatccattctaggccaagtgctgcagtggctcacatctgtaataccagcactttggtagaccgaggaaggaggatcacttgaatgcaggagttagagaccagcctgggcaacatagcaaaaccccatctctacaaaaaatttaaaaattagctgggtgtggtggtgcgcacctgtagtcacagctacctgggaggttgatgtgggaggaatgcttgagcccaggaggtcaaggctgcagtgcgctatgatcacaccactgcactccagctgggcgacagagtgagcccatctcaaaaatcatcatcatcatcactattcttaagatgaggcttgtcattagtttaacatataacttactgtatcttttatcttactattaagataacttattgatacgtttttaattgacattaaggtaacatcataaggataattatctgtcaggaaagtagactataattaaatacaaacgtgaataaaagaaaaattgatattttaatttttgttagagacagtatggggtcttgctcttgtcacccaggctgtagtgcaatggtgcattaataattcaaacagtctcaaactcctgggctcaaacaatgctcccaccttagcctctgacgtagctgggactacaggcgtgcgtcaccatgcctggctaatttttttatttctttagagctaaggtctctctacgttgccctggctggtttgaacttctggctcaagccatcctctcatctcagcctcacaagtagctgggattataggcacaagccactgtgcctagtggaaaattggtattgtaaccatgctatacattaatgtgaatactaaagaatgaaaatcataacatagttatagaaggctattcttttttggagaagattaaaggattataagtggtacattttacaattttttgagaacatatgtgaaataaaaagagggttccggaacatttctcctaaaaactatagtgaatgtaaaggcctcatgattcattttagagaggggaaagtcggatacatttttaagatacagctgacctctatgatggcaatgtactaagattgtgtagctaatattttttgaggcttgaaatgaaatttcattacatatattaagttttaatctgtatatttgttttgaagttatttaaagatattttaaaaattaaacaggatgtctcaatttttaaaaatctatgcagatatataattaggaaaatttttgctctataggaattgaatctccttataacataaacttccaagctaataatttttaaagaaatattcttagtttctctttagctaaaaataaaggcttataagagtctggatataaggaaagaatagttgctacgctggatcttagtgcaaaaggcactaagaaggtcaccaaaaatgttaggcaaaaccctaagccaggtgaaagagctgcccttttcaacttagagctactaatggtgcaggtagccaaatcagttcatgaaacagcacttcctcagctggttaaaggaaagtagcagtgtgcagcaaagcaaggcaatatttccatgttactgtcttttagctccactcccaaaaaggagagccaccaatgcactcttcactctttcctctttccctgttccactctacacccattcaactcccctccacaattttagaacatgttctttcctctgagaccctatattagaacctgaaatggagtttcccttgagattaagcaatatggagaatctagctggagtcctcatgtagttacatggtgactgccagccttctctgtgttctctatttctaggttgtccttcttgggtagttcatgaaatacatgctttccgtgggcctgctcatcatttttcatcactacctacccatactaatattttcagcgtatatggaacactctgcctcttcccttcttttttctctaaagccagcatttcccaaagtgtttctgaagctccttgtgagggaatcagctgaatacaaaatgcagattcctcagtcccacctgggcctcctacatcagttttggcaggattcttaaaagtttttccacaaattctccagatgacttttacatatattgagaaccagtgattttctcattcctatttaaattttttttttttttttagagtctgggtcttgctctgtcacccaggctgcagcacagtggatcatagctcactgtagcctcaaacacctgggcttaagtggtcctcctctctcagcctcccaagtagcagggtatacaggtgcatgccaccacacctggctagtttttaaatttgttgtagagatgggggccttgctttgttgcccagactggtcttcaactgctggcctcaagtgatcacctgtctcagtcttccaaagcactgggattacaggcgtgagccaccatgcctggctgcttttctcattcttgaaatgaactgaaggcaaggaggcaaacatatctgcttcatccctggtatactacatgctggcccatatacgcactatatcactggttcttcagtgtggtccaagagtccctgagagatccacagacccaggagacctgtgaggtcaaaactattttcataataacattaaggcattatttttttttaactaccagtctctcatactttacaatggtattttctagaggctacatgacatatccgtaataatctgaaaagctaaataaaatattcctcccttttctaactataatacatatttaaatgaggcatatactatatacatatacactgcaacaaatcgaatgcaaaggcagatatggtactccaactgtttcctattaagtcagacatttaaaagagttacagaaatttaaaagcatgctattcttttttttggaaaatatagaaacttatataaaagtgttatctgtattaaaatataatgggttgattattgctatcttagaatgcactaataaatatttttaaattatctcaatgttaatttctaatgcaaaaataacaatacccataacctacccaaataaaggcactttggagtgctcaataatttttaagagtacaaaggggcctgagaccaaaaattttgagacttgcttcctcacataaagaataaaaccagaaagtaaagaacaccaattaaaaatagataagaatgagatgggtacttagagctatccaaatgaaatatataaatattttaattaaatttagtaagtatttattgagcaactactatgtataagacataatatgatacacttccttaaaaaaatgctatgggatctcaactcagccagaagggtgtttgcatttagcttacctatgaaaaataagcctgttattacaaattggttttgtcctagttgattacactaatctttagtttttgagaaactagatatttgtttcctgaaaaatgttaagatttcacttgctttaaatttctaaaataggccaggcacagtggctcatgcctgcagtcccagcactttgggaggccaaggtgggcgggtcacctgagatcaagagttcaagactagtctggccaacatggcaaaacccccatctctattaaaaaatacaaaaataagctgagcgtggtggtaggtgcctgtaatcccagctactcaggaggctgaggcagggagaattgcttgaacttggaaggcagcagttgcagtgagccaggatcacgccaccacactccagcctaggtgacagagcgagactccgtctcaaaaaaaaaaaaaaaaaaaaaaattcctaaaataaacttaaaagccagatacaaactgtgaattgctataatactcttgttattgctatgtgactgactcctgtttaactgtaattatgcactaacatcttaacttttcaacttccaacttattaagtagaataggtaacagctttatcaccactttctaattaattattaggaataatgattttggtaaaggtgcatttgagacatttgtactccttttccatgctgtaactttgattcgtactggatagtcacaccacataaaatactgtcatatcaccttaggcaaatctgatcatacataaattagagccacataccaaaagtagattttctatctgctatccatcgcaaggcccaatctgcttttttcttaacatagggcatggtttcaattgcattaaataaaaattccctgtaaaaacaaaagaatgaacagcaaagttattcacttgtttttctttttttttttttgagacagagtctcgctctgttgcccaggctggagtgcagtggcacgatctcggctcactgcaagctccacctcccgggttcatgccattctcctgcctcagcctcccgagtagctaggacgacaggtgcccgccaccacgcccggctagtatttttagtagagacgtggtttcactgtgttagccaggatggtctcaatctcctgacctcgtgatccacctgcttcggcctcccaaggtgctgggattacagccatgagccaccatgccttggcctcacttgtttttcttaattggactaaacttaatcagagataataattgtaactctacggtatgctaccagatctgtagtttttatacatttttacatgtccatagaacagaaataaaactcaaattattggtttgaatctggtctcatacaaaaccagctaaatttgagtattcaatttctaaacagaagatgctactgaacagttcttaaagataaaatatctaaaggttaactggttctataacaagttttttttaaaacccaatacattattaagcaatagaaaatattatgctcagaaacttccatacttgaataatctttccttaacattgagttttggaataaattctgatctgaacataaccaagccgtaagcaatattttgtaaataaaatcccaacaataccttttcttgggatctctgatgtaagtgtctatcagcaaactgtacatctctgagtgaacattctcgatgagaatttgaaagccatagaaacagcgagcctctggaacctgcacctcctgactaaagcgctccacctaagaagataaggaaaatagatatatccagttctataggctctcattaaacactgcaaatcagaatctggacatcagcattatcgcttaaaaactgcctgtcatgtaacaaacaggtcagaaagaccttatggattattttaagcagtatcctaggcagtactgtttatccatcaattctccatggtaaattatttgcatagtatattcttttttttttttttttttttttttgagatggagtctcgatctgtcaccaggctggagtacagtggcgccatcttggctcactgcaacctctgcctcccaggttcaagaaattctcctgcttcagcctcccaaatagctggggctacaggcatgcgccaacacgcccagctaatttttgtatttttagtagaaatgggttttcaccatgttggccaggatggtctcaatctcttgacctcgtgatccgcccacctcagcctcccaaagtgctgggattacaggtatgagccaccgtacccggcctatctttctaattctttttaaaaagaaattatgcctcctgatcaaccataatcaagttttaaaatggggagccagaatccagtgttctattacagagctccaaaggttaaggtgcaggttctctattaagcttactatctgagagtaaaaatcaaactcatgttaatgcactgtaaatagttttgattcatatcatttatgcttgatttaataatagtttgctggtcaaaggataagcaattcatcagaaaaacatttaaagagttaagcttcatctagttcattttttagacatcttgtctttggctgaatttaataatcttactgacattatcatcatttaactgctaaaggagaacaaaagttaaatcaagcaaaaatcttaccaaattttcatttacaattccatcactggctgcaaaaaaggctaagatgtgagagatgaagtacttctcatctgctttaagcttgttccagtgagggagatcctttgataagtcgacctggaataaaaagattttcaaaaattttaatttggagttaagttcttctcaaagtgtttgggaaactaacttctattgttaagtaggaatatcccactaccagtaaactatggaaaaagaaagatgttagcactgcaaagaaataaaaaaaaaagttatgttaacaagtgtattatattcaggatttttgttaaatgagtagattacagctattcttggtgggggggtgaacagctaaactatgtgaggcaaaggaaatattaatttgttacataatgggtaaccattttattatatatatatatatataacatcatgtcatacaccttaaacatacacaataaaatttatctttaaaaaattaagatggaatcgaattttctggctaattaagaagctggccaggatgtactttaaaaatattcaaattaacataatctagtggcactgaagcaaatgaaagaagggctaaaaggggaggggggagagtaaaaactagtcaagaaggcactgaagtaaataaactaatgaatctcaacagtcactgctttaacattttatataatatgtgctatggtgttagataattaggcacctattaaccaactgtagctgctactttactgccaggtaatcagtctacttttacatccagaagtaatgccaggcaggtaacaacctgagttttgttttgttttgagatgaagtctcgctctgtcgccaggctagagtgcagtggcatgatcttggctcactgcaaccttcgcctcccaggttcaagcaatcctcctgcctcagcctcccgagtagctgggactacaggcaggcgccaccatgcccagctaattatttgtattttttagtagagacggagtttcaccatgttggccaggatggtctcaatctcttgacctcatgatctgtttgcctcggcctcccaaagtgctgggattacaggcacgagccaccacagctggccttgttttgtttttttaaagagatggggtctcactatgttgcccaggctggtctcaatctcctggcctcaagcaatcctcctacctcagcctctcaaagtgttgggattacaggtgtgagccatcacaggtggccaacaacccagttttttttttaaagcagtttatacataggtatggcttccattgggaatggaaatatttttgaaaatgttcattagaattagtctttggaattaagggagacgtactttagaatttggtgaaacctacaatttaaaaattgtttatttttttaatttttgagatggggtttcactccgtcacccagtctggagtgcggtggcacaatctcagctcactacagtctctgcctcctaggctcaagcaatcctcccacctcagcctccagaggcacaggtgggaccacaggcacacaaaaccatgcctggctaattttttgtatttttggtagtgacagggttttgccatattgcccaggctggttttgaactcctgagctcaagtgatctgcccgcctcaacctcccaaagtgctgggagtacaggcctgagccactgcacccagccaaaaattgtctttaaatgtaccttcccttagtcagttctgggggctataacaaattaccattgactgggttgcttaaacagcatacttttatttttctttttgaacatttctggaagctgaaagcccaagatcaggatgtcagcatggttgggttattggtgaaggccctcttactgatttacagatggccaccttcttgctgtatcctgacatagcagagagagagagatcatatctctcatgtctcttaagggcactaatcctattcatgagggctccacccacatgacctaattacctcccaaggctccacctccaaataccatcacacagcatatatagacatcattttgatagggacaggaggcagggaaattctgggcagaagaagatggtccccagcgaggactccaccctcaatcctggaactgcagcccaaagtgacatgtattcctgttttcccactataatgttgccctttccaaaaccacccatggccccactcccctaccctgtgcccataaaaaccccaggctctaccagcagagaagaggagaggagaagaggagaagcagctggatgtcagagactacggttggatgtcggagagaagcagcttaacttcagagggacagcttgacagcattcctttggagaggagtcagctggggacggccagacagactccaggagaagattatttttccactccatcccctttccagctcctcttcccactgagagccactttcattggcaacaaaatcctctgtattcaccacccttcgatttgttcatgtgatctgatttttcctggatgctgaacaagagcgtgggtgccacaggtgtggatgctaaaagctgtcacactgaccctctgccctcactggtggagaccaactgccccatgtgaaaaggcagagggcccactgagccgttaaaacttaagccatctgcggacagcaaaagctaaaagagagttaactataacacattccttctggggcttcaagggttgtgggtactcctcacagatgctgccatgaggcctgcatggagttttgctcctgccggtgcccaaaagaattcacccaagctcctgcacctgctcacctgcatgctccctccctcaaggggctgagcgcaatgggttcaagtgagtggagtttgcccctgccagcgccaaagcagccagctagctccagcatgcgcattccagttcccacccacgaagggatcggagaaactatcctgcttcaattttgtcagaaaaaatcttttaaatatttttcataattaacttcatgaacagttgaaatatgtaattgtctttgtcttttgcctttcttttatttactctaacaaaccctcggctgggcacggtagctcacgcctgtaatcccagcactttgggaggccaaggtgagtggatcatgaggtcaagagattgagaccaacctggtcaacatagtgaaaccctgtctctactaaaaatacaaaattagctaggcatggtggcgcatgcctgtagtcccagctacttgggaggctgaggcaggagaatcgcttgaacccaggaggaggaggttgcagtgagccaagatcgtgccattgcactccagcctggcaacagagtgcaactctgtctcaaaaacaaaacaacaacaacaacaaaaaaaaaaaaacccacaaagcctcaagcctcaatctctttgacctttccaaaaaggactaatgtcccaatcttttaatcacatgctattttccaaatcctttttcccactaatttattctttaagtgtttgctgagcacttactgcacacctgacaccgtgctaagcactggggatacaacggagcagggtggaggaaatatttgtcttcatcttttaaaatatgcaacctaaaaatcaagttctgttctattaaaagctcaactcaggtttaactgaaggacatcttcttcattcatatatattataacccctcaggttttttttcggagacagtctcactctgttgcccaggctggaatacagtggcatgatctgggctcactgcagcctctgctacctgggctcaagcgattctcctgcctcaacctcctgagtagctgggattacaggcacctgctgccacgcctggctaatttttgtatttttactagagacagggttttaccatgttgtccaggttggtctcaaactcctgacctcaagtgatctgcccactttagcctcccaaagtgcttggattacaggtgtgagccaccatgctcgacctcttatatattatatatttgatattaaatgttaatattgtaagatgcttcctcttaaatattaaaattatttctttgaacactcagtttcaaaggtcttctaaattttatttacactacattggaaatattcccttcctgcctagctttttcttatttgagcaaattctcaatttcatcatttaaatactgattccaaactagacaattatcataactgcctgagtggctttaaagaaaaaagtcccaaaccccagacttttgtcttttgatcagggtttctgttgatcagccatatttaagaattaagctcaaccatttaagctgactaaatggtaacttacataatttgtaaatgaaaaatatgtggaactaaaaatgtgtttgatttatcttcaaaatatgtatttgaatcgtcctataattagctacagaacacgtaccaacctgtagatttcagtttttaaaaattagtgttgctttgttacaggtcacatattacctttgctaaaagatgcaagttaatttccaaatgaatttcaagaatcctaagaatcctaagtacctttttaacataatgaacgaaaaagccacctgcgtattccactcgttctctgaaccgtatctaacaaaaaacctttctaaaaaccacagacagttagggacagtcaggtgtgtcaagcattatgaccacgtatgaaaatattgggtgtttgtttttgtgtggtttggttttttgctctatatgtcaactataatataacaaagatgttgacaatataacactacaatataacaaagatgggtaagtgggtaaaattagtgtaatagaagcttcaaacactggtgccttctgatttctaggttaaattttcccccttctgtgcataaaataatagtttacatttatttagtgcctactaagtgtcaactaccattttaaatatctcataaatcctcataacaacacaaatagccaagtacaattagcctaatttactgatgaggatacacagagaggttatgtaactttcccagttccatagctagtaagtagtggcacaggatttgtacctaggcagtctgaccccatagcctgcattcttaacagcatgtgtttaacatttatagaattaatgtcttgaaaaatagattcaaatctatctatccaaatagatacatctatctatagagatacatatacaaacatatacagaacaagagtgctgtataggtatcacccattatatttaaagatcaagacaataactatttgttcagttagactacagggcaatcattttcatgaccactgtccttaccaaccagcaaatattttctagtttgctgtgttcaactgatctcccaggtggaattaacaaaaagctttctacagctgatctattagtggcaactctgtcacgtttgatgtagctgagggcagggccaaactgggagcagcactgtgagttccacctggctgactcgggagtgagtccacagcctagaggatcaaactcttcatgcagcggctcattttgtacaatcagataaatctctcaattgaaagcagagttgctacagctttcactcattttttgactacagctgcaattttacttattctgctgaccttgtaagactagtcagacaagtcttacttggccatatcaaactaaaagtctgtttaaaaatagaaaatgttggctgggcgtggtggctcatgcctgtaatcccagcactttgggaggctgaggcaggtggatcacaaggtcaggagtttgagaccagcctggccaatgtggtgaaaccccatctctactaaaaatacaaaaattagctgggcgtggtggctggcgcctgtaatcccaactactcaggaagctgaggcaggagaatcgcttgaacccgggaggtggagtttgcagtgagctgagatcgcgccactgcactctagcctgggtgacagagtgagactctgtctcaaaaaaaaaaaaaaaaaagaaaaagaaaaaaaatgttctaatatattggaaataaaaatctggcagaattagatgccattgttgcagcagaaaacttgtttatagatagtaatctaaactaaaacattgagaacatcatatttagtctcagtaattccaacacttatcttctacaactgatcttcttcaatgtataagttaaagttattcaatatcctgtaaaacaagaaggaacactgcactataggatgtgaatgctcttggaggcaatgccacgtacctcttctgctgtccagaaggaagcctgtgcctgtttatacattttccaaatatcagggtactggattggaaagatgacaaaccggcgagaactctttcttaggagtggctcttcatttgactttatttcactttcgttggtgtctgaagatgatctctttgaaaaataaagtacaaacacgccttttatatagacatttcttctttattcatacctaaacatacatctaaggaagtcagggagacggcattggtttgagagcctgtctgcctgggttgaatccttactgttacctggtagctgactaatactgttaggaagtgcgtgtgtgaccatagaaagctgcttaacttctctaaccctcagtctcctcagctgtaaaataattcctacctcataggtttattctgatgattaaaagtgctttaaacaaagcctggtatatagtaagcactcaaaaattattgtaattattgctagtttgaggataagtacaaagctagacccataaatgtcatcatgatgggcaaatttctaagtttgtgaacaaaatgtccctttagagcctctctgataagattgctggaatgaataagctactggtataagctactttaatgttttttctttctactcttcactgaaataatataatacttatctgaaaactcattacctacaacttaacctttgttcatcttagccttctgatactccaatttgttactgctatttacattctaacattactgcatatgatctcactgtgggctgtctcaaagctttgtgaataaagtgagaaacacatacctgtattcacactgcttcaaaacacgatggcactctaagagcaaatggtgccatgcatatatttttaaaatagcgggaacatcagaagagaatcagaagagtcgcacatgtgtgagaatgagtataaacaaaggacatacaaataagctaaacgtgtataaaccaggattagaacacatacaacttctagactcctatccaaaactgtctctctctctactgtgacaggcccgttatgttccttactccagcgtccacccattgtcacctcgccaaagcaactgttatagcagaggaggctaaggcttagcaagaagaaagcccaaaatacaagcatacggctatgcaaatacaggggggcttgcgtgctttatacctactgccatcacagtacagatggtcttgattttaactacttgtttaaaggtatgggcctcctcagatacagcacttgagccctggagaagaggaaccaatttttatttgttgtgatgttcccagagcttagtatcgtgtcaagcatgttagctaagtaaatgggctgctaatttctcttcttcctgtactcagatttctaggtacctttagaaaattttaatttaacataggaccacaatacatcagtgagacaacccaataaccattaaaatcaatcacattttcccctcttcacatcaccccaaaggtctgggttaggttccagatataagtacatagctcactgcaatttaattccctgttaattgtctctaatttcctgtgcttcttgaaagtaaaatccattttcacccttgtagaatcccttgtgcttagcacagtacctggcacttagttggtactcattccacaaatatttgagcaatttttttttaagactgggtcttgctccgtcacccaggctagagtgcatagatcagagtagtgtgatcatagatcactgcagtctcaaactcctgtgctcaagcaatcctcctgtctcagcctcccaagtagctaggactatgtgcacacgtcaccacacctggataatttttaaattttttgtagagatgggggtcatgctatgttgccccggctggtctcaaactcctggcctttgttatttttattactgaaatttgggatatactcaaagtatgaaagttgggaacttctatacttttgttactggaagttgggaaggacatcacaagcagtcactcttcagcaccaaatgccctgacgatgaatgaagtttttaaatgatgataaataactgatctgctgaagactagtacctttaagttagaatgaaagtcacatttgtatacacattctcctgttctatcctgataacctgtagactattaagaggagtagctggattaggagtgtattatgagggattttgcaatgtgaagagaaggaggttaaccaacatcaacctttgagctgggctagagatgacgtattatttcataatgcttagaaacgtgcacaaacatacatttgaatacaatttcagaaagttcatgcatcttgaaactctaggctctccacagtaccctctgtggacctaatctaagaacccatattttagaagaaaaaaaaaatgtgaaaaaagatatgatgggcagggcgcggtggctcacgcctgtaatcccagcactttgggaggccgaggcgggcggatcataaggtcaagagatcgagaccatcctggccaacatggtgaaaccctgtcactactaaaaatacaaaaattagctgggtgtggtggcgcgtacctgtagtcccagctactcgggaggctgaggcaggagaatcacttgaacccagaaggcagagattgcagtgagctgagatcacgccactgcactcaggcctggtgacagagcaagactccatctcaaaaaacaaaacaaaacaaaaagaaatatatgggtgcatgagagagcagcctactagacatagaaatttcaaagctcatgggtatctatatttttacagggttaataaaagagcaaaattggttagtagtaatctgatttttaaaaaattttggaggttaaagtggtctgctttgatataaaacactttggcatctaataactctaagatgtatgctattgggagccactgaaggtttttaataaggcaaataacataatcagatatatcttttaagatcgcttttctagaaacattgctagattagaagagaaattagaggcagaaagaacaatgaaaagattattgtactacccatctcttgcctgaactagaaacacacacaaaaattgatttaagtgatattcagaagtagaatgaattattcttcctaaaaatttgaatttgggacaaggggcaagaacagttaaagatgcccttgatgtttccagctccagtaactgggtgataacaagatctaaaaggcacacacaaggtgctcagtacctggagaataaataaataaatcagacaaaaattttgcttctcacattagatgtttaacggaagtttaatttaactcctcccaccaagccaggcgacaacaacaaagttacaaacacaatatcctcacaaagtcaactaggtcattagaagagataatgaattcaggcccggcgtggtgcctcacgcctgtaatcccagcactttcggaggccgaggcgggcggatcacaaggtcaagagattgagaccatcctggccaacatggtgaaaccccgtctctactaaaaatacaaaaattagccgggcgtggtggcgtacgcctgtactcccaactactcgggaggctgaggcaggagaatcacttgaacccaagaggcagaggttgcagtgagccgagattgtgccactgtatgtactccagcctggtgacagagtgagactccgtctcaaaaaaaaaagaatagaaaagataatgaattcagtttcaagatgtccagtaagcagttaaaaatataacactgcagaacacgagtgatggagatcccattagtggttgccaagggaatggatgtgattatccagagagaacatatagagcagcaagacaactgaggatacagtcttagagaatgctgatatttaaagggcagatgaaagaagagaagccagctgagattaaaacaggctgaaatggatgcaggacaaggaaaagcaaaagtaggaatgatgtgatttggctaaagcaaaggatctagactcttaagataaatcagactaagaggttaggaatcaattttgtggccaaagatcttcaaacatcggaggtctagaaggctcatactccaattctccccatttgcccccaaccccaggtgctggcgttcatagcagggtacagtttgaaaatctgtaccccacagatttgggggtacaaatagtcatggagagtttctgaatgggaattaacatgaatagaggtggcattaggaagactaatcagaaaaccacgtataggattaattgataaaaaactagattttgcaagcaactaaggaaccaatttcaaagatggaaatgaggacttgaattaagatgtggcagttagcatgaaaaaagcagcttcaacaagacttcaccagcctgaggtgttggccaggctttttggtaggaattgagactcttttgggagttttttgggggacacagggtcagtgacactgaggcactggtctaatgaaggattaacttggcaatggtaattaggattgaatggcaggtaagataggagatagagaaacaacaaaattattatagccgcacaggtgtaaagtgatgagaatttgaaataaagtttagcagtaggcattccttagtgacattctgctgttttttccagaatggtacttccagtttccgactgactcaatttctggtcacccagttggaagacatgcctgggcatgtcaggacaacaatttaggtcaagatttcccagcaagcacttacgatgccccaatctaggctggcatcataccaggctcttacctcctatccagccccaattccaccacttccgtttctttgcctttatgtctcttctacttctgtaaaatagctgtatgttgtcatagtcatacactacttgtaagtattattttcacttctattcccacaaagtctgacggaaccaatgggatacccgcccaggtgcaagaacttggttttaaatttagctcctctactgagtcctgggcatgccatttaatgttttctggcctaaactttaccttgacaatagactatgaattagattagcaatagttaactctgagaaattgacaataactatggacccctttctcagaagattcacatctgcacatacaaaatctacatatcacttcaggagatttataaagccccttctagtctatctatggaccctttaagacagtggggggttttttgtttttgttttaatatgtgtaccaggatcacctgaagtacttgttaaaaatgcagatctcaagagattttgattcactatgtttggggtgttggtccagcaatttacattttttacaaaatactccaagtgactctgatgcaggtctcctattatgcactctggcatctagaaaaacaaagtgcttcaggcaacccagcatctcaagttaaaaacttttggaccactaaaattcattctgaatctaaaattctgtctgtccttgcgggtctgtatcattgagataggagtaataaataaaatgtaatatccaggtgttaagcctgaatcactgctggtgccattagcataaacagcagtctgaattttcccctttgagtagggaagttggtactaaacgcatttgtttcaaaacaggaagaaaaagcttgagggatatttacagttagttactaaatgcttacaaaaatcaagttaaataaaataaaatctcaaacctggaatctacaactttctaaagaaatgtagggccaagcatgaatctcttggggtggaaacgtttgtttcccccaaatcttcacagtattaaatcaaagataccacagcaacaggttccagtagtacaaaaagcatttctcttgtccacaaagggcttagaagtatttgcaaaatgacagtgtttgaaaattatacagcaacagtttaaactaccatacaatcctacagtctaacaaattctggtttatttattttaggtacttttatcagcataaacaacttggatgaacaacttgggcttattaagcacctacaattttcgtggcactttgcataaagcattttacttaattctctctgaagtatcacttccattgtataaaggaagaaagtgacaccccgaagattcagttagttaaggagccgggcctgagcaaaactggcctcctaccctgattttttcactgggaggaggtcatgaggatttcgtgtccccttctacctgtcatcttcaccccagccacctgtgtcaatttccacacgcgttctccaactccttgtcaccatcccaaatggtatgcacctctccagcagagccgccacagtcctctttccttgcctcggtttccctggccagggctccaaaacagggaaggagggtgggagagcgtgaggcggataaacgcaggggtaagtctcaccccggcctgaggcctccaagcgtcgtccttggctggccccggggcagagcagcgagcgggacgcaaacccaaagtcagctccttcctccgccctccccggggacggcctccccggcgctcgcaacgacgaagccaggctgcggcgagggcgggcggacaggcctgtcctgaccgcggcgaataacatttcctacagcggtcctgcaacttgcaatctaacgggctggcgtgactgcggtgagggggaagacgcaacagcaacatttacctcatcctgatccagcccggccgcttccggcctttccgggtcgcccatcgcgcagactccgccgaagctacgggcgctgagggaactgagctcctcaggccacctccaactacgacagcacccaggtggtccgctggtccgctgggtccgccccgcccccagctctagggactcggccggccccgccccgccgcgccggtcctgctttctcgcctgtccattgagtgactctccctgcgccggcccggccccgcctcccccgcctcggggctccgcctaacttcggccagcc

SEQ ID NO: 138 - DNA, 18491 bp, Homo Sapiens
tgagaagatagagtcttttttttccttctttttatttccactgccttggagcaggtttatcacgttagagcattaattctttccccttctagggcactgcatcagagcatgggggacagaacaaagaaccagccaagaagaaaaggaaaaaataaatgaaatgcctgagttaatgtgaactttggggcttctgcttcatttttacccaacaagcaacaatgccccttgtcctgtagtccacaccgatgttggcatcttggttctgaacccactgaattcaactgcaccttcagttagaaggaatcttcttggcaggtcctgctactgaaaaatggctggccttaggcaagcccttttgcaaaaagcacagctgaaagcctgagtttgggagcctgcaccaccccgatgaagctccacgggagcaaatacagagcctccaggcagtgctatggtccaggctggcttcgtttttccaaggagcctttggtgagttcaattatctggtaaatatccagcgcttcacctgaaagatagtgcaaattggttaggatgccacctcaagaactgtaactgagagctcagaagtgagcaaaggagcttaatgctaaggtcaaaaggagagtgaaaggttgagaacaattgccacgaacggtaatgttacatgttaggagggtctgttttctttttatataagtgtgtcttagatatattttaaatagaaaataagctttctgatttacttgtttggtatttaaagcacagtttgtttttctgtcacctatagagtgcaagaatgcactctatagaataaattatctttaaacatttcttctgtggttgaagtaggggacaggtacaggtagaatatttgaagctctgctgccttcatttctgaaacatcatatcacattcactctggacacagggcaccttataaactgaaattagcctagaatatagcctgagtcaagagtggattctctggggccccaagtttcctgttctccaagacccactttctagtccacctcagatcctatgtgtaatgaggaacaaatgtgttgtgctcaccctggggaatcccgtatctcctttccatcccagttgggttggaaggggttttacaatccatggtcacttccttcctgaggcaccggtcaatatcgactgcactgaaaaaggcgactgactggggcaagtcattcagacccagcttgtaggcaaacatgcacctgaaagagacccaatctactctcacagtcatgcccctcctgtgaacagatgcatcactcctggagcaatgaccccacaccccttagagcagggcttcccctggaccaacaccccatctgttcacttagctaagtcaagaaaggtgaaggtccagcactgttttccatccagcagcctaacctcccactgagatactgaaatgcaattatggactcaacatactttttttttttttcccagtttggtacactttattaattaatatacgaaatcacttccaattgggccagagtttgaagcataaatgaggacttttagctttgttaagcataacctcccggagatgatgattaagagggcaatgggaacaatgttgaatattgtaaacatctgttatttacccaataatcaggatagatcatggttcccaaactggttctgagtggcagatcaacatggaacggtaatatttaattcatccatatgaactaggaattttactacaagaaaatacaactcaatatataaaatatataagatatttttaaaaatcacatttgagtgtccccattaacagtgttttctgttagcagtcaaataacaaacttttggcacttacttaagaaagaaaacatttatgggagaaagaaaaacaaacatctcaattttctatgaaatgagaaaaggcttctgtcatttgattttccaaatagaaaagcgtgagtaccacccttcggaacaattcccctaacctcactgcttccctcaatgatcagtcttggtatttcacattttcaaacccaataactctttttttacgaattgaggctagtctttttaggacttctacaactttttaaaaattagaaataaataaataagctgaaacattcacttctagggggatgaaaagtcaaaactgaccagtctggcccaaggaacgctcacccaaagccccacataggagcacatggccaggctagaggccatgggccccgcatacctggtcaagaggttggtgatctgcaaggccagggcagcgcggtagcggtcctcctcccgcaccaggtagcgaacctcgtcatggatgctgatgcagaagcgcccatctatggcaaactcttcaaacagccacttcatggccacaagcatgaggtgtaagtagtcaacagcagagctctgtaccacccaattcacacggctggtcataaactgggaagggaaggtgggcagaggtgaaaggggctatgctacataccaattaactccagggtagaagccccaagagaagcttcactctggccctacctacaaacattggtaaggtccacagggagctctgccctgccctccctggggcccctctgcccatgctccaaaggtagcaagatacctcttcctggacagccgagggctccagggctcggctgatgcagcagcccagcaccggggtacgtggtatgtcagacgtagcaatgctctcaagcttattgaacatttctgactctgtgccccccttccatgcccgttcagcaaccacctcccacttcttccactgtgacctaagggaccagaaacagagggcagactttgtctttcagcatctcaaagctaaaaaacaaagcatccaagctcttctggggcaagcccagacccctccctccatccttaacacaaagaaggttcttacttccttgcagtttctctctggaccttgcgcagatcctgcagggaaatccagccaccctcagtcctgtccactgggaggttcaactccctcaccagccactcgccctcatccgacagccgatacctgggggcagtgttatcaccatcattccacgggagtgcttcctgtgccacgctagtgccttggcaaggaatgttcacatatcacttcaacttttaaaaacactgacatcatgccagtcccctaaaggcttttattcagaggaagaaacggctcagagaggctaagtgccttgcctaggatcatggagctagaaagagatgcagcccaggcttttgtagccccaaagcctgggccaccccatggtagcccaataaaggacaaagactccagcacaggaggcaccactattcctactgtcctgtttctttagacactgaattgcccaatgaccaacacgggccttttattcaggaggcagcaagggccatcactctagatttggggggataggggtaagaataggctactccctgaaggggagggggcatttgttgaagcagaaaacacaacagccaggcctggcttacccctctcaactgccacaaccctagacaactcccagcttccatctaacctgcagacctcacaaggcttgtcgcctgaaggctccagagacacgtcactcgcataaatggcttccccaccacctgcacccacagtccaaactcctgtgacactttcaaaggtgtccacaactaaagccccaccacctttctcgcctccaccagcacacgctgctcacggtatgagccttacccgacctcactttatccactggacgatactcagctccccttccctgcatttatagtcatcaaccactatatcatttatcacatacttaacttttagttgttgacgagaaagtgaagtttccacaatgagccagctaattaaatgtggacagtgtactgtacctcaggaagttgtacctctcttccctcaatgtttttggaaccctgcagagagtctgctaaggccctgagcacacagtatgcagtacgatcagaggaaacaaattggagagctaggctaagtaacctggaggcctggtaatgctttctccagtatcaacatcagcctacatgctccagtttgccacagcgccctcctgtcaactcctgtcttccacccactccatttgctctcattccctgtaggcatctgagtttgcaacccctgtattattgattatgcagcataatcagaattgtcaagatgctaccacttggtaacagtataccaaaagtatagctttactcccatgaggaaaaactgtttaaggctgactataaagcaaccaaatgtcacaataggacaaatcatcctggaaccaggttacacaggtgtggaaggagaggggctaggtgagagttcaagtaatgggcaggagatagaacagatggtagtactaaaggacagtaaagcaggcctcgggtcctgggtgttaaagtggatgggagagggaccctcaccagcggaggcccttggtggcagcgtacatctgctgggccttctcagctgcctcctgctgtgtgagccggtggttaaactgcattagtaagcgctcagcaaagggctgcccagcaccatagatgcggccgtagttgaagattttggcatgctcacggctgatgcccacagtagtggctgtcttactgtgtagatcagtgcccctgctcttcctgccctgcagtgtcatccacccaaaggctgtgcagcctggaagacaagcaggagtgagaaaagcagctcaggaacattctgcccaatgttcatcagaactgtcaatatgctgaggggctgggctgccccaaccccggctcctgctcaccatgcatgccggcaaagtgggcgtctccaagcacagctgcaatccacagctcttgggagtccacatcagcacccacaagggtgtagccaggtggggcctgcaccatggctttcaactcactgcctactcggtcaggctgtgggaagagtgagatacccaaatgagactcttcctaccccattcctggagccagagttgactgagaaagagctagagcctttcctgaggggatggctttagagaatgccagacagcactgctgaaattccacagttccagagatggccacctatcagcaattggtgtgacaggtaaagaatctactctatgcctagcgctatgccagacccctcacctacacggtcctatctaaattccatgagagctgtagctattacgcctgtcacggtctggccaggagcaggtgcccagaacatatttactgaaggagtggacagaaatcatgaagccagatttgactagagtcctgcctgacccagatcacagggtccttttcatgatcctcactaaatacctaaaggccctcagagcccagtttctacagacctgggagaggaagagcaggggccagaggtacagaggtcacatacccgggcattgctggcggtgagccatgtgggctccacagcccggcgagtgatggtgccggcagtcaccacttggggcaggatggccccatagaggccttcctcatcatagtcggggtgcctggtggggtgcaggggaaggaaatgggtcttagcagggtgctttggccttaggacctaccacctcacctcagttctcctatccctacaaccactcagcagaccatacctgatcacagcacggggcagagctgacctgggcagccacaccaccatctgggagctgtggggacagacaacgtgaggctcagcacagccatgggaagcagaatctatcccacatcccaccatggccctcacctgcccacctccaggactgctatactccattacccagcctcactaactggactcaaggtgagccctggctcagccaagaactggggccctatgatacaccaatcaagagcataaaccatctgggaaccggccaggcctccgagcgagcttccgctcctctccggggggcatccatgaggcgctccttccaccaatgcctcttcctacacacaggcagacttcaccatcccaacacccactctgctcgccagtgtgctgatggccacaaccaccttggaaatggccttcaagatgaatacatttgccattccagactagaagacccagctcccagcccccaacagggcttacaggccaccagctctccatggtcctcagccatagcccacggctccagcagttacaccaagaagttctgttggagctacgaagggctctcatggtcctacagcaccattctttttacattaacagggaaactgaagctagaggggagacctgcccaaggtccatggcaccaggaccaaaagtagccaggcctctagaccatagtcaggctggccctctgtgggaatccagggttagtcaggggtccctgggtgggaagagaggggaaaggcatcccaggactcctcccatggtggcccacctgatacgtttatgggcgttcctccagaaagaaatcattttgttgatttccagagcacggggcccactggcacctcctgggccagcctgcagggtgccatcctccatcttgggcaggaagtccttggcaaaggggcttcccacattacagctattaccatcctggacagagcaaaggaagcaggggctggaggcaggtggcagacccctgggtggggaaccaacgtgagtacctgcactcctcccaacactgagcccagaacctcagcagtctgaggcaaatccctgattgtatcacgcacgcgcgcacgcgcgcacgcacacacacacgtgcacacacatgccccctaagacacacagacacaagcaaacctggctccctgcataataacaaatcggaaaaacctatcacgtaccagatgtcgtaccaaacatacgacgtgccccatgtcatttaattccaccaccatgccccttgccacccgactttcattagaaaaacaaaagctgagagatgacagtatgtgcctgaaatcacactctgtcccactactagtcattcccacaaaaaggaaagtctcaggtgtgtcactctgaaggcctgctgtgggccttgagcagaatgaggaaacaccacaggacaggccatgacccaggacacaccttgtgaggcagcttgaaaaaccagcagccagggatgtccacgtcgttgtaaggtccattgccatggtgatagctgggctgggtgtccttggggccaccacgggcagtctgtgagggccacacacctatatcaggccctgctccagcacctgcattcagcaagggccatggggtagggggtgggaaaagggcctgaaactgtcgtcatcagctgggaaatgacaagatggccatgaggtctcacccaggctttctccttgctccaacacgtgtggggcctcccaggggcagggtggcatctccaacccccttaagacctagggaactctggctgggaagaactaggtgggcaagaggaagccctttccacccagcacccacctagagaacccaagccggcgcactgctcaccagagctaggggttgacctggcactgcagctcgcaagttctccatcttggcctcagcctccacttctaagtaatccagttcttctacctggagcagtccaaggaccaaagtagtgaagcaggggactgggtaggccccaatccaccagcccctccctgcatggtactcagacactgcaggccagtctggggtgagccaccagtgccagcctcccacccaaaggctgccccttccctgggtggaatacagagacctcccctccccaaagctcaggttcagagcctgccctcaccgtttgccatatggcactattgtcagtgagcaggaactcctccgccaggccggcctcctggggcatcagctgctgcttcccctgttcgagacagtgcttcctgtacagggactcgatggctctgggcagagaacagtagcagcagcagccgctgattaccagatgcccactctgggccaggcagcttgctagtgccttccacaattccctttgtttagtcctcagaatcagctctgaggcagaaccagatagcactttcccgggttttagacagggattgattgacaaactgaaaatgacagcaccctggcagcaggctggggttcaaggccttgtctcactcaaatccaagttcctcttacactacagagctgccgtctcaagagaagttctgagagcacagcagcgggaggacaggacccaaggcccagctgcaggctggctcctgtccgctcacctaccctcgggctcaaaggagcaaggccagtgttatcccctttggtcccatggccccataagagactcaggctgccctgaagagccaggactcttaattctgggccactgtaagtttctccccaacacctgcctgcctaaagctcagggtctgtgatcttaagtcaaccaagcctttgtcaactacaacatggggataaccattctagctcatgggactccttggggaacaaataagggaagcactgcttggcccataattatcactcaaattatatacacacacttttttaaaagcccatctccctgctacttgtaacagccctccgcatgttcctgtgaaggcagctatgcttctgggcccaagagtagggcctttagtcctccccactgtgaacatctcaacatactccctcccagagctctgagatccagagggtaagggtagccatggaagaaaaaacctgaacccagagagtgagtgagtgagtgagagagtgagtgagtgagtgagtgagtgagagagtgagtgagtgagagagtgagagagagtgagtgagtgagtgagagagtgagtgagagagtgagtgagtgagtgagtgagtgagagagtgagagagtgagtgagtgagagagtgagtgagagagtgagtgagtgagagagtgagtgagagagtgagtgagtgagagagagagtgagtgagtgagtgagagagagagaaagagagagagagagggtgtgtgtgtgtgtgttaatttttttcctgttttcccttcttctgaacccagactcttgaacccaaactctttccactagcctgagctgaccagccaggggaaggggtccctaggctccagccccttcctcccctgggcctaagccttacctgtaggggcagaccaccccagctgactccagggtggtacctgtcggcagcttggccaggttgtcccgccgcccaggcaccaagtagccccagccatgacgctctgagtagtgcagagggaagccatcccaggtaagtgccatgagtttaggtgtgacccgcatctgcaggctgaggaggctggggcccggggtccatgcagggtcgtctagccgggggcagagcttccggtaccatctacgtcccagcaggaagacagcagtgtcacgatggtaagggcagttgttggggggaaggttctctctctcacaatgtccccacccaccctccaaagccctggggctttctggtgaccccagcctacagccgccatcccctcctctgggatgctttagccaggacccccatggaatcctctagaagaatatttcaaaagcaaagacactaagtcagtcccactggactagtcagaagccaggacacaaaagcataccctgacccagggcagggctccttcccaagctccatttcatccagggtaactgaccagaggagggagcagatctgccctccccacccctctagagaaacaccagtccttctgggtgctctcttgcaggctgttcaccagagttgagcccagggtgagactagcaaggcactcaggacacttgctctcagggtcttgcaggtgcaaagctggcaccctgctgctcaccctggctgccctttttctcatctctgccaccctatgaggctcaaaggaaggggcaccttctcaaggaagccttcttgatttatttcccgaggcagagtcagaactctacctatggacactagctgcactggctggtctacgtgcctggctcctcctaggaaaaagaactactggaaaggaggagctatgctccagtgtgtacacccggtggctgccacgggccattgcacagcaggtgctcacaacactgtgctgaatgagtccagtgagccggtccagagtgagcaaatgagaataggactggaagacagtgtgactgaatggcagcaggtcaataagtatacatgtgcatgatgcctctgtgccagaacccagaccagggctgtcctgagaatggagcaagggtagactctagatacactgctgggggtgggcagggctcacccagggtgtccaggaaggtgctggggccgcttgggcaggagctctgtggtccccttcagcttctgcaagcaggcgcgggccatgacatcttgttgaaactcctcctcctcactgcaggggccgaggtctgtgagggtgggggaagacaatcaggagcaggagaaggaactctcaataagatctgctcccacccgctcatctccagaaggctggagcaatcctttcgaaggaccccctcaatcacaggaccttcccagagacaacccctaccctaccctacctcccacccatgctccccaccttcctgatccatgggatcaccaggggccccagccccctcgatgggcaacttgctggctgtggctggttccttcttcaccttcttagctttcttctgcttaaattcttgcaggtcccactccaggtcccagagccaggggtcttctttgtacctacagagccagtccactagggcagggctaaggctaagccgaaggctaggccgcccacctgccagtcccctgcctagatcctgcccacccaaggcctggctacctctctcctgagagcagctggcaggcatcattggccagatccatcaacgacttcttcatctcccgctggagctcctcataagtgccctgtgcctctgccaggtaacgctcccagttctggttgacaggcaggtaggagacacccatctccagcatgccggccagagtcactgggtggggacaccttggaggcaaacaccaggagctgccataaatgaccacaggaggcaagactggcccaatccctgagctggtttagcaagcctcaacccagccactgacatggcacagctcaaaagtcagacggcattaaatcccagctctactgttactcatccctgggtaagcaaccccatctctcggagcctcagttctttcatctataaaatgggaacaatatcatcccatcctcaggggtaatgtgggaaatatagatggcaaaagtgaaaatggctgccacacgtggagtaatgactctgtgccaggcactgtgctaataatcccatacatgaaaaacatcatgcctgaacctcacaacttgggtggtaaaatacagctgacatttaaacaacacatgtctggatcgtgcaagttcacttacacatttattttcttcagccttagccacccgagacagcaagcccaacccccgccctcagcctactcaacgtgaaggatagatatctttatgatgatccacttccacctaatgaatagtaaacatattttctcctcatgattttcttaatacattttcttttatctagcttactttaagaatacagtatataatacgtataacataaaaaatatgtattatgttatcagtaaagcttctagccaacagcaagctattagtagttaagctctgagggagtcaaaagttacacccaaattttcctcccttcttttttctttccatatctttggtacaaatatacctgaattttcagcatacaagggtcacttcataagacagactcattaataaacataaccacgctgtatgtgaagcccttggctaaggatctagttagagaaggtgcacagtaaaccaggaccgtgcacatgacacacaagcacaactccatggccctccccttcagggcctctgtcaaatccagagtccagggcccagatggacaccactgaacagaagggctccattctttcagcctagaaaagctaaggtccccaacctgagatagaaccagcgccacctgattacagtgggcccgggtaccaggaacacactgacccccagagattcccacatgggctccccctcacctctccaagaagagcggtagctgctgctggaaaacctcatgggtggcccacacgtcctgggcacagtactgcatcaggtcctggcacaaggtgacaggaaggcgcaaggtgggcagccatcccattaccaccaccagctctcagggtcaggcctggcagctgcatctccccaagtgcagctaggggtgtgccacagcccatgtccccagagccccctccagcaccatacctggaagttctcacgaatgtccttcatggtgcccttcacaaacagttctcgaggctccttctctaagggaggcccccctacataaagtctgtgcacctctgccagactgttgacactgctgatgtccagccagtcccaggatgagatctggggaaccagagcaagggacatggcagatcagcctggcctcgggccagacgggctggtgagagggggtcccaagcactatgctcctgcccaccggcagtgtgctctcaccgctgggcctcttctggctttcctctgggacttctggccttgctttgtggggggctggaccttgtgtttgccctgcttggctgctatccacagactgcgctggaagctgcttagccctgagatggccatgtgcatgctcatggtgtccaggaaacgcatgcgggaaccctgaggaggaggaggagaaaagggaagggaaggagggaggctgcaactgtggggccagcccaccactgcttggtggtgtggacctccagccccacctcagctcctcaaacagcctcccctcccagcacacagccttcaacaccaaatacagaatcctcatgcttgttcatgcttgccccatcacctgtaaggggcctgccttcccaaatcctagccaccctttaagatgcaggcctggctcaatcccaatgtgcaagtccttctcagcttccaacaatagctctgagcaacgtagatacagagtggccaaaataaagccttcagggctatctggtctggccccaaccctgccactcaaaagctctgtggccctgagcatgtcaacaaggctgtctgagcctcagcaccctcagctatagggtaaggttgctctcccctgcctggcctatcttctagggctgttgtgaagatccagtgaaaaaacacttttcataaaattaagaattgccactactatacaccaggcagagtgctgagtgtttgacatgcaggcattgttccaaccctcctattaatcctatgagatttctgttatgtctgcctttttataaaaaaggaaactaagacttagagatgttaaggcgctcacagtagtcatcggtggttaaggcaggaagtgagcccaggctgtggctcaaaaccttcaagacccatgctaagctctaaaatgccacagagacgaaggccattattactttgtgacaacttaggtcctataccaggctttcccggggacatacaacagctaggcacagagaccagaggcacagctggtcaacagatgcgccttgcggcttcagcaaaggcaacagagacacgtgccaggaaaggagtacctcccctaaccactgagattagggctcctggcccatcccatgccagaacctgcagttggccccaggaaccttacctggatcaggtactgctccctgatatgagctcggtcaaaggaaacattgtgccccaccactaactgctcctgccagtctctctgggtggggctgctggcaccagtagggacctccagggggatgaggtcagccggcgacagctggctggtccaagagtaacgctcttccaccagccgctggctgcaccaggaatacctgagggaggtgagaggcaggcaggttcaccatggagacattaaacttccactccacaacaaccactgcacacctaccgccacatgccagatggtgcattggcagctggggacacaagtgagaccaaagggtgctcctaactcaaacagctacaggtcaggtgtggcagggtgggtgtgtgtgctggcgggcaagagctacaaaagcttctttaaacttctgcacataaaaatggaactactgggctattagacctacgtgcaggtattctattacagcctgggctatcaaggtgtttgctaggcccagcgttcactgagtctgcatctagctctgaggttttatgaacattatcaacccctcacgtctacaggcacaaaccagctactgttcaaagtactagtaaaggagatagacaataacagaacccaaggtggagatttaattgaattggcaaaaaaaaaaaaaatgacaaatgctgctgcacacatgtacaggatgaatcatctcacggctgaaaagattctgggggacaaagagcaaatcacacaccttggagaagcaaccaccctcagtgagaaccagggaaagtgccagaatgagaaaatgtatgtgtatgtgacagggttggggtgggagggataggggatgagtgctgcctgttgggggcccgacactgattcaggaaaaggctgcagtttgctcaagatccacaaggctaggtgtaggggaatggccactgaggaaatgcctgttgcaagccacagattattctaaacaatcaaggcccactcagcatcaaagtgagtgacgaggccacgtgtggacaacacagctgcgaaggagctccttgcaacctttatggaagggaaaaagggagtatctgcctcaacagattcaacacacataaaactaacttctttcaaagagaaagcaaaaagaggttcctagttttaaacctgacaaaatcgaactcatactccaaatggtgaaaataagccaagggactgaaagaaatccccacccccccacattttaattcagcatgtcaaagcccttaaaacaacgcagacaaaaaggctaaagaatgccaaatctttgaggccatggtggtaacaggaactttggttacagtaaaaagccacactggtgtcaagatgcagctctgcagctgtgcatgaagccatattataaactagtgattaaaaagaaacaagccaaatttaagatgagtagggatccatgccattaatactagttttactgtgaatcttagaaaaatgctgatggccagagagacgtccctctagcctgatggccgaagcccttaccaacaccctttgggaagaagctgccctgtgggaggctcatagctgactaccgcttctcctcccattgtaaattgtgggctggtcaggtacctaatgttactcagctaaggggcaggggcatgcccaggttcaaagtggaccgctattagggcaccatgtggcacccacccccacccaccagtcagactcccaggaggaaggtcccagcatgagcccaggccttaacagtgacttctgccatcaggtcaactaagcaatgccccgagtaccactggcaagaatggaatgagaatgagggcagagcagggaaggacagggagggaaaggagaggtaaaaagagagaaagaaggagaaagagaaaagaaaaggggacttgaggtaatttggcctaaaatgaccgacagatcaaaaaacaaatctttcttgtcactggtttcctaattttctttcagccaccaaagcctactttatcttttcaaatgatggccgatattcccctttactttgaccatcaagttacatattctaagtagtgtgattctcattgtaactggaactcaatcaatgcagaatcatctagttttgctcttttcagccattaatgcctaccttatctatttagccatgttttcaccattttcaactgcatatttaacatttcgcagctttctttacaaagatgtagcttccaataggaataaagaaactgccaacttttttgctggccatgcctgaaagcattaaggttgtaaatagtattttaatcctggaatgaagaataaaaaaaggggagaaacagtactgccatcattgtttgaaaaagaaacttgggtagcacttagaaagttatttaaaaagaaaagagagattggatatacttgtttgggaccaaaatgcctgcttggaaggctgggggaaggaagcaatgtttctcaactaggggtggtcaaccagatgccacctcaagggggcgtctggaaacgttgccggcgggggcaggggggcgggggggtgttggtctggcgtttatgggaaaggctggggatgctaaatgtcctatactgcctgggacagtcccacaaaagggagctttctaccgcccaaaataattaatagctccccaaatagaaacactgttcaaatgacttttcagactaacttctcatgacgctattaggagagggggtaaaggcaccaaatcaccgtgatcttaagtggcctcccgaaggtctcatgtacagcgctctactgtgattctctgcgtggcctttactgcctgacatttacttgggtatttgcttactgcctgtgatcttcccaccagaaagtgagtcccacataaacaggggtctagtcctaattcaacacatcagcgctccctacgtgagcacccagcccgtaacaggacctcagaaaatgttcactgaaacaaactattaagctgggcccccatgcctgcttatgtccccaaccctgcccctacttaccaggccgagggggatatggccaccgccaatgtggggcaagttccctctgccaagcagacctccacgtcgaacaccagggcccgctcctcggggatggccacgggtacggcctccccctcggggccgtaccgggtccagccctccgcccaggcccaagccgggggcttcgggggcagctgggcctgcaacagcaagttggccgcctccaggtagggcaggctctgcttctgggccaggaggcggaagtgctggtccaggttgtccccgtagaggggcggcaggcgcagctccacgtcgggcaagggcacggctggctgcccccagagcccgtgcttctgcaggtgctcgacgctgcggcgcaccgcggcctcgccaggcatctcccctccttgcccgaagatttgctcgtgcagccctctcgagagcatctggatgtccaatgggttgtgccgcagctgcccgccctccgaggatagcacttgcggctgctgaggctgctgttgctgctgctgctgctgctgctgctgctgctgccgccgccgctgcccgtcgctggggtcggacgcggggacggagctggagacccagcgccccggagctggaaccggccctggcccgacggtggcgccggccaccttcctccagagcaggcggctcatggttggtgcagggacccccacgctgggagtcagaacacctggctttgggctccagcttggcttcttttactggctggaagacgtggagagagacacgtcctgtctctgctctcctgtcagtgaaatgggtttgaccatgcctgccttccaccccaaatcctaaaggagacagatgatataaagcgttattttaccatatatgtaataggtgtatccataatcatcattccttgagcatttactgcgtccccaacactgtgccaggcgcttcagttgcattttccgttaagcctcaaaacttgggaaacgtcaatacccctcctgggggaaccggggtccacgcaacttcgtcagtgaacccacgtggggaagccgagggcagcgagtaagagagcagtatctggagtagggcgacgcggttttgaaccccgcttctggctctctcgagctgtgtgaccttgggcaaagctccttaggccctgatatcctattctgtaaaatgggattacggattctgcctgtcacaccgggctgctgtctgggggacacagggcgcctatgtcgtgcggccctgctcttggcaagcgctcggcaaatggtggctgccattaccgcgaccggcgcgggcctagcgtcgagaggtgccagcgcccggattcgaacccgcagggtgggccgccgtcccccgggacccacacccacacccggaccacggcccacccggccgagagcgtcctgcaggaggagtcggcggccacccccgtgcgccccgccgcccgcctgcgcccggcagaggcgccgcggtgcgccctgggactagccgccgccctgctccgggcctcgctccctgactggagagggaggggccgcgccgtcgctcagcgacccggcctccccgccgccgaccccgccggaaacctcggtcctcacggtgcttcccggtctgctgctcccccgaccccaggcccacggcacggcgtcccccttcgcgcggcctacgcagcctcggggtagcgtgtggcctccacccggccggtccgc

SEQ ID NO: 139 - DNA, 33728 bp, Homo Sapiens
ggcgtggcccgtctctgagcgccgcggctctgggcttgcgcgcgcgggagtcaggggtcacggcggcgtaggctgtggcgggaaacgctgtttgaagcgggtgagtagaggggaaaaagggagttcggggcagtgggcctggtagggaacggggcttgagcagccaggcacatagatctgagagacggttgcgagggcaccctttggcccgggggcgcgcaggagagggcaggggccaggggtttcctgggcgagggcgcggggacgagcaggaaaaggccggggtgggggtggaattcctcggcgggcagggggcgcatgcgccgggcaccgtggggcgggacgtggcccgggaggagctggggggactgggtggtgcacgtgcgggcttggtgtcatcctggattcgctgggtgtttgagtactctgtgccaggcacttttctggaagcaggaacaagtcagagaagtccctgtctcgggaagacagacggtagacaagtgatgagttttaatagatcagtaaagcagtgctctggggctgtgagatgctctcagaaggaaactaacgcagggtaacgtgataatgagcgaagagcctgttgctttagctggagtggtccagaatcgaccgctctgggaccctcaagtgcaaagccctgaggtggaaggagcttggcgtatttgtagcaggagccgaggggacgagagaaacacagatgaggtcggagtcatgatggggaactagatcctatagggccttgtaaaacttggtatggaatttctcctttattctaggttcagcggggagccgtgggagggtttgagcgtggaaacaacacgattcgccccatgttttgaaaaactcaccactgagtggaaattggattgtagcaggaataagaatggaaggagggagatctgttaggagggagagcgtcctgcaggcagagaatcaggctccggttacctttgcgggcggagacagggggactggctgatggactgggcgtaggagcaaggggaagagtccaggatgactcctgggtttgtggtttgagcagcaggctggatggggaaggctaagggagaagcaggttggggttgccgctctgaaggcaaagattagtgggggagtgagtgggcagggtttagagcggagccaggagtgggcagggcgatgtcagtgcctcgcctcagcccttccactgaaggaacttgttgccactgtcttctcttttttttttttttttttttgagacagagtcttgctctgtcacccaggctggaatgcagtggtgcaaactcagctcattgcaacctccgcctcccgagttcaggcgagtctcgtgcctcagcctcctgagtagctgggattacggcacccactgccatgcccagctcattttttgtatttttagtagagatggggtttcgccgtgttggccaggctggtctcgaactcctgacctcaggtgatccacttgcctcggcctcccaaagtgctgggattacaggcgtgagccaccacgcacggccgcttctcctccttcctgcacttcccccccacaggtctctcttccccctagagaggttccttccctccccctgaaatgctcttccctctcttatgtgtttctgacagctgctgtttggacaggccctctgctgagcactggggagccaatgatcattcagtttggttggggaaggacaggagatttcagtccagagtgcgctgagctatggcggagcagtgatagtctttgggagccaagagaagaacctgtgcgctcagggaagactcaccagagtggttgatattcacagggagtttcaactcacatgtctttttttttttggtttttgagacagggtcttgctctgtcgcccaggctggagtgcagtggcgcgatctcggctcactaacctccacctcccgggttcaagcgattctcatgcctcaggcttccgagtagctgggattacaggtgtgtgccaccacgcccagctaatttttgtatttttagtagagacagggttttgtcatgttgcccagactggtctcgaatccctgacctcaagtaatcctcccacctcggcctcccaaagtgctgggattacaggtgtgagccaccacacccggcctaaactcatgtcttgaagtaaccggacactgtgcagagtgatgctggagaccccaacttgggcaagatgctgactccttttctcaaggagctcacaggctgaaaggatcccagctctgcattgtgcaataacgaaagtggcacaaggcgttgtgggaaccctgaagggcagctggtcagcttggaggagctaagcctgagctgagtctctggatgcagtggagtttcatgcagcgaacactgcctaaggcctcctgggggcccaccctgtgctgggtgatgctaaggtcccagaggagagtcagtccttgctctgccatccagaggtccctggctggtaagggaggaagacacacacccaggcagtccagagacagcagtcacagaggcctaggggaaggacaaggccgaaagcatgcaggtgagcctgggcaacatagcaagaccctgtctctacaaaaaatacaaaagctaggccgggcgcggtggctaaggcctgtaatcccagcactttgggaggccgaggcgggcagatcatgaggtcaggagaccaagaccatcctggctaacacggtgaaaccccgtctctactaaaaatacaaaaaattagccgggcgtggtggtgggcgcctgtaatcccagcactttgggaggccgaggtggacggatcacttgaggtgaggagtttgagaccagtctggcagacatggtgaaactctactaaaaatacacaactagctggacatggtgggcgcctgtaatcccagctacctgcgaggctgaggcaggagaatcacttgagtccaggaggcggaggttgcagtgagcaagatcctttcccaaaaaaatatataaataaaaataaagctgtgagattgggcaagattggatgaggtcattgaggaaatgagtgtctcactcatcgagaaaactggtgtctggcctgcagcgagcacgtggtgtcattttgttgctgaatctctgttaagtgcttgctaccgaagggtcgtgagaggggcagaggacagtgtttgccaagctctcatcctgtgccagggccaatgagaggggacacacaggggcctttccttcctaatgctgctgtgcctccactaacaagagcccaggttttgcccctggtgacaccgtccctcccaccgcacccccgcagccacagccaactgaccaagggcagccagtcagctccttccttcctcctccagcttcagcactgactctgggctcccacaagcccctgcgcttcctctgtcccacccgggtctctcctcgcagatcatcactccctgtccctctctggctacttgcacaacccgaagccagagccgctaacgacgcttgcttcttcctgtaagtcacacatgtacgcggttgtcacccaaagagcacaaacgcagtcaaagtcttcctcacacaaaaccccctgcacacgctcacggctgcaccactcacaaaaggtggaagcaaccctaatgtccatccactgatgaagggatacgtcagacgtgttctagccatacagcggaaaagtactcagcaaaaaagggacacagcactgacgaaaggccgccacacacatgagcgatgaacacattcagagaaagcagccagacacaagaggctgcatattccaagatcccatttataggaaatgcccagaataggcagatccatggagacagaaagttagatgagtggctgccaggggtgggggcagatgggctgaatgcagggagagagctaaaggatttaggctttttggggtgatgagagagttctaaaattgactgtggtgatggttgcctaactctgaacatactaaataccattgaactatatatactttaaatgggtgaattgtatagtatgtgaattatagctcaataaagcagttagcaaatgaagtcttctaccctgtcccccaggaaaccagtttcttagctctccttatagaatgatgcattaaaagcaaatagatttatacatatgccctgcattacaataaaaaagacgtctacatactccctgcattacaataaaaaagacgtctacatactccctgcattaaaagcaaaaagatttctacatactcttctgcccaccttgtaaatttgttactattttcattttatatatttcccccttaatattttgaaaagtttcaaacctgcagagaaggtacaaattgagtacagtgaacagccatggccctttgcctagattcactggctgttggcatgacacctcatttgctttatgctttatccaagcacatgcatatacctgtaccttttgtcctttttttggctgaactatttgaaagttgtggtcatcatgatacttcacctctgaaaactccagcagttaactctttttttttttttttttttttttttgagacggagtcttgctctgtcacccaggctggagtacagtggtgcgaccttggctcactgcaacctctgcctcccaggttcaagcgattctcctattgcagcttcctgagtagctgggactataggcgcgcaccaccacatctggctaatttttgtatttttagtaaagatggggtttcaccatctttgccaggctgctcttgaactcctgaccttatgatctacgtgcctctgcctcccagagtgctgggattacaggcatgagccaccgcacctggcctctttttttttttttggtacagtattttactctgtcatgcaggttgtagtgcagtggggtggtcacagctcactgcagcctcgacctccccaggctcagctgatcctcagcctctcgagtagctgggactaaaggtgtgtgccaccacaccctgctaatttttatattgtttatagagacagggtgtcaccatgttgcctaggctgatctcaaactcctgggttcaagcaatccccctgcctcggcctccaaatgtcctgggattacagccgtgagccaccgtacctggcctccagcagtcagctcttaagaacagggatgtccgcctgcagaactacagtgtcattgtcatcatcatgcagtttaacatgagacagtgacgttattgaatagacgattcttatttagatctgccacgtgtccctgtaatattcttcaaggctataaataatttcttattttttttttttttccaagactgagtcttgctctatcgcccaggctggagtgcagtggcactatctcggctcactgcaacctctgcctcctgggttcaagccattctcttgcctcagcctcccgaatagctggaattacaggcatgcaccaccacgcccggctaatttttttgtattttttgtagagacggggtttcattttggccaggctggtctcgaacccctgacctcaggtgatccgcccgccttgggctcccaaagtgctaggattacaggcgtgagccaccatgtccagcctgtttttttttttgttttttgttttgttttttttttcttttttgaaacagagcctcattgtcacccaggctggagtgcagtggtgcgatcttggctcactgcaacctccacctcccaggttcaatcaattctcctgcctcagcctcccgagtagctaggattacaggcgcctggcaccacgcccagctaatttttatatttttagtagagacagggtttcaccatgttggccaggctggtctcaaactcttgacctcaggtaatccacccacctcagcctctcatagtgttgggattacaggtgtgagccactgcgcctggccaataatttctttttttcttttcttttcttttttttttttcaagttacatgaagtaaatttattatttacagctaggcaacaagggaaaaccgaagcataggattcattgtgagccaatctcccgagactcaggaaggttgccccgggaggatggagtctcatttgtgtgtaccccatttgtacctggaaagcagaccatcttgggttttatattctggaggcaacatgacatgttgggctaaaatgatgaaggacatcctgtttctaggagggactggaacagagcctgggctgtttcagccagtccctccttatctcaggatattgcattcctagcacattctacagttattcttgagaactattttttttttttttttagtatttattgatcattcttgggtgtttcttggagagggggatttggcagggtcataggacaatagtggagggaaggtcagcagataaacaagtgaacaaaagtctctggttttcctaggcagagggccctgcggccttccgcagtgtttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacggggttgggggtaaggccgtagattaacagcatcccaaggcagaatttttcttagtacagaacaaaatggagtctcctatgtctacttctttctacacagacacagcaacaatctgatctctctttcctttcccatttcccccttttctattcgacaaaaccgccatcgtcatcatggcccgttctcaatgagctgctgggtacacctcccagacggggtggcggccaggcagaggcgctcctcacatcccagacggggcgtcggggcagaggcgctccccacatctcagacgatgagcagccgggcagagacgctcctcacttcctagacgggatggcggctgggaagaggcgctcctcacttcccagactgggcggccaggcagagatgctcctcacttcccagacggggtggcggccgggcagaggctgcaatctcggcactttgggaggccaaggcaggcggctgggaggtggaggttgtagcgagccgagatcacgccactgcactccagcctgggcaccattgagcactgagtgagcgagactccgtctgcaatcccggcacctcgggaggcccaggcgggcagatcactcgcggtcaggagctggagaccagcccggccaacacggcgaaaccccgtctccaccaaaaaatacaaaaaccagtcaggcatggcggtgcgtgcctgcaatcccaggcactcagcaggctgaggcaggagaatcaggcagggaggttgccgtgagccgagatggcggcagcacagtccagcctcagctcggcatcagagggagactgagaggggggagggggagggggagggagagggagaggtctttttttttcccactcccccgctcttgttgcccgggctggagtgcaatggcgcaatcttggctcactgcaacctccgcctcccaggttcaagcgattctcctgcctcagcctcccaagtagctgggattataggcgcccgccaccatgacaagctaatttttgtattttttttagtatagacggggttttcaccacgttggccaggctggtcttaatctcctgacctcaggtgatcggcctgcctcagcctcccaaagtgctaggattacaggcgtgagccactgcacctggcccatcattttacttttttaatccaagttctaacctaggataacacacattgtcatggcaactttttcattttttaagacatgtcttgctctcttgcccagactgtattgcagtggtgcagtcatggctcactgcagccttcacctcccaggttcaagtgatcctcccacctcagtctcccaagtagctgggactgtaggtatgcaccaccatgcttaagtaatttttaattttttgtagagattgactaatttttaattttttgtagaaatggagtctcaccatgttgcctaggctagtttctaactcctggcctcaagtgatcatcccacctcagcctcccaaagtgttgggattacagacgtgagcctcctagcccaggcaacttactttttcatgacatcgacagttttaaagattacagaccagtgttgtcacccctcaccttggattcgtttgtttctttttcttgttttgttttgagacagagtcttgctctgtcacccaggctggagtgcagtggcgtgatcgcagctcactgcaacctctgcctcccaggttcaagtgattctcctgcctcagcctcccaagtagctggtattacaggcacccaccaccacgcctggctaatttttgtattttagtagagatggggtttcaccatgttggtcaggctggtctggaactcttgacctcaagtgatccaccctccttggcctcccaaaatgctgggattacaggcgtgagccactgcacccaggctgtttgtttcttaatgactagaatcagggtaaacgttttcttagacattgtttttcaacacaaaagataaaattgtgagtgcaccactgtgcatcttgctttatctactgaacaatgcctctttgagaaccttccctatcagtacacaaagagcttcctcattcctttacacagttgcatagtattccattgaacggacttaacatatttaaatagccccctgggggaggacagttaggtggtttccagtccttggggatttcaaacgatgcttccggaaataaccttataaatgcagtttttcttatgtgataatatatctacagtgtacgtccctagatgtggaattgagcctccaaacttttatgtttataattgaggtggcatttacatggcgtgccatgcccaggtctccagtgtacagtcagctgtatagtgtgttttatcaccccagaaaccccctcatacccttcccagtctctcctaccctaggagcagccactagtctgatttctagcgctgtagatcactttagtgtattctacaactttgtctaaatggtattgtacaatttttatggaggtaaaattagccattttaaagcaaacaatggctgggcgtggtggttcatacctgtaatcccagcactttggggaggccaaggcaggcagatcacttgagcccaggggtttcagaccagcctcagcaacatggcaaaacccgtctttaccaaaaaacaattggctaggcatggtggcacgcatctgtcttcataactactcaggaggccaaggtgggaggatcacctgagcccgggaggtcaaggctgcagtgagctgagatcatgccactgcactctagcctgggcaacagagtgagatcctgtctcaataaagagagaaagtaataataaagcaaagaattcagttggtacgttcacagtgttgtacaaccattacctctgtctagtttcaaaacatttcatcacccctacagaaaaccccatactccgtaagcagtcactcctcattcccccagtgtgcactttgccttctgcacagcctgctttcaagattcatccgtgttgcatgtctgtcaggagctggcccctctctaatgctgagtgtctgttatgaacctccctgaacatttctaacatatactccatcagttcagaatttttccatgcttatttcaggtctaagctgttgtaccaaggagcccccaaaacacagtggcccaagaaagatacaaattgatttctccacataacgctttggaagataggcaagtgtgcagggttggcagacagctttgctctggaaggttgttggggagcccagtgttgtccctgtccttgtggttggctctcccactacatccatgttccagccactgtgacggggaagagggtgggaggatgtcccagtagctgcacacctcatgatcactctcattcctggagggagaacttagtcacgtggccctcctggcagcgcacactgggaaatgtagcctttggctgggcagcctgtggccactccggacacgcagggttggaggggtgtgttctattgcaaaaaagcaaagcaaagccgggcgcggtggctcacacccataatcccagcactttgggaggccgaggcgggcggatcatctgaggtcaggagttccacaccagcctggccaacatggtgaaaccccatctctactaaaaatacaaaaaaaaattagcgggtatgatggtggacgcctgtaatcccagctactcgggaggctgaggcaggagaatcgcttgaagccaggaggcgaaggttgcagtgagccgagatcagccactgcattccagcctgtgtgaccgagtgagactccgtctaaaaaaaaaataagtaaaataaaaaggcaaaatgaggactggatatggggcaaccgttatgagatccagggatagacagctgacctgctcacctgcctcttcccagccgcatctaggatctgccctaggttccagtaatcccctctgtctcagcctggaccctgggggacaagtactttgtttttgtttgtttgttttttgagacagaatttcacccttgttgcccaggctggagtgcaatggcgcagtcttggctcactgcaacctctacctcccaggttcaagggattctcctgcctcagcctcccaagtagctggggttccaggtgtgcgccaccatgcccagctaattttttttttttttttttttagtagagacagggtttcaccatgttgataaggctggtctcaaacaactgacctcaagtgatccacccgcctcggcctctcaaagtgctgggattataggtgcgagccacggtgcccagctgggtacaggtactttttaaaaacttctttctctgacaatttcaaattaacaggaaggttgaaagaataaatagtgtaggccgggcgcggtggctgggtacaggtactttttaaaaacttctttctctgacaatttcaaattaacaggaaggttgaaagaataaatagtgtaggccgggcgcggtggctcacacctataatcccagcacttcgggaggccgaggcgggcggatcacgaggtcaggagattgagaccacagtgaaaccccgtctctactaaaaatacaaaaaaattaggcgggcgcagtggcggacgcctgtagtcccagctactcaggaggctgaggcgggagaatggcgtgaacccgggaggcggagcttgcagtgagccgagatcgcgccaccgcactccagcctgggagacagagcgagactccgtctccaaaaaaaaaaaaaaatagtgtaaagaacacctgcacgccctttgcccagatcacctgtttcaacattctgtcctatttatgatttgcatggatgtttcttatctcccttctctctgtatacgtacactcactttttacaaagaattcccaataccttgcagacattatggccgtttactcctaaatacttgagtgtgtatctccttagaatattcttattgaaccacaataaagtcacccacttaagtttaacctgcatataaccttgtctaatcaaccagaggatatatactttttttttttttttttttttttttgagacagggtattgccatcttgtccagtccagtcttaaactcctgggctcaagcgatcctcccaccttggcctcccaaagtgctgagattacaggcataagccactatgcccagtgaacttttttgttgtggttgtttttttgtttgtttgtttgggttttaattgttgttgttggtggtggtttttttttgtttttttttttgagacagaatattgctgtgttgcccaggctaaagtgcagtggcgcgatctcggctcactgcaacctccacctctcgggttcaagtgattctcctgcctcggcctcccgagtagccataattacaggtgtgtaccgccacacccagctaatttttttgtatttttattaaagatagggtttcaccatgttgaccaggctggtctcgaactcctgacctcaagtgatccacccgcctcagcttcccaaagtgctgggattacagcgtgggccaccgtgcctaactctagtcaacttttatattgtatatcttgtacattgtatatcttgtcaaggatattgtatatcttgtcaaaatacacccccaaaataataatatatatatatattttttgagatggagtctcgctctgttgcccaggctggagtgcagtggtgcaatctcagctcactgcatgctctgcctcctgggttcacaccattctcctgcctcagcctcatgagtagctgggactacaggcgcccaccaccatgcccggctaatttttttgtatttttttagtagagacggggtttcaccatgttagccaggatggtctcgatctcctgacctcatgattcacctgcctcctaaagtgctgggattacaggtgtgagccactgctcccagcctccaaaataatcttttataggttgtaattaagaaaacacaggccaggcttggtggcttacgcctgtaatcccagcactttgggaggccgaggcaggtggatcacctgaggtcaggagttcaagaccaggatggccaacatggcgaaaccctgtctctactaaaatacaaaaattagccaggcatggtggtgggcacctgtgatcccagctactcaggaggctgaggcaggagaatctcttgaatctgggaggcggaggttgcagccaagatcgcaccactgcactccagcctgggtgacagagcgagactccatctcaaaaaaaaaaaaaaaaagaaaacacaggccaggcttggtggctcacgcctgaaatctcagcactttgggaggccaaggcaggtggatcacttgaggtcaggagttcaagaccagcctggccaacatggtgaaaccccgtctctactaaaaatacaaaaattagctgggcatggtggcgcgtgcttgtaatcccagctacttgggaggctgaggcagaagaattgcttgaactgggtcccgggaagcggaagttgcagtgaatcgagattgtgccactgtactccagcctgggcaacaagagtgagattctgtctttttttttttttttttctgagacggagtcttgctctgtggcccaggatggagtacaatggcacgatctcggctcactgcaacctccgcctcccaggttcaagcaattctcctgtctcagcctcctgagtagctgggattacaggcgcctgctacctcacctggctaatttttgtatttttagtggagatggggtttcaccatgttggtcaggctggtctcgaactcctgacctcgtgatccgcccaccttggcctcccaaagtgctgggattacaggcgtgagccatcacacccggccctgattatgtctttaaaagaaagaaaaagaaaacacaaatatatataagtagcagtctgtatgtgttttgtgttgtgttttgtttgctactgtgggtcctggactcggggagaaagcaggttactataaacggcattttggagacagttggagaaattgggaaaggtgccctttattttatatcaaccttgagtcagtgttaaatgtcctagattgtatcgtactgtgctcggtgaaaggaattccttattgttaggcactacgtgctaacatgtggaggggtatgggatctgcaaggaactctcaaattactcaggaaaagaagtaacaatatgatgtgcataccgcacatgtgggagggcagagagaggcggtgagagagcacacacacgacacgctgaccaccggggagcctggggaagggcatacaggagttctaggcatttgagattatttcaaagtatttaggttggtgcaaaagtaattgcagtttttgtcatttcaatggcagatggcctgggcagatgggtggttggtaggcgaggtatcggagacagaggtttatggaaaataaagagatgtgccaaggccgggcgcggagactcaggcctgtaatctcagcactttgggaggctgaggcgagtggatcacctgaggtcaggagttcgagaccagcctggccaacatggcaaaaccccgtctctactcaaaacacaaaaattagctgggtgtggtggtgggcgcctgtaatcccagctactcgggaggctgaggggagaatcgcttgaacctgggaggtagagcttgcagtgagccgagatcatgccattgcactccagcctgggtgacaagagcacaattccatctcaaaaaaaaaaaaaaaaaaaaaagcaagagatgtgctaaggacctagtgtgatgggagagagggtcggggagtcgacggggctgctgctgcagtagctaacaattgagcgtctggaatgtgctcccaccccactgcctgcagggtgcagagagctatgttagtacagccagtccagagtaggaaaaggctcgtggtcatggtgggtgcatgggatgccatggagacagggtaagaggtgtctccggtcagaacctccaccaagctccaacttgcccagcaggatggatggcaagcggcggccaggcccagggcccggggtgcccccaaagcgggcccgtgggggcctctgggatgatgatgatgcacctcggccatcccaattcgaggaggacctggcactgatggaggagatggaggcagaacacaggctgcaggagcaggaggaggaggagctgcagtcagtcctggagggggttgcagacggtaaggcttggagttggaggttcctgctgcccaacccattgcccctggtcttgcctttggtccaagagtcagctgcaaagctgacctgtgaccccactctggccaattttgaatcctacaaaggactgcccttccaccccgtgcagcctgtgtggcctacagtgattctggccctgacccttgaccctcattctcttccaagtttcctgcctgacccagaccaccacctctgcctggctcctttcagaaccacatgccatcctggccggggaagaccatgactccatgtactccacttccttcccttcccccaccagggcaggtcccaccatcagccatagatcctcgctggcttcggcccacaccaccagcgctggacccccagacagagcccctcatcttccaacagttggagattgaccattatgtgggtgagtttaggggttatgggtgagtgctggggccctgcgctcctggggcagaggccgggccaggtcagcccctctggccctgtgctcctggggcagaggccgggccaggtcagcccctctggctctgcccctctggttgccatagagctgtagtgacagaacagaccagtgggtgccaggggttgtggagtgcgaagcgaaggtgacacagggtcagcttgagggaggtgcttggagcgttgatctgttttgcatacgtagtagctgcagcctgtgcaaggacctctgtgccttaaaattcataacaccagacacataaaccaaaagtcaatttgacttcttttttttgagatggagtcttgccctgttgcccaggctggagtgcagtggtgtgatctcggctcactgcaacctctgcctcccgggttcaagtgattctcctgcctcagcctcccaagtagctgggattacaggtgcacaccaccatgcctggctaatttttgtatttttagtagagatgggcttttgccaagttggctaggctggtcttgaactcctgacctcaagtgatccacccgccttggcctcccaaagtgcttagattacaggtgtgagccattgtgccagcccaatttgactttttaaaagattttttttttttttttttttttttttttgagacaagattttcctctgttgcccaggctggagtgcacctggccaataattttttttttttttttttttttttttaagatggagtcttgctcctgtcgcccaggctggagtgcagtggcacactcttggctcactataacctccgcctcctgggttcaagtgatccttcttcctcagcctcccaagtagctgggattacaggcgcccgccatcacgcccggctaatttttatatttttagtagagacagggtttcgccatgttggccaggctggtttcaaactcctaacctcaggtgatctgccgaccttggcctcccaaagtgctgggattacaggagtgagtaactgtgccccgcctattttttttttttttttttttttttttttgagacagagtctccctctgtcacccaggctggagagcagtggcacaatcatggttcactgtaacctcaacctccagggctcaagtgatcctcccacctcagcctcggagtagctaggactacaggtgtgcaccacaatgtctggctaactttttttttttttttgagacggagtcttgctctgtcacctaggctggagtgcagtggcgcgatctcggctcactgcaagctctgcctcccaggttcacgccattctcctgcctcagcctcccgagttgctgggactacaggcacccgccccaactcctggctaattttttgtatttttagtagagatggggtttcaccgttttagccaggatggtcttgatctcctgacctcgtgatccgcccgcctcagcctcccaaagtgctgagattacaggcttgagccaccgcgcccggcctggctaacttttaaaaatatacttttgggcccggcatggtggctcacttttggaggctgaggcaggctgatcacttgaggacaggagttcaagaccagcctggccaacatggtgaaaccccgtctctactaaaaattcaaaaaattagccaggtgtggtggcatgggcctgtaatctcagctgttcaggtggctgaggcacaagaatcctttcaacctgggaggtggttgaaatataaatataagatatatatatatgatatattctttatgtattaatttatgtataacatatattatatattaatatattttgtagagacaaatatatttatttgtacatataatatgtgtgtgtatttgtgtatatgtgtatatatatatatatatatatatattttttttttttttttttttttttcttttttttgagactgggtctcgctcttttgcccaggctggtctcaaagtcctgggctctagcgatcctcccgccttggcctcacaaagcactggaatcacaggtgtgagtcactgtgcacggccagttgtttttatcttgtaataaaaaagaagggcctccctgtagttgtgctgtggagaatggatcctgggggatgaggctggagatgggaaccaggggggaggctgaaatggacacagggaacggtacaggggcaggagtgccccaggctgcaggccccaaggtatttcgaggctgtggagacacaccttggaggaccctgagaggcatggccgctgtcttaccctgtgaccccacaggcccagcgcagcctgtgcctggggggcccccaccatcccgcggctccgtgcctgtgctccgcgccttcggggtcaccgatgaggggttctctgtctgctgccacatccacggcttcgctccctacttctacaccccagcgccccctggtgagtggcccctacccagcccctccctgagccactggagccccctgcacctctgatcatccctcccacaccaggtttcgggcccgagcacatgggtgacctgcaacgggagctgaacttggccatcagccgggacagtcgcggggggagggagctgactgggccggccgtgctggctgtggaactgtgctcccgagagagtgagtgctcccccaggatcagcgggttggagggtcccctcgggaggccattggctggtcccagcttcttccatccacaggcatgtttgggtaccacgggcacggcccctccccgttcctgcgcatcaccgtggcgctgccgcgcctcgtggccccggcccgccgtctcctggaacagggcatccgtgtggcaggcctgggcacgcccagcttcgcgccctacgaggccaacgtcgactttgagatccggtacggcctctgcctcacttctccggcctctatccccaccctcgggcagcccctgtccactgacccccagccccctccaggttcatggtggacacggacatcgtcggctgcaactggctggagctcccagctgggaaatacgccctgaggctgaaggagaaggtgcagggcttcccagggcagggctgggtggggagctggtaccctgctgccaccgctgacccacccatgcccacaggctacgcagtgccagctggaggcggacgtgctgtggtctgacgtggtcagtcacccaccggaagggccatggcagcgcattgcgcccttgcgcgtgctcagcttcgatatcgagtgcgccggccgcaaaggtctgtccccgggcccgggctcctgcccgcctcattgatgtgccaagtcgggggtcggaaaggcaggtccggtggagggaatggcaagcatgaaggtgccggggcaggagcaccccagcccatgtggccagatggagtgagcacagagggtgtggagatggcctggaggtgagagcagagcaggagccagggtgagccacgtagggccggcaggcagcggggacagccccggggagatggcaggtgcagcctccctgctgtgttgggagtgaggggcaggagtcaggcccctgcatcctcctgcctcgcaggcatcttccctgagcctgagcgggaccctgtcatccagatctgctcgctgggcctgcgctggggggagccggagcccttcctacgcctggcgctcaccctgcggccctgtgcccccatcctgggtgccaaggtgcagagctacgagaaggaggaggacctgctgcaggtagctctcgctccacgccccacaccatttcccggggtccccgccagcctccgcgtcctgagccatcagctcctgggtgctgcgacgcccatgtctgtgggtctgggtgggtgtctgtgggtctgggtgggcccctgtgcaattaggcttgagcacttcccctctgggttctgcaggattttcaggggtggctggggttctagaacattctggaagtaggggaatccgaggcagggcaaccaccagggtgacccaatgtgctcccacccccaggcctggtccaccttcatccgtatcatggaccccgacgtgatcaccggttacaacatccagaacttcgaccttccgtacctcatctctcgggcccagaccctcaaggtgagggctgggcaggtgggaggcttctctcagatgccccaggtgtggcctccgggccctgggcctccttcccactccctctccacatggcttggtgcatcttgctctgtgtgcctcagccgattgcctgcaggggcagcctaggcctggtcctgccctgctccaagtcgaaaaagttactgtggcttttatcagaggcaaggagggcgttacggtggagtaagagaaggctgtgcattcaaggtcggcctgaagcttgcaggggttcaacaagccatgaagcagccactgaatcccagtcttcctttaggttatatcagcataaggaaaagaatcataatggaggaggaggggggagtgtgttgactgatggggcaaattccggatgcttcttgagtctgcatgtgtgtaagggtggattcctctgcccgagttgctgtaacaaagagccacagaccaggtggctgaaaacagcaaaaagtcattgtctcaccgtcctgaaggctggaaagtccatgaccaaagtgtcagcgggcctgcttccttcgggggctgcaagggaggactggttcacggcctctctccttggcttgcagacggccatcatccccctgtgcctcttcacaccgtcttctctctgtgcgtgtctgtttccacatgtcctcccttttttttttttttccaagacaaagtctcgctctgtcgcccaggctggagtgcagtggcgcaatcttggctcactgcaaactccgcctcccaggttcatgccattctcctgcctcagcctcccaagtagctgggactacaggcgcccgccaccacgcctggctaattttttgtgtttttagtagagacggggtttcactgtgttagcgaggatggtcttgatctcctgaccttgtgatccgtctgcctcggcctcccaaagtgttgggattataggcgtgagctactgcacccaaccccttttctctttcttttttttttttttttttttttgagacagagtctcgctgtgtcgcccaggctggagtgcgatggcacgatcgaggctcactgcaacctccacctcccaggttcaagcgattctcctgcctcagcctcccaagtagctgggattacaggcgtgagccaccacgccccgcaaatttttgcttttttgttattgtttcttgagatggaatttcgctcttgttgcccaggctggagtgcaatggcacgatcttggctcaccacaacctccgcctcccagggggcgctggggtgtagaagtgattctcctgcctcagcctcccaagtagctgggattataggcacccgcttccatgcccgactaattttgtatttttagtagacagggtttctccatgttggccaggctggtctcgaactcccaatctcaggtgatctgcccacttcggcctcccaaagtgctgggattacaggcgtgagccaccgcgcctggcctatttttgtttttgtttttgttttttttagcagagactaggtttcatcatgttggccaggctggtctccatcctcacctcaggtgatctgcccacctcagcctctcaaagtgctgggattacaggtgtgagccagtgcacctagcccacatgtcctctttgtgtagtgacaccgtcgtgaggtgagggcccaccccagtgacctcatcttcacttgaccccctgcgaagacatatttccaaatgaggttacattctgaggtgccgggggttagggcttcaacatcttttgggagaacatggttcagcccttaatgagatatattgccttattttcctgcttttctctatgtctggccagcttggtaatggaaaaacaaaacaggctgggtgtggtggctcacgcctctaatcccagcactttgggaggatgaggcgagaggatcgatggagcccaggagttcaagaccagccagggcaacatagcaagaccctgcctctattaaagagaaaacaagaaaaaatccattctaaaatacagaacaaactcttaggacccccagtgtatattccacagcgtggcgctgatgcccgggccatggtactcctcctccccttccctgggtgtccctcaccctctgccctgtccccagctcaggcttcttctggcctcagtctcccccaggctgggccccagcaccctgcaaggcctcctgcagccaggcgccctccagcgccctcagcatccatctcagcccagctccacgccgcctcctgcctctgcccccacctggccgcctgctcacagtgtccccaaatctcttcctgtttcctgcctaggtacagcccgcagacactgggctccatccttggcccccagtccatcagggcccctgactctcgctatcccagccttggctgcagcttagtccttactccggactccctccccagtctccagccacccacacccagccccagaccgtctttctgcccccagggttgctctcgaccccctagggttgttataaggatgttgtggttggtctcaatctccgttcttcaggcttatgtgacggggacccgcagcctgctgcacaccctgcctctcctcctcaggtacaaacattccctttcctgggccgtgtggccggcctttgctccaacatccgggactcttcattccagtccaagcagacgggccggcgggacaccaaggttgtcagcatggtgggccgcgtgcagatggacatgctgcaggtatgggcgggaggtggggtgtgtccctgtccttggaaggccactgcccaggcccgcagcccaccagcccacccacccacctaggtgctgctgcgggagtacaagctccgctcctacacgctcaatgccgtgagcttccacttcctgggcgagcagaaggaggacgtgcagcacagcatcatcaccgacctgcaggtgcctgctgcctccctgacctctcaccccaacctctgacctccacctcacccttccccggcctctgacctcaacttcacgcccccacgtctgacctcactctttgacctgctgttatgacctgtgaccttacctgacgcccactttttcctgacctctgaccccagatttctctccactcctgtgacctctgtcactatgaccttgtctctgctttcctggcctgaccacaggtccacggtggccttcaggctgctccctcctcctccctctggccctgtggactccctggcccccaaccctacctccatccccacccagaccctgacgacttggagggccctcctgcccgcctcacctcccaggccctccccaggctacctcaccctgacccccacttccttctcctgctccacctcccacccccaacccctggtccctgaccccatccgtgcccatccccagaatgggaacgaccagacccgccgccgcctggctgtgtactgcctgaaggatgcctacctgccactgcggctgctggagcggctcatggtgctggtgaacgccgtggagatggcgagggtcactggcgtgcccctcagctacctgctcagtcgtggccagcaggtcaaggtcgtatcccagctgttgcggcaggtcagtagccgagacttgtcctcgccaccccccaccaggcacgtctgtggccccctccaggcaatggcatcctggatgcactttttctccccactcccaatccgcacggccccacctatacccactccatttcccaccttctcccctcccaggccatgcacgaggggctgctgatgcccgtggtgaagtcagagggcggcgaggactacacgggagccactgtcatcgagcccctcaaagggtgaggccccaggctgggtgcagtttttacctgtaatctctgggaggctgaggtgggaggatcacttgagctcaggagtttgagaccagccagggcaacatagcgaggcccctgctccacaaaatttttttatttttatttatttttatttttatttttttgagacagagtctcgctctgtcacccaggctggagtgcagtggcgcaatctcagctcactgcaagctttgcctcccgggttcacgccattctcctacctcagtctccacagcagctgggactacaggcgcccaccaccacgcctggctaatttttttttttttttttttttttgcatttttagtagggacggggtttcaccgtgttagccaggatggtctcgatctgacctcgtgatccacctgcctcggcctcccaaagtgctgggattataggcgtgagccaccgtgcccggccgaaaaaatttttaaaaattagccaggcgtggtggtgcatgcctgtaatcccagctacttgggaggctgagctgggaggatgatgagcccaggaggtggaggctgcagtgagcgatgattgcgccactgccctccagcctgggcgacagagcaacaccccggccctaaaataaattaataggccaggcacggtggctcacccctgtaatcaatcccagcactttgggaggtcaaggcaggcggatcacaagttcaggagattgggaccatcctggctaacacggtgaaaccccgtctctactaaaaatacagaaattagctgggcatggtggcgggcgcctgcagtgccagctactcgggaggctgaggcagaagaatcgcttgaacccgggaggtggaggttgcagtgagctgagattgcgccactgcactccagcctgggtgacaaagcgagactccgtctcaaaaaaaataaaataaaataaaatagtagattaattatatatattatttttctttttctttttctttttttgacacagggtctcactctgtcacccagggtggagtgcggtggcatgatcttggcttactccacctcctaggctcaagcaatcctcctgcctcaggcccctgagtagctgggaccacaggcgtgcaccaccacacctggctaatttttaaaatttttttgtagagatagggttttgccatgttgcccaggctgatctgaaactcctgagttcaagcgatcctcctgcctcagcctcccaatgtgctgggattgcaggagcgagcactgctcccagccaatgaatgattttttttttttaaagggtgaggccacaagacagggcgggggcggcatgggaactcctagccctgactcccggccgcggctgctcccctcccaggtactacgacgtccccatcgccaccctggacttctcctcgctgtacccgtccatcatgatggcccacaacctgtgttacaccacgctccttcggcccgggactgcacagaaactggggtatagtgcccaattcagcatgtgtcccccgaggcccatctgggccttcccttggggggctcagtctggtggggggcataggcacaggcccagagatagtagggagtggaggggtgcttgaggggcctgcgtgtgctcatggccaaggccaggaccgtagggcagaggtgggctggagcaggagggtggccggcagtcaccccaacatcttccaacccagcctgactgaggatcagttcatcaggacccccaccggggacgagtttgtgaagacctcagtgcggaaggggctgctgccccagatcctggagaacctgctcagtgcccggaagaggtgagccctggagatcgcctgcttggagctcagacctgttggggcctctgggcaatccctgtccctcactgggacaccccagggctgcccagccaccctgccctcagctgtgcgtgaattagcacaaggcatcccctcctggcagcttccttttgcccccttggccagaagcttctgtgcagtgcacagtacgcccaaccgtacatggcactcacttccagaaaggagccctgaccaatgcccaggtgccgcctgagtgtgctttccccgtgttccctcgcagggccaaggccgagctggccaaggagacagaccccctccggcgccaggtcctggatggacggcagctggcgctgaaggtgagcgccaactccgtatacggcttcactggcgcccaggtgggcaagttgccgtgcctggagatctcacaggtgggcactcgggcccctggaaggcaactgggggcaggtgggccccctgtgtaggagaccagggctccatgtgggggacctgtatccagaggactgggcaccccaactcactggccttctagagagaggatgccaatgtggcttgagcaattggtccattccttcactcagcaaatgcctactgagcacacactgtggtcagggctcactctgtgccctggggatacagaggggaacaaaatggatgagagctcctgtccctgtcatcttgcagcccagtggggacactgacaggtctgtgtaaacgtgtttaggacacaagtggcgctacgagctttgcagccggataaagcaggaggtgcggactgtcggggagtgatggggctgggcgggactcacccctctcaataggcgacgctcacacagaggccaagggacgtggggagggaagccattcaccgtccccacggcagcgtcccggtctgcctacccacggcagctctgctgcttgaacagaaaaacagattctttgaaaccacagagggcctgagtttccgagattgccaagctggggtcagtgccccagctcctggcatatgagggcctcggaagggtcttcctgtccagccttctcccctgggacttgagtcttggcccattccaggccagtagttgtgctgctctgcttggttacctctagccacggggagctccctctctggctgggcactgcgccacttttcacagggctctgggtggaaggcttggatgaattctcagtgggtggggcctttgcacacacccacccacccgcagttctgggggtcccaaagaccacttaggttcagtgattcactagaagtactcagagagcagaaaagctggttctcatggttatgatttaatacagcaaaaggacacagattaaactcagcaaaagaaagaggtgcacagggcagggtataggagggaccaggcgtgtcttccagttgtgctctcccagtagagttgccaggctggccctccttcctcccagttttgatgcgtgcctgcacacatgcagcattgccaaccagaggctctcacccaagctttggggtccagggtttttcttgggtgtcagtcctataggcatggagcaccctgtgactggccttagtgactccatcatccccaggcccctcagcaacccccagaggtcaaactgatactgcatggcccagggccctaccataaaccatgttagtgtcaactacctggtgtggttcaaagtcccaggtacacaaacaccttttttttttttttttttgagacagagtctcactctctcacccaggctggagcgcagtggcacaatcgtggctcactgcagcctcaacctccgggactcaggtgagcctcccacgttagcctcccaagtggctgggactgcgggcacgtgccacctatttttgttattttttgtagagatagggtctcgccatgttgcccaggctggaacagagacactgttatcaggcgggatattctaggggcttagactaccaggagccaggcaagagccagacctttctttgcacaaagtgaatcgctcactgcatgctcccaactcccctctgcctttcacagtccccggctgcctccccagcctccttggtggaaaggggtggctgtgtggacatcaggctctagccctgaagcagaggccaggccaagagagcacagcttggccctcccctggggctgcctcttaccaatcctgtgtctctgtcttttctctctcagccgcttccctctgtcactgttctgtttctgtctcttgacctctttccttatttctgtctctcaagcttatgggagcaagaggtggaataataaaaatgcaatgaattggctgggcgcggtggctcacgcctgtaaccccagcactttaggaggccgaggcgggcggatcacgaggtcaggagttcaagaccagcctggccaacatggtgaaaccctgtctctattaaaaatacaaaacattagccaggagtggtggcaggtgcctctaatcccagctactcgggaggctgaggcaggagaatcgcttgaacccaggaggcagaggttgcagtgagccgagattgcgccagtgcgctccagcctgggcaacagagcaaaactccgtctcaaaaaaaaaaaaaagtaatgaattacagtgttcacgcctgtaatcccaacactttgtgacactgaggagggaggatcacttgaggccaggggtttaagaccagcctgggcaacatagtgaaaccccatctctacaaaaaatacaaccaaacaaaactagccaggcattgtggtagctcatgcctgtagttgcagctactcaggaggctgagacgggaagatggcttgaacccagcagtttgagttacagtaagctgtgatggcatcactgcactccattctgggtgacagagttgagaccctgtctcttttagtttttgtttgtttgttttgagatggagtcttgctctgtcacccaggctggagtgcaatgccacaatcttggctcactgcgacctctccctcccgggttcaagtgattctcctgcctcagcctcctgagtagctgggattacaggcacccgccaccatgcctggctaatttttgcatttttagtagagacggggtttcaccatgttggccaggctggtcttgaactcctgacctcaggtgatccacctgcctcggcctcccaaagtgctgggattactggtgtgagtcaccacgcttggcctcctgtctcttaaaaaaaaaaaaaaattgaatcatttcaggaaaagattacaaaggaaagaaaaaggaacataggacaggtggaacaagtaaaagctagacagtaaagtggtagacgtaagcccagctatatcagtaattacactaaatgtaaatggacaaaatgctctagttagacagatttcctgactggatccacacaaacaaaaacagaagaatcacacccatctctccttggtgtccccacccccagcctcaggtttggtggtggtggtggtggtggtggtgttgttgtttaagtattttttagttttgtgtgtgtgtgtgtgtgtatttttagtagagatggtgtttcaccatgttgtccaggctgatctcgaactcctgacctcaagtgatccagccacttcagcctcccaaagtgctgggtgtacaggcataagccaccacgccagctagttttcttaactctaaaataagacagtgggtttctcaatggtttcttagtcagggtggtgccaccccctgctctggggggcatttgtcaatgtgtaggtagggccagttctggtggtacagggatgggggtggcactgctggcttccagggatggggctggctatgtcggtggtcctgtaccatagagagctgcccagaatgtcagtgtgagggaaacactgggccagtggcctcttcaggccgcagtctttccagcatgcatttgatgtagtcacttccttgtgcatgtccagaactctgagccagggaacccacttctttccacctgaccattgaggagccgccttatagtcccattttgcagatttgggaactgaggcccaggaggggcagagtggcttgtacataagcctatgccactgggaaatggcagaggcgggacccctcccccgccggcccacgttcactgcacatggcccccagggcttcactccgcatgattctctccccgacagagcgtcacggggttcggacgtcagatgatcgagaaaaccaagcagctggtggagtctaagtacacagtggagaatggctacagcaccagtgccaaggtcgggggctgcccaccgctgccctgagatgggcccagggcaggtggggggatggaagccgggccggacccccatgtccccgtgcctcctggtcacaccctgcccactctcctgttgcatccttgggtcccgttggcattagccacctgccaccccccgacaccagtagttgacagaagggaccctgcttctcacatacacacatccccaccgcccgcaggtggtgtatggtgacactgactccgtcatgtgccgattcggcgtgtcctcggtggctgaggcgatggccctggggcgggaggccgcggactgggtgtcaggtcacttcccgtcgcccatccggctggagtttgagaaggtgcgtggctgggtcaggggctctgcatttaggtgccctcatcagggtactcagggtgtcccgttctttgggttcacaaaagccacagtgtgaagggatgttgctgcttagattctcctgaggctggggccttggtttgggaagcctccaaggccttgggctttgttaccctggatggcatctgttctttgaaaaccctgtcgctgtccctggttttgaggtgtcacagtgtccctggttttgaggtttcccagtacctgtcagatgtggagctgccctccacgcagggaccctgatgggggtgcaccttagatctgtgcaccattgcccctggccctctgagtgcggcacacttggtcccaggaaaccttgcaccatattttcttttgaagagtctgggtctcgctctgtcgcccaggctggagtgcagtggcgagttcacagctcactgcagcctccaactcctgggctccggcgatcctcccgccttggcctcctgagccgccacgcccagttctcacactgtactgtttccccgtggcttaacgctctctcgtgccaggccttggacttggagcctcgcagagtggggaggtctctgcctcagggctcacccagccgtagtttctcctctctttcatgggatgcttcatcgactcgcctgtctggatctcatgttttagggactatctggatttatcccagtctctgtttcagattggggtctctggtgtgggggctctggcattgccgaggggcctcaggagccacttccagccatacagtgtctcggtccatcccaccaggctcagggcacggctcccatgtcctcaaactgcgtctgggaccctgtctaccttcagtttctggggggcgtctccagattggggcttggcctcctcaggctcagggtcttggccatggctccctcccaggtctacttcccatacctgcttatcagcaagaagcgctacgcgggcctgctcttctcctcccggcccgacgcccacgaccgcatggactgcaagggcctggaggccgtgcgcagggacaactgccccctcgtggccaacctggtcactgcctcactgcgccgcctgctcatcgaccggtgtgtggggcctcctccctcagactcagggggctgggccccaaacccctcctccctcagacccaggagtctaggccccagcccctcctccctcagacccacgggtccaggcccccagccccctcctcctcagatcccggggtcagggcccccagccccttcctctcttagatacaagagtccagacccccagcccctcctcctctgggaacacaggtgtcaggcccagctcttcctcggtggtgaagcagtggaaagagtcggcttgggcagctgtgggttcaggccctgcctctgccactctgcagcctatggtaggaagggcccctctctgccctgagcctcagccctaagagctcatcctggtctccagccctgagacccgtggaggcaccagcctggccctcagtgccttttggtgacgctgtgcggcccgctctcctacagagaccctgagggcgcggtggctcacgcacaggacgtcatctcggacctgctgtgcaaccgcatcgatatctcccagctggtcatcaccaaggagctgacccgcgcggcctccgactatgccggcaagcaggcccacgtggagctggccgagaggtcctgcgcggggcgggtggcctggccagaaataaccccctccttcctgccagctgggcccacttcctacaccctcgcccccacccccgccacccacctgccctcacccacccgccaccccatctccacgcaggatgaggaagcgggaccccgggagtgcgcccagcctgggcgaccgcgtcccctacgtgatcatcagtgccgccaagggtgtggccgcctacatgaagtcggaggtcaggcccacctggctgcctgctcccgcccagccccctcgctctcacttctgctttccgagatgggcgggcctgcgggaagggtggggcctcccgtgccctgtggggccctgagaaccgccccccatggcagcctgggtgtggcctcggccccctctggaggtcccccctctattctgacccctcccttgcttccctatggaaggggccccagtccctcccctgtgcatacagctccccagccgggggttcccttggattcataatcctccagctctacccccacccccagtgacccacatcttagccccatgacctctgacctcctgaccccttcctcatccttgcttccccttgtgaactctgacccttccgtggtgacctgagagccctacagactctgtggcccagagactccgtgacctccgaccccatcccagacccaggccccccccatgtcacagcccgcaggcaggcctaggccctaagccccaggccccatgaccaccccgtgtccaccccggtgccctttccctggctgcccgggtgtgactgccatgtggccgcaggacccgctgttcgtgctggagcacagcctgcccattgacacgcagtactacctggagcagcagctggccaagcccctcctgcgcatcttcgagcccatcctgggcgagggccgtgccgaggctgtgctactgcgtacgggggcaccaggggactgggggcaccctgggggggcagaggagatcaccggcccaccacctgcctcctctcctgcagggggggaccacacgcgctgcaagacggtgctcacgggcaaggtgggcggcctcctggccttcgccaaacgccgcaactgctgcattggctgccgcacagtgctcagccaccagggtgagcggccctggccactgggcccccactggccctcaacctgctctgccgtcaccccagatcctagacacccaccccatcggctggcactgccacccagtgggcccagggcccctgggtgggtggcccctgtctccaccccccacagagggtcctcggcccccaccccgggagttccccaggggagttttcccagcacacttgctccgttgttctccagcctctggggactttcagaagctgggattggcagtgggcagggatggggtggcccagttcctggctgggccccagcacttgggctgacccgcctccccacaggagccgtgtgtgagttctgccagccccgggagtctgagctgtatcagaaggaggtgagagggccgggaggtgaggaggggccaggtggggaggcgggggcgccctgctcagccgctgccgtccccaggtatcccatctgaatgccctggaggagcgcttctcgcgcctctggacgcagtgccagcgctgccagggcagcctgcacgaggacgtcatctgcaccaggtgtgtgccatgtcccgaccctgggctgccccgccccttcccagctcccaggcctgtgggttgtggacccaacctctgactccaaggcctctcctgagcatcctccccgcccatccccttccagctgtgagctgtcctgagcctcagtgtccttgtctgaaaaatgggcccatcccagccccccagagggggtgggtgcttagggaggcagcgcccggcacccagtgttgcccgggaaacggctgtcctcccgacacacccagccagcctggccccctccccagggcggggccgggctttccccagggaacgggtaggcggggtgggttcccacgccaggtgacaggtgatatacggccagccatggccctgcacctcgccaggcacccgctgttatcggctccccccccccaccccccccgtgcctgctgagcaaacagcccgctgcgggagggggcgggtgggctgggcagcaggcggggaccaaagtcctgggaacagcccccacccctctcccaggctgggcactgggccttggctggtcctgaccctgcccctgcccccacccgcagccgggactgccccatcttctacatgcgcaagaaggtgcggaaggacctggaagaccaggagcagctcctgcggcgcttcggaccccctggacctgaggcctggtgaccttgcaagcatcccatggggcgggggcgggaccagggagaattaataaagttctggacttttgctatatg

SEQ ID NO: 140 - DNA, 63763 bp, Homo Sapiens
gaaacttcagtatgaaatacaaataaaaacaaagtgtagcagcgatggcctcagacagtagatggcagggacaaactaaggctggctctgggccaaagacacgagcctcctggggagcctgtggggccccctccctcctgtgaggctctcgtctggggtgtctgcatttctgatttacatttcatacttgtttggtgccctgtgaaattggcctttcttctttctgcttccagctggtcctgtgtggaggtgaaggacaagggctgcagtgagccaaaagtgaggtgcacagaggtcttgttttcctgaggctgatagagggttccctctagacccggctccaaataagcagggctcacaagccaaaatccagattctcacgggttagggtctggattcctggggaaaccagcccacaaactgctcctgtgaggctgtggggccagcccatttctccatgcaaacaggtgagactccagccccaccagggccttgggaacccgtctcgtctcagagcccaatctcagggagccagaagcccccaggggcttttcctccctctgggaggcaggacaaagaactaggggcacctagaggacgctcccaccccaccaggtgtggtgcaggaagcaacagaggcctggaaaagcattcactgcgtgagaaacggcgcccagggcactcgcagcctcgctcacggcctgcttcttcaggtgctctggcgaggccagggccacatcctgctcccgctccctcctgtgacgtctgagctccctgaaaatggttttctttggtttcctccccgttccctggcctggggtcacaggtttggacagtcagggtggtcagtggtctggtcactggaagcacggggatgtggccttggcatcaggaggcctggcacggacgcagaggcacccggggcccggggctggctaatggcccagctgtgggttcttctgcagcagccactccagggtctccaggaggtacgacatgccgtagtgctgggcaatgttccggaatattccgatctgttccatgaagacctgcaggaataaacaggcacagtgagaccccagtccactcagagaggaggccaaggaggccaggctgagccgaggcagatgagggagagcccacctgggtgtggatggtgagggcgaagtctcccgcgcagctgcagtacacaggcatgctggtctccttcaccccgcggcacttcaggcagacctgaaagggagcagccccgatgggcgccagccctcccgcgctggccagacctgcctgctgcttcttcacaggctcgcgagacacattcgtgggcccatcagtaagcctcgagcccctgctgtgtgcagccagccctcggttatgagtaaaatgcacgacctcatcccacggtgccagcgccttccctacacccaccctcgctgtggatgttccaccccagatgcccagtcctgaggcctcctccaggccctgctcactccctccatcctgcaggcctgaacgccgtgcaccaccacacggcagcttggcgcgtcccccagcctctgctcagatgcccctcggcaagaccttcctgtggccgagctgtgcaactccctcttcctcctttccttctcttcacacttgggagtgtctgcctccttccgctagaacgaagcacccacaaggccagctcttgacccaaggcaggtgctcaaccagtgtggacagaacagtccatcaggctcagggcatggactggtctgcagggcaggccccttggaagacaccagggcgtgcctcaggacctgcacacaccccggctcccgggagtgcacagaaacccccctgtggactccagggcacacgggcaggcggcatgcacgactcaccaggtcctgcagggtgaaggccatcagcttcttctgtagaacttccaccagcgtcatctcgatggcagaggagtcgtagggcgcctgacagttggagcagagccactgaggcaggaccgccccatcctaggcagagcaagagtgcgagaggtcaccagcccagcctccagaccacagtgccatgggcaggatctcaggagaggaaggggctgtgagaagcgcctggtgacgggcgagtctcctgagtgcagctgcacgcactctggcctcccacctgcacttgagcccttcctaggacaacattccgaacatggtgtggggaggcctgggaaggggcctgttgccaatccatgtgagtcagaggggcagcaggtgtgacccacagagctggagctgcagaagccctcaagacaccgcagtgccctcggatgttctgctccacagtgaagggcccgctggagctcagccgcacctctgagaaggaagagtctttacacaggtccaggtcgcggcagaagttacagctgcggcagatgacctcaggaagcacgtaggagcggcaggggtctcggaactgggcctcctcggagaactcgccgacatccaccaggcgaagcaggtctcggttcagcttattcacctggtttgtgatgttggtgtccagggacagcacctgcagagaccacagcccacatcgggaaggagctcccggggcctccctgctgctctgtctggaccagaaccctctggaccttaggctacagtttcctggtgtcctttcctcccttccttagtccctttagacgcctcagctgacttctctacattagcagttttccatcggtgaggacaggcttccctggggaatttactaaacatttaaggaagaaatgctgctgattctacacagtatctttcaaaacactgaagagagagagcactcaacccattctatgaggccagcatcccctgatactagaaccaaagaccgtactaagaaactacagaccaataacagcctgagcacagacacaaaaatgcgcaacgagatattagcaaattgaatgcaagatcgaaaaaaagaatacataatccagaaagagactcacatagataaggttactaagttatggaaaaaggtacaaagatgattcgatagaaaaagaatagtcttttcaacaaatggttcttgaatacaagcgtatcttggagatatggcaagttcggtttcaaaccacctcaatggactaacatcacaataaagcaaatcacacaaattatttggtttctcagtgcatataaaagttacatgatttttggctcacgcttgttttctcagtacatataaaagttacgtgatttgtggtggctcacgcctgtaatcccagcactttggtaggccaaggcaggtggatggcctgaggtcaggagttcaagaccatcctggccaacacagtgaaaccccatttctattaaaaatacaaaaattggctgggcatggtggcgggtgcacctgtgatcccagctacctgggaggctgaagcagggaatcgcttgaacccaggaggtggaggttgcagttagccaagattgcaccactgcactccagcctgagtgacagagtgagactccatctcaaaaaaaaaaaaagctatgtgattttttttattttgggacaggatttcactctgtcacccagaatggactgcagtggcacaatcatggctcactgcagcattgacctcttggggctcaattgatccttctacctcagccttcccagtagctgggacgacaggcatgcgccaccatgcccaggtaatgtttgtaatcgttgtaaagatgggttttgccatgttgcccaggctggtcttgaactgctgggctcaaacagtcaacccaccctgacctcccaaagtgctgggattacaggtgtgagtcactctacccagacaaaacttaggtttaccctatactgtagtctattaagtgcataacagcattatgtctaaaaaacaatgtatgtaccttaattttaaaatgttttattgctcagaaatattaacgatcatctgagccttcagtgagtcgcaatcgttttgctggtggagggtcttgcctcaatgtaaacggctgctgactgatcagggtggtattgctgagagttggggtggctgtggcaatttcttaaaacaagacaacaatgaagtttgctgcatcaactgactcttccttccatgaaagactctgtagcatgtgatgctgtttgataacatttcacccacagtagaacttctttcaaaattggagtcggtcctctcaaattctgctgctgctttggcaactaagtttatggaatattctcaatcctttgtcatttccacaatgttcactttcatctcaagaaactactttttggccaggtgcggtggctcacgcctgtaatcccagcactttgggaggccgaggtgggcagatcacaaggtcaggagatcgagaccatcctggctaacatggtgaaaccctgtctctactaaaaatacgaaaattagccaggtgtggtggcgcttgcctgtagtcccagctactcgggaggctgaggcaggagaatggcgtgaacctgggagggagcttgcagtgagccaagatcgcgccactgcactccagcctgggcgagagtgcgagactccatcttaaaaaaaaaactacttttttgggctgggcgtggtggcttgtgcctgtaatcccagcactttgggaggccaaggcgggtggatcacctgaggtcaggagtttgagaccagcctgaccaatatggtgaaactctgtctctattaaaaatacaaaaattagctgagcattgtggcgggcacctgtaatcccagctacttgggaggctgatgtaggaaaatcacttgaacccaggaggcggaggttgcagcgagccaagaccgcaccactgtattccagcctgggcgacagagcaaggaggctccatctcaaaacaaaacaaaacaaaacaaaacaaaacaaaacaaaacaaaaaactactttactgctcatccatgaaaagccactctttatctgttaaattttgtcctgagattgcagcaacttggtcacatcttcaggctccacttctaattctagttcccttgctgtttccaccacatctgcagtcacgcctcccacaatagtcttgaatccctcaaagtcatccatgagggtcagaatcaacttcttccacactcctgttaatgttgatattttgaccccttctcccatgagtcacaaatgttcttaatggcatccagaatggtgaatcctttctagaaggttttcaatttactgtgcccagttccatcaggggaatcactatctatggcagctatagcctcatgaaatatatttttaaataataaacgttgaaagtcgaaattgctccttgatccatgggctgcagaagggatgctgtgtccgcaggcatgaaagcaacattcatctccttgtacgtctccatcagagctcttgggtgaccaggtccactgtcaatgagcagtactattttggaaggaatctttttctgagctgcaggtagtggccttaaaagactgaatgagcagtggcttcgacttaaagtcaccagctgcatctgccgctaacaagagtcagcctttcctctgaagccaggctctgaggcctcctctctagctatgaaagtcctagatggcatcttcttccaaaagaaggctgttttgtctacacggaaaatatgttgtcagtgtagccaccttcgccaatgatcccagacagatcttctggagaactcgctgcagcctctccacccgcacctgttgcctcatttgcccttttatgttactgggacggcttctctccctaaaccccatgaaccaacctccgccagcttcaagctttccttctacagcctcctcagctctcagccttcatggaactgaacagagtgagagccttgctctggattaggctctggcttgaggggatgttatatctggtttgatctatccagactcaactttctccatatcagcaacaggatgcttcacttctttatctttcatgtgttcactggaggagcacttgtaatttccttcaagaacctttcctttgcagttgacttggctaactggtgtgagaggcctagctttcagcctgtctcgactttcaacatgccttcctaagtttagccatttctagctctttatgtaaagtgagagacgtgtgactcttcctttcacttgaacacgtagaggccattgcagggctattaacttacctaatttctatagtgttgtgtcaccgggactggggaggcccaaggagaaagggcgagatggcagaatggcccgtgagtggagcaatcaggacacacacaacattgatgaagctcattgtcttctatgcgcacggttcatggcgccccaaaacaattgccatagaagcatcaaaggttatcacggctgatataataatagtggaaaagtctgaaatatcctgagagttaccaacatgtgacacagacacagtgagcacatgctgttggaaagatgagacttgctcaagacaagattcccacaaaccttccatttataaaaatacaggtaaccgcttcgaagcacaataagacaggatatgcctgcaatcagatatcccatgcagaaatatggacttggatctacagcatgcacattgtataaaaattaactcaaatggataaaacctaaaacttcaccaaagaggacagacaccaggacagcaaagaagcccattaaaaaatgccccacagccaggcgtggtggctcacgcctgtaatcccagcactttgggaggccgaagcaggtggatcacttgaggtcaggagttcgagaccagcctggccaacatggtgaaactccgtctccactaaaaatacaaaaaattgggggggcgtggtggcaggcacctgtaatcccagctaaccaggaggcagaggttgcagtgagctgagatcgcgccactgcaccccagcctgggcaatgagagtgaatctccatctccaaaaaaaagctccacatcattagtcgccagggaaatgcaaatcagaaacacaatgcgataccactacacacctactggaatagctgcaatttaaaaacccaatgataccaagtcctggtgaggatgtggaacagcaactcttgccacacactgctgaggagaccctgacacggtgcagccacttcagaaaagagtttggcagtttcttatcaagttaaacaaacacttaaaaaatgacctcagagaattgaaatttatgttcacacaaaaacctacacctacagaatgtttacagcagctttgttattaatcaccccaaagtgaaagcaacgcaaatgtccttccaccagtgaatgaaaagcaagctgtggtttgcccacacaatggacactgctcgcaacagaaagggagttctgatacacacgagcgcgtggatgaaccaattccaggtgtgttttgctaagaagccacatccaaaaggctgcacaatgtctctacttatgtgacgctctagaagagaaaaaaaatgcagggacggaagacacaccagtggctaaagggtgtcaggtgaggagggcagtgcggggaatgttttcgggcggtgactatcctgtatcctgctgatgatgatgcaattccattcacctaggaaaaatcacagaactgcacgccacagagtacattttactgtatataaattacaccttaataaaaatgaatttaaaatatgtaaaagtcaataaaggaattaaaatggtgagctaaaaacacttcttcaccacaaccagaccttgaggctgtcacctgatctccagcgtaaccttagccgtgtgtgagatgcagtttgctgggaaggctgagtgaggaaatggacagtgaagcactctgctctgtaagggctgacacccgcggtcgttatctggtaatattatccctccttggactcagcctgcctttcccagaaaggcctcagcatccgagcaagctctcatctcatcagctctgggtcctggtccagcctactggtctccggtgacccatcctcccagccggtggcactgggtgttcggctgtgccttcaccaacacaccaagctcaccccccagggcctttgcgtcttccctcctcctgcacctggtcccagcgcccctcacaggctccatccccacagcacctgcgcctctgaacggccctctcccttctcgggtcggctggcagcagacaggccccacaaggcaggacctttcctgtcttgctcacacctgagcacagatgccgcaactgtggctgcatgtgacagggacatgataaatgttggtggaatgaacaagtaacttacacctgctcctcaccttgcacacgctggcaccctgaccctacacatgtaggtacctcccccttgcacagctgaaagcctcatcctgcattcattaacatccttaccatgcacaggtatgtcggtgtccttatcttgcacacatacgctagcacgttcatggtgcacgcattacagcctcaccttgcacacagtaacattctcgccttacacatgtacgttagtgtcctctcctcacacgcacgctggcactctcaccttgcacacgtatttgatgaactccagggcagggttattgagcagcaagtgggaaccggggaggacaggaaacatctctgagagctcagtggagttccgagagcctgtgactttcttctgaatcttctgagtgatggtgaagaagctctgagtgagctcatttgcgacataatcctgagagaaggtgatcattcctggaagtataaggatgctgagggaggggtctgggacctgtctggcactggggacctcccacctgggggactggcaccggggaccacccatggcacacagaggagttaggtcactggcacatggcagtggcctcaaaagacaaaagactgctcaccgggaagggctccgaccgccccctcggcctcctgggagagctggctggcccccctcctcctcacgggggtgctccctggagcactgcgcctcagcccgtccttcatgcagtggtacacggccacgatgtacgctgtggagaggcacacacaccacaggccctgagtcgggctgctgcaaacaccctagaatctgaggggacccatggctggtcagattgcctcacagatgaggctaaaatgtcattgttaataattttatctgcagcctttagatgagctaaaagtaaattagagaagtgagaagtggaaatgagaaggaacactcgctgacacctgagttcattgtcagagagaaaactgtataaatggggccatgtacactaagcctctcactgggtagcgcgtgaaagacagctcccaacacaagcaaaggcagggcccctggcatcagcaagcttctccaaaaactactccgggcctgtcacctggcacttacccttttttttttttttttttgagacacagtttcattcttgttgcccagactgtagtgcaatggcgcaatctcagctcactgcaacctccgcctcctgggttcaagtgattctcctgcctcagcttcctgagtagctggtattaaaggtgtgcgcaccacacctggctactttttgtatttttagtagagatggggtttcaccatgttggccaggctggtctcaaactcttgacctcacgtgatccacccgcctcagccccctaaagtgctgggattacaggcatgagccactgcgcccggccaacccggaacttttcaaaagagacatagaaagttgcaagagagaactgagaaagttaaagactcaaggacaagtagacaaaaatataaaatgatcatcaacgaaggcctctgtgaccgcatccacctgtgtgtgcacatcacaacctgctgtttttacttagggcattctttaacttagggctgtcaactacaaacagtgcttcctcgatacacttcatctgcacactaacctgcatagcttgatttgcaaactctaagcctgcagacccaaaccaaggcataggaactcccccaccagaaagttaggcctcacagaccagccagggggcagctgacctgacccagggctttatcttcagctactgaacgtgcacacacacaaatgttccctgggaatgtatgtgactgagttaccgaatcagatggcgggagcagagctaggaaactcctcaatgacacggccaggggcagccgctccccatggagtttcctgagagcaaaggctggagggaagacagtcacccctctccgggccctccagtggaacatgcctggagcctggagaggaggcccctcggctcacaaagtcccaactgctgggcaggctccgcccgatctgattttccctgtctcccttcttgcgataccatggcacaggagccacatctactaaccatgagtcccttcagtgggggctgcgcagccctgggctctgggcttacctgaaacaatcatgaggaagtagttctggcaggaggctgcctgtggcaaaaactgcaaaatgttccagttgttttccagtaaatcctccacgttggattcctccgcctcttcctcctcctccccatctctttcctcctcatcgtcctcattttcctgctcatcctctgctccccctgctttctgggagtcttgctgtaacacatgagacaacgcggctgtgtttgcaccatcgcggcctggtagaggggtaggatgccacagcgaaggctcctccaacctgggtccatctgccccgtttgaccagaggccttcctcgcagtcaaggcatcccctggagcctgcgtgaatcccccagggtggctcccagtacaaagtgctttgtgggaagcgcctggcacacagaagtgctcgtgacctgggactgtgagcttcactctgctcttccagagttcactttaattgttgaactcccaccccccaaggacgaaagaaccagccagagcttcccggtgactgttctctcctctgagtccatgaatctcctgggacggcacgaccccatcacagacccagcctcccgcgcagcctgtgttcgtgccacggcaccatccacgtctgtgtagacaccgacacccactgccacctgccctgaccacacgctgatcccctcctcagagcggtctacactgcctgagtttctaccctcccactttgttctgaatcccttcaatcagggtttatcccccaactccaaccagaatcgctcccatccaggtgtcctgggcagtcttggcttcatcctgccagctcccagaagcgtctgcgtccttacaaagggctttccctctgacatctgagcccctggctctggtacccacagcttcctctcagtccactatgagggcccctgtggaggacacaggcctcctctcaacccacccagccactctctggccactcctgcaccagctgaccacccacgtctcaaccttgcaaacaccatgagccccagccagacgtgaccccttccccagactgctcccgacagccacctccactcacccacagcctggcccgcacctgggcatttacacacatccgatccgctggccccttggctccacttcaaagcccacccaggcccttctcaccaacctcgctgcccagcatctccctgacacaggcactaaccggctttacctgcctgtgccctccaatggtgggttatccacatggggccaagaaagctccaacatcacccacacagaagctcccatccccacgaaagccgaggccctgccctgccatgcccaagttgcctggctctgtcagctctctgcctgcatctgcaaccactgctccactgacttgtgctttgcctccctggtgtccatccgctggaggcgccttatgctcgcacaactatggtgcacttcatcagctctcggattccctgtcaccacctcatgggcctccacctccctgttgcccacggcaagccttgccatcaccagggctgacgccacactccacactgacgtgcttgtctgcgcatggtccctccccgtgttcatgagggcaggatgcgggtgcagtgtctgctgctcacggccaggcccgccggggccctgagcactcagcacttgctgcaggaatgaacgcgacccccaaagctggctcgggtgccacactgcagctcgcttaccagtccacagtgaatacgagatgaaacttttcctttgattccgccatagttagatggatccatccagagaagaaattcccagcatcgagagaaagaaattgtcagagaatggaaggtctcctttgaatggatgctgcagaggaagcattgaagacgctgcttcagtgaaatcgaccttgttctcaactttcctttatttccccttgtatctatctgtaccctccacttacttaacactgaatttgaaagttcattcagaccacatcatccctcaggcttcctggggaaatgtggtaaacgtaaaactaaggaggcccaccaggcccctgggagctggcgccacaaagagagctgggtgcctcctcgtgctggggatggcccacagggtgttctgcctctgctctgcggccttaggtgacctgcacctgctggtaaccaaccacagtgcttcccactgccaagctcttttaagctatcgtcatccttgtcactcctcggttaagcctccctagcgctgacccaatcctctgcacattagatccatttaaggaaaaaaaaaaaaaaaaaaaaaaaaaaagaacaggccaggcacggtggctcacgcctgtaatcctagcactttgggaggctgaggcaggaggatcgcctgagttcaggagttcaagaccaccccaggcaacgtggcaaaaccctgtctctacaaaaaatacaaaaattggctgggcatgctggcatgcacctctagtcccatctactcagtgggctgaggtgggcagatagcttgagcccagagtttgaggccgcagtgagccatgactgcaccactgcactccagcctgggtgacagagcaagaccccatctcctaaaaaacaaacaaaaccccaaaaaatggaagaataaacaaagaaagagaggaaggaaggaggaacatcctaaatcacagtttcaaaatgcagctgagtagcccacatcgcagctcctgcaggagaactttatgttctccctaactctgctcttcgcgctaaggaagaatagcagcctgtttctcgacatgagcaaccccggcctcctcaggtacagggcacccctggagctgcccatggccaacgtggggagaggcacatccttcccattatctcagccatgctccgaaatacaattctagcccaagccagctttcccaggcacacagcgtgaccactgaccatcaaggctcatcttggatagacataaggggccacagtgggtctgcaggaggacaacagtgcttttgtgtttcaaattaatccagtgcatatggtttgattaggaatgaaagtcttataagctctaccttcctacttctcagtgataaggcctattatcaatttagtgtcagccttttctgcagcgcccccagatgctacccctgtaaccatgcaaagatcagacccatgcagactctctgtgcctccacaagcaactcccctctgtgctcagaaagggctgcattcatccccagggtgagcgcacctaggagggagcttcctactatcagttgaacaaaagttgctggtggagatttttctgttgctttgtcttctatttagatttaaatagtgctgagtgtgtgagaagcacagcaaggcctaggagggaacctcaggaacatggcctggaaggcaggaagtcaaaaccacaccaggctctgacagctgagagctgtgcacacctgagcacccgggaaccacaccactccactcgccaacactgacgtctatgaaaaggcttacaacgtcaacacttacggggtgcatatattcagggcaccttgaatctgtgccctgaatatccatggggaaaaaaagcaaacaaacaaaaatcactgtggaaccttcttagcaaaggcaggccacttcctgaacttgcccaactcaagctgcacagctgagtggcctccgatctgctaccgcgcacaggtggcggtaacccccttttcacgctgctcagattcaccatggtgagtcctgcacttctaacgacctcccagcccacccaggaggagagctggcacctcagggggtcattttagcatccctctcaaagccacagtgctgcgtcaccaggaccagccagccgcacctgctggtgatgtactccacgtaagcgatggcatcttccacacggcgcttctttgtacagaggatgatgcggttgaagttggcgtagatgactgatgaccccaggcgcttgaactcagcgatgagcctgtggagcaagttgagagtccgtggtggagacgccacagtcatggagagccagagggcacccagaaaatccaagagggaaaagagctgagggtcctgaagcagaaaagcctccgagatacactagaacccagaagctaatgaagagcaaagatttctgcatggcaaaaatccaccacaaacaaaggcaaaagataaccaaaaacaggaaaaaattagcaaattcttatcacagaaaaatggcaactttttgtatggagacaactcattcgatatttaataagagaagaaccaccaaaactacagaaaaatagacaaaggactagaagagaaaattcgacttcattcattgtaagaatcctaagttaagactgcaccaagaagcacttttatcccagcagttgggtaataatccccggccatgttggtgaggcgcggccagggaagaagtgtccacaaggggcctctgtggggccgctctggtgaagtccatcaaatcaggattcatcccgagttacaacacctctgaggcctgcaagagggctacgccccagcaattaccccacggatctatctgcatgagctcatgcatgaagcctctcactgatttgctatttgtaacaacggcacaaggctggagagaggctaaatgttctttcatatggcatgtcctcacacagatctcctgacacaggcatattttcactaaaacaacaaggcacacagcaatacaatgtgtagcatgactttgtgcaggaaaggggcaggagaggaggtgccacctagtgttctctgcaggatgtgcaggcgacgctgcagcagcagctgcgtgtttctctgggatcctttggattgttatgctccacaaactcagaaatacactacttatcccagaggcactggctggccatgtctctggttctggggagtaagggaccagcccagctgaggacgcggtggacagcccagggaggaggagcactcactgcaggaagagcttcttcatcatgttgtggagtgtgcggtgcagggcagggtcatgaagcagagaggatggcgaccgaagccagcggtagaagtgcatcacctggttgtctgcatagatgttgtggtactgggtgatctccttcacccagcccacgaccatgctcttcaggatcctgaaagagaaggtgcacgacaccctcgtaccctcagcctcccacgctgctgccacgcgggacgctccaactgaaatgggcacaggttttccctacacggctgggtccaaatccgtcactgtcgcctccccttctcactgtccccaccttaagtcacggtccaaatttcatcccttcaccctcatgcctcatctgtttcttcccatttcattccttaaacttgttcaggcttcaccgcatcccaaactctgtgtgttctaaagcaggacgggagggcagcacagtacaaagcagcaagtgtgtgacgggccggggaccctgacaggaaggacacagcaaagccactgcctagacatcagaacaccacactaggccggatgcagaggctcacgcctgtaatcccaccactttgggaggccgaggcaggtggatcacctgaggtcaagagtttgagaccaacctggccaacatggtgaaaccccgtctctattaaaaatacaaaaattagctgggctagtgcatgcctgtaatcctgctactcgggaggctaaggcaggagaatcgcttgaacccgggaggtggaggttgcagtgacccaagatggtgccactgcattccagcctgggtgacagagtgagactgtctcaaaaaacaaaaacaaaacaaaacaaaacaaaacaaaacaaaacaaaacaaaacatcaccatacccacatggccccagctggtcagaaacaagaacttagaggcctctctcccgcctagcaggctgggccctgccttcccgccacttcctttaaatggaccattcaggcgctcgcccgtgaactaacacatgcctacaccccattccctcacacgcctagctgccctgggcaccctccctgtctgactcttcagtcctgccttgcaggacccagggatggaggatggcctccctactcacggcaccctccctgcccaggagctgtaaggaacacatctttgcacttgttccctattgtggtggtgactgattttgtgccttccctctgaagaggcaggggctgccctgggctgggtcttccctacgacactagggggaacacaaggctgggcccctacaccgaagcaatggtcaggcaggtggtacctagacacaggtcacacaaaagccacaagggcgtgtgccagtgtaaacaagtttcccgttccggggggccctggtcacaggccagacagctaggcattggccagtgcactgtacacgccctgtctggcccccttcacttcccatggggcagagatgccagctgctctggtactggaaccccaattcagctaaaggattccaaaactgcacatcaccctactgaagaagcgggaacttcaatggggtcaagaacagaatgttacaagagaacctacagaggtccaagtcccattcctaaaactccctttcatcacaaactcttcaataatttggcaaaccccacattctccagagcggcagtttgggtatctgctgttggactccttctacctttcaggcctgggctactgtctctctgccaagaccctgctcccggctcccaactgcctccctgcctctttccaccagtcctctccctgcctcatttcccagctctggcatgctccctctccccttttgtatggagtcattaaaactacagctgagtacaggctctggaattacaaagacttgtttttgagcacctacccttccattcatttgtggtatgaccacaaaggcagcccctctgacctcagtttccttatctgaaaaacagacaataaccgctccccgtccctgggctgatgtggggacagaggcagaatgcgaagtgctcggcccacctcctggtacacagcaagcattgcccagcatgaaccaccgctggtgggtaatgcgagtagctgccctcaaccatgctctccgcagactgatggctcctgaccctcaaccacgccctctgcagcagaccgacggctcctgacacctaagtgctgatgcctcacacatcatactcagtagagctggctggagatccctgtgatgtacctttggtcacatcgaaaagtggccctggttagaaagactctgtgtgaagtacctctggccacagggaggtcagaggcagcacactgaacagtcgccagggaccaggccggacccccacagtggtaaagacaatagactatggaaaactcgccacacagtggtctctggctctgccattaagactaagggaagcccaatggaccctgtcttagaccttagctttccaaattaagggcaaaggataagacccttctattagtaacactccttcccagagagggtggcacctgaaggtgttagagcacagggctgtctcatcgtagctggccggggcactggcagcctgaccacccgtgatcatgtcctccagggaggcctgctggatcacgtcgaagctgatccccatgctgtcggccccctccatgtcgttgacatggtgagactggagaatggtgttgacggccaggttctgaaggtccagctccacacacactgcacaggaagacgccatgctcagccagcatcctgccagctccagcaccaccagccccctgggcctgactccagccaccaccacctccagaaccagcaacagacctgcccacacccatcctcacacctgccaggctattcagattcccgagggcacaggaggccccacctggaccttgaccccaggaccgtctcctgcagcctcagctctgacctgcgcggtcgaactctgagcccatcctcggcactattgccttgagaagatgtcacagaatggcagaaacaccagccaggtctcatgggcctcgtcctcccgcccacttacctgtggagtaacagcctgaactgttgatctcaacagtggcttggtcatcgaactccatgacaagacagttgtcatcagcctcctttccacccaggtcagggcgggctgtaggggacagccagagcaggtggttgtggcgctggaggtggcgggcaaagaagaggtcggagccgaatgtggagatgtcctctggtaggttcccaatgggaatgtgaaagtacctgcaccagggcacaggtcagcaccggggcacatcgccgggtcacagagaccaccgaggccggctctgcctggggaccactggcccacaacgacagtactgtgctcacctgctcatctcgaaggcctgcgacaggcaggtgtccaggttgaggtagtgacggatcatgcgccgggctccatggcgctgccagtccaggaccccatagttgatcttgtcagccacacagataggcaccagtgggaattcctccaagacaggaatttcactggccagcctcttcagctcccagctggactgaacagcgatgagtgtgggcccccggcgctcctcctgggtcaaggcaaaatggaagaaaagacctgggtggacccagcctcaaagaagatggggctcacacagcaagaccccaaccactctcaccttgtaggcgagcaggaatcgctggatggctctgcagatggtcttcaggtcagtttctgcccgaacttcgaaggtgtgtttggggggtggcaggagctcagggcccaccttctccaggaggaggccgtgctctgctgagtacagggcgccaaggctgggcatctggttgctgcgcacctagaccaacgcaggccacgtcagcctccccctgcgcaggaggaagtgggggcagccctggggcagactccaccactgccacggcactgccaattcaatcacgacaagcactcatgggcaaaggcccttgaggacaagacctggagggcctgggcaccctgggagatgtcctccttccccaaaccctgccccagccaatgtgctgccatggagggcccaggactcacagtgtccagcacaaagacggatgccctgcgctgtgaggggatgaagatcccgaagagcgctttgtgggcctgtgcgtggtggtacaggtagatatggcggatactccctggagaaggaaacaagaccgtcaccccagatgtgtgggaggcaggcacatgatgggcggctggtgcaggccatacctggttccaggtagctgaactgggccagagagcgcatctccaggtgctcaagagcaaaggtctctgcttcccagcctgaaaggtgcctcaccagctgtttattgaccacacacacacagcccaggtgcaccagggcccggaacagtaacggaacctggaagaatcgggcagacaggccggcaagggctggatggtgggggctctggctgcccacgtgacttctgcccgggatgtggctgtgcccctgcagctgcccggcccactgcccaaaggccacttttggcagacacactgctgacattcacctcacctgtgggaacgagtccactgtcgctgctgttccccagcccacaccctgggcgggtttctttcctccataccaccctgctggagcctcccccagttcagtcgagggtggctggggagtcacctgagtctcatatacgccctcgatgtctggcgctgacagctcagcgttgatctcgttgatgtgttcctggtacatgtcctctggcactgaatactcatagagattgtagaccatgttggagcgaggaaggacccgatttacctggcgagaatacgacgatgatctcgtcactgggcgtaagtggtaatgtctgtggtacacacacaaagcacacgctattcggagtcctagacttctggtgcccctagcgacggggtacacccaccacgccacagtccacctctctcaatgattacaactaaaaactctggatgtaatttttatgttatttatttattttttacagacagggtcttagtctgttgcccaggctggagtgcagcagtgtgatcacagctcactgcagcctccaactcctgggctcaagtggtcctccagcctcagcctcctgagtagctgggacaaggaacacaccaccacggatggctttttttttttttttttttttttgtagaaaggaggtctcactatgaggcccaggctggtctcaaactcctggactcaagtgatcctcccaaatcgctggaactgcaggtgtgagccactatgcctggcctctggacgcaattttgaaaagcaacctgcagcctctgagaatagacaagagctgtcagaatacagcagtcaacactgatctggggaggttcccagttcatcttcctccattctctcatgggtttaacctgagggtgtagatggcaaaaactgagagaaatcacattttcctagtcagagaaacggaaagagagcccctgggggagccagagtgtgtgtgtggggtcctggggggctctgggagagctggagaggggcaccctagcttcgtgaatggggtcctggaggggtctgggagagctggagagggggcaccctagctccctgtgtggggtcctgggggggtctgggagagctggagaggggcaccctagctccctgtgtggggtcctgggggggtctgggagagctggagagggggcaccctagctccctgtgtggggtcctgggggggtctgggagagctggagaggggcaccctagcttcctgtgtggggtcctgggggggtctgggagagctggagaggggcaccctagcttcgtgaatggggtcctgggggggcctgggaaagctggagagggggcaccctagcttcctgtgtggggtcctgggggggtctgggagagctggagaggggcaccctagctccctgtgtggggtcctgggggggtctgggagagctggagagggggcaccctagcttcctgtgtggggtcctggggggtctgggagagctggagagggtgcaccctagcttcctgtgtggggtcctggggggtctgggagagctgaagagggggcaccctagctccctgtgtggagggctgggggaattctggagaggcgagctggagaggggtaccctagctccctgtgtggagggctgggggaatcctggagaggagagctggagagggggcaccctagcttcgtgtgtggggggctgggggaatcctggagaggagcaccctagcttcatgcatgaaccagcagcacaagtcccaggctcactacgagctgcacttgcacaggtgacccaaaacaacgcagcagaggctctggaggctgagctgacattggaagctttgcacaaagaggcaaggaagagcttgggcactggaattaaccgtgttggttgttgctaaaacaaacaaacaaaaaaacctgacacgctaaaggatttttaaaaatacccaaagtctcaaatatgtaaaatgtccaggttgcaataaagcgttatttggcgtaacaacaaccaggaaaatctgaataattctcaagcgagaagagaaccagtagggttagatttttccagtaacatgaaattagaccgacacacacacacacccacacacacacacacaaaatcaaagaaatgaaaaattatgttctggtaaatatgaactggaacaattagtgtaattgcactttttaaaatgtatatatttcctggctgttcactgaaggaatctagatgaaatgataccccttgagctctaagcttggtttctcaacataacctctcaacgaggctcaggctctttagaggaacagctaattccacgtctggaagttcaaggtgagcctggcctctcttagtggccaaaaagcaaggaagttttcaaagaccaacagggcatgtcaaaaggactcaggtgccagcttgaagggatctggccagcccaatttgggataatttgagtctcaagaagatattgaccaccaaagagtctactgtctggttccattaatatgaagttctagaaagtcacatgcacacagttacagaaatacagaaatcaggccagcagaaggttgcacagggggacaagagcaccctcccgggtgatggaaacgttctgcacctgggtgggggtgtgggtgacacaggcatagtcatgtgtccaaaaacccaatcaactgcacatttaaaaatctgcacttaactatatgtaaattacagtaagtcctcacttaacatcaatggattcctggaaactgtgatggttaagtgaagtaatgtatagcaggtcctcaaataacatcattttgttcaacattctttcttcctttaaaaaaaaaaaaaaaaaaattctggggccgggcgccatggttcaacctgtaatcccagcactttgggaggccgaggtggatggattacctgaggtcaggagttcgagaccagcctaaccaacacagagaaaccccatctctactaaaaaatacaaaattagccgggcgtggtggtgcgtgcctgtaatcccagctacttgggaggctgaggcaggagaatttcttgaacccgggaggcggaggttgcggtgagccgagatgcgccactggactccagccgggcaacaggagagaaactccatctcaaaacaaacaaacaaacaaataaaaataaataaatttaaaaaatactctgtagagaaggggttttgccacgttgcccaggctggtctcgaatgcctgagctcaagcaatccaccagcctcagcctcccaaattgctgggattacagatatgcagcactgcgcctggccaacacagtttcattatagtttctgagaagaaaaaaaatctgtttcattatacatcatcttacttagtcatttcacttaaaattgcagtttctaaggacctatcaacaacataaagtgagggcctaccgtgtaccttaacatacctaacgtgtgtgtgttgggcgggatttggctacggttgatgttaaaacattaaacactgaggcaggaggattgcttgagcccaagagtacaaggctgcagtgaggcaagatcatgccactgcactccagcctgggtgatggagtgagagaccttctcaaaaacagaaacaaaaaagttaaacaaaaatcctctaatccatagtaatactttaaaaagagaggaaaaatgaaaggaataaacccattttgccatgccctaccttgaaaattaaaaataatttaaagggaaaaagcatttatcttgcttaaaaaaaaaaaaagcgtattatccctctcgtatcttgctttttaaggaatagagttcatttctacctgatctgcacaaagctcttcgttataaaggaaacagctaatacacacagaggaacagaatctgaagatatcatcctggagccccatggaccccacgagacatggatgctgacaccatccagtcaaacgttgaggacagaatattcacacagcgccagaacctccctcgagatgagctgatagtcataaagggaaacatcccaaaagttagggcacttccacacggccacagcaccacagcaccacgcatcgaaaggaaggtgtagaaaccccacagtcccacctgttctctgtggtctcgatgcctctgcgtccgctttcctcttgttatccgcccacctcggtctcccaaagtgcggggattacaggtgtgaaccaccacacctggctctgcgtctactttctatatgcacattctactgaatcacctggctggaatcgagtttcaccttctccagaaaacctccttgtgtaggtacaaatatgcacacctcatctccccaactacgtgtcacttcttacgtgattcacagcatccagtcaagaaatgtgctgagccgacacattaacaacggggagttcgggtggagatgccatctaagagcctcagcgcactcatggccacatgaaaaccctcgcagtttctgcaggtggaagaagcccagcacaaagacccacctactgtagggttccatttacatcaaatgcccaaacaggcaaacccagagacaggaagtggatcagtggctactgagggctgggggaggatggtgacaggtaagggatgccaggtttctttttggagtgatgaaaatatccgaatgggggggtgaggggagggggaatatcaggataaacagctaatgcatgtggggcctaatgcccaggtgacggggtgatgggtgcagcaaaccaccatggcatgtgcttacttatgtaacaaacctgcactttctgcacatggatcccagaaatcaaagtaaaattaaaaaaaagaaaaaaaaagaaaatgtcactattgactggcaatagtcatgccactaaaagtcattgaattctgcactttaaatgggtgagttggatggcgtaactttacatcccaataaagctgttaacaaccaaagagcctacggagacagagttcacaatctctaaccaatgccacttggtttgtccccgcaacatggacctcgcgggcagacaagctcatcgtgacaaggacaccagcagctccattcccggcactcgctctgccccaggctcggtgctcagcgctcacacacgttgttttgaggaattcctagaacatccccataaggtactgaggagatggaggctggaggccaggctagatcatgggaaagccacctcaggctgcccagatgactgcagaggcagcaccagctcctccctaccttgcgatacgaagcaccctcctccgctttagcgactcgctggttcacgtagaacacacgggggatgctcagcctgatgcagtgcaagtcactgccaacgagcgcccacagcctgaacaggccggcctggctggtctcgctgatctgaaaggccacacggacatacagcacatcacaggacacactggaacccacagacggggccaccttccaggtagcttgcagctcccagcacagggccttaggcctccctacgatgggcaggaaactccaggcccactctaaccctcccatcccagacctcagggcccagctggacaccccctccctgggccatcagcagagccactgccctccccttggatcaaggtctatacctgcacaatctgccacggaaggtccaggatgctgcgggcagttcttcgcaagaagctccccagccccgtggcaggaccatcccggatggccccgggcctgagcacaccctctgccgactccagacgctgcctcttcctgcgggcgaggcgctgccgggcctgcagctgccacttcttcttgtggaaccggagccagacaagccattcctcctgggatggatggtgagcacagccagtgtgcaagtggtgagatgggaatgcccgccatgactttctcacaagcagcctccctaggggtcaggacgcatctcgggctccctgggctgtgcagacccctcagagacagacagtatcacagctgtgtgccttacctggctggttcccagggcgggaggctgccccaagatttcctgccagggcacagtcggcgtgaggtcctgggactcctcctggctctcccaaagaactcgcttcctcttcacagtgacaggggctgctgggtgaggcagctttacgaggccgaagtcctccatgtcaggagcacttggcctcggactgtcttctgaggcctcggccatcgtgacctggaaagacccagtgaagccttaaatctcaggatctcgggctgcgcagggtggctcatgcctggaatgccagcactttgggaggccaagacaggagaattgcttggggccaggagtttgagaccagcctgggtaacagcaagaccctgtctctacaaaatatattacaaattagccaggcgtggtagtgcgcctgtagtcccaagctacttggtaggctgaggcaggaggatcacttgaacccaggagttggaggctgcggcgaactatgatcacaccactgaactccagcctgggcaagtgagaccttgcctcataaaaacaagcaaacaaaaatctcaggatctcatccccacaaattctacttctcgaaatctagtataagtatatcacctgaaatgggatgttcgtttacacaagtttattgaacctttaatagtgaaggccgggtgtggtggctcacgcctgtcatcccagcactttgagaggctgaggtgggcggatcacttgagcccaggagtttgagactagcctggccaacatggtgaaactccgtctctacaaaaaatagaaaaattagctgggtgtggttgtgtgggcctgtggtcccagctacttgggaggctgaggtggaaggatcacttgagcctaggaggtaggggttgcagtgagccaaggttgcgccactgcattccagcctgggcgagagggtgagaccctctttcaaaaaaaaagtgaaaagatcaaaccgaaaaataaaacgtcactcaataccaccaataagtaaatctttgcattttgccatgtttgctccagaatgctttttgtaagaaagaaaatattgcaaataatgggtacagccctcttctgtctgcccccacacacctttaaatttttaccacatgtccacagacacatgccacagctgtaagttttaacctaaatagtaacatgtgggacacatctgactgcaacttgtttcctttttttttttttttttttttgagacagaatctcactctgttgtccaggctggagcgcaatggcacgatctcatctcactgcaacctcgcctcctgggttcaagcaattctgcctcagcctcccaagaagctaggattacaggcacctgccaccaagcccggctaattttttgttgtatttttagtaaagatggggtttcaccatgttggccaggctggtctcgaactcctgacctcaagtgatccacccacctcagccttccaaagtgttgagattacaggcgtgagccacatgcctgtccctgcaacttgtttctttattcagccatgtatttttgagactgacaccgggtgaaacatgcacatatggttcgttcattgtaactgatgtgaaatgatttatcatataaacacatcagcctacctacccatgactttgcaaatgaagaatgacaagcgcctactttttcaaaactacaaactgtgactcaatgaccatctctgtatgtgttgcctggtcccggagaacaaccacctccacctctagcaccagggatttcctacttcccacaatcttgctacttgatgccaccacacttacttgccttcagtgtgacctgctatctaaatacatcatgctgcatttacctcatcaacagtaaggctgaacatcttggccctgtgcaggcagctcccaaaatggcccaacgacccccacttcctggtgttcacaccctgtgtgactccttccctgagtgggggtgggacccggtgacttgcccgtaatgaacagattccagcaaaagtcatggaatgccactcctgagagcagctataaaacactgtggcttctgcctggctggcactctctcaaaagtccagtgccatgctgtgagctgtcctgtgaagagccccatggagcaggggactaaggataacgtccagacaaaggccaaggaggaaccgagtcctgccatccccatgggagggagctcggaagtggctccttctccagtggagccctcggatacacgagtgcatttaagttgctaagttttggggttacttgctatgcagcaatagatagctaacacgtttatgagccatttctaacttttatacattctaaacatcttcaaaatgtgactcaggcctttgtttcatggtgacttctgtgctacatgtaagtttgtgtgtgttgacttcctatcaggaaagttttcaaacatacacgaaagcacagtaatgagctcccatgttcttatcaccagtgtcaacaattatcaacattctgcctttcttgtcacagactacacaagatttaacttttaattaattgatcattctttccctttgtgatgtttttcacatgtgccttaaaaaagcccttcccaccccagcatcatagtctcctgagttgtttaccaaagattgtagtttcctttttttttttttttttttttttaaagacacaggggtctcgctctgtcacctaggctggagtgcagtggtcatcttggctcaccgcagcctcaacctcccaggctcaagtgatcctcccacctcagcctcccaagtagctgggactacaggcatgcacaaccatgcctaatgttgtgccggattttttttgtagagacgagacctccctatgttgcccaggctcgtctggaacttctgggctcaactgatcctccttccttggactcccaaagcactgcaattacaggcatgagccatcacactcagccttagtttcacactcagtgtgatacaacaacttacttctccaaatatgaaaaaccattttcaccagcatcactcactgcagtccactctctccttaacgatctgtgacctaccaacttccgactaacaggggagtctgtttctaggctcccaatcggctctactgctctcctctcatcttgtcaagatgccatgatagtgtgtctcgttacatagtaagatcaacgtgccctccttattcttcaaaattctttggttattcttatccttaccctttatatgaattttaggattcgtctgtcaagttctatccaaaaagcttttggcagattcttttttattggaattacactgaattttatgaattaatatggggcaaactgccatattttaatactgagtcctttcatctgtaaagatggtacctctttttgttacttaggtaaatttttatatgttcaataaagttgtgtataggccaggcatggtggctcacacctgtaatcccagtgctttggggggggcccaggcaggaggatcacttgagcccaagagtttaagatcagcctgggcaacagtgagacccagcctctacaaaaaatacatagccaggtgtggtggtgcacacttgcagtctcagctactcaggaggctgaggtgggaggataacgtgagattaagagttctaggctgtagggagccatgatcttgccaccgcactctagcctgggtgacaaaggaagaccatgtctcaaaaagaaaaaagttgtgtaattttttctgtaaaagtcttacacacattgttaccatgaatttattccttagtacattatttattgctattgtaaatggtatctttcaaaaaatattttgtttctagtataaatgaaagcaatagacttttatatcttaccttggtatctaattgttgctgaaatacatataagttaacacaaaatctaggtttccttacattttctgttaacaaattacatcgcctgtaaataataagttgatgtctcccttttcaatccttaattctttttctggtttaattatgctggctaggatctccaaactgttttgaacagaagcagtggttaacaggcatccatttcttactccttacttcaatgcttccagtgttttgtggttaagtatgaggtctgctgttaggtttcaagaacactttatcaggttaagaaacatctcatctattctgattttgattgttcaaactttaacatgagcagatgttaaagttttaccgcatgttgtttctgcatctattggagatgatcttacgagccttctcctttaatgatgaattagtggatttctcccaagaaaaactaacctggcaaattctaaaattaaacagtgcttgctattcccagcataagtcctagttggtcatattgttattgttcatgtatgttgatattttttcatctattgttcatggcccgtaactttcctttcctgttttcaattatgttaccaaagtaacaaggattgccaaggttaccaaatgagctaagggttttttttttcctttttctcttaaaaatcatttgggtttgatgtttcttttacacttattttttttcgtctcttttttttttctttttgtggagaacggggtctcgctatattgcccaggcaggtctcgaactcctgggctcaagctatcctcccgcctctgcctccctgagagctgggattacaggtgtgagccactgcgcctggcctgtttctttttaagtgtcaatttctgtaatggttaaagttctattcaggtttttattacttcttaggtcagtgcataacttgaggatactgtccgttccatctatgttttccaactgtttagcagaaaatgggaatccttccatttttttaggctttactatatctataatgatgtctgttttcattaaaataaaaaactctgtcctgaaaaagatgtgaccagccaggacaacatgacaaaaccttgtctctacaaaaaattacaaaaattagctggatgtggtggtgtgcgcctatagtcccagctatgcaggaggctgaggcaggtggatcaattgagcctgggaggtcaaggctgcagtgagccatgactgcgccactgtactccagcctgggtgacacaatgagaccctgtctcaaaagaaaagaaaaagatgtgactattttcctaagtcttttcaaagaacaacattttggttgtattgtttgtttcactcattctggctcaattttgtaacctctttcttttctttcttgagttgggttctccctgtgttgcccaggctggggtgaagtgcctattcacaggtgccatcatagcccactacaacctcaaattcctgggctcaagcaatcctcctgcctctcagccttccgagtagctaggactataggtgtgcaccaccatgcctggttacctttataactctttataacttctgtctacttcctctgatggatctgttgttctctaactttttcagttggaaacttaattttctatttgtttttctttactaatacatgcatttagatatataaatgcgtatacaagtcctgtttaactgcatactacaaattttaatagcatttgtatttacattcagttccaagtattgtctaagttctatgacttttttgatccacaagttataaatgtgttttttttttcttaaatttccaaacatggtctgtatttaagttatctagaattggttgcagcttactctgtggtatatatatggtcattattttatgtattcttgaaaaggataggtattctctaattttagtgcaagactacatttgttcactaaatgtattatagctagtgactaaatctagttagttgattgtgtcattccaaacatatttttgctgatttttggtctgctccaactatcaattgagggagggatgttaacatctcccaaactgattggaggtaaattcttcttataattaggtaaatgtttacattatttaatgtgaggctacattgttacaattagtatatatttccagagaattgtgactttcagtattatgtaacaatagtccttatgtttcctaatacttttggcctaaagagtattttgtctggtattaatacagccacatcagctttcttttggttaacatttacctggtatacgtattttttactccttttgcttttcctgcgtcctatcttttcaatataactcttgaaattgttatactggcccataagccactgggcgcagtgctgtatttccagcactttgcgaggccaaggcgggtgcattcacctgaggtcaggagtttgagaccagcctggccaacatggtgaaaccccgtctctactaaaaatttaaaaaaaaaattaaaaaaataaaaattagctaggcatggtggtgcgtgcctataatcccagctacactagaggctgaggcagaaaaaaattaaaaaaataaaaattagctaggcatggtggtgtgtgcctataatcccagctacactagaggctgaggcaggagaactgcttaaacccaggaggcagaagctgcagtgagccaaacccaggaggcagaagctgcattgtgccactgcactcctgcctgggcaatagagcaagactccgtcttggggggcaggggaaagaatacatatataactcttacaaataagacagttaaattttaaaatccaatccatctcagaacctttttctttttttttttttgagacggagtctcgctctgtcgcccaggggagtgcagtggcgtgatctcggctcactgcaagctccgcctcccgggttcacgctgttctcctgcctcagcctcccgagtagctaggactacaggcgcccaccactacgcctggctaattttttgtatttttagtagagatggggtttcactgtgttagccaggattgtctccatctcctgaccttgtggtctgcccacctaggcctcccaaagtgctgggattacaggtgtgagccaccgcacctggtcaaagaaccttgttcttgtcatgtgagtttgtatactgctctgatttatagcttacttttaattttcagcatttaagaattttccttttgctcttctgactttcactgtaccttttattacactgtgtcctgtgtttctaagtgtttccatagggaagatattcatttcacattcagaaaactggggcttcaagagacagtgatttgcccaaggcactgagtctaagtagtgcaccctaatattttcacataaggagacagttccttgccctcacctcagcctcacaatggtgtcctattaacaaaagagtgacactcagagttagagagtaaagtgccaatgggcacattttcagaaaaagtccattttcgatgcttgaacagaagcttcactacagcacacacagcagcgcaagaagcctggagtcctgtgtgtcacaaggatcccgcccagcccagccttggggccccaccgtcacctgtctcctgccctccagggtgaagagctcactgatcttcttctgcttgtagacatcattcttctccagcagttttttgtgcagccagtcggggtgtttgacacgtggcactgggttctttacctgtgtgaggccaacacccatcagagagagacccttgtctaactgcacagtttttagccccacagcccgtgccactgaccccgcccttacctgctgcagggccgcagggatggtgatgatcttctggatggcgcttcccagccgctcaatgtagtagtcccaatccagaatctgcatgtgcaggaaacgggcacagagaacagcaggtggcagcagccaagagtggggctcacttcatgctgagcacagggctaaccactgtgtcttatttaatcctctcagaaactctatgatgaaaggtgcccattgcacaacagaggacaccaaggcagggagcttcactgactcctctagatcacagagctagtaggtggctgagccaacacccctggccttagtccatccaatagaacagctaaagggccccaggcacttcatgttttcagttttgccctaaaaggttattaggtgctcacctattacttatcagaaaggaggaagtcaagagtgaagacgccagacaaaaaacataatccaactcagacatattctgctctgtctagctttccttgtaaacttttaagagtagagaacgcaactggcactcactgctcgaatatcaaagtcttgaagggaagagctcttgagccatttccggagaaagtgcttcctcaccgtgggctctgcttggaaaatggcaagtgggatggccctgggtaaggaagacaggcacacagctcagtaacagtgaaaatcacccaaaatctgatcctaactcttatcaaatgaacatggaaataaggacgtgtaacagctgttcacaaacatcaatgtatacatctgcgtgcatatgtatgcacaaacatgcctacaggttcctcggggagtaacacgtgcgtatgtgtaaacacgtgcgtgtgtgcacgtaaacatgtctacatgttcctcacagcgtaaccatgggcatgcatatacataaacacatgcgtgtgcgtagacatgtctgcgtttctcattgagtaaccacgtgcatgcgtacaggcaaacacgtgcatgttcgtaactatgtctacatgtttctcacggcataaccatgtgcatgcacatacataaacgcatgcgtgcgtaaacatgtctacgtttctgagtaaccacgcgcatgcgtataggcaaagacatgcgtgtgtgcgtaaacatgtctgcgtttctgagtaaccacgtgcatgcatacaggcaaacgtgcacgttcataaccatgtctacatgttccttgctgagtaacacacagaagactcaggctgctttctagaaaaaacgagcctgttttcatgtcactagcaaagcaactggcaaccgtcagtgcttccctttcactggaggaaacatctgtggtgaatactgcaaacataaggagacctaaagaagacacgcacactatgatccactcggctccatcaagcttcaacacttggccactctgacttcctttgtgagacgattagagtgaagccctgtgtgaccccaacctattccctcctcacacagaagtaaagacaacccttattctggtgttcatcaaccccatgcaggcatttgtactggtcctatttgtatataaccaccaaaaaaaaaaaaaaaaaaaaaaaaaaagagcagtttccatgtttttaagttttacatacacggaggcataagggtcttccttcaacctgatttttgcttttttctccaaagtggtttcaaactgtcagtgttgtaacctgtagctgcaattcaaccctttgaactctggtatagtgtatctcattccctacaaaatggcaattatccatttctggttgatggacacttatgccatccccaaacttggtgttaaacacagcccaaatctgtaaggaaccccttacctctccgtgacagggcagccctcacctctctgtgatgaggggagccctcacctctccgtgacggagggagccctcacctgtccgtgatgggaggagccctcacctctccgtgatggggggagccctcacctctccgtgacaggggagccctcgggcttgcgggagatgatgtagcggcaactcagccctgcatccttgaccatctggtctcccaggaactcggccaggcgctttgctgtgctgatggacgtagacttctgctccccgtaatcttccagcttccgagacatggaacggttctcagagatgagctcgaatagctcagagtcaggcatgttggctgcctagagaaagacaatgggtaaaacactgcagaaatcaaggggcagagtctgagctcaccctggactgtgctcctctaggccatgcccttctctagcctgagacgcagaaggctgcaatttcaagagctctctaatatgcctgtgtggcaatactttaaaacatacacacacacacaaaactttagcttttatattttttttgagacagagtctcattctgtcacccaggctggagtgcagtggtgcaatctcaactcactaaaacctcccctcctgggttcaagagattctcgtgcctcagcctcccaagtagctgagattacaggcacatgccatcacatccagctaatttttgtatttttagtagagaaagggttttgccatgttggccaggctggtttccaactcctgacctcaagtggtctgcccgccgaggcctcccaagtgctgggattacaggcgtgagccaccacgcctggcttggcttttattttattaaactgtgcacaaaatatcaagaagaatttactgaagagcaccaaggctgcagaaaaggatgttgctcggcctaagacaggaagtttttctccttgaaaggaagagaaagaaggggcaggaagagccagaagagaggaaagagaaactccggccggctggagagtggcctgagcagtggaggcctgagcagttccagtgtggcacccacatccagctggagctgtgctttgcacacatgttcctgaccacaggccccccacatcctgtaaggagtgctgggctcatgaatattctgtgtgataccctggtgctcccttgctcgtgtgtttcactctatacaagacaatatgccaagaaacagaagcccacacagcaaagcaagccaggaaagcactgcagagtgttccagtattccttctacccaagacgcctgtgcctgggaaacatatgcaccgagatatctcgttcaatgcaacaccattgataacaatggaaatgtgaaacctatctggtagtaaataatcgtgggctagttacgtaaattaaggtatgtaaactgtcaaaatgttatgtagcctgaaaaatataaaaaatacaaagtaacatagaaataaacaaatatcccaggctggagtgcagtggtgcagtcacggctcactgtggcctctacttcctggtctcaagtgatcctcccaagtagctgggaccacaggcacgcatcaccatgccaggcttatcacgctatttagaaaaacgtttccctcagagttgtgtccctggatgcagaagttgaggggaactccaagggggtaattgtgctcaggaggtcttgggatttcattaggactggccctgtgttcttcggtcaccttggtctccaggagcccaggaagcacggggtccccttcttgcttcatccttcatccctcagagcaggtgagggtggagggtaggcctttaccttgctgtacagcacgtccagccagtagtcagccaccttggctacagagccatacacctcttccagcgtgctgcccttgaggaaggcctcaaacaccgaggattggaagatcttaatcagctgcagttccccgcggcgtttgacctcaaagcccttgagctcagccagagaaccgtcttcattgaacacagcatacctgaaaaaaaaaaaaaaggcaagcacagcagtggcaaggagcgctggggagccaccagctgtgcctcatcctctctgcccgcctcttccctttccaaccctccacctgtcatccacgaggcagcaaacgtctctctcccttaggccactgcttctctaaaaggaaaatggctgaagggcctgcagccacagagccagaatacagcaggcgggcagacagagctggtgcaaacggaatcagtaagatcacaagaacccaggtctgtttctatcctggctcctgatccaacctcctttctgggctaaatttaatctatctcaatccatgtcctttctaaagcacaaaagctatgagagtcccacctcttcttcaatttcttgccttcttccttggaggctggaagaatcatggcaaggtagggcccatcaacctcaaaaaagatgctgttctctgagcgggtgacgtaggtgagtgaggacggctcagccagctcctggtactggtcattggtgaagccttcctgagaaacaagagtgaagagggggcagcttcactcatgatggcccaaacctggaaaccacctggtgtccctccaggagtggatggattgacaaaccgaggcttttccacataactaacacgacttggcagcaggaaggaaggaagttctgatgcatgcaaccaagtggtgaaactcaggtgtatctgttaggtccaagaagccagacccaaaatgctacaggccgtatgcttccctttacatgacattttcgacaaagcaaaattatagtacaaaaaacacattgtgggttgccagggtttcggggtagggagaggatttgctgacaaaggggttgcagctgttttgtgttgcttcgtggtgctggacacacacactatgcacttgtccaaacccacagggctgtacgctacagagtgaacgtcactgtgtgcaaattacaagccatccagccatggtgctgggatcccaagaggggtgcagactgggccaaatgagcccaacagcactgtggacatacagcagaacatgccaacagggtggggaggaaggagctgcccgtgaactctgctgactggacagggtaaggctgaaaacaaaagtaactatctacaaatgctgtacagtggctggtgaaattatttctcatgggacacaagtctgttagcaattctaaaactactttacatggactctaggattgaacaaacacatatattgagaaattcgaaacaggtttatcactgaaggagaaagaagtcactaataagaaaggggcagactcatgtgtttaaatgcatccatgcagacagacagacacagaaataaacagttctgtgtgcgtgcgttactagagacatacttcctggctgcctccactatgagagactggaagctatgacactcccaggaacagtgagcacagcaagcaccccatctcgggtttttacatcattcttctcggagaactggctgactccaggttggagcagggaaaatacaagatgaggctggtggaccttacagtaccaagaagtaggaaagtgctccagaaacaaagaccagaagagggcgtgtcccaagaacacgccacaaactaggaggccccagtggcccaaggggaacacgtggagcaggaagccactccggtcctatgaacaataaccctgggatgtccactctgatccgcaaatccacactgatgtcaataagcagacaaataaacgagaacaaatggaagagaaggatagcaacgcttccctacaggatcccaattgatacagtagaaggaatgaaggaaacagacaatcgccagagaaaaaccacgacaggaaacctcaggcgtaactgctgcaggtgcggcccaccagcaaacacagcccatcagcaacgctaacacagtgggcagaagcttatggagcagctgtggatacactgtctcgaagcacctgctccacgatatctatttgctgctgtgatggctctaatacaggtccagaaactctgacagccctcctccagggacgcttatatcctccccactgggtgtgtatttacgactgaagagccgtatgggagggggcacaggagcgccacagtaaggcctgcagaagcccctcaggcaggagactaagccgtccccacaacacacccacactcccacaccaccacaaaccaacacgatgcgtgtgagaacgtggggagggtgtcgcacctgtggagctcctccaaaaacccaaatcacctcagtctagtcacgagaaacaacagacaacccctgatcaagggacagccaaccatcgcctggccggcaccaccagagggggaggtcgtgacacgaggacagaccgggacaggacaactcggcgccacgtgggtccttgctgggatcctgggagagaagaggggctatggtgggaaatgggaaatccaggtgaggcctgcagtgcagttactggggcacagacataggtttcttagttttgacaagcgcaccatggtttatgcgaggtcagcattaggggaaggcaggttgaaggggatacagaaattctctgtactatttttgtaatttcctgtaagtttaaaattatttcaaaataaaaagttaaaagcaaaaaattctgggagctatgctgaaagagaaaggagtggaatcacttgatacctctgaccatggtcttcaggctatagaaaagcaatgtgagcagtgctgggtgccaggaaggcatgcacactgtgaggtgctgcagagccagtgacatcagggcactgacgccaggccagccagagcttcaggaccagaggccccagactcaccttgaccatgatgttcaacatggcgcctgggtaggagatggtcactttgggcttcttcacattggtcgtcttgaagacaaaattttctgggaagctgttgggcaggacgcaccatataccatctgtgtccagctctaagggcctccttcagagaaagagaggagcaaggtcgtgagttcccctttccttttcacccagtgtgtggcctccagccttccctccttccttcctgcccagtgtgtggcctccagccttccctccttccttcctgcccagtgtgtggcctccagccttccctccttccttcctgcccatgcttgcccccaggacctgctcccagccccacggctccccttctgcactcacccaatctgctcgatcagctcccgtgcctgggtgatgatgttggcccctgtgaagcagacgatgccagccatctccatggagtaccagcgagccctgagaggacaccacaaactggtgggtggggctggcatggctcctccagggggtatcagaggcagtgaggagtagggaggaggaaaggagagatgcgacagggacaagggaagcagccaaatgtgcgtgcaccaggacagaactaaggtggaatctggctctgcccgaggacacctctctgtccccaccttggtgcccaggaaggatctggaagggtgcagtatgtgccactgcgtccagccgttcaggactccagcctcagcaggactcttaataccacccagacccattcacgccttctctactctcttcacacctcctcccaagccccattctcacctccagcttctcagagaaagcccaggcctagctgccaggcccaaccctcctccagcctgggtcccagccctgctgtcagctgtcccaccctcccctcccggcaccagccccatgccccttgtcagttgcttctctgcccctcccggacacgcagacatgctgtgaagcaactgcccgacactctgcaagtccctgagtgaggatccacgctgggagacatgaacgcgctggaaaatggcaagtcgtgtctccagcccatgatgcagagacacatacaccccacagcacgcatcactcatggacacccagaccctcaaagtcagcgtggcccccactctcttcaacctcccagccccaccccagcccaaagccttctccctccaacattccttgaatcagatgaacggccctccatgcacagcagcctacacctgaagctgccctaaacgtggactcatccattcctcccataagcctctcccgggcccgggcccacctaccccttgcgcatgacatagccatagaaggagttcaggatgcacttgtgggccagctgcagcgagtcatacagcacctccatgttcttgcagcgcttcacctcagccgcgtcgcccacctccacggccgccgagagcttctttttccacacctgagaagcacatgaacatggagcacctcacagattcttccatttcacattctacaaagtcaatagcccaggtttttagtattttgaaaattttcaaatctatagaaaacctaaaaaaccagtacaatgaagagtgtacattcttctcctagactggccaactgtcaatattttgtcacacttcctttattctgtctctctgtgttgacagaatcatttgaacattgtagatttcacggtctgacatcctaaacgcttcagcacagtttctagggaacaagagctactcgggggtgcctggtaaaatcaatcaagaaatgcagctaagaccacagatgtctcatcaaattccccacccaacatgagaaaaggtttttaaaggctgggtatttaaggaacaaaagcaaattccttaagataattactgagtgcctagtatgtgccaggaactccattgtactctgaagcacgagacagtcactacacttttggtgcttatttgatgagggagacagatgaacaagtaatttagcagttgcttaattaaaataaagtgagatagtaaggcagctccttaaaaggtaaatgtagaattagcatatgacccaacaactctactgctgggtacatatccaaaatcaccaaaagcagagacctgaagacgcacttgcagcccatgttgaaaccaggattgctcgcgacagccaaaaggtggaagcaacccaagtgcacgtcggtgtatgaaggatagacaaaatgtgacaaatccacacaatgaaatattattcagccatttacaaaaatacagtacagatacacgctgtatgttgataaaccttgaaaacatcatactaagactgggcgcggtggctcacgcctgtaatcccagccctgtgggaggctggggtggatagatgacctgagttcaggactttgagaccagcctgggcaacatggtgaaaccccgtctctaccaaacatacaacgatcaggcgtgatggtacgcctgtggtcccaggaactggggaggctgaggcgggaggatcacttgagcctgggaggtggaggctgcagtgagccaaggtcacaccactgtgctccaaccttggtgacagagtgagaccccgtctccaaaaaagaaagcatcatgctaagtgaaaaagccggtcacaaagatacaaatactgcacggttcacttacatgacatccctagagtcgtggaattcagagagagaaagtggaatggggtcactaggggccagggaggaggtggggagctactgtttgatggagataagagtttccgtttcagaaggcgaagaattctggaggtagatggtggtgatagttgcacaacagtgcgaatatgcttcatgcccctgaactgagcacttaaaaacactaaatgtcatattatgtccgccttaccattataaaaaagaacatgtgacgatgagttcagcagggcagtgcaggatgccagggggccgcacagcaggggccgtgctgagtctacagtgaaggtctctcagaaaaaaaatggctcaatctgatcagatataaaataatgacccgttggtatcaaaacagaggtgttgctatgcattttccatgttcctaccggatgaaatacgtcagttaaacacgaggggccggatggtgaataccatagatgagaaggccttagagtttctaggaactcctcacctcccatgacagcgggaaagagataaacaataggcgaaggcagttgggttcgtaaaacttgatgtactcaaacggccagccagctgtagcttgctgacccctgctctaaataatcactttagaaatcatcctttagggtccttctgaggcctcagaccagggtggatgatggtctgcatccttcgtggccatcaactcttccaagtcaaaaacaattgcacgttaccatccgagtgcaagtgcctgctcagaggatcccaggcaaggagccaagagtgcccacttcatgagccgactgaaactgccctcacagaggccaaagcttgcagcccctcagagctcaccttgtggagccctttgaactcgtaacgcctgtcccggaaggcacgcacggtgtccacgtagaaggagttttcccgctggcagatggtggtgagacgctcttccaccttggtgatgtggatcttcttgtaggctttccggcagtaatctaagcacgacggagatgggcagagcaggtgggtgagatctcccagagcagagggagccagggcacaggggtgctgaagaacatggcttctacgtcaccacaaaggagcaacagctcagatacactgctagtttctcataccgaaaaaggtgggcgggcacggtggctcacacctgtaatcccagcactttgggaggccgaggcaggcggatcacttgagcccaggagtttgagaccagcctaggcaacatggcaagaccccatctctacaaaaaatacaaaaaattagctaggcatggtggcgcacacctgtagtcccagctacttaggaggctgagatgggaggattgccggtgcctgggaggttgaggctgcagtgagccaagatcacaccactgcattccagcctgggtgacagagtgagacctcatttcaaaaaaaaaaagaaagaaataggacagcccaggggtaggaacaggccaaataccccaagaccacagagcagcagtgtctaacacttgcagatggggaagcaaataaaggaccctgcagtgagagcacagcttacagtgacctagagcagcttctggtctgctgtgacaacacctctggggccccagctgggatggaccaacgcagcccagtaagaacagaaagtgggagcaggagccacatctttacagccgtgaccatgcccaggcactcacccgccagccttctcttctcgtatttcgcctgttcctcgcgggacagttcatgaaaggcccgagctggcccctctgggaacaagggggggaacttctctgactccagctggtgctggatccgatggtattcgctgcgactggctggcactgggaaggaggcaatgggggcaagttcaaaaggaggcacagacacaccggcttcccaccaagtggagaaaggcggccgacactcacccacccgtttcccaccgagtgcccacccaggcggccgacactcactgaactcgcccctccactgccaggccatcttccgctggcagtttgctccaggcttattgaagtcacaggcagcacaggtggcttcgtccaccatggcagagggctgggaggggtgagaaagcacttagggctgggcagagagagctccgactctgacacgggaagtaaagtctcacctgcaggcggttggtcaggatgatgttggggtacatggcccccacgtccaggtggtagatgagtggacactcgatgcggctgggaacgtccttcagggaggcaagcttgctcttaatctcatcacacacctgcagagaaagcgaaactcagtagaggctggtgaccaagcttgcctcgtgtgcagttcaccaaccccttttagacattcaggagaggaaaaagctgaaaaatatataaatagagcaaaaactagccagaagaaaaaagttaagaagggttgccatcatttctatgaaatacattaaatttggtggagtcattagaaaattacttgaacactaaactctccttagtattaaaaaaaatccttaggccaggtgcagtggttcatgcttgtaatcctagcactttcggagaccgaggccagaggatcacttgagcccaggagttcgagaccagcctgagcaacacagtgggacccccgtctctataaaaaataaaaaattagccgtgtgtggcggtggcacctgtagtcccagctactcggaacgctggggtggaagaatcgcttgagcccgtgaggtcaaggctgtagtgagcccagattgcaccactgcactccagcctgggcaacagagccagatcctgtttcagaaaaaaaaaaagaaaaagaaaaatccttaaaaccctccaaagtagtaaaaatagaaaacacacctaaaattttaagaaaaaagtgattacaaggaataacatctattccatagaacaggaaataccacaacagtaacacctattgtttctacttgaattacagataaacgaatcagccggggaagagcctccactgcacccttctctgcccagtaacggcgtgttctgaaaggctgtccagtcaagaaggggaggatgggctgggacaagtgaatggccaagtttccatggtggggacaccacctggacatgccccacgtggctgtgagcccctgctgacatccccccagccaccctccgcccaacaggtgacccttcagggacacaaaggcgatcctgggcttccctttcaagggcacttgcgaggacttaggaatcgctaacaggacaatgtcatctacagagctcccttcctcactcaccagggagcctggcgtcctcacatctacagagctctcttcctcactcaccagggagcctggcatcctcacatctaccacacctccagcctcactctacctgcccatctcactgtttcttaaagactttaaatatctgcttctaggtcgggcgcggtggctcacgcctgtaatcccagcactttgggaggccaagcgggcagatcagctgaggtcgggagttcgagaccagcctggccaacatggagaaaccctgtctctactaaaaatacaaaaaaaaaattacccaggcgtggtggcaagcgcctgttatcccagctactcaggaggctgaggcaggagaatctcttgaacccaggaggcagaggttgtggtgagccgagatcatgccattgcactccagcctgggcaacaagagtgaaactctgtctcagattctgagacgtctcgccaccacgcctgggtaatttttttttgtatttttagtagagacggggtttctccatgttggccaggctggtctcaaactcctgacctcaggtgatccacccgcctcagcctcccaaaatgctgggattccaggctgcccaggctggagtgtagtggagcgatctcggctcactgcaagctccgcctcccgggttcttgctattctcctgcctcagcctcccgagtagctgggactacaggtgcccgccaccacgcccggctaatttttttatatttttttagtagagacggggtttcaccgtgttagccaggatggtctcaatctcctgacctcgtgatccacctcggcctcccaaagtgctggaattacaggcgtgagccaccgtgcccggccatggccgacattctttaactcctatttgttattcagacaaggctctcttcctgatcggttcataagagttccctgaagtataataatggatgtggctgacaatagccaaacagtgcttcacagcttgccaagagtgtacacatattcttgtttaaattttgactagtgaatctattacaagatgtttcttgagggcaggcacagtggctcacacctgtaatcccagcactttgggaggctgaggtgggcagatcacttacagtcaggagttcgaaagcagcctggccaacgtggtgaaacctcatctctactaaaaatacaaaaattggccaggcatggtggtgggcacctgtaatcccagctactcaggaggctgagacaggagaatcgcttgaacccaggaggcaaaggttgcagtaagccgagatcatgccattgcactccagtgtgggtgacagagcaagactccgtctcaaaaaaaaaaaaaaaaaaaaaaaaagtttcttggcatcaatgtgaaaactgttaaaaactctaaaccagcaacctcactgaacatgatgtagtgctgcacagtgcctgacataaagacctgagataggccaggcgcggtgcctcacacctgtaatcccagcactttgggaggccaaggcaggcggatcacaaggtcaggagttcaagatcagactggacaacatggtgaaaccctgtctctactaaaaatacaaaaactagccaggtgtggtggcggatgcctgtaatcccagctactggggagcctgaggcaggagaattgcttgaacccgggaggcagaggttgcagtgagccaaactcatgccattgcactccagcccaggccaacaacagcgagactccatctcaaaaagggaaaaaaaaaaaaaaaaaaaaaaaagacctgagatgtgccatgtcctgaggaacagggatcagagaagaactggtgtctccctctccagtcacataacacactttgtaagtgtgctttctaaccattatgtaaacagattttacagtcactaatcctgtcatttgtaggaatttactgtcatttttaagtctcaacaacaaaaagtaaataaaatttaaaacctccaatggctccccagtgcctataaaataaagtcctaatgctttaaaacaggacacgggatacatcccaccaggacccaccttccatgttactgcatttcaggagcagctcacaccccacctctcatgaagccctccgaccttgtgacagcatcacacgtcacaaccatgactgccctgtcccaccagagaccctgtgtcatccgtccacagcaccacacgcagcaggtgcacaataaacgtgctgctgaaagacgtggtctgtgaagaaggcgccaaacacagactggctcttcctgcctccctgatggttacctcttcaaagttggtgacttgctccacaggcactttctcctcttcctcaagggcgtggcgcaaggtcttctcaacccgctgcagcaggaagtcaaaggcggcaggattctagcacaacagtgagacgacggggtcagaggggaaacacacccacactagcctgcctcaggtttgacgctgtggctgcacgtggcaggttgtgcccgagaaagctccggaaggactcatgtgcacaatctgcagtgcactgccctaaagaagcccccggggggtgctgggccagagaagccacacccggtgaggggccgtgggacaggatggggagaaggggctttatttcagcccctgcagcttctgggtcctaccacagcacaagagtgggaagaatctgaatcccagggaagaagcacaccatcctaaaccggcaagggatatcgctgcggaaaaccccagactcgagggcctccacgtggcccccgacgtaggtctcagagtccagcacgtgtccgtcgtccgtcagcttattgaactcctgctcttgcttgttggggaagatgatgttggcgtggaaggcctgcaccatcagcaaggcctcacacagagtgccagagcccttccgcagcacctgcaagagaaaccaaggcttccagccaaaagcaacaccaaaggccctgacttgcaggcaaagtccaggaacctaagctgaacttcagtgtgaaaggagagaaaacctcgtggtaaatggctgcaaattctgcctcctgtggtttcttcctcacaccagggccagagaattcccaaaggacatccctgacgtcacacaccagaattctactgccgcctctggtgccagcactcctgggacatccacctccattcagctccagtgcatttggaatggggcaagggctgaggaggccagggtgccgacaggacagataatgctcacctcgtcgggctccatgggaataatggtgcacagagcaaagatgaatgggtggacgtacttcatgtacaggtagtaagtggcgacagcatctgacacagaatacgtggccagagtctgaggagagaacgccagagagcagggccatcaaaaatcaagagcccagggtcaagtgtgaagcacagaaagcaaagcctggcctgaccagcctgccgcacacacagtaaggagaccggcacaggacaaaacacgtgtgtcccggagacacagcctgctgggtggagcgggctggcatacatgcgtgcacacggcagcagggggagccgggatgtggctcacatgcctggggctgctccgtggccatctggatgcgtgcacacggcagcaggggcagccgggatgtggcttacgtgcctggggctgctccgtggccatccggcacatgtcctccgggtctagctccacgggatcatagcctagcttggccttggcggccgccttgagattatgactgcccacaggaaggtaactgtccctcttcacccacctggaaggagaatgagaacagaagccaggatgattctaacatgcagcccgggaacccctgagaactggcaaaactgggcaccacacagacagatgcaagttcctaacaggcacccaggagcctcacaccaaggccccacatggtgtagacaccttgtgaaaacccttcatcaggatctagttaatctcacagacctatccacaacacaaggaagcaccaggactggtccttccggccctcgccttcctcccatcctcagcagagtttgtggcctctccgacgggcgccccacctccttgggcctctccccagacctcaggtctgcacccctggggcctagttctatcaaccacactgatcttctctcctcacactgtcccttcagcacggaaacactcaagcccaccctcctttaatagaaggcaagatgtgatcagatgccaagaagaataaaaatttaaaaaataaataaaaaataaaaattaagaaaagaaggccccccacactctacccggaacctgtctctacctcctccctacagacgcattccctggagcagctgtccaggggtcatgtccggtctccaccccccgcagcctccaccctgtggccttcttctctcactttacctcttgccttcagttcatccactaccccagctttcaccaagacccacccgcaacccagtgagtcccaatctacagtgcgagcccaaaccaagcctcatggtggtcttcagggcccccatatgggtggggcttccaggctagcatatcggtagcagggtcacctcctgcctcaagccccttctctacccattccctgtctccacggatggcacaaaaaccccaggtgccaacccctccctaagaaccagcatccctgggcctccccctgccccacatgacagatcctgaatcctcacaaccctcactccctgccttggatcaggactgtcacaccgtcacacgctaaaccggccccagcctcctggcctccctctccaagccaagtgctgagcatcagagctaaacagaaacgcattcaggctgcaagcaccccagtggcactgtgcagaatacagaggccgtggaggcccctccattcccttccttccctccctcccttcccttccttccctccctcccttcccttccttcccttccctcctttcctccctcccttcccttccttcccttccagcctccttctgttggcatttccacatccacctgtcttcccaaccagtcatgtcagagcccccgaacgccgtgactctccgaagctctgagctgcctcccaccctagctcatatggaatctgtggttgtcccgtgaggcttgtcctgtgaggcagccgggctgccacatcccaaccttgcctgggcagagcagctccatgaggtcctaggtctgggacctgtcagctgagtgcgtctttccagcggcttccccaccccagaggctgatgctcaatgtgcctggtcactgatgaattgtcagtcaacagtcaaagacagcacatcccgggccctggcagggttgcagctgccatactcttgggtgacctgaaacggcctctcggaggccaccctcctcccatgagatgtggtgacagcacagtctgcaagaggccttcagatctcgctcacggacagcagtgaggagccatgctgctctgtggcccctacctgaggcagtccatgtggatgcactggggcgccttgtactccccctggctgtccttctggaagcctatctcctgctgcatgctcagaccgtggactgctgcccgggcctccacaaatggcctgggttggaaagaggacagacaagcaagtgggcaggtcaggctctaatgcccctttctccattcctccctcagacccagggaggaacccagacacgggaggtgcagagtgaacccaggagccacctcctaagtcgacatgggaagcgcccctgcaccacgcaacgccctccctctcaaatgctgcccagttactcatagagaagacacagactcaccagtcaaaaaagtccccgttgtaggtgaccatgatggtgggtttggtctcctggacgtgttcaaaccacctttggatcagatgagcctgaacccaagtcacagcagtcagaggtctgctctttctcttcttcaagctattccaaattcctctcccaaagttcagaagcagcagcctcatgttggcccttattcctgccccgcccctccgcccgtctctggcagaaaagacggtcataccctgagaacaaagctcatggagctgcaattctgatctgacggaatgcctgaggccttggaaagatccacatgtccgttcttcccacaataccgggtagtttcccaagtgatacctccttacctcatcgggttcattgaagacacaaaaggggccttcatattctggcttgggggtgaactcaaaatcttcaatatcttctgaaacaatctccctgttggtgatgaggtagccctagccaagttcattagcaatcagcacaagtcagaggctgcaaagccaagaaatggcgttcccaccctgcccacacactctgcctagagattctcactacaaagaagtccacagcaatgtgaaagtgctttaagcttcctgagaagagacgctctgtgtgtggattcccactcgaaaggggagggtacagctggaggtcggaacggcttggttgctcccattcctggactaactcattattcactcaacaaatactaacagtggggcagatgctgctgtagtatggggaccagacaaggtccccatcccaggagcttacttcccagaagccacctgctcacctggccatcgatcatgtaggaaatcatcataatctggtctgtctcagcatcaggaaacttgaggggcagtttggtcgtctcaatgtcaaatgccaaaaccacagggtcctgtggggacaaaataagcataaagccaagctctaaactccccattaggcctccctgaacacccacccccagcctgctctacctccctctggttgttaaaagagtcaaaaggctctagagctgggagaaggaccctaagactaaccaacctacatcaagagtatcacgactccctatggtatgaaaactgacatacctaagagagcagctgatcacaggacaagcctaaaatcacagaactttaggagaaaaactcttcaaaagacatcacctcattctggtggttatgacaactctgaaaggtaactgtggcacagagatgatatcttcatttcggaaaagagaaaactgaatacaaagactttcccaacaccacaaagtcatgtttgaaccaaggccttctagttacaaatccatttttcaccatgtcccttcactatcaactacccaaacggaagtcccagctttccctcgagtgtccaaatcctgcctagctcaaacactgatgtcatacagtgatatacaacaaaaaaggaaatgatactgtcagaaactgatgaaaaattctaactccatatttcctttaataaagtatttgggggaaaagcagcaaacatatctttgagtcagattcactctccagcactgaagaatattctctccagaaaactggaaattttaggatgaaggtaacacaagcaaaacttacaggtcgttcaacaaggtcatctcggcgggtgatttctaccggaaaagcatttcctcggtatctgacattgtaccaatgagcctgcaaaacacacagtgtgctaactagagttctacatccaggaaagtctattcttctgtggattcacccataatgatcatctcctggctgttaggaaattcatgtgagcagcgacccaaccctgccccactcaccacgtggatcttcaggtcaatggagaggcggatgtggtagggaacatcgtactcgcgcatgtccacaatgttgtccaactggtcagctatcttcttagaggtttcctcttcatcagtaatgacaccgcccctctgcagaacactaggaattaacaagagagcaactaactcagctgccagggtctggaggaggtgagaccagagttccaactcagtaggaagaggtgagaccagagttcaaaccgaggaaacacaaaaggtaaattgatgtggtttcaacgaccaaggcagtccttcctttaagaatggcttggactgggccaggcgtggcagctcacgcctgtaatcccagcactttgggaggccaaggaaggcggatcacccgaggtcaggagttcgagacgagcctggccaacacgacgaaacctcatctctactaaaaatacaaaaattagccaggcgtggtggcgcatgtctgtaaccccagatacctgggaggctgaggcaggagaatcacttgaacccaggaggcggaggttgcagtgaacccagattgcgccactgcactccagcctgggcaacagagcgagactccatctcaaaaaaataaagaatagcttggatgataactctacagacaggagaaaattcagtgtaagatgtattcattttatatgatgtgagttacaccccaactagaaaaaaaaaaagagggccaagcatggtggcttatgcctctaatcccagcactctgggaggcaggaggatcgcttcggcccaggagttcaagacaggcctgggcaacatagggagactcatctctacaaaagtaataataataataataataattagccaggcatggggtacacacctgtgatcccagttactcaggaggctgaggtgaaaggatcgcttgagcccaggagttcgaggccacagtgagctatgattgcaccactgcactccagcctgggcaacagagcaagaccctgtctcaaaacaaataagtaaatagaagaaaaaagaaagaaaacattaagtgctgccagtcaggagagccaggcatgaccatcccaccatggtcctgatactcaggaggctgcctcatgcaggctgaagagcaggcctgggcttcacacagcctgtgcatgggtctctgccatgtctaaagaagtggcccaccattgcggccactattggcctataagctcaaatactgaacgggctattcagggggaaaaagacagacgagtctcagatatggctcaagtctctgaggactcagtctctgatcacaccttccaatatttcaaaaagcaacttgtggcattgccagggaaggcggactccgggtagggactgtagaaatgttcagcatcccaaactgatcctcttttgtcagagggtaaggtaggttcttccgaagtcatctaaacttcattactcaagattttctcttcctaactggttactttgcatcctattattgttgatgctcaaatacttgaagaacagtgtttagtgttctaggcttaaatttctgtggacgatacccaaggttctctggagatgtgctgtgtaaatctcagcacttaatgaaattcatagatggattgtgttagggcagtaggatgagggatcttttcccctctaaggtgactttactattacaaccactcaattttagagccataaacccacccctccattggaaaagagagctaacacataaaatataacctgggaagccactgtttatttaacacagaacatacagaaatctctacctaattgctcaagttttccgtatcaaacagagccagccattaaggtaactttgttgctacgtgttcctgtctcctatccatcttgtcgttctgaaccgctgatgctttgctcacaagaccaaagtttacctggaaagcagagctgtgtacgcgtcgctggcgtgatcctgctccctgttcttcttcacggcaggggagatctccttcctcactttgacaagatcctccacagtgtggaaggacagcctgatgtaatttcgcttcaaacccaccaagtgatttggctataatgcgaagagatcacgctcattggttcaagagaaataggactttatgggtgagagggtaaacactcaaaggtaaacacacaagtcaaagagttggcgacttcaaggcaccttgtccaactctgcacgtggcaccaactaacaccactagagctctttggaaggaattttatagacggtcaccacaccgccccatcacccaacagatgacctgaatttctacctcttccgatcccacctgccaggaacaatgtagactctggcctcatttacccctggaaagtctgggtgatactcaccaagtccagatcctctttggggacagtctccacttttgcaattttgccctgaaacttcttggagagaaaagatgaaacttctcgctcacaaccctaatcaggatcagaatgaaaaggctttccattggtaaaatacatttccttccttgcctatttcccagttgcaaagcccaccacagaatgacacacaggtcgtctgacctgagtctatgaaacacactcacctttctggtcgcaatgtagaaatacggtttatagggcaaagccacctgttaagagtcaccaacccatccaggggtgatgagaaagaagaaagcgagagaaaagtgaaaacacattgcttgctcctatatcccatgaacagcctagggccagggtagccttgaccttggtagcatacaggaagtcagaatgcgcacttttcacaggggcaagaatctgaaagacacgctacttctcaccattcagagtcttcctgaactgacctctctcaggacatcttacgtgatgactgatggggcctccaggggcccgagttctgctgggctatgggctgctgtgcactggaagcctcccatgccctccctgacagtcacagagctacatgaacacccataaaagtgggttttagcttgtcgcagtcaggggcttaccttaaatctgcttccgtcatcttgaataaagtagtaatccactgcactgcctaagcgcttatcttcatctaaaatctcggtctacaagagaatcagtcaacacagacacaagaccatcctctacacagttagagaaactttcctcctacctttcgggaaactcagcactttagaaacaaaccctctcatctaggtctttactccacccctacattaacactaccagccttattcacaagaaccacactgtaacggcctccaaatggggatctctctcaatttctccctcataatccttgaaagctttattctgatggctaaaagagatgcccatcacctccggcttctcacagtggcctctctgtggccctcaatgacgttaaagaggaaaggagagctgggaaccttcacatctcccacctgattcactcaaagttccctcatgtgtcccccactctttagataaggaccacgctatgaccagaagggttgcagccatattcctgggtgggagaaggacctagtgcttacaggatgcatgttaatgagccagcctgtcttctcaccaggctccttcagccgctcaaaaccaaaccgcaaatccatcttatccgtccactgactccgttccaggcgcttgagtgccgaaactgaggaagtggcgccatcatccctgagtgaaagaagggaaccccgtgcttaatttgtaatgccacctgctgctgcttctttttttcttttttttctttttttttgagacggagtcttgctctgtcgcctaggctggagtgcagtggtgtgatctcggctcactgcaagctccgcctcccgggttcacgccattctcctgcctcagcctcccgagtagctgggaccacaggcgacagccaccacgcctggctaattttttgtatttttagtagagacggggtttcaccgtgttagccaggatggtctcgatctcctgaccttgtgatccgactgccacctacttctgcaaccctcatcccacctagtgttaagtgtttcggatatgacagggtatatatattcctgaaaaaccccgagcttggaaaaaggctcattaagataaaaggactcattggaaaaacacaattagggcaggcccttcaaaacctgttcaactttataaccagaatactaacaaaaagagtcatgatggctagacactgttgcctcttgggacactaaaaatgcataaaactagccagacgcggtggctcatgagagtgcatgtaacactgacatgatttgaataaaacagacggattgtcaggccaggcacagtggctcacgcctgtaatcccaaaactttgggaggccaaggcgggtggatcacctgaggtcaggagtttgagaccagcctggccagcatggtgaaaccctgtctctactaaaaatacaaaaaattaaatcccagcaccgtgggaggccgaggcgggcggatcacgaggtgaggagatctagaccatcctgctaatacagtgaaaccccgtctttactaaaaatacaaaaacttagccaggcgtggtggtgggtgcctatagtcccagctactcaggaggctgaggcaggagaatggcgtgaacccaggaggtggagcttgcagtgagccgagaacgcgccaccacactccagcctgggcagcagagcgagactccggcaaaaaaaaaaaaataaataaaaataaataaataaataaataaattagctgggtgtggtggggtgggcctataatcccagctactcaggaggctgaggcaggagaatcacttgaaccctagaggtggaggttgcagtgagccaagattgcgccactgcactccagcctgggtgacaagagtgaaacttcgtctcaaaaaaataaataaaataaaataagataaaataaattagatgggtcgtctcaatgtcaatttcttagttgtgacaattgtactctacttacacaagatgttatggtgaagtgatacgggaatctctgtatcatttctgacaaatgcatgagaatcaatctacaattacctcaaaaaaaggttgagggccaggcgcagtggctcacaactgtaatcccagcactttgggaggccaaggagggtggatgacttgaggccaggagtttgagaccatcctggctaacatggtgaaaccccgtctctactaaaaatacgaaaaattagccgggcgtggtggcgggcgcctgtagtcccagctactcgggaggctgaggcaggagaatggcgtgaatccaggaggcagagcttgcagtgagctgggatcatgccactgcactccagcctgggcgacagagcgagactccgtctaaaaaaaaaataaaataaaaaaagaacaagataaaaaaagaaaggaagacccttcctttgtctgaaggtattccttggatcaccttcaactcaagagcagaatgaccatattccaagactaggatccttacttctcatgaaagattataaccacttgtggtaggcaggcaggatgacaccccccatgaaagacccacatcctaatcccccaaacctgtgaatgttatcttacaagacaaaagggtctttgcagatctgactaaattaagggccttgagattctgcttagctgggtgggcgcagtgtaatcacaagaatccttgtagagtgaggcaggagagctagagtcaggaaggagaaagggatgggagagagagggtaggggggagaggagatgcaacccttggttctgaagatgaagaagcagcaaggaaacagattctcccccgggaaccatcacaataaatataaccaaccagacactttcatattacgacttctgacttctaaaaccgtaagagaataaatttatatagtcactaagtgatcatgtgttactgcagcaataggaaactgatacaccaccatactgtataataaaggtttaatcttttaaatagttgaatgcacccgtaatcaaaaacacagaaaaactatattccaaatcttgctagagaacagcctcagttctgagtcccagatctttatcaaaatcaagagtgaatgaagtgctatttacgaggcatcacctcttaacaggggcgcacggccctctatgccagtcctccaaatatccttgcctcaagtaagttggattaagtagactagaaaactgctcactgggaccatatttcctcccaaaactgctttctctgagctgtgtatctcacttttaatccagggacagtaagaaatctgaaaaatggggataagtgtcacacagggagctaccatcgactggttactatatcacaccgtcccagtactccacacaggctctcattcacagagagctaccattgactggttactatatcacaccgtcccagtactccacacaggctctcattcacagagagctaccattgactggttactgtatcacaccgtcccagtactccacacaggctctcattcacagagagctaccactgactggttactgtatcacaccgtcccagtactccacacaggctctcattcacagagagctaccattgactggttactgtatcacaccgtcccagtactccacacaggctctcattcacagagagctaccattgactggttactgtatcacaccgtcccagtactccacacaggctctcattcacagagctaccattgactggttactatatcacaccgtcccagtactccacacaggctctcattcacagagagctaccattgactggttactgtatcacaccgtcccagtactccacacaggctctcattcacagagctaccattgactggttactatatcacaccgtcccagtactccacacaggctctcattcacagagctaccattgactggttactatatcacaccgtcccagtactccacacaggctctcattcacagagagctaccattgactggttactgtatcacaccgtcccagtactccacacaggctctcattcacagagagctaccattgactggttactgtatcacaccgtcccagtactccacacaggctctcattcacagagagctaccattgactggttactgtatcacaccgtcccagtactccacacaggctctcattcacagagagctaccattgactggttactgtatcacaccgtcccagtactccacacaggctctcattcacagagctaccattgactggttactatatcacaccgtcccagtactccacacaggctctcattcacagagagctaccattgactggttactatatcacaccgtcccagtactccacacaggctctcattcacagagagctaccattgactggttactgtatcacaccgtcccagtactccacacaggctctcattcacagagagctaccattgactggttactgtatcacacaatcccagtactccacaggctctcattcacagagctaccattgactggttactatatcacaccgtcccagtactccacacaggctctcattcacagagagctaccattgactggttactatatcacaccgtcccagtactccacacaggctttcattcacagagctaccattgactggttactgtatcacaccgtcccagtactacacacaggctctcattcacagagagctaccattgactggttactgtatcacactgtcccagtactccacacaggctctcattcacagagagctaccattgactggttactgtatcacaccgtcccagtactccacatatgctctcattcagttttcatgacaacccctacgagggaggccactggtgtccccatttcacacaagaagaaacgcaggcaaacagcacccactgcctcctggggcacactcacctcccaggactgttttaaggatgagatgaggtaacccacataaagcatgtaaggtaaaagccatcacttgtacttatcccagcagcagccttccccctgcctggaggccatcactgagcttggggcagggcagtggagtggagcacgtgagtgcagtcctgtgtcctgaagcagggcagtcagtaaccgtctctaagctccaagttccaacacaccatgtagaccctaagggtacctgcctctctagggcttgcctgatatggacagacagcgatgagcacaacagcagttagggatccttaccacttggtttctcctctgggaagaattttgttcagctaagtgtctgtaaaaagcttcacgttctcacacgttttttctatttttttttttttgagacagagtttcattctttgttgcccagcctggagtgcaatggcgcgatctcggttcaccgcaacctccgcctgccgcgttcaagtgattctcctgcctcagcctcctgcgtagctgggattacaggcatgcgccaccacgccccgctaattttgtatttttttagtggagacgggatttctccatgttggtcaggctggtctcgaactcctgacctcaggtgatcctcctgcctcggcctcccaaagtgctgggattacaggtgtgagccaccgcgccgggcctcatccgttttctgcttatggcaggccagtcctccggtcatgtttaccgtttgctctggccaccaagcagccgcgtcttatccttgctctattttttttgagactgggtctggctccgtcgcccaggctggagtgcggtggcgcgatcccggctcacagcagccttgacctgccgggctcaggtgaacctccggctcggattcgggagtattaatagctgggacctcgggcgcgcaccaccagcctgtctaatttttcttgtttttacaagagaagggccgggcgcggagtctcacgtctgtaatcccagcactttggaaggccgaggcgggcggatcacctgaggtcaggagttcgagaccagcctggccaacatggtgaaacccggtctctactaaaaatacaaaaactagccgggcctggtggcgggcgcctgtaattccagctactcgggaggctgaggcagcgggatcgcttgaacccgggaagcagaggttgcagtgagccgagatcgcgccactgcactccagcctgggcgacagagcgggactccctgcccaaaaaaataaaacagaggagacgaggtctctctctgtagcccaggctgatctagaacaggatcctgggctccagcgatccgcccgcctcggcctcccccagcgctaggcccccaggcagggtccccggccccgcccctccccgcaccctccccagccgcgcgtccaccccgcagggcctggcccgggtcccgccgctctcatcgcccccgccgcgcggcaggtcccaaacgcagctgcgcggaaggcgaggcccgaaaaacctcagaaagagccgagcagggaaaggccgcgcggcccgcctcgtttccccgcaaagaagccgcgcccgtagcgcctccgcccgccccgagcccctccgtcggcggtcggggcgcgccgccctaccccagtcaggcgcggcgagtgcgggcggctgcgggaaccgggcctccctcccgcctcggcggcgccagccgaggacggccccatggcaccctccggagggccggcccgagagcctcaggagggcgcccctcacctgctggcctcgccatccgcgcctgggtccgcgcgccgccgcccgccgctcctcagagacatggagccgttggctaccacctctgcttcaggggagaaatttggcgcgctcccacccagactcgcgagagccggaaatgccgccgtccatcaagaggcgcgctccgcccctcccccgccccccgaggcgctccaattggcgccggcgcccggcgggggaggtggccggcagggaccggggaaaagtgtgtggtaggcgcgcgcggcgcacc

SEQ ID NO: 141 - DNA, 11670 bp, Homo Sapiens
tgatgtttgaaattcaagtaactttatttaaattcaaaaacaattcttaaaactgcatttagagtcaagacccttttgtattataaaaatcacaagtatttctaagagacaaaaatacttctaggttaactagaccagatctgactttggactttattctttaaacaaattgcagagaatagagaaaaaaataggttatttacagaaaacaatatctacatatgtacttagaggtacaaatttggtgacagaaaagacttcagtatatgctggcatcttagaagcagttctcaaagagcttagttttattttcttgaattttaagaatgcctaagatccttcttcatcctcgatcttgggagccaagtagtattttaagtgtcccatatccgcaattttatactctacaactgaaagacaggaagatggttaattactgaggagtatgtatcacatatgactacctacaaaacaaggttcaaatttattatcttaccaaggggtacatctgcagacatactgagtgtcaccgttgaagagagtggagtggcttttgtaaagaagttcaggtacctcagtgcaaaagttagttgaactggttcattcatctctatggtaacctacaaaacaaaagattcatcattgaaaaacatcaagaaagttgcaatctattagctcattatatatttataaaaacccacaaacacttgtattggtcactttggagggagctatgaaaattttgaagactgatacataaagcaaaagactcgattatctagcttgtctttcctatagctataatttagataaccaaattatataatatgggaaagcttttctttatggaagtttttctaataagcagccaataagtgaataaaacgtattaatttcagctctgcaaactctaattaatgacttaatggatctagacaatgactattatagctgctaacattgcaaacacatccagacaccctgtgcctcctactagaggcacacaccaccacctatattcttgctctctcacccccgaaacaaaacaccctgaatatcaaggctccagggctatagctaccagtctgtaggacacacagggtagaggaatttatgtatacacaggaatgcaatcagcaaaatccaaactctggaaaacttaataaatgatctaatttcttcaacaaatagattgtaatggaagggggaaaatgaaattaggggaaaccaggctaggtgtgttggcacacacctgtagtcccggctacttgggaaactgaggcaggaggatcacttaagccctggagtttgaggctgtagtgaaccgactgcaccaccgcactccagcctgggtggacagagcaagaccctgtctcaaaaacaaagaaaaacagaaaaagaaaaaaacgaggttggcaggagtggaaatgtgattcaggaaacagataaagaatcagctcctagactttattaatttaaaaaaaaacctttcaactgaattttacctttatttaaactaaatgttgactacccattcaagggacaagagagcaatatatagtatttattgtaagcttataatatgccacacacagcatatgctaagctctttaatgctaccgtatttaatcctaacaaggttatgaggttaggacctttgtccttgatttacaaagttttaatttatgcccaggttagcgagttttttttgtttgtttaagatggaatcttgctctgtcacccaggctggaggggagtggcatgatctgggctcactgcaacctccgcctcctcggttcaagtcattctcccatctcagcattccaagtagctgggattacaggtgtgcgccaccacacccggctaatttttatatttttagtagagatggggttttgccatgttctttctattttggttaaacaagggctctctaggtactctcaaagttgcatggagtctgctttctagccttagtgagaagtctccttcctgtttaacctttgattcctacagcctgtgactttggctaaattgtcacttaaggttgctcagcctgcttctccacctttaaaatgggctaccaattggacccacaacatgtaagctaatattaggattacataagtgctccaaacaggtagacttttactcctaaccatatccttctattgagctgctgtcctatgctcaattatttggtaagagagtaagtatctccagaaagctaaaggttatacgcctaacttcccaatcctacccttaagagccggtgtggacttgatccataaaccactgttctgtggtatgtacacgtgctgaatttgtattcccttcttgcaaatataattctaaattggatgacacttataaatcattcgcagatttcaacagtatctcaattttcagaaattacttgggatccaattctgtctacttttaattttagcaattaacctaataagcagtattataattctcttcaaactattttctttttacttaaaaactacttacagcttcctcctctttatcgacattacttgtctgtgacaatttaatgtttccatttccaagttctccacttgcagaaaatttcactccgtcttttgcacaggaaattacaacagcatctccaatatggctgagatctcggcatatacgtgcaaattcaccagaaggcatctttactacacagctgtactcctgttcctattaagaacaaaaattttccaaaagttaattgttagaaatttaatgatttggcaccctcactttcttaaaaggcaacacctaaacaactcagaatcaatattttctgattactttaaaatatgacttgcgtaatttcttaacaaactccactcaaaaaaataaatggctattaaatgcaccatccagggaacaagagcctcctcctcctcatcctccagggataaagtaagagaacattagagtatggcacagaaatcatgatggcgcaagcaggcctaactactttctaaaagaaagcaagagaatatattaggcattttcaacattcaaacatttcttctctcctttggtgtttataaacctaacctggataaatttcttccaagtcagctttaaaatccacttaataaaaagcaagcattctagaaggaaacaaattttaaaagaggttcatggaagttaatgcaaatagacaactggcagtaaacaataaatttaacctgtgagttttagacttgtggtgaacaactatccaaatactaaaatctctctttgaaacatgcaccagtagatatatttctagaaaaagttgttatgaagtaggcttaaattatattaacatatcttgacggaggaggatcacttgaggccaggagttccagaccagcctgggcaagactgcccccacgcccacacacaaaaatgaaaaaattagccaggtgtggtgggacaggcccgtagtccttcctagccacttaggagactaaggcaagaggactgcttgagcccaggaatcccaggttagagagagctatatggcactactgcactccagcctgggcaacagagccaagaccctgtctgtaaaaataaacaaacattctatgacataactatcgtgcctgtgtacagcactctctacaatgagaaactgatactcactggaattccaagttgttcaacatctaaatccatcaacttcatttcatagtctgaaactttctcctggtctaccaaaagaaagcagatgcttttgagaaatactgacacagagttttgattttctgtagcttcgtgactcggtaaaaaggtacgacttacttggtgcttcaaatactagcgccaaggtatccgcgttatcttcggcccttagtgtaatgatatcttcattgccggcgcattttagtattttggacatactagaagacaggagacacatgctttaaaatcaacgccgtctgctgaagggctgtatttcgaacgcggttagaaggggttaccactctcacccatcaggccgtctcagaactggtggagggtaagcggactgctggaggatgccattattaatgcagacgttttgggacgcatctggcagtatttatactaaaataccaccagcagtgtcccttctggatagaaacaatctcctgccactaagtaggatgacaggctgccacatttctcgcaagggcattataaagcatttaaagtcaaccgcgactgagccgggaggatcgcttgagcccagaagttggagaccagcccgggcaacacaccgagaccgtctcagaaacaagaaagccacagctaaagcgtccattcaaggccaacaggatttagtgagcaaagagccctggaacagtgttcctggcactgcggaaaaacccttgattttcccgccaccacccgctttgtgactttggcgcgaaaaagcaggttcgcgcagcagccagcgcgggcttttccgaaccgcgcgctcagctgggccccaccccactgcgtggcaggccaatgagaaggcgcggatggcccacgccagccaatgagggctaggctcgaaagcgctcccgccaagcaccggaggtgcaggcgggccggggccggcttcccggggccgcgaggctcacctggtgaggttcacgcccatggccaggttgcggtcgcagcggtaggtgtcgaagccctcagaccgcagggtgagctgcaccaaagagacgtgggacgagtccatgctctgcaggtttacaccgctggagctaatatcccagcaggcctcgttgatgaggtccttgagtgcctccaacaccttcttgaggatggagccctggaccaggcgcgcctcgaacatggtggcggagtggcaacaacgccgctacaggcaggcgggaaggaggaaagtctagctggtttcggcttcaggagcctcagagcgagcgggcgaacgtcgcgacgaccggctgagacctagaaagacaacgaccactctgctacgcctgcaaccgtttaatgccgccgcgtccgcaagcgcgcgctctcaccctgcgccgcgttgcgacgtcaccacgctgtccagcccacggccttgcggggaagactttagggccaatcgtgtccatgctccccgcgaggcccgccccctagagcatacattggaggaagcgggcgcagggcggggcagcgtcgcgcaggtctccccgcctctttgactcctgaacccggccgcagaacaagtccgggcatatgtggagatcgggtcccggtcccggctcgtcaagccccagctttatggtggctcctcagcctcccactacgtgggtagaaagtttccagccacgaaagtgaaagtgaaatgcaaatcaagcctaccgggaggaaaagcctccttgcagcctgaagagagtacagctgctgcaaatatgcactttatttttcaattacagaattgatgcgctcgtaggtgtcacaagataaagaggtgaattgttctgttaaacttagctccctatcatcctcttaacattcccccgccagctcttataatcactcaatcgttcattgtataaagcttttaaagcttttttaaaagttcgaatacactttttttttttcaaaaatgcactcattccgtaaacacttggaaaagtacttaataaagtacatttaattttatgccacgtacatcttttatcatatcagtacctctttaaaacatagcatcacatgtatataacataatttatcaatctcctgttgtttaactacaaacacctttgagcacttaggcaattttggtgatatcaactccttgaagtaatacagctgagtcaaagagcgtacacatttaatattttttcttttcttttcctttctttttgagatggagtcctgctctgtcatccaggctggagtacagtggcgcgatctcagctcattgcaacctccgcctcccaggttcaagtgagtctcctgcctcagcctcccgagtatctgggattacaggtgcctaccaccacccccggctaatttttgtattattattattatttttttttagtagagacggggtttcaccatgttggccaggctggtcttgaacacctgacctgaggtgatccacctgcctcggcctctcaaagtgctgggattacaggcgtgagccaccacgcccagccagaaattttcaattgttacaggatggacaggatttgttgtttctctcttgctttcttcacaccacttctctttagttacttttaataccttggtcagcagaattctttagtttttctaccatgtatctaggtatggagttagttttatttgtcttgttgagggaactgaagattcatttcaagtctgacatattctcaatcattatggcttcaaatatctcctctccttagtctattctttatctctggaatgcctttctttccttttttttttttttttttttttcctagttcagctgtgactccatacaaggttctaagatgagtttcacagtctcttccctggattttgtggagacttaactttacccttctgtatcagcctcttaaagcactgggtcagccttaaaagggaacaggaaagggcatttctattataagatgccttcaattgtaatatgtaccattattttatgtagcacaagcaagaaaactgtcaaacttttttttttattattttctagagaggggagtctccctttgacacccaggctggagtgcagtggcaagatgactactcactgccacctccaacttctaggctcgagagatcctcttgccacctcccaaatagctgggactacaggggtgcaccactgtacctggctaatttttaaatgtttttgtagagagaaggtcccactatgtcgctctggctggtctccaactcctgggctcaagcaatcttcccaatcggtctcccaaagtgtgagattacaggcatgagccactgtgcccagcctcaaactgttacacaatgctttatcacttagaatttctttttttttttctttttctttttcttttttttttttctgagacagagtctcactctatcacccaggctggagtgcagtggtgtgatcttggctaaccgcaatctccgcctcctgggttcaagcaattctcatgcctcagcctcctgaatagctaggattacaggcatgcgccatcacacctggctaatttttgtatttttagtagagacggggttttgccatgttggccaggttggtcttgaactcctgacctcatgtgatctgcctgccttggcctcccaaagtgctgggattacaggcatgagccaccgcgcccgggtctattttgttttaaaagaacttttagactttaaaaacattcttattatatattactcttgtgcaaacatgaaaaaatttaagctacattggttaaggcattcctactgtttctccactcagttagttgctgattctgctgtttttctgtataatatcctactctgtgttgtcaagggtattgatgatgcagtatttttcaatagtgctattctattgtctctggaatttcttgcaagcctctgctactcatttgtaagttttgatgttggcactttcttgctttatgtgtgatggactacccatttgcatacatctcaatatcaaaacataatacagcatcatctgtttgtggttcttttcctttcttgggtccgttaaaatctcagttcctttgcaaaatgtggaatgtgttccttcctccagtgaggaacatttgcttcactaaaaacaaatgcatatgctccactactctgtttcagttctgtctgcttacataataacattttggtttaatgccaaattacatgtaatagatttgaagacattttaaatgacaaactctatccatgggggatccaccatgtacatcaatctgtttatttctgctctattacagaagtgatgtcctcctaaaagtgtcaaatgataaagaggtgtacagttacgtaaattttatgttaaactgaaatgaggacataaacatgcctatgactgtggtcagagaaggcctctctgaggaggtagcatcttatcagagaagacagctgcttggagagttggaaaaaagcattctaggctgagagaatagcatgattataaaggtcagcatacttggaatatattcagacaagtttgatgtagaactcagactgatgtgtctgaagcaagagtggtgcaaggtgaggttgcagagaggctggggtgagctcttgcaggactttgtaggctctctaaaagtgcaagggaatgtggtcaacagcagatctttgatgtgatccaatttacattttaagtggctactctaacatctagtaaaggtactattggatcagtgggagaaagaatgaagtaaattttgatcagataattggttaaactattagaaaagaataaaagctgtagacttttctggatgggcgcagtggctcatgcctgtaatcccagaactttgggaggctgaggtaggtggatcatctgaggtcaggagttcgagaccagccaggccaacatggtgaaaccccgtctctactaaaaatacaaaaattagctgggcgtggtggtgcacacctgtaattccagatactagggaggctgacgcaggagaattgcttgaacccgggaggcagaggttgcagtgaaccaagattgcgccactgtactccagcctgggtgacagagcaaacctccatctcaaaaaaaaaaaaaaagacttttcctaataattattcactaaattctagataaagaattcaaattcaaatcttgacccaataagaaatggaaaaatattttggtaaatatttatgagatcttcctatgggcttccaaacataagaaaaaaacccataaaacataatgaataaccatacaagttttaagacttcagtatgcctcaaaggattatattggttagtatagtttaggtttcagtgacagagaactcaacttgaatggattaagagaaatagaaaatttattcatctaaacaaaaagccagaggtatctggcctccactgtccagtcctagtcttcataaacgtgaagtttgttagccacattaataagcaaagaaatgtaaattcaatggagacagaattttaacctaccaaattaataaaaatcatgttaacacctggtgtgttaggaaggattcaaggaagtaggcacttaaatacattgcaagtgggagtatacattggtataatttttctggtggaaacttagaaatgtgtatcaaaagccttagaattttacttattctttgacacagaaattcgatctctagggttttttcctacagaagaaatcaggggcatttaccaagatcaagcatgcttaagaatgtttcttgagccaggtgcagtggctgatgcctgtaatcccagcactttgggaggcccaggtgggcggatcacctgaggtcaagaattcaaaaccagcctgacctaaaacccctgtctctactaaaaatacaaaaattagccagctgtggtggcgggcgcctgtagtcccagctactcgggaggctgagacaggagaattgcttgaacctgggaggcggaggttgcagtgagccgagatcacaccattgcactccagcctgagcaacaagagggaaactgtctaaaaaaaaaaaacaaaaaacaaacaaaaagaaaacaaaaaacgaaaagagagagagagaagggctctaaagctggcctaaagccctattagcatcacttccaccagacccctgttcgtcacacagtactgacttcaggaatatacttgatctgagttccattaacctgagagggctgagtgtaatggatgagaagtttgttcagaccacatgttatccatcctagtaatcatgctgtgcattctataattctgacttatgtgcattgattctccaagcctccttttattaggctggatttgaaaaggagcagctgagtttctagaaggactgacatgacactcacttagatatgacctttcatacctacgtgcccctgaaggtgaagttctagacactaacatcttcacctgtcttagaagatcatcttgctcgagtgctgtggctcatgcctgtaatcccagaactttaggaggcctatgtgggaggattgctcgagcccaggagtttaagaccagcctaagcaataaagtgagacttcatcgctacacaaaaatttaaaagttagctgggtgtggtgctgcacacctgtagtccaagctactcgggcatatactcatatagaaatcaggaatatataatgctgttttcagaattctcactacctgccccaaaactcacagctcaggtcaaaattaccaataggaaattttagccaggcatggtagctcatgcctgtaatcccagcactttgggagacctaggcgggaggatctcttgaacccaggagttcaagaccagtctgggcaacatagtgagaccctgtctctaaaaaaaggagaaataaattaattaaaatttaaaaattgaaaagaagaaaaatgtaaaattatatttttttaaaaaacgaaattgcaattcttttgtgtgcaagtgtctcattgtgagattacagtatgcttaagttggggacgcagtgttatatgtgttttacatcacttacagggcagtgaatagaaagaacaggaaacaccaaaggcaatgctggagcaacacaagtattaataaatgcaggcaggcagtatagtatggtggttagagtgtgggctggtaacaaacctgtttgtgttctaattcttactaggcactttctagctgggagaccttggctaaggtccttttaaaagttttaaatccatccaacaagtacttacaatggatgtgtcaaagacatagaggatgcacagtaaacaaagtagacagcacttctgtcccaaaaaaggtctttccatagtccagaagacaaatttgaaaaactgaggaagggccaggctcggtggctcacgcctgtaatcccagcactttggaaggcggaggcggacggatcacctgaggtcaggagttcgagaccagcctgaccaatatggtgaaaccccgtctctactaaaaatacaaaagttagccgggcgtggtggcgcgcaccttggaattgtttgcgcccgggaggcagaggttgcagtgagtcgagatcatgccactgcactccagcctgggcgacagagcgagactccgtcacaaaacaaacaaacaaacgaacaaacaaacaaaccactgaggaagatcttaactgtaaaattcaaatcatacccacttccaagccatgtgtggattaaacgagataagccaactaaagcgattactcagctcagtgcctagtatacaattagtgcttaacaagtactagcgaccgcttggcaaagcaaagcagactgaagcgtgggtttcatttctcatcatgtgataagtgataaaatgctcttaaccaggtcggctcacctggcctttccattcgacctaaataacgtctacttacttgcgtaagggaagagctctggcccaggtcagcaagcatttgtcaggctagagcctccgggtggcgcttctcgccctcagtaaccggttacctccagaaccagggcgccagctccggccatcc

SEQ ID NO: 142 - DNA, 184685 bp, Homo Sapiens
tatattattttatattttattcaattttaatatggtttccattattaacttttaaaacaaaatgatttccagtttaaaaaacaatgcactgaccacataattccttttttattttacacagttatacaaatattctaaatacacattttgtgttcaagatgatggcaaataagattaactgtacagtacataaggaaagaaaatattttaagtatatttagaagcaatagaaatgtctatacaaaacaagcaaatggaataaaattttttatttttaaagtattgcaacaggcccacaggtttgtaacaaaaatgtctttgcacagttcctcacaatgccccattaatagctaaagcaagacagcattttttaaaaaaaaataatgtttcaaaatgctacacgtggtactactgtttgcacagtttgatcaaaataacgatctactttgagtcaagcaaaacctagaggaaatataccaaacaacttgaaaatcatttgtataaaaatcattgcacattattttgctcgtttgaaaagtaaaaaagtgtatttacaaaatattttgcagtcaaaattataaagtgaatggatatctcgaagtaacacgtcttgatacagacagttcaaggaaaacacacaaatgctttttctttaagaggttttcagtgctccttccactgggaagtaaacatgatctactcaaatgaatttacaagatggtacacatactggagcaaatccaacacctgcattataaaacaatgtttaaaaggtgacagaatgaggaatttgtacattgtaagaagtgagctattcagagatcaacaagtacattttaattcggttagcatagaagtcttcatagtcttcagataacagacagtgaacatccttgactcgatgaaagttaaaaagcaccatgcacaacagtttagtggtaagcactgaaaaaaatagcacctgtaatactgtgatattgacaatttaaaactggtctaataactgccggagatatggtgccttggacaattctctatttactcgggagagtttgaaaagtactgggcagttcagagaaacacatgggatgtgtcgatcaaagcaacctgtacagttcttgcatatctgaaagcataagagaaatacaaaaaataataggaaagtttttatgcgtgtatgcaaacaacaaatttttataatccctactttctagactaccacagattactggcagacatacattacagaaactttcattaattttaatctcttggaagcctagactaccctatgttgagacatttctaaaggatattattttgtaaagatagagtacaaatttccctaaggattcatttaattcctaagattaactttcatttacaatggaatcctattaaaatctacataagctacccaattaccaaagaatgtctcttacatgaactataaacacgttttcaaagtacttagactatattctcatatgccaatcataaaaaagttactctttttcgtattccagaagagaaaagcaacctgctgaagccacagcagaaaaacataaattgtgaagatttcatggacatttgttagttccccaaattaatactttcataatttcttatgcctgtctttactgcaatctctgaacatgaattgtgaagatttcatgaacatttatcacttccccaatcaatactcttataatttcctatgcctgtctttaatcttttaattccgtcatctccgtaagctgaggatgtatatcgcctcaggaccctgtggtgattgcgttatctgcacaaattgtttgtaaagcatgtgtgtttgaacaatatgaaatctgagcaccttgaaaagaacaggataacagcgatttgcagggaataagggagataaccataaaatctgactgcctgcagggcctggcagaacagagtcatatttctcttctttcagaaagcgaataggagaaatatcgctgaattcttttctcagcaaggaataaccccgggaaaacgaatgcattctcaggggtaggtctctaaaatggccactctgggagtgtctgtcttatgcagttgtagacacgggatgaaatatgccctggcctcctgcagcacccccaggcttgctaggattaggaaattccagcctggcgaattctagtcagactggttgtctgatcacgaaccctgtttcctgttaagatgtttatcaatgacaatgtgtgcccagcacgacatggaccttcatcagtaattctagtttcaccctggccttgtgatctcactctgcctctttgctgttgtgatattttactgcctttgaagcatgtgacccactccctattcgtacacccctccccttttgaaacccctaataaaaacttgctggttttgtggctcaaggggcatcaaggaacctgccaacatgtgatgtcacccccagagacccagctgtaaaatttcaaaaaaaaaaaaaatcaaataatgtgaatttgaaagtagtggtgcagaccagtggttcttaaccctggctaacaatgagcttaaaaataaacaagtgccccatcccagacccataatgagtcagaatctccaggcatgaaagcctaagaatctgtacttcttaaggcttcccagatgatttggatgtataataagatctgatcttaaggaaaataataaatcataaggcaatttttaaaaagagaagcactataatgttttacacaatgatcaatttttaaaaatactttaaagtctcaagttgcatatatagttaaaaaaaaggttataaaacatgaagaacataaaaaaattaaaaaggatgccaatgaagactccaaaggttaagaaaatgcaggccgactttcacctgaatagtgtagacaagtgattttaaaaaagccataccaaatggcaacaactactctggattgtcttttaagagaaatcaaatacgctctagtgaattctttgatctatatttatcaaagggtttcagtttcagagatggctcacaggccagtgaagttttgttctttgccccagttatcttccagttaaccgaagggcacactttttctaagtagactggttactgtatccaatattatgatattgtcacaagcagactgcttacaaacatgtgcttcagtatgctccatgaagactgagtatgctgttctatgatgaagcctttgctaattagatctctgccaagagactcaaatctattcccaaatatagaatttctgtattacagctctatgaattgcagttacattcaggtgccaggacaaactgataaatatttaagctctttctgtgcttgtctgataaataagccaggatggaattacttgactcactaaatttaactcagtgtttagtttcaagatcctttactggtttaaaccctgagcattatagcttgattcaggcttacatttaaaactttagtgccccaacccggacatctactttgtagcacatagggaggcaggcacttaaaaaatatctgctttaatctttattctttttactatcctttggctttcttgttcaaaaaaaatttagtcaaggctgggcacagtggctcatgcctgtaatcctagtactctgggaggcagaggcaggtggatcacctgaggtcaggagtttgagaccacctggccaacatggtgaaactgtctccactaaaaatacgaaaattagctgggcgtggtggtgcatgcctgtaatcccagctactcgggaggctgaggcaggagaattgcttgaacctggaaggcagaggttgcagtgagccaagattgcaccaactacactccagcctgggcaacagtgagactccgtctcaaaaaaaatttttcagtcagatgcttgcttcatttgctttcattctttcatgtttatgattaacagtgttaaggtgatgaatttttctctgaggtctgccatctagaatctgatttgcagtgttttcattttgtttaacagaatttacaagtggaaggatcacttttttttttagtttgtaattaattaccattttatagcattgtattacattcatttgtaatatttctactttttgaaatgtactgaggctttcttttctttctttttttttttttttttgagatgagagagagcgtctcattctgttgcccaggctggagtgcagtggcatgatctcagttcactgcaacctctgcctcctaggttcaagtgattctcctgcctcagcctccttagtagctgggattgcgggtgcccgccaccatgcctggctaattttaaattttaatttttattattttatttttaatttattatttttgaaatggagtctcactctgttgcccaggctggagtgcagtggcacaatctcagctcactgtaacctctgcctccctggctcaagcgattgtcctacctcagcctcccaagtagctgggattataggtgcctgccaccataccctgctaatttttgtatttttagtagagatggggttttgccatgttggccaggctggtctcaaactcctgccctcaagtgatcctcctgcctcagcctcccaaagtgctgggattataggcgtgagccatgatccccagccgaggctttttttttttttttttaacagactatgacttttttttttttttttttttttttttttttttttttaagatggagtcttgctctgtcacccaggctggagttcagtggtgtgatctcggctcactgcagcctctgcctcctgggttcaagtgattttcctgcctcagcctcctgagtagttgggagtacaaggctcatgccaccatgcctggctaatttttgtattttttagtagagctggggtttctccatgttggccaaacgtttcaaactcctgaccccaggtgatctacctgccttggcctcccaaagtgttgggattacaggcatgagtcaccacacctggccagatatttttaaaacattctagaaacacttaagaagtatattttttggtactgggttacagagtttgatatataatcacaaggtctgacttataatgtttacaatttccataatttcacttatttctgatcacttgattggtcttggattgagaatgatgtaaaatctcctgtttggatgtgtttctaattctcattacatctctagtaatttctgcttcattaaaaatttctacaaattagtgcatgggagacatttaaaacattctagaaacacttaagaagtacattttttggtactgggttacagagtttgatatataatcacaaggtctgacttataatgtttacaatttccataatttcacttatttctgatcacttgattggtcttggattgagaatgatgtaaaatctcctgtttggatgtgtttctaattctcattacatctctagtaatttctgcttcattaaaaatttctacaaattagtgtatgggagacattcatttgaacgttcttgaaaaacacctcaaattaaaatagctcttgaaagatgacaaaccatcattatttataaatagcatcgctttttcttttttttttttttttcgatccaagggtatacatgtaggtttgttacatgggtatactgtatgatgttgaggtttgagcttctaatgatcctgttgcccatgcagtaaatgtagtatctgacaggtggtttttcaacttttcctctcctcaccccccttttggaatccctagtgttcatcattcccatctttatgtccatgagtacccaatgttcattatatgtgagaacatgcagtatttggttttctgtttctgcgttaatttgcttaggataatagccccagctgcatccatgttgttacaaaggacatgattttgttctttgttcttttttttttttttttgagacagagtttcgctcttgttccccaggctggagtgcaatgctgcaatctcagctcactgcaacctctgcctcccaggttcaagcgattctcctgcctcagcctcctgagtagctgggattacaggcatgtgccaccacgcctggctaattttgtatttttagtagagatggaatttctccatattggtcaggctggtctcgaactcccgacctcacgtgatccgcccgcctcggcctccgaaagtgctgggatttgtaggcatgagccaccacgcccggccgattttattctttttttatggctgtggcatcactttcttttaaactgtatttttataagaaataagatggccgggcatcatggttcatgcctgtaatcccagcccttaggcagctgaagtgggaggattgcttgagtccaacagtttgagaccagcctgggcaacatagtgagacccgatgtctaaaaaaaaataattagtaaaacatggtgggatatgcctgtagtcccagctacatgggaggctgagctgagaggatcacttgagcccaggaggttgaggctgcaatgagctgtaatcatgccactgcatttcagtctgggtgacaaagtgagaccctacctcaaaaataaaataaaataaaaataaataaataaaaagaaaaaaagaatgaacacctaatgttgaaggaggatgggctctgggtaaattgatggcaccaagtagtgatgtgtttgtcattgagtgcagaaaaaacataagaaagtctaggaaaggaccatttaacagcctgaccttagcagagccctggaggtcctgctctcatttaggcgtcatactaggatccagcaagggaattttctatgagagttggctgctgccatcaggacagaagtctattaaataaatagaagctgggagcacccagtgacttcagtggttgtactgactagaaccacaaaactggtaaaaaatggctgaaagttggttggtaataactccagtgatatattccttctttaatcatgcattaaccaggaacttgttcatttattcaataaatatttacagaccagccccatgggcttggctatatgctaggcataactgacttgacagtcaaagaactgggcctctgtcctcactggttcatttgctatttagtgaggaagacagacaaaccccaaatcacagtaaagcagaggagattatggcaggagcctactgcaaggaaggcttcacccagtccagaggtttcagctgattcctcagaagatggggggtggggtgggataggtagaggaaagtgttcctggcagaaggagcagggtgtttaaaggccaggaggaggcggcgaggggcattcacagacctaagagaagttcaatatggtatgggtcgaggtagagtgtgacagagaagagcaagaaatcgtgacagagggatagcaggtagggacagaacggagatgacttatcaacaataaggagtaatgattttattggggggtgcgaggtggcaaatttttctttagatttcattcttcaacttactttgagatgtttgttgtttatttctgctagaattctcatacttgaaaaatcatccttgcattttatgtctatatcccagctcggccacttagcagtgtaacatgcaaatcacttaaactctctgtatcagtttactcacctgtaaaggtgcctagaacagtctgtggcacacagtatgactcaatcatgccattaatcatctacctggactcacagaattataaaccttccaagtttactagcaagcaattctctaagacaactaggtatttttctttaaagaatggtaagcactagtagagcaattgagacttttcctttcttctttttaatactgtagattgagtatcccttatttgaaacgcttaagaccagaagtgtttcagatttcaaattttttcagattttggaataagtgcattatacttactggttgagtatcattaatctgaaaatctgaactctgaaatgctctcatgagcattccctttgagagtcacgttggtgctcaaaaactttcagttttggagcattttgaattttgatttttctcaattagggatgctcaacctgtattataaaagaaattggatggatggccattcttgttgtagctattaagaaacacaacacactattccataaaaaaaacaaaaaataaattataaaacaaaccattattaatagtttatgatatttttgagatttttaggaagtttatcatttagactcttcatttcacttttcacaccagttttgtatctcacactataattcaagagtgactatatcttcctgtaagatcagactgcttgtgattctgggcccatggaacaaaactgtacctttacaagttgctcctgttgacgttccaactcccggatttcttggttgaggatgactgcaacatgctgaggttggctccgacatttactacagatgccatgctgagttaggtcatcacacacaggacagtgtaaggtagtaaaatattgtgaaatagtgcctttccgcccttcaggttcacttcgcgaggagctggtagctttatggatctataaaaacatccattcagaagtaagcctgagtcagcttcacagcaaagctgctattttcatgctaattacaggtttactcaggcattcattcattcgttcattcactcattcaacaaatgttgagtagctactatgtgccaggcactgttccagacactggagctacagaaatgaatgaagtccttgccttcatggaacttacatcttaatattatcagatacattttttttttattattataatttaagttctagggtatgtgcaggtttgttacatatgtatacatgtgccatgttggtttgctgcacccatcaactcatcatttacattaggtatttctcctaatgctatccctcccccagctccccaccccccgacaggccctggtgtgtgatgttccccgccctgtgtccaagtgttcttgttgttcaattcccacctatgagtgagaacaggcggtgtttggttttctgtccttgtgatagtttgctgagaatgatggtttccagcttcatccatgtccctgcaaaggacatgaactcatccttttttatggctgcatagtattccatggtgtatatgtgccacattttcttaatccagtctatcattgatggacatttgggttggttccaagtctttgctattgtgaatagtgccgcaataaatccctttgtaaaaaagttattaggttagcctcttacaaatgtcattgggttaacattcttgccgatgatgaaatgaacattagtaataaagaatctgagtttcctgccttagagccaggatatgtgctcagaacacttagtaacatataggtgggcaagatcatctaacacaaagcctattttataataaagtgttgaatatctcatggaatttattgaatactgtaccaaaaatgaaaaacagaatggttgtatgggtacttgaactacggtttctacagaaggcatatcattttcgcaccatcgttaagtagaaaaatcttaagttgaaccatcataagttggggaacaactataatgctattttaccattgcagtaattctttactctggtttcttcagggctgtgtctagtgtgtctagatactaaatcctacacctttcttagacattcatttcgaaggaatttttgctgtacatttattttctattaactggcttattctacgttatttgcggctaccattgaaattgttgtgggatttattttaatatttctataatttggccaacttgatagaagctaggaatgtgtttgtagaatacttaaaacgtttatcttttaggaaaccaggagagcatggcatctttgccagtttaggacagaggatctgctttgctctcacagtgaaacaggaaaggttcccttgttccccttgcagggtgtgcgagagggacaatggctcgcttcttcagtgccccgctgctcaaacctctaggggagcacacagacgggcaggttgtggagctctggccccatggcagtgtctaggggtgaatgtttacagctgaagccccagtgggtgtgtgttacagggtattcttttagtttgctgtctataggcggcttgtgttaaccagctcaattagaccctctagcttgtctcaaggatggagggctttctgtattccgggttcttgccttggtgtaccagaagaatccgatcacccgtgggctaggagaatgagtgcaacgttttattgagtggaagtagctctcatctgatggtggaatcagcagggagatggttttcccctggagttgggcttctaggtggccccgtctcttctctgactgccctggccaaactccaccttgtcctgccggtcaatggcctgccagcatgccagtgcctctcggtgtgctgttctgctggcgtgctcctcttgacgaccagctgcttgggtcttccaccgaagtgttcctcacaatgtccagccgctcgtgtgtctgcccactagggtctcgggtttttataggcccaggattggggcatggcaggccaaggtggtcttggaaaatggtaacatttgggcatgaaagcaggagtgcctatcctcacctagatctgtgggggtggagccctagccagggacccacctttctctacccagcacttcccctcccgctttccgtatcattttacgggaccacactcttcccttcccagcactcccatatcaatagcacataaaacctttagttctactgaaaatttggagtgaaatctctccatagttagagcacatgtactatttggtaagcttacccttggtaattcatgataccagctgaagacatcaataccaataagtgagaagattcttgccaagggtggaaggatttgcttggtaatatagtaagtagcattcagtctcagagttgggtcctgcaggacttccactgggcgccttacaagctggataagtggtactccgggggtcccataaatgatgacgtatggcactcgctccccaacctgaggctcagagcgccggtcataagtcagcattttcctattcgaattcaaagaaaaaaaccacacccaaatactgttatggaagccatctttctcacaaattaagtcagaattaaacaataataaaacaatgaaaaaactacaaaagacaatttcaaaacagaattactatttctttgagaataatatatatacattttgcttagttgacaccaagtgtagatatcctacaagagtttaaaaattactctgtaaatcactgttacctggaaaataatgagttggcagatatcaactagcttaagatgtattttaggtgggagtggtggctcatgcctgtaattccagcactttgggaggccaaggatcacctgagcccaggagtttgagaccagcttgggcaacatagcgagacccccatctccacaaaaaaattagccaccataatggtgcacacctgttatcccagctacttgggaggctgatgtgggaggttcgcttgagcctgggaggtcaaggctgcagtgagctgtgattgcaccactgctttccagtctgggcgacagagtgagaccctgcctccaggggcaggaaaaagatgtattttatcccctaagaatgagaactaactatcattaaatctatcatgaaagataagagaaaatttacctggttaaactatctgattccagaatgataccatctaaatgctttggtagaacaatattaaggactacctagtgattttgatgtgggaaaaacaaatgaatcaaggactgtgtcacaatttctttgcataagtttctgaaggaaagcccaaaagaggatttcctcttcacatcttacgaagtatgagggaatattcactaactttcagtgaggcttcatgtgcgcaggtaaagaaacaattttgtgtctgtgtctatggactgtcttttcatttgggtcttctagacctgtgcagaatctcaggactatcctggcaaggtactgagggtatcattaccttgtaagttcaagggctggcacacaagctcctggtttataagaaaaacttcctctgtattccttggcaaagataaagtcttgtatgctggcctttccttccagaagcttcatacattgtcgctgaacatactgtttaattagacttatatctctcgtttcaaatagcagctttagagaacgctcaagtatcttaaaacaaaaaagatatgcaagtaaagataaaatatctcctagtatgtttcaccattgttattacactttcaattatgtaactactgggtaacctgctaacctacctaaataatctgttacttacaatgatgggataataaaattattaaaaattgaaagttatttgagactttagagagcttgctatttctaaaaatagaatatcatgtagtttaaggaaaaccatgtggaatgacatgcaaattaacatttgtcatgtgataagcaacataaaacacgttaagttttttttttttaatagtcaaagcctctaggtacaagaaaccagacacgatttcatgtattgtttttttatttaccagtatagaaagggtcctgattcagtcacaggaaacacagagaagtttaaagatcaccaggcagtcaaatcaaaatcagcctttttgactttttataaaaatgttgataaataactatgacagaattttctgtgttggaaatttctactaggaaataaccagcatgcagtggatttatgtaagattaattttttttttttttttgagacggagtcttgctctgtcgctcaggctggagtgcaatggcgtgatctcggctcactgcaacctctgcctcccgggttcaagcgactctcctgcctcagcctcccgagtagctgggactacaggcgtgtgccaccacgcccggctaattttttgttttagtagagatggggtttcaccgtgttagccaggatggtctcgatctcctgacctcatgatccgcccgcctcggcctcccaaagtgctgggattataggcgtgagccaccgtgcccggccaagtagattaagttagttctaggtgaaagctctgtgtcttattctgaatactggaaccaatggatatttatacaataagcttattaatttagcttgagtacaattctgcctacagagaaagaaggtactggattatatctcttccagaaatagtgctgaaaaaaatcccaaattcacataatattatatatatgacataatatattgataatattcaatccactatgcttttaatgctctcatcaaacagtatatagaatgctattcccatttataccatttatttttgttttgctatagaaggagtctaggcccgaataaagaaaaagccaaaaaatatcagggttattatggttgagaaatttgagtaatttatagctaattgtttggaaatcttcctaatttgtatttgataatccaaataaatgaaagttcagttaatctggaatggattatgtttctctctttttattttgatggagtctcactctcttgcccaggctgagtgcagtgttgtgatcttggctgtctgcagcctcctcctcccgggttcaagtgattctcacacctcagtctcccgagtagctgggattacaggcatgcgccaccacacccagataatttttgtatttctagtagagatggggtttcactacgttggccaggctggtctcgaactcctgatctcaagtgatctgcctgccttggcctcccaaagtgctgggattacaggcgtgagccaccacaccgggtctgtttgtcttgtttatcctgctctgctttcaggagttgttacactatgacatatatgatctccaggcaataggcaggaaactctcatgtattgctttttagtaatttttgataaaacgtaaggtatgggaggaagtcagaaacttaaggactaaaatcaaataaattgtttttattagaaataaaattctagctactcaggaggctgaggcagaaagattgcttgagctcaggaggtcaaggctgcagtgagccaggattggactactgcactccagcctgggtgacaaagtgagaccctgtctcaaacaaacaaaaacaaaataagacactacaaataaaattctcaaaattcatgtagttactcctatagttatattaattatataggctatagttccttcacctagatgcatgtttaagggtagttacattttcaccagacactttagccacttatttcttacagatgaagacaagatagataaaccttaccttagaaacagcagggcaggaatctcttctgactgtttctattccttttgcatcaaatactgggtccttctgatccagtgtttcatacatgtaacccacatacctcttttttgtttgtaaaacacagggcaaatatacctgtggtaaaattaataaaatgcctcttaaaaaccatttccccccaccaagaatgttttatttttatgtctttgtgctttctttaatcaagtatcaattatttaaaaaattctatatatgactttgggcccaacaaattcatgatataacacgtgggagcaaaatgaattgtctttaagttgttaccacttgctcactccttttcttgcgctaccagttttgtttatttactgaataaagtataaacactttagcttggcattcaagacagtctacagtctggtctcaactttatttttccggatctatctcctgcttccccgtatttccatactgtccttttccaattccatacatgccattttcttctgtgcagaatgattgcagccccatgtctgcctactgaaattctaacaatttttcaagacatagttcattgttacttcctatatggagtctccctatccagcccaggaggacgcaattcctcctttcctttgtgctctcacagtgtttaagcgggctattctcatcttgctttccgttatgtttacaacaagagactgcttatatacattcctaacctttccttttagattactggctcttagagggcaggactgtgtcttatgcttcttcgtattccacacagttcctaggctaagtatcttttatacagaaagaaagaaatacatatttgatatctaaaggtaagtgaaaaagagttcaaagtccttgtggtagactttgttttgcaaagaaagaatatatcttccatcctacatggtcttcttacaatgtgactttgacattcttcctattaatagtggggtctaagttcactccctttaaatctagagaggcgtgggacactgtgttactttgagcctgggtcatacaaaacaaagcagcttttgtgtttctttgggatgttcacacctagaacccaaccctcatgttgtgagggagaacaagcagccccggtgaaaggccactggtaggtgttctggctgatgttccaactagtagccagcatcaaccaccagacatgatggtaagcaagcttcagatggtttcaacccttagctgctggttgggttacccctaacccctaacagtcttctcagctgaggaactagacatcgtgcagcagagaaaagccattccagttgcaccctgtctgcattcctgagccagaaaatctgtgagcagaatgaaatgctggctgttttacaccattaagtttggggtgatctgttacacaataatagttactggaacaaagttttcatttccttacatatatacattactaaacaaattttgagaaaattatacaaaagagaaaatatttaaatactttttttttttttttttttagagacagggtcttactttgttccccaggctggagtgcaccggtcaatcacagttcactgtaaccttgaatacctgggctcaagtggtcctcctacttcagcctctggaacagctgggactacaggcgtgtgccactatgcctggttaactttttaatttttgtagagatggggtctggctatgttgtccaggctgatctcaaactcctggtctcaagcaaccctcctgctttggcctcccgaagtgccaggattacagacatgagccagtgacccaaatttaacactttaatagacccgtatactgttagtgattctgaaaatgtactgaacaaatcagaggtctctagaaggtatatgaattttatatgtaattactaatattacattcctcttaccttttcaaacttcaatttcactggtttaggattggtagcagttacagcttcggcaatttcctgaccaatcttaaaagactgctccttagtggctcctttcagtagcacaaacatactaaggggattaaaaataaagtaaggtaatgaggaagtcattataacaaaaattttatcaagagtaactttcctggctatgactcttgtctaatgccaaagaaaactccctttctcctatttactctttaagatgctttctatgtaagctctcctgttttattactttccttatgtacttatatcttgttacaaatcttttaagacatccaatatttctaacacacagatcagctcagatatcccagtagtcaagaaagtcctggatcatccctggacatttaaggctttgtatggtacacaaggggtcactaaccccaaggctacagactgataccagtcagtctgtgatcagtggcagatcagtcagatcagtggcagcattagattctcataggagcatgaaccctattgtgaactgcgcacaagtgaaggatctaggttgtgtgcaccttatgagaatctaatgcttgatgatctgaggtggaatagtttcatctccaaaccacctggtctgcggaaaaattgtcttccatgaaaccgatccctggtgctaaaaaggttggggactgctgtggtccaggcacagtggctcacgcctataatcccagcattttgggaggccaaggcggtggatcatctgaggtcaggagtttgagaccagtctgaccaacatggtgaaaccccatccctactaaaatataaaaattagccaggcctggtggcatgtgcctataatcccagcaacttgggaggctgaggcaggagaatcgcttgagcctgggaggcagaggttgcagtgaactgagattatactactgcactgcagcttaggactccatctaaaaaaaaaaaaaaaaggttggggaccactgtggtacacagttaagtacatcacaaaataagagactatatgattataagaaaatggaagatgtacttgtgatatgggagaagttcccttaaggctagaatcactcaacttaaaaaagaaagacattggctgggtgcggtggctcacacctgtaatcccagcactttgggaggctgaggcgggtgtatcacctgaggtcaggattttgagaccagcctggccaacatggcaaaatcccgtctctactaaaaaaatacaaaaattagccaggggaggtggcgtgtgcctgtagtcccagttacttgggaggctgaggtgggagaatcgcttgaacccaggaggcagaggttacagtgagctgagattgcgccattgcactccagtctgggtgacagagcaagactccgtctcaaaaaaaaaaaagaaaaaaaaaagacagacatatattctgtaatgtatgttaactgaaaaatagttagaaaacataaaaagacacacggaagaaaatcaacatctgtaatcatatcatatacaaaaaagacattacaaacactttgtgtatatctgtaaatcttttcatatgctataatggatcatgttacttggtaatgaataatattgaattacatgaataaaaaacaccaatataaaatatactcaaaataccaatacaaaatatactcaaaaataactgataaaatgcattgggcatctttttttctatttcagtatattctacaacctgaccaccaacagaagtaatggttaataaatatttaagtaagatagattataaagttcatcttcacttatatttctagtgaaaagacattaaatagtggaaatggatgatatcttgaaacatgactttaagattcttttttctagccatataaaccaatctcatatttctgaagtgtttttatactggatttttaaatcccattttggatggtttctttggaaaaagtccctgctaataatggagacagtacttgcctgacagcctaatatgaaaaattaaaagaaaggaaaaaagtagtttattcaactctactaaaagtctttaaaataaatattgtctcaatctgaattaattttaacattcactaaggtagaataaaaatgccttagttaattagaccttcaatctaggctatacttcgaaccatctgaaggttttttttagtttctttataggccatctgatgctcatttataccaatactaccttactttattttatttaagaggcagggtctcactctgttaccgaggctggagtgcagtggcataatcatggctcactgcgcctcaacctccttgtactccttcacaataatttttcagtctattcctggccccaggttcaatacataagacttgctttctgttatataggttttttccaagaattttatataaatgagctgggtacagtagcttttgcctgtaatcccagcaactctggaggctgaagtggaggactgcttgaggccaggagtttgagatggcctgggcaatatagttagaccctgtctctaagtaaataaataaaaattttatataaatgaaactatatagtatgtactcttttatatctgtcttctttcactcagcatattttgagattcatccatggtgtcagaataacagcaactggttggtttccattgttgagcagtattccactgtatggatataccacaatttgcttgtccaatcactcactgatagacgtttagatattttgcagttttggactattacgaacaaagctccaatgaagaatcatacacaagtttttgtgtggacataggttttcctttttcttttttcttttttttttttgagacggagtcttgctctgtcacccaggctggggtgcagtggcgcgatctcggctcactgcaagctccaactcctgagttcacgccattctcctgcctcagcctcctgagtagctgggactacaggggcctaccaccacgcccggctaattttttgtatttttagtagagacggggtttcaccgtgttagccaggatggtctccatctgcccgcctgtatttttagtagagacggggtttcaccgtgttagccaggatggtctccatctgcccgcctgaacctcccaaagtgctaggattacaggtgtgaccgtgcccggccaggttttcttttttctaagataagcataaaggagtggaatcactgggtcatatgctaagtgtatgttgaacttcatgtgcaactgccaactttttatgaaagattattcttaaaatgttcagatgcaatgatgaatgcaacattttttttgtttgttttttgagatggagttttgctcttgttgcccaggctggagtgcaatggcgtgatctcagctcaccgcaacctctgcctcccaagtcaagcgattctcctgcctcagcttcccgagtagctgggattacaggcatgcacgaccacgcccggctaattttgtatttttagtagagacggggtttctccatgttggtcaggctggtctcgaactcccgacctcaggtgatctgcccaaagtgctgggattacaggcatgagccaccgcgcccggccgtatgcaacatttaaaataagtgcacatacacatatttctgtacggttttataataggcaaaactaagctacagtaataaaaatcagataagtggttgtctagggcatggagtgagggcgagggattcactgtaaagggagaataagataactttttagggtgataaaaagtgttctatatcttgacgggcatgatagctggtaacttgggcctatatattttaatattttattacatactatacatgttgttaaaaattataattccataaaaatgataaagaaataaaggtacatatactttacatcttaaaagttattattggctgggtgcggtggctcatgcctgtaatcccagcactttgggaggccaaggtgggtggatcacgaggtcaggagttcaagaccagcctggccaacatagtgaaaccccatctctactaaaaatacaaaaattagctgggcatggtggcgcatgcctgtagtcccagctactcaggaggctgaggcaggagaatggcgtgaacctgggaggcagagcatgcagtgagctgagattgcgccactgcactggactccagcctgggcggcagagcgagattctgtctcaggaaaaaaaaaaaaaagtttctgctaggttgccacggctgggaaaggtactgtgtatgtgtggggaagtggagatggttaatgggtacaaaaatgtagttagaataagacctagtatttgatagcacagcagagagattacagtcaacgataacttattgtacatttaaaaataactaaacgtttaattggaatgtcatcataattggaaggtcatttaccttcgtctatcagatttccttcattttgatgatgaggcaactaagcctcagagaggcaaaatgacttattaatggttatgccatcatctaggagtatagctagaaagagaatccaggtctcctcactctcagttgggaactcctttttttttttttctctgagatggagttttgctcttgttgcccaggctggagtgcagtggcgcgattttggctcactgcaacctccaattcctgcgttcaagtgattctcctgcctcagcctcctgagtagctgggattataggcatgcaccaccacacccagctaatttttttaatttttagtgatccacctgcctcggcctcccaaagtgcagggattacaggtgtgagccactgcacctggccttttttttttgagatggagtttcgctcttgttgcccaggctggagtgcaatggcgcaatcttggctcactgcaacctctgcctcccgggttctagctattctcctgcctcagcctcccaagtaactgggattacaggcatgcgccatcacgcccagctaattttgtatttttagtagagatggcgttctccatatggtcaggctggtctcgaactcctgacctcaggtgatctgcctgccttggcctcccaaagtgctgggattacaggcatgagccactgcgcccagccaggaactctttttcactccaccaggcattacctattatcccaagagcagtgtttctcaaccttttatcattattgtccttccaaggaaaaaaaaacacaaatttaaattatatttaacaaggcaaagtaattactaagaagtaaaatattgttgggtaggtctgggcactgtggggccaaaaactatggtactgacttttttgtgtcctccttcaagaacttacttgtattctgccagggtgacactgttgtgaattgctctcatacagatgtcactaaacgtttgggtttcttgtttttgagacagggtctcattctgtcatccaggctggagtgcagtggcatgatcatggttgactacagccttgaactcctgggttcaagcgatcttcccacctcacagcctcccaagcagctaggagtacaggtgcacaccaccatgtccggctaatttttaaattttttgtagagacagggttgcactttgttgcccaagctggtcttaaaacttctgggctcaagcaatccacctgccttggcctcccaaagtgctaggatttcaagtatgaggcagcacgcctggccaatgtttgttgaatgtatcaggtagtgaatggtgatcaaaagttttaatgacattgcaagtaaatttcctttgactggaatcatataataactataaaatctgatgtagagagaaagcatcagctaggaatcaaaacactgaatatcaatttatggctctttactgactagttgcaagatcttaaatttcttatcctagggaaatttgttcttaataagcatcacttgaggcacattctaagctctccccaagtatgaaaactgctggcctaaataatatcaaaatcccttccggctctgacattctgtgagtctattattttttgtagcttgacttcttacagatcttaaagggtaaataatataactacaatcagaatcatgctgacttctgggtgttgtcaacaacatggatagcccctgaattaaaatcagtaagttaaaggattaacatttttccctaaatattttttaaggagttctgctaacaagtggagaacttattttagtaactcttattttgctggaatacccagcagaagtagtttcatagaacaataaaataaccaaagccaaactaagaagtggcttttgatgagcaacaggagagaatatggataattagggcctggataatttgaaactatccccaccggctggtaatgaaacagctgctctataaggcaaggtctcattcagcattaatatgattatgctgtctgtatgaacattttaaagaactggataagattaaatgctgttcaaagattacttataagctatttaatgatcagaagcattatctcctattgctctgttggactgtaaagagatcagaggtcttgaagcaagtgctcttagcatgatcacactgtgactctacgtccccaatatggaaaaaatttcactgtaagaaatttgaatagtgcctacattctagaagaatttcaataagccatgcaaaaaagatgttacataaataactgaaacctgaaaaatatcacagcaagcaggaagcatgcaagctggtgttaataacttacattattaataacgtgccttcaaatgcaggcacattatttgccaatccataaataataggcttgaggaagtctgtggaccctctggaatcaaatggaaaactgtatttgcctatatgcacttctcttagaaggtcaacatattctggggccgagtggtaagttaaccattcacagttctggcaattgtccttcaaaaacagtttattttaagatatacacttaaattcagagagttacagctatattagaggaattattcacattaaaagtagtttctttaaataaactagactcctgtgtacacagttagtttacagatcactatctacttggcttagagctacctggagggaagccataggtatcttcagtttgtggctcaggacacaaactgtctcttacgatcctatctggtaaatcaggatctgtgttaactctgatcatgagatcgtaaggactggaaaggactcagacagaactctgtttttagaaaagattcccttaagccattttaaacactgaaatgaagatctagagagatgcaaaagacaactacaaaaccaaaaacccattacctgtcagtatcgccatatacaaccctagccccccatttcttggtatcattcaccagtttaatagctcgttccaaggtctctctggctttgtgaacaatactatcgccaacctgttggtacaaacacattggaaataatttcttaacatagctcagtataagttaacagactttaacatataatacatttaattactaaatatttccagaaatgaaacgagaaaagaacgtaaaaaagaaatcaaaatagccatcagtatcatcattctttctacaagtactcaagaagaaactgaggtgaagaatttgaaagaaccaatcaatatacaaacttgtctttgagtataacagtaagtggactgcacttgttacaaggtactcagctacgttggattcttggaagaataatccttctttattcaagaactttttttttttttttgaggagtctcactctgtcacccaggctagagtgcagtggcacaatcttggctcactgcaacctctgcctcctgggttcaagcgattctcctgcctcagcctcctgagtagctgggactataggcgcacgccaccacacccagagaatttttgtattttttagtagagatggggtttcaccatattggccaggctagtcttgaactcctgatttcgtgatccacccacctcggcctcccaaagtactgggattataggcgtgagccaccgtgcccgacctattcaactttcttatgtgcccttacaactcatcaggcagaaaagcactctttgtgggtgcatgagtatatgtacgtgtatctctcaaaatttttctgttgaagtgttgatgataatgtctttcaatatcattaaagttaatgctgaacttcaatcttgtcactagttatacaaagaaaaatgtatctaattatatgatgggaaatatattaaaactgttcaatttaaattaaataggtagatatatatctaggaaggttttactcattggtgattagtgaattttaacagtgaccacagcatgagtttacaaaacaaaaagatgctgggccttgacaaatatgagaagcatgctaatgagattttacagttaagtaaattaaggagactatataacaatgctgttttatttattaaactcattaaagctaagagtgggaaaaattgccattcaacataaaacataaatggagcattccttttgcaattttaaaacgcaaactgcacatttttttttgttaagaagcaaacaatagcaataatcatccttctccctttactgtaaaatttgaattactaaatataggattgaatagtatttaaaaggctatttaaaattgcattacaaaggacatattaagtacatgaacaaaggaataaataataaaactagtagtagaaacgagttgggatttatttatttatttattctgatttatttacttattttgagacagagtctcgttctgtcacccaggctggagtgcagtggtgtgagcttggctcactgcaacctctgcctcctgggttcaagcaattctcgtgcttcagtctcccgaatagctgggattacaggagtgtgccaccatgcccagctatttttcgtatttttagtagacagggttttgccatgatggccaggctggtctggaactcctggcctcaaatgatccacccgcctcagcctcccaaagtgttgtaattacaggtgtaagccaccatgcctggccttaggttttaaattaagattatgaattctgctgagacctctagtacatcagaaaatcttgagaatgtaaactgtaacttaatacattacaaaaatcatgttatctaatggaaactcaaattgaataaaatgttctgttacctactgccactttcaaacaaggtcaacttttaaatatgtgaggaaaaagagctgcataagcaagccattttagtgtcaaagtcaaatatacttctgagatgtatacttacaagtatatactcgaacatatacatagtggtcttaaatgtctgcctaatgctcttactctggcgcatttaagttataccccaaagagtcagaactctgcagttacccctgaagaccacataataagaagaattcagcagcactagagtgagggggaggcggaagagggaaggagaagtaattaaattaacagattctgctactttgtgccaaggttcctaacctgaaaagcattacttcattaaagggctaagagaggatttaaaagaggaaaagaaatggtttcacaatttaggccatgattggggatgctcaaaagtctttttttttttttgagatggagtctcactctgtcgcccaggctggagtacagtggcgcaatctcggctcactgcaacctctacctcccgggttcacgccattctcctgcctcagcctcccaagtagctgggactacaggcacccgccactacgcccggctaattttttgtatttttagtaaagacggggtttcaccgcattagccaggatggtcttggtctcctgacctcgtgatccacccgccttggcctcccaaagtgctgggattacaggcgtgagccactgcacctggcctcaaaagtcttaataaaaacaaatgttttaagtaaaaattaattccctgaaaagacataaaaaggaagaaataaagttcagacaattttttaaaaggcacaaatatacctttatcataaatatgaatgaccaataatttagtagaaaactgtcaacatataaaaattttaatttatgaagtaagtccaactgagacagagacattaacctccactattagctactttattctccatattctcttcataggaatttttgcttaccaagtcttgtctttctctatgatggtactgagacagagacattaacctacaactattagctacatttatttattctccatattctccttatatgcttacaaagtctcatctttctctatgatagtccagatctagtacttttttgattgtgtgttctctgaaggaaagcaggagaccacagtcagtaatccatttgcctcccgcttttaaaagcttttaattattctggatacataactgttgtatatatacgtatatgcggtacatatgatgtacacaggcagacaatgtgtaatgatcaaatcagggtaactgggatatccatcacctcaagcatttatcatttatttgtgttagacatttcaattccattcttttagttatttaaaaatatacaataagttgctgttcactatagttactgtgctactaaatactatattttattcattctaattgtatttttgtactcattaatcatttctactttatctccctccctccccacctcattgcctctggcaaccatcattctactctctatctccatgagttcctttattttttttagtttccataagagtgagaatgtgtgatatttgtctttctctgtctggcttatttcacttagcataatgtccttcagttccatccatgttttgcaaatgacgggattttattcttttttagggctgattactggacaaatgggatcacataaagctaaaaagcttctgcacagtaaaggaaataatcaacaaagtgaagagacaacccatagaatgggagaaattatttgcaaactacccatctaacatgggattaataaccagaatatgtaaggaactcaaacaactcagtaggaaaaaaacaaataattcgattaaaaatgcacaaaaggtctgaatagacatttctcaaaagatgacatacaaatgactaacattactaattagagaaatgcaaatcaaaattataatgagatatcttctcaccccagctaaaatggcttttatccaaaaaacaggcaataatgaatgctggcaaggatgtggagaaaggggaacccactgtagtgggaatgtaaattagtagagccactatgtagaacaatataggatgctgcaaaaatctaaaaatagaactgccatatgatccagatatcccactgctgggtatataccccccccaaaaaaaaaaatggaaatcggtacattgaattgatatctgcactcccatatttattgtagcactattcacaatagccaagatatggaaacaacctaagtgtccatcaacgagtgaatggataaaggaaatgccatattatgtgtacaatggaatatcatacagccataaaaaagaatgaagccatctgccctttaaaaaaaaaaaaagtggctgatatcttccatttttactctattggtgctaacttttcacttattcatgagaggctctttctgtgatgttagctgctttttccactcatgatttcacctagaagttaacattgtactgttgcgaagttagcatatgatgaggggtcaaatgcatgcttgcagtcattaatctgaggatagctgagaagaccagggtcaaggaagcaggtactgcttggcagtctgagttcaccgtgcaaagcagcaacgtactccctggtgaaaccctattcctaaacttccactgctagttcaaaaatcctaccaaattctggttattctaaagttacagtatttacatattttaaaaatagtataatttctgcattattactaaaatacattaataaacacttttaaaaccgagaggcagggaagaaattagggaaatgtggaaatggcccctaagaaaggatttgggacaagcatggtcgctcacacctgtaatccctgccaaggcaggagaatcacttgagcccaggaattcaagaccagcctgggcagcagggcgaaaccccatctctacaaaaaatagaaaacttaactgggcatagaggtaagcacctgtagtcccagctacttggaggcagaggtgggaggattgcttgagcctgggaggtcgaggctgcagtgagccgtggttaagccactgcactctagcctgggtgataaagcaagacgctgtttcaaaaaaaaaaaaaaaaggatagcttttggttttacattagtaatatcatttccattttttttttcctgctagatcatatagatcagtggttttcaaatgtattaatatgaacccccaggactgacaaagtattttttatcttacctaaaagtatacaaatataaacctagatacaaacttttattgcttacagcctttacagtgcaactataaaaaaatttatccagcacaaaatcatattactgtaccaaaatattcaagttaacaatattaagtttccactatagatggtattttgctgctttcaatgtgaatatgccactactgccttgctcatgtttttggagttcattttgcctactgtgagctgtgtgaagactttatgctttccctgcttttctcttactgaactaatgcaaatatgatataccacaatgttctctgaccttcatttggcatgaaaagatcacaatataacaagttactctgttcttttctcactcactagtatattatttatattaccctgtcacactatattgtatttgtatcaaataaacaccttaacttagtaaatatgaaattaagtcattctatgaaaaatgtctttcaactgtcactatcattgcaaaaaaggttgtgctttatatctactggtatactagtaaatatggaatgactgttgtttattctgacttaaaaaatttttttagtttttaattttgtgtattaatagaggcaagggctcactatgttgcttaggctagtcttgaactcttgggctcaagcaatcctcccacctcagcctcctgagttgggatcacaagtgtgagacaccacacctggctaattgtgacatttggacaagccaacataactataatcagatctcttgtcaatacataaaatgaattatgcagtaccaaggctgttgtaaaaactgctacaaaggtggcactgaaattttatgctaatagaaagttacagtatagttatgaagatcatgcagaaataggtgtatgctaatttctaaaattatcattggaataaagacacagaggtatcttatagagaaaagtcacagatccccaagaatatatatatatttaggcttggcatgagaaaaactgatgttatgtcatagaaatgaaatggtttaaagttttaaaacaaaatgaaatgcttgaatgaacaggcattcatttaatgctgctttagtctcttttttttgagacagggtctcgttctgttacccagggtggaatgcagtggtgcaatcatggctcactgcaaccttgacttcctgggctctagtgatcctcccatctcagcttcccaagtaactgggaccacaggcacataacactatgcccggctagtttttgcatttttggttagagatgggatttcaccatgttgcccaggctggtctcaaactcctgagctcaagtaatccacatgccttggcctcccaaagtgttggggttacaggtgtgagccacttttttgagaccaagtctcattctgtcgcccaggctggagtgcaatggcgcgatcttggctcactgcaacctctgcctcctgggttcaagcaattatcctgcctcggcctcttgagtaactgggattacaggtgcccaccaccacacctagcttatttttgtgtttttagtagagatggggtttcaccctgttgaccacgctggtcgcgactcctgacctcatgtgatccgcctgccttggcctcccaaagtgttgggattacaggcgtgagccaccatgcctggccttttttttttttttttcttttaaaaaagagatgaggtctcactatgttgtccaggcaggattcaactctgggctgaagacccccgcaccacatcttagcttccaaagtaactgggaatacaggtgagtgccaccgtgcctcactgtattttagtctcttttgaaaaaactacagatttgtatcacttacctcaatgcatggcattctcccagaaaaattagcagatgtatagccaaatgtgacatttgctatcagcttaagtcccaactgacgcgcatcaagcattcgtgacagggctctgtcttgcttgtaagccttcattgactgcttcaccataaatctagtcttcaaaatttcttcaagcattcttggtagtacaccttttcttactgaaggctatcataaagaaaaaaaatgtttaaaacccctcaaacattatagatttacataattaagaaggaagcataaaacataataatggccaactgtcaggaattgaaacatgctaacaacagagtgaccatagtattagtggccgtcaatataaaatcatcacattttatttcttggaagaggatttctcctaaatggttcctgcaatgtttataaatctaacagagcacttctatgtgagttcagagacctccagggaggaggatgtcaactagtgcataagtgaccatacaacaacttcagagggaaattttgttcgaaactttgacagaaacccccattctttcaaaatgacacatgggacttgtatcactcataaccaactcagtttttaaagatctcatcctaatgaccccacacagaaatctgcatggaactccatttatctaccttggaagaatgatgagctgggttgactctgctgacattcaaacctgcagttccagggactctaggtatttcaaatctgatgcttagaccactaagccatcccctccggcctacatttattagcaatctggaagaggggatgaatagtgaggtgataaaatttgttgatgccaaaaaaaaaatcatttgtattcatcaagactagggagaatttatgagaactccagtaggaatgaaaaccacaaaacagtattaactttgatgatgattcacagacacgtgcaaggtaatgcatgtcagacctaacaattaaaatctcaggtataggatattcacacacctgaatatttaaaaaatcttattttcattaagctttacacactgggtccaaaagtagatgcaagtttaaaaaaaagctgttaaagggagataataagctgctagatatgcgacaatggaacatattctaacctctaattcatttggtgtacattttgaagcagccataatgttttaagacataagataaaaagaacagggaccaaattcgcagaaatgtgactggaaaactgatttttatatagagacccatttaataaaaaaaaatctgtttccatttctccaagtagatctcatctacatcagtccttagaaatactacattttaaaattttccaaaaagaaacataccatgaactctttggttaaaattttcttcatctacatggctaattttagtttagtattccctcttactggtagagaatgatgccacttttgatatagtacaccagaatgaatttgagggctggtggggtccactctaccatcaaccactctactgtctcatgattctagtacagactcactgctaagaaaatagaaaagaaaggaataaagttggcatttaagaggcaatataatcttcttttaagatgtctcttatttgtctttaatttgtaaagttttcctctgtctcttttgaggggagatacaggagagaaaaaagggaccctatttttagtttggatatcttctgaaaaatataaacaataagcctattagagtatcattaattctaagatagtcttaatttaaaataatgtagaagaacaactagtagcatctacacattaaaacaatttaaatctttgtaggtaatatattttgaccattaagttgccatttaagtctgcctgattctaataaagggcagaaagtataagcatacgtttatttctttcaatatttcgttaactaaaatttaacaatttaaagatttaaaacctaaattcaagaaaaacaaggtgactggtttgttcctgaagtgatttcttagaagattctcatatctttgactttttgagataaaatattcaagcaaactcggtgtttttgttttctattatgtgccaacaatatctaaaccattatcagctctccaaaagttaagccatagttgttatctttcatttacaagagagtattaccttgacaaaagctactccattgggggacactgtgatatcatgcctaacttggtaaagtaaatctggaggtactctcagagaggtacagccaaatttgaactcatcatacctgttaagaaagagaacattaagcaaatacttcctcaaatcatagaacagagattttacgcaatttaaaaaatctttctaactccattagaaattcattttcaaacatctaaacaagaattcatgtacttagtaatatgtttatttgcctcattaccaaaatagtttttcaaatattcataatttattacaagaaacatttcttaaatggcactatcctaaaatttatgggtaaaatctatactgaaataccaaatttcaactcaacatctgatcatcttatttattttattattattattttttgagatggagtctcgctctgtcacccaggctggagtgcagtggcgcgatctcggctcactgcaagctccgcctcccgggttcatgccattctcctgcctcagcctcccgagtagctgggactacaggtgcctgccaccatacccggctaattttttgcatttttagtagagacagggtttcctcatgttagccaggatggtctcgatctcctaacctcatgatctgcccgccttggcctcccaaagtgctgggattacaggtgtgagccaccacgtccagcccaatcatcttatactaaattacttaaataaaaatttattttaacatccttgtgaatatatttaaagaataatttaaaccttaaatagaaatactgtaaatcttgtaaattttccaaattcctgtttttaataaaaagacaggattaccaatataatttccacagatgctttctatgaaggaatataggatatactaaaaccaacacatgatctcaaatacgcaaaaatcaataaaaaggaagactccgttatttcctacaatttaagaaaagtatctaatcctttgagaatttaaaatgttattatcagtttataaaatttaatttacattaattaataaaacctaacatttaatttttaaaatcctggactatttataagaaaaataaagaggaggtctagttgaagttataagatcataatcctcaaactgttccactgaaaggtaatttacatcaacaatttaactttcattttaaaagagactatagttacatatggagtgaaacagttgcaaggctgacctattcccaatcctcttcatgagtcatccatccatgaagctggattaatcatatggtgatccatgtcaattggtaagacaactataatgaatggattagctgggatacagtccatttatcttgctcatagggaaggtgtccagagcaaagagacactcagaaagtgtctaattttagtaagaagtacaaagcacaacaatattattgtaaatgtgaaaaaaaccttactttcccaagttctccacatggccaaggcaggtggaaaagcagtagttatatgcaatcacaatagaaggataaagtgattggaaatccaaaacgagaacagagttgctatagaagcgggattcaggctccataattagaggaacacactgtggggctctcatctgggatctttgctgaacactaggtgtcacaggaatatagttcattggtttagcaatacgcaacatcattgattccacacggtactgcagggagaaagggaggtgagaagagaagaaacacagttaaatatattggtcatttgaatatataatcatttgaggataatctgcttttcagaataagattgtatgacttttttttttttttgagacagtgtttcgctcttgttgcccaagctggagtacgatggcacgattgcggctcactgcaacctccgcctcccaggttcaagcgattctcctacctcagcctcccgagtagctgggattacaggcatgcgccaccatgtccagctaattttttgtatttttagtagaaacagggtttcaccatgttagccaggctggtctcgaactcctgacctcaggtgatccgcccacctcagcctcccaaagtgctgggattataggcgtgagccactatgaccagcctgtaatactggttatttagtcagctttcagatgcgaaaagggatatatgtaaatccttttcctattcctacgacttttataaaaactataaaacatgtcaaataacttaaaagataagtcaattttaaaagacagatgcaattagatctctttttatttttattatttacttatttattttgagatgaagtctcgctctgttgtccaggctagagtgcaatggcaaaatctcggctcactgcaacctccacctccagggttcaagtgattctcctgtctcagcctcccaagtagctgggataacaggcttgtgccatcatgcccagctaatttttgtatttttagtagagatggggtttcatcatgttggccaaggtggtcttgaactcctgacctcaagtgatcccctgccttggcctcctaaactgctgggattacaggtgtgagccactgcacctggccctctttgtatttaaatacagctacaccataataaaaaactgtaggacagacagctgtatagtttgacaatttcgtttaagaagttggttgataatcctggagaaatttatttgggaaaattagagaattaaaaagctgtcaggagacttaagatagaaaatgttatcccagtttttcaaagaaagaaacaaaatgattatagaattataaagtattgaatgtggcttttgttgtggaaataattaaaaaataaaaaaaaagaactgaatagtaatcagcttattactggtccctagcaaaactgaatcaagcaattactggtatgtttgtttctaataataactattagaaggcttggggtattagaaaaaaaattactcacaagaaccagcctgggttcactgaagtattctcatgaggttttaaggtatttttgccttttattacagactagctcaaacagttgttaaatttgatgggtataaataaaataaatagcttataagcaattaaatgaaataaacaggtaaaacaaacgtagttggaactctatttttgctatatttactgaactggttgattatgttatagacacaggtaattaaaataagtaaggattttacaacgttaaggaatctgagtgttttaatatggtatcgctgatgcctaccaccgtgcttaacaaactacaggtattcaaatacatatttgttgaatatataaaatcattttcagcaaggcgtttagtaaaaatctctcattatatccttgggaaattacttagatatgaattaaatggcttcttaggtttctttttttataacatttaaaaaagttacatagtccacttatattgattttcaagctttttatttttatattaaaattatctatgggaagttttaacaagccaaaattaaaaatgtaaaacaaaagaaaggtactttctttgttgcttctctagttttaagggacatctttaatcacagtaacaatattcaggaatattatatccttaagggcatggacatttattttcttaataccataaaaaacttggcagtggccggaaagttggcatagaaagagaataaaatgacaagatttaattacccagctattgattagttggtaccaaacagaaagtttaaaaagtcaaatcacttcaaacatcacaaaagtgtatcactcatacagaactttcaagtctgcaagaaaactgatttcccacctgtgaaccccttgtcagtacatgtaaaaactgaatgccaaaaagtctagccatctcactggttttcccaatcaggtccagctgttctaacatttggagatttccacggacacggctaacataatgatcaaccattttccatctgttaaaaaagaatccacattatgaacatcagggaaaaatttggacacttgaaaacagtactttttttcctgccaaaaatctacatgctaaaagtgaggttacttaaggaaagagtaatgatatgagcctttaagcaaagtatgctaaggaattaaacattagaaaattttaggtatttcaagggcatgaaaaccagtaaagatacacaaaatttaaaatagtacttgtgattaggtggtaagattaaggatcactctttttcaatattttgcttgatgttgctctattctttttttttctattcttattatagaaaattaacattctcctttaagatacagctgctgattatgcaataattatttatcatatctatagatttttaaagaacatgaagggtctgggttatcattgtaagtctaaaataaaaacatgcactatgttcatggcaaaaaaaaaagagtaatttggtgaagatttagaaaaatcaggaacataaattttagtgagataatacatgggttaaacatatttcaataagtattttttgttaaaatataaaagttctgtttttcagtttaaaccttaaatttaacctctttaccttaccttcttaagaaaacaaacaataaaaccctcagcaaatccataaaaagaattttaatattataagatgtaaaaatgacccagaagtatactataaggaataaaatttattcatttgaagattaaggttcacatatattgtaatctttaattatattgcttttagaacaatatagtcacataattgtctaataaatgtgtttaaagaccttttcctcagacacatgactaatgcttaatagaaaaactagaaaatgcatgtgaaggaagaaaaaaataccctattataaaaaagataataacagtatattaccaagaaagtagagacattggaatcctcatatactgctggtgggaacgtaaaatagagtagttgcttgggaagataatttggcagttcctcaaacagttaaacatagagttaccatataatccaccaaaaattctactcctaggtacatatccaaaaggaatgaaagagggtatctacacaaaaaactatatatcaatgttcattacagtattaatcatagtagcccaaagtggaaacaaccaaaatgtctatcaactgatgaagaaataaaatgcagtatatatccatacgatacagtattattcagcaataaaagaaatactgaaagatgctataacatggacaattctggacagcattatgctaaaagaagccagccacaaaagattacatattgcacgattctgttcatgtgaaatgttgaggacagtcaaatttatttgggaaaattagagaattaaaaagctgtcaggggacttaagatataaatctatggggacagaaaatagatcagcggttgtctaaggcaagaggtagagggtggggggactctggtggagggggtgataggagtgatgaaaggttgaagagtggtggctaggtgatgcaggatttccatttagagtaattaaaatagtataaaacttactgtgatgatgttgtacaactctgaatatactgaaagccagtgaattatatactttaaatgggtaaattgtatgatatacaaattatatctgaataaagctgttaaaacattaggcaaacatgaaagaatcctaaactctataaatgtttaagaaacagaaattttgtttcataatttacatttttaacttaatatactgactccccatatttatgttttgtagctatcgagcgtgctattgtataatgataacatatttaatcgaaacacttactgaatatcttttattactgtaagcaatggtatgatgaacatttttaaagctaagtctttatacagatgattaaataattccttaaaataaattcctagatttggtcagttttcaatacctaacaatacactgctttccagaaaggttttaataatttatattcatactagtgatgataaagtgcttgtttccttgtatatttgttaacaatgaagattatagtttttaaaattattatgagtttgatagacaaaaaatgatacattttaatctgcattgttttgttttagatcattaatgtaacccctcaacaatacaaaactgcaaagtgtaaatctgaaataatgcattatgtacaaatcagatcagtccctttaaaatagaacaaaatggatttaatggctcaccactccttcaggatgtgtggatttatctatggagagtgcagaaaaaggagataacatttacactttgccctctcaacatatggacagagagctgacctggagaaacatgccaaatgagataccaaaatagtgagacaccaacataatttctgaaaatgccaggcagcacacaagcattttgctgagatttgtaaaacatgagaaaaataagtgttaagtctcaaccaacacaggtttaacagaaaactttaaaaaggtatgtattacacatatataagaatctgtttcaacagataatcatgctgactgggcacgaatatttccttgaaatctgtaggtggtgattcaggagaagagttaccaattgaagtatgttgacgataatttgtttcggaaaatgtgttttaaaacatactggtttattttctttgtttactccagtctaaagtccttttttttttttttttttttttttttttttttttttttttaaataagactgatcttgccaataggtttttgtaattcatggtacaattaagaaacataatcagcagattaagaattcctttagtaaggtaaacatttgaatatttcaggatttttttcctttgataattgttcatgtcttttacccttttttttactaatttaaaagtatataatatagttaatatacataactgttacggtgaaaatggttttcctaggttgatgttagctttttacttttgttgatgttatttaatgaagtacagaagtttgtttttgggcaaaaatggtgaaagtaagtctaatactttatatacaaaactgattaaactgaatcttaaaggttcctgatttaagtgatttgactaagatcaactctatttttttaggcagtatagtctattagaacttaaataaatggatataatagtatatttcaaaagaaatatttttactatgctacatataactaactctttttaaaaagtggaaatggtttatttcacattttgaagaatatagtctaagagattttcacatattggttgacagcacagactttggagtgagatagtcgtaggttcaaattgtggctctactgcaagctgctacgtgaccctaggcaaatcatttaactctctagttttcagtttctgtatgtgtgaaacagtggtttcactgttgtaaggtgaaactgttgtaaggtgttaggcaaaagcaaaaacttaataacctttgctgctattattatgataattatggtaattactatttccccatttcattcagaatctaattctctatcctgaaaagaaagacgtaccaattaattaacatttattgagagccttctgtgtgttgaagactcatactatctcatttaattcttacttcacttcatgaggtagaatatattaacatctctctattatagataagaaaactgaggattactgtaagactaatccatcctagtttacaaacctagtacactagaacctgagattttggccaaataaacgaaaacatgatgaaaagaaaacaagataatacattataaatgagtaactgtcttgttaaatttctgtcatcacagcaaagtactcatttcctcactaacaaaaatggtagaccattttgtgaaatgaatgcttattcatttcacactaaatgtattcctctccactgactggtaaccaagtaatataaacaaattagatgcatcttatctttcataactaaaggttaatttaacaagggacattttatcttatacagtttatccagcaggtaacaactgctgttttctgatctaaatctgctgacctataggcatgaatataaaaaatactttgaatggctaatttaaaaaaatgtattttagactttttaatttaaaaaagtgatctttccgaaataaaatcatcatcctttctactttcgggtcctatctgactaaccatataacataaaagagaaagagtaattgtggcctttacttatggttaaaggagaagattgacttttgttagttttttaaattgttgttaaagaattatgccatcctcctaatgctttgtcaaacttaacggtaataaatacaagttttgatccggaaaggaggaagggaaacatacttataaagcacatgctactcaggataggcttgggtagtgctgaaatgggaacttagagcatcctgaaggcatggatatttttcaagatagttcatctggggagaaggtgacaaaaaaggagacaggagaatcccgagtacaaaattcacttattctgaagtttttctgtggactggctctatactcagcaaatagaaaagaaaatttcttatattatcttcttcagctacagaactctgctcccaggatatacctcctagctcagaaactggaatctggaatagtatttaataactattccttgaatgacagataaaatcatgctggtattaggaattatatagattagtaatattagagattaggaaaagttttataggctggcttaggaatctaatcacaagacattattttatgaaaaaatgtgttctaagcttgaaacaataaaatgttgggaacataattcattcatataaatctggggcttccaggagacaaaaatctgggtttattaaaaaaaattagggtacctttgtgttttacaggtttaacacaagaaatccttgactagcaagttcttctcattctaagtcgatttacaatatatatgtatgtccttaaaacactgtagaaagcaaatggaaatcaaaaggggttaccatacctaccaaaaaagtaagtcagacttatttttttgtattcacttaaagttaagaatgtactcatttaaatttaagtattcacttaaatttaagaatgaagttgtctgatatttccaagactactcaaagagtgcatggtcttctcatataacataatccatttgacataaatggtctaatgtctagtctaagtcccttctgtacaattttagttccagtcctctattttacttgtcaaaaacagttatcatcctagataatacctaattaaaggtggtaaaacatgtatttagagattccggggcttataaacaaaccactgaatatagttttcaatgttaagttaaatatcaagttttatttattggtgtataatttctcctcagctttttttttttttttgagatggagtcttgctgtgtcgcccagactggagtggagcgcagtggcgtgatcttagtcactgcaacctctgactcctgctcccgggttcaagtgattttcatgcctcagcctcccgagtagctgggattacaggtgtgcaccaccatgcccggctaattttttgtatttttaatagagatggggtttcaccacattggccaggctggtctcgaactcctgacctcaggtgatccgcccgcctcggcattccaaagcactgaaattacaggcgtgagccactgcactcagccaacttcgcctcagcttctatttctataaggctttgatagaagctaagtgctttctgttacttcacttcacttccctgagattcctcaaaagtgattggaatatgcgatgacatgctcaggaagcagtttccccaaatattatcaagttgttttcaaagctatactttttccatcctcaccaccatacagccttacaattcagtaagtacagattcactcatttaaaaaattagacacattaatttaaggacttttcctagacacagtgcagtgtgccacagtctacacagagcaaggctgtcctactaagccaaagatgaacagctcagagttcatttaggcagctcacagctcgagtctgtgggacggagcacaggagagaaagggagctgtgcaagtggcaggagttggggggggtcagaagtatagctggattccttatgagtgatagctcaaggctgtcccgaaaacgaacaggatgaaaccacatgaggctgaataaagagcagctcgctgggggttgagtgtgggcagaaatggtcagatagtgctggggttggaggctcaccaatgccagagtggagagacctcatcacccccttgttaacaaccttggcattcagttgtgagcccagaaaaaaacagaggcctttgccctagagaaaggcctactctagataaaacttaaaaccaaatactgacaatatgtacagacgacagagtttggagattgaatcctacatcaagttggaggagcttaggaaacaccttgggcctggtatacttgcctgttccaaccataggctttgaactaaataacaagcaactggaaaaggggcaagaaaacttcctgtcatagattccaggcaaaggaacagtatcactgagaaaggagtagaagaaaatgctatctgccccagggggagggtcaggaagcttacttgggcccaggacctgccagtggtacaaagcagaggtctgttgcctctgtgggaagagcaggagtgctgagcaaaccccagaagaataggaagatccaggccgggcacggtggctcatgcctgtaatcccagcactttgggaggccgaggcgggcggatcatgaggtcaggagatcgagcccatcctggctaacatggtgaaaccccgtctctactaaaaatacaaaaaattagccagttgtcgtggcgggcgcctgtagtcccaggtactcgggaggctgaggcaggagaatggcgtgaactcgggaggcggagcttgcagtgagcagagactgtgccactgcactccagcctgggtgacagagcgagactctgtctcaaaaaaaaaaaaaagaacaggaagatccaaagactgaggttagacaggagaactgagaaactccccctgcctccactataaaccttgcagagagtaaaaagtgacatcggtcaaccactcattaaatctgactttggaaagaaaatgaatcacaaatactggaaaaatgagaataactgttgacttctcatcagcaaaatgagaggctggaagggaacaaaatctttagagtggtgaaagaaaaaaacgcaactgagactgagaaattatccttcaaaaataagggtgaaataaagacatcttcatataaacaagggctaagataattttttgccaacagacttgccaaagaaaacagattaagtttcttaaaatgttaacacacaacagccatatgacccagtaattctactcctaagagatatgaaaatgtatgttcacatgctgactcatatgcaaatctttattgcagttttattcataatagcctcaaactggaaacaacccaaatgtccatcaacaggtgggtgggtaagttatattcatataattgaatactatttaataataagaatgaacaaactatttatgcaacagaaatacatactatgttttctgagtttcttcaaagccaagatagattatgaatatttccattaatatgaagttctataattggcaaaactaatctacagtaatagaaatccaattagtaattatctagatgattagggatgggtaggttgactgcaaagctgtagaagggaatcttctgggtgtgagatatgctccttatcttgattggagtaatgagtacaagataaatgcatttttcaaagtcattgaacaataatacactttatttatttatatattttttgagatagagtctcactctgtcgcccaggctggagtgcagtggcacgatctcggctcactgcaacctctgcctcctgggttcaagtgattctcctgccttagcctcctgagtagctgggattacaggcatgcatcaccacacctggccaatttttgtatttttagtagagatggggtttcaccatgttggccaggctggtctcgaactcctgatgtcaggtgatgtgcccgcctcggcctcccaatgtgctaggattacaggcgtaagccaccgcaactggcctgaacaatacactttaaatgtgtgcattttattacatataaattacatctcaatgatgattttatattaccttcttcagagttatagaacagtacctgtatagatctgtcttgttatcaaaccagtctgacaagactcgaaaggtaaagaggggaaaacgctgatgaagaacatgaaagctcacattttcaaaggtgtagttagttagagccacctaaaaaaaaaggcaagacaccattataataatgcttacatttatgtagcaaatttggttctaaaagataccaatatcactttaaacttttcatagtagatattaaagctacttgtaaaactgatgtgcagtacaactgaatcataattcaaaactatgtagagcctactggacagaaatgttcataacaaattggaaaattatttaattagagaaagcagacctgatgagattcaacttggtcatataatacttattttaagagattctagttcttaccatttttatactccatgataatatacatattgacagaagcattgtcaagcaaattaattttttgttctttccatacttactttttggttcttgatgacatgctgattaatgggattccacagatttgaggtgagttatctagttaaaggcaggcattctcctcccaataattacattagttactagaccccactacacagacattatagagccactcaatttcattccaaaagcaaaatactaaaatgtcagaaatgtctccccatgttccaaatacgtaagtgaaagcagtgttaatgggtaaaggatactgtaaaagggcccaaattaataaatatgtacttccagctagatgatttctctgaaatatctacaagacaaaagcaatctagacaatggcaggtatttcaatgcaaaatggaaattaaggaaccagtagtccccattcttaggtcagtttcggattcagaaatagttcaaacagcacttcacatttgtatattacattataattttaaattactttcttttccactcctgtgatccaggaggtacaaaatagggattgaatgttaatcttatctcagtgcagtgacccaaattggtcttactttatctacaatttctgtcaatcttcagaacaatggcactacaatgcagcacacttcacagtgtgtgtatgtacttgtgtaggtatacatatacacagatgcccctcataggttgtaaaaaggtagagagcaatagaatgaggaaaaggccacaagattaaatgaggaaggattataaaatcactaacagaatgaaagctcatattgaaagcagtaaatagcagaacagttctactaaatagttctactaaaagtcaagttaggaatatggaaatgtctcagcatgcagataaagaggatgaaaacatgaaaatgagaagagggaagatatggggaacagagaacagaatgttaatatataattaggttcctaaaggaaagcctaatatggagacaggagcaataatcaaatatattaattagctggaccttagatttctcctctgcagtactaaattccagaggtgaatggcactatatctacttgaattttaaaggaaaaggactactgttattttatatgcagtaagtgtaacaattatgtgggaagaaaataaagatactccttgattccttgaactcctcttctctaatgattttgtcctccatcctacctaagctacccactcccataatcataccccaggatctatcaacagctgtactccctccaaaatctcatgcatcccattctctgaccatcatctccggtgcttccagcttactccccttgatgctctgacctctctgctccttatttagtttaaatttcatagtcaatcatggtaatcattcccctgcatgtacccttcattcccttgtccctttcctgctgctgccgcctttttttttttaatttttaaagcaaatccataaccctttgtgagtgatggttaaatctaacttgcacctgtgaatttgaacatagctggtgggtatcactttaatttcctaacccaaatctcaaatgggctcttaatgtggcccagtgtttatattttctctcaaattctcctaataaccatttcaaactcatctctcctcaaaccccaaaagcctctccacaattctgttttagctaagaacagtaattcctattttactgagaaaatgaatcacaagagaacttccacagattctcactgccatatctctacctaccaacatccatacccatatattccgccttcctgtctgttactatactcttactttatctaaacccaggcccctcaaccagtgcaccaaagatggcattcagtaaatatttgttgaattgaatcaagtctgtttccaacccacttggcaaattcttgaaaagcctagattgacttgacatccagaaggcctctaagtataactgtctggggaagagctatttattgtcatttaagcagtcaacaaatatctaataagcattactatttaagaggtattttgcttgtcactacgaattcaaagtccataaggaaactgcaggagttctatgttcaaagtaaagtaagagaaagaaatctagtacttgtatattaaaaaaacaaacaaaatttatgattactattattttaacagatggggtcctgctttatctctcaggctattcacaggcataataaaacagtgcactgcagccttgaattcctggcctcaaaatgtcctcccgcctgagtctcctgagtagctgggactatatgtgtgtgccactgtacccagttccaaatttttaaaaaacaggttacccagctcataactttcttacagttgtttcccacatttgcataaagatcagagatactatatattcatcctaaatgagaggaaacatttgaccctgaattttcagtgaggactagagaaggccctaaactttgcaaaaatatttgttctctaatttgcaattttaagctactagttaatttgctactgttgccttttggatatacagggttgaaaagacccctgaaactaggattcagtaatttactttgtgtttatacacttaaagtatgtgctcatctcaggcaatatcagactatacattaaaatatataatgaggcctgggctgtggctcacacctgtagtcccagcattttgggaggccgaggtgggcagaccacttgaggtcaggagtttgtgaccaggctggccaacaaggaaaaaccgtgtctctactaaacatacaaaaattagccaggtgtggttcaggcacctgtcatcctacctactcaggaggctgagacaggagaattgcttgaacccaggaggcggaggttgcggtgagccgagactgcaccactgcactccattctgggtgacagagcaagactccgtctcataaataaataaaataaaaaaaaatatatatatataatgaaatatacacaccaaatacaccacaatctctgtatctcttatatcctgtgctgtatcactagaaattactttaaatcactggggactctaacactcttctattattttaagaacaacacaacaagataaaatcattctcaagcagagtcatgttgtatactgcatacagcagcttagaaagtcaaatgttttatataaatccaaagagccaagaagataataataataagtatataatagaaagtgtctaatgagaaagtagtttcaaagagcagaagcaattgaagaattagctttcttttaaatataaacattttagttgacattatccaaagtccaaagtctaagaatagaccaatttatagtaggtatctttgtttctgttttgtcttttttgagataggctctagctctgtcacccaggctggagtgtggtggtgcaatctcagttcactgcaacccttgcctttgaggcataataaaacagtgcactgcagccttgaattcctggcctcaaaaggtcttcccgcctgagcctcctgagaagctgggactgtatgtgtgtgccactggctctcaggatcaagtgatcctcccacctcagccttccaagtagctgttgcctggctacacgctaggcacatgctaccatacatggctaactcgtattttttggtagagacggggttttgctgtgttgcccaggctactctcaaactcctgggctcaagtgatccaccctccttggcctccccaagtgctgggattacaggtatgagccaccatgcccaacctaattgttttttattttttatttttaatacagacaaggtctcgctatgttacccaggatggtcttgattgaactcctggcctcaagctatcccctcctacctcggcctcccaaagagttgggattagaggtgtgagccaccatgtatggcttttttacatttcaaataagagaaattgggtaacttcaaggatgcaaatattacccaggaaaatcctatgatcttactttttgtgtgtgaaataattctttttctaagtgaatgcaaattaatgggatagttcattgaaattactctactaaaaaatccttatctgagctcccaaagccttaattattaactatttcaaagtactgtctctttatcttattaatctgacccagtatttaaatatacttcatttgagaagctccttcctatttctagactaaatttttcttactataataaatcaacaaggccagctgaattcatctggccttaagtgcaaaaatgacttccgtgaaaaaaatacggtgaaattagacaatattcaacatgtacaacacaatattttattgtattttgagacagggtctcactctgtcacccaggcttgagtgcagtggcacaatcacagctcaccgcaacctcggctgcctgagctcaagtgattctcccacctcagcctcccaagtagctgggaccacaggcatgcgcctccacatccagctaattttttttagctattatttgtagagacagggttttgccatgttgctcaggctggtctggaactcctgggctcaagggatgcccctgcctgggcctcccaaagtgctgagattacaagtgtgagcactgcacctggccccaatattttattatagctatagacctttctagttattgctaccttagacacaagaaaaaaaaaaaaactcacttaaaacattaaagtctattacctctgtagttttgcattttagaaagtactattttaactctacttaagtataacagtaattgacaaacgcataagctatatagtaaatcttactaatactctataatgattaaatcattatattgaccgaatatcttatttctaaacaacattttggataaatcacccacctcatttctcatgattctccaaagatttagtgtaattcggccaacaatatttatctcactcattgtatatgatccatactcatctctttcagctgcaaatctgttctcaattttgtcatctatagaaatgaaaacagactgtatcagggctcacagaaaacaaactttcaataaaattatgccagggaaaatgagaatatacattaaggatgaatattaaagatgaaatataattcacaatgtatgaaaaaattttgtgaaataaatataacctgaagtctctccctccctccttctttctatatttaaataagaaacacttttttctttagatttggtaatttttggcactacctttttttgtttgttttttatgttgcccaggttgagtgcagtggctagccacaggtgcaatcatagcacactacagcctcaaactcctggtcacaagcaatccgcctgcctcagctgctcgaatagctgggactacaggtgcctgatgctacctttataaacacctaatgctaacatttctttggtcttagcatgagaaagatccacagttaatctggtaatttcttggaaaaaaaactagttcaatttttaacctaaacgattctctgaaaatttgttgacatcatgttcacattcaggatgaaattctcttgaatgcatatggagaactagatgaagagttcctcatagcaaatagcgttgtgagtctagtttcttaggagatgaagtttacctagaatataaattaaaatgcgtctctcctatgtaacactaggtatatgtgaatgttgatgattagaggttccagaataataaaaatatttaccatattgaaggtttattatgttctaagaattttaccaacatcatttattttaatacaaacattacttcctttattttaacaggaccatttaagaagttagtataattttcattttgtattacggaaaattctactcagaaatgttatatcttgcccaagatcttacagtaagaaaactagtattctaaactaggattacctgaatccaaagaccatgtacaaccactcacccaattctttttattttaaagagataatgtttaaaagtttgtttttcatttagcaaacaatgtaacatatactctggtgattgttttaagttcttcaaaataaccctatgaaataagttctattatccctattttacagatgaataaactgagacaaggatatttaaaacctatcccaaaaaagatattgaaaaaaaaaaaagatataccactattgctatcatgcaaaggacacacaagctacacaaaaattcatggaatgaaaagctaaacttaaagcatctctgccccccattccctttttataagacagagtcttgttctattgcccaagcttgggtgcagtggtgtgatcatagctcactgcagccttgaactcctgggttcaagcaatcatctcacctcagtctcctgagtagctgggactacaggcacaagctatcacacctggctaattttctttcttttttttttttttttggtagaaatggggtctcactttgttgcctgggatagttttgaactccagggctcaagcaagcctcccaccttggcctcccaaagatgggattacaggtgtgagccactgcacctgatctttttattccaattttttgcaaagctaaaaaactttactgtcctggaatcttccagcttcaacttttcctaaagtatacactactttgttttagttagacttgtgggaacccttgggaacaaatttattaaaaatcctatgtttataaagaaaacatagttttaaaaagtgcattataaactacaaataattttggtatgaatattattattcccttctagttagaatgaaactttggggaatggacttcaaaatttctgcaatatttgtagcctgatatccaaataaaaatcaatgattagttaactactagtgttcctcaacccatcctgtccttcttaaccaacaaaatggattaaaaaaaacagaggcagacaaacaataaaattatggtacaacaagtcaaagaaatgctatgtagcttcataataattatgaagactatttcataatgcagaaaaatatgtgtggtaagacactagatgaaggaagcataataaaaatggaatatacggtatgattatttaaaaaccactacatatgtatatgaaaagtgactgaaaggaaaaaacccaacaactatactaacagtacatatagcagtgagactagaatattttttattttatttttaattttttctacaatggagttatgctatatctaaaacttacacaacttagtactaaaaaattgggctacagcataagtactctttaacattctgtctttatttcctttataatttgctctgtagttgaatgacaaaacattcacaatgacacatacctggcacccgagagatcatccgacataagtcaatacttaaagcggcagccctttgtaagaggtaaccccaggaatgcatctgaatctcatatcctagcagaatatcaggatcatacctaaaaaaggaatttaaaaaagttatataagtaccatacatttgaacctttaaccagaataattgtttcttcatgatataaggtatgaaaacaaaaacctatgttctctaacggtgcccagatggagaagggatgatacagtggtacctacagagtttttatacaggaagagatggatggttaagagtacttgatttgaagctactttgtttctttctttcttttttttttttgagatggggtctcactctgttgtccaggctggattgcagtggcatgatgttagctcactgcaacctctgcttcccaggttcaaacgattctcctgcctcagcctcctgagtagctgggattacaggtgccccacaccacgcccggctaattttttgtatttttagtagagatgaggtttcaccatgttggtcaggttggtctcagactactgacttccagtgatctgcctgcctcagcctcccaaagtgctgggattataggcgatttgacgctatttttgtaaagtaaacataatttttacttagactgtgtatttgtttgatacaagtgggaaaagaggctgatggaaattggggtggaaggcaggccattaccactgaagtatatgagtgaaggtacaagtgagaatataatgtgggcaggggaaggtgaagtgtgagggtgtgtgtgggtatggtattttgaaaaagatccctaggtcattgtgttgccacttatctacccttctaatctatactgcccttaaacagttttaatgctgagaaagaaaaatgagaatgctttccttttctcacttaattttagtaattatttggttctcacacaaaataaggcctaagtaatgacaagtttgtcctttaaatttaaaaggatggtgattcaacttaatggaagaatgaaatattaatagaggtgggattaaggtggggaaggtaaacatcagaatctagaagaaaaatgtgctcctcgtggtcagagcttcactggcaaaactgaaccgaccacctgcgtccaatccagaaggagcctctttgtggctcctcttagaacctccatgttgtgaccaccatagagaaatgtttagctataaatatgaaaatttatttcgagtggaaaattgtgtgggagagagcggaactaattatagttataagttttgagagcaaaaactacagtaagtagctctatcaattagtagcattatcttgttctttataaatgccaaaaggccaagtgaaatatcacaaaaatttaaatcgttgagttttacataactactcatgaaacactaaattgtgagatgtgcagcctgtccaatttacagcatttaataccctaagcctcagccaatgtctacagtactagactaatttactgatataagctatctatggctactctgcaagtctggcataacaatggatcatgaccagatcaccagatctgcttttagaaccaatatgttaatattttatcataattccatagctgtcttctaaaaatgggtattgaatggctttcgtttttacctagtcaataaaaattggaatgtcacaataaatgttttctgatttttaattctggagtatttcagtggctgatgtcaaaagaactgggttcaaacttctgcaacagcacacttttaaattttcctattccctaaaggccctatgaaagtacattctgtagtataaattttaatatctggtgatctgttcatgatccattgttataccacagacttgctgagcagccttcaaacttgttaggagaaaaagataataaacatattatttatgtgcttttctctatacaaatagggttgacatttctgagaaaatggcttaatttaataaacagctattgaagcaaagcaataagcaacaatggcatgaatatccagaaaggaagtccagaaagatcccagggcactcaaggaaagagaaatatcccaatactctttctgtttagtcttccaacataacacccaaacccttaaccaaatccttgatactgacttcatctctttcattaaactcttcttagtccaaagacagactatctacttgtccagtatatctccctttaaaactaactgtgtaatgaatggctacatttgagaattggggcacaagtattaagtggctctaaggatcatcaggggtcgcagacttgaagcattctcatacaaacacaacagaacccacacagttgtctgctaagtactcagagtggctcagaataggcattacagtgtggccacagttgaccttgatcttaagaatcgggaagattcctggagttcctatcacatagttacctatcacatatcacatagttacacagctacaacatgaagaggatgccagatgattacacaggccttctgttttaaatgttataaagacagttcttctaatttcttcatctgaatctttctcatttatgcaacatcttgttattgcaagacttattccagtcagctatttgttctgttgtggcaactaagggagttggctacgtacactttttttaaaaaaaataatgtattgaaaataacttcgtctcagataaaaagctgtctatttttataaactgctacagctcagaaatgactgctgaaaaaagttaccctgcgcttctcagatttatttcacagattttgtccctttagaagaattgtaaagttgtttcaggcattttttcagatatattacatatatatttattttttgacccggaggatgtttagtctggaggatgtaagagactcttttaaagctgataaaacacctgttttcaagttcaaaagccaaaggattccatttttcctctctaaaaacatttggagacaataacaaggtcttgatgacttgttcttcaatttctagtgggttttattcattctatcaggtttctgaaagttacagaaagaataaagttgggtagatgggattagtggtgaaaacaacccaaaactgtggataaaatagaagcagaagaaataggtaaatggttccatttgcttaggcagaaaaaagctgcttcacagttagtattttaagtaactcactaccatctacacacatgacagataagggtactctagtagaggcaaggggcacggaggggaaggaatcatcttgaaaaagaattctgaggttaaatggatatgatgtaatataaatgtaatagcatttagggaagaggaaaagggaagaatcatagttatatttaagttagggagactgcgcaaagtgaagttaatagtccaaggaaatacagaaagaggaaaatgattgtgacaagattatagatgaggttttacttgtttaatatcactttatattacttttcgtgtttgtcacttgaggaagtcaatattaaaaatggaaaaataaagatatatttatttttatattagtacctagcactgccccttacacacagttaacatttatgtactcactatgtgccagacctgagtttaagagttttatgtgtattatctacccattttacagattaggaaaacaaagctgagagagttaagcaacttattcaagacagaaacacagtgctggctgactccaaaggctgtgctgagtaggtacacaacaaatagggtgaaagaatgaaataatcaatctttttgcagagttgtttggactaatatataaagaacactatagaattgaaaagttgacatttaagcatttttctttttatgacagttttgtttaccccattttccttaattactagtacatttcattttatggacatttaagaaagttattatacttgcaaatgactaacaaaattctcaatgttggcaggtaatcctatcattgggaatatacccaacaaggaaaaggcaagcatacaagcccagggacattactggacatgtgctggtacacaaaatagtattgactgaaactcttacatatttctttctctgagttgcttgcagaaataaaagaagtgtggatactgaaagcatctgacatgttgatgacaacctctgtgagaagataaaaggtaggactgacaatgacaagactcaaatagatgggaatctatctagtcaccagtgctataaatagtaaaaatactttttttccttcagagtcgtgggtagtagcatactatttttgatgctctgtcatttaattttgttttgtagaaaacacatgttttggttttctaattctcagaatggtttatgttaacccatctgggattcaatctgatgacaagtctgtagaatatcatcttaatttttcatgtagaatactgatttagtttttataggatgaagttcaactatataagcaaaacaaaaaagggtgagtataacaacatgctcatggacagcttttatctgtatatcaggatccaaagaatgtcttctatcttgctttaggcatctaaaaccctaaacctagcaatgggcagaatccttaagtttctacaaagtgaagcatttaataagagagtccatggctaccaagagctacactgttgagaaaatgcaaattatccacttaatgattttatttttaaattaaaatatttttgttaaaaattttttttcataaacttggacaagattctactatcggactgaggaccgactaccaaatggtcaaaagagattttttaaggagctctgtgcacaagagtatgtaatagataatcctacatttatgaacagataaatttatacagagaatgcatcccaaagctttttgaaaatattggcttgtttagaactcagaaaactttaaaaaagaaaaaacaaaccaaaaaaaggtactgaaatggtggctggctcccaaggtagaaacctagttaatgaataatacaatggaactttatacagttctccattatttcagcaccacagaaaaaccaacctcaagtacaactgggaagttagttagaggctaaacaaatatttgtctttcactggcccctcaatcttgagaacagaacactgcttttcctatcccttgtctgatgaaaatagtgatggtggtgggaagtgagtataaaatcttcccaagagtaactctgctttcaagggtcataggaagggattcgctttcttcctacctttacttttatcttcactattatctgcaatagcatgaaacgactctctgaataaaactggaaaaatcagatatacaaaacaatacctctttattatatttgcaatttcatgaaaaagtgccttctcatcagcagcataggtgacttcgagtcctgtaattccagatctaataagtaatggagtctgatatctgatatctaaaaaacaaacaaaatgtctattatatataacattatataataatataccttcataatataaaagtaatattatcctctacttttaagtaaaattgtactactgaaatatttcaaattaagaaaacatctccccaagtgaaaacataactaactcaatgtctttaaaaaactctcaaaagattttttagtttaatatacaactgaaaattcaaattttgtattttcagctattctcctgaaaaggctgcattcataaaattccctagaaaataacatatcactggctgggtgcagtggctcacgcctgtaatcccagcactttgggaggccgaggcaggcggatcacgaggtcaggagatcaagaccatcctggttaacatggtgaaaccccgtctctactaaaaaatacaaagaattagctgggcatggtggcgggcacctgtagtcccagctactcgggaggctgaggcaggagaatggcgtgaatccgggaggcagagcttgcagtgagcggagatcgcaccactgcactccaacctgggcaacagagcgagactctgtctcaaaaaaaaaaagaaaataacatatctcttgtgaagaaactgtattactttgtttctgtctttactcttcctagcaggagagctttgcttagcacaggacattttaatctctggtatgatgaaaatgcttaaccaccacttctgcaggaaaaaaaagaaagccttaatttgtagtgctggcctatttcatgatgtaaggacccctcccccaccctatgactgatttccaactgccaaagtgacagcaactagtttgaaaaattcatgaaaatccaagaactggcttgtgagctggtatgtgtcagctcaagcacatcactgaataaattgcaaattcttaatatggttgtattctgtgctaagacttcctcctcagtggactgaattcacttgtaatggtgaccactgaaagctgcagagggacagtaggtattttataaaatgccttatatggcattctatatgaagaacctctgaaccaaaagtatattatttagaaagaaagataaagagatataagcaaagtaagaatatatcttaaaagtatcttataaaccattaacttatagtggtaagataaaccctctatcagcaggaaaatacctgcatatgcatacataaggaagactgtgcacctaatctagggatacataataaggtggactctgtattagtagtaagtatttttataaaataatacttagaacaaattatataagataattataaatattaagatctttatattgcattgcttctgacttaaaaaatgaataaataaatggggtcttgctatgttacccaggctggaatgcagtggctatttacaggcacaatcatagtgcactacagccccaaactcctgggctcgagcaatcctgttgcccagcctcccaggtagctgggactatatataagcaggcaccactgtgcctggctgcttctgactaatccaagtaagaataataaatctaggacaaagttatacacaatctcctacccctacctcagcaaacattttagaaaagagtcatcatgcttgcttagattagatcttcagcacaggaattccccattaaaacattcaccctagagtgggcaggtatatcattaataaaaatggacaataccttgactgaaaactgtcttgtctttatcaatcactattacacctgtgagttctgttttttctgtatctggcagtggagtgtcagatgagatgcagtagaacagagcacagattgggtcaaattcaggatccggttctaagtctcgtctagttcgagcatgcaactccacactgattagggtaagattttgtatctataaaagcaaataaatactatgtttttaaaacattttttaaagacatgctcaaagaagtatgtaaggctctagggaaatatgtatgtaagattacagaaaaaatggacataaaggacaaagtcacagctcagcagcactccatatattaaaacgaaagatttttaatcccaagattagattaaatcaattcatgatgttatttcagaaaatctgctctcaatgacaatatttagactatttttctcaaatatatgcaggatctctcaatgcctgtttgagaaagagaatgactagtccaagtagttatacaatgaaaccaaagtctgtcacgttttactcttcatgtagttagctaaactatatagttttacctgtagtttaaagtaaaaagagagcttttttaaaattcaaatttcctaccaattaattcactactacttgagggctacttaaacttagacttttgcatacactaggcagatttttaattatagtttttcctgaaaaaaaaaaaaaaaaaaaaaagaactgttatggtatcaactacacaacagccagatttttacacatgcacattttctctttaacatataatgcaaaaaagttaatatttgcttttcatgcttatttttctatgccaatataaacttttaactgtaattcttagttttctttctaaaatcaagacagagtaaataagaaaaacaaaatataggttgaattcatgattatagctagaattatacctcatctttttatcatgtacatgtacctggcaatggaaaacagattcctgtttcaatattggtaattattcagatcatataaatttaacaaaggatttgtgttttgtattatcttgcatgcaaactgttgaagaaatgtaaattcaagtttctcactagtgacaggagtagaatttggtaaatctctatcaaaattaaaatccattgatgtggcaatcctactcctgaaaatttatcctagagacagatacactcatacatgtagataaaatatacacaacaaggatgtttactcgagaatagcaaagactggaaaaaaactaaatgtttacctgttggggacaggttacataaattatgtggtatccataaaggatacacacaatggaatattctgtaacctttaagattttcaagggaatgaggcagatctgtatgtcctaatataaaaagatcactataatacactgatacatggaaccagtaaacacagtaaacttctatacatgaaaaaatggaagcacatgcatagaaaatttctgaaaagtgacataaaaatgcagacatacttattgctttgggggaaagaaattgctagcctaaagtaggagggaagcttacttttcattgcaaatttttttgtcctgattgagtatttttggtatatatactattgcatgtgctcattgtaaatttgttaaataatcttttttttttttttttttttttagacacagggtctctctctgttgcccaggctggaatgccatggtgtgatcatagttcactgcagccctgaactcctgggctcaagtgatccactcacttcagctttcctactagctgggactataggtacatatcaccatggccagctaatttataaaaacttctgtagagatggggcctcactatgttgctcaggctggtctcgaactcctggcctcaagcaatcctcctgcctcaacctcccgaagtgctaggattacaggtgtgagccaccttgcctggccactaagtactttttaaaatataaagaacatcaattatgcatgtataaggcataataataaaacaaatacaaatctaccactttcctcagaaacatatactgctgtttctactttaaaatattagtattaaaaaaaaaatcaaaccacatgaaatggagagctaagggaaaaaacttttacttttaaatgcatactcttcagaacttaattttaacaataagcatgcattaatttagtaaataaaaaatttttaaatggaaaactcctcccacaaacccaaataaaacaaaacaaccagtttcattagaaagggatgaacatatgaggccgggcacggtggcttatgcctgtaatcccagcactttgggaggctgaggcaggtggatcacctgaggtcaggagtttgagaccagtctggcaaatgtagcgaaaccccgtctctactaaaaatacaaaaattagccgggtgtggtgacgcatgcctgtaatcccagctactagggaggctgaggcaggagaactgcttgaacctgggaggtggaggttgcagtgagctgagattgtgccattgcattccagcctgggtgacagagtgagactatgtctcaaacaaaacaaaaaaaaacaaaaaacacacacacacaaaaaaaaaaacaaaaaaaaaaaagaaagggatgaacatatgaaaagacatgaagactctgaaaacaattttaggttaaaagggtcttagaggttgatttttgtttactagatcaaattttcacactcaaaatttgcatttctattccttaataacaaaatgcattactgtgcttagggggtatttttttaaagcaaactatataaagacatggcttgagagatttagtgagtgtgactaggcaagaggcaggtgagaagggggacaaagattacaacccttgtcttctgcactgagtactgatgtgcagaagaaagagagattatcctagggtaatggaaacagagggagaaaatgccacaagcataatttcctagagaaaggaagagaacagtattttttctttggtttattccctgtttcaaccaccgggcggcagtttggaatgtgccttgagatgaggaaagccggttatcgggaggaagaagctgtcagagcaaccagtgagacctccagagtgattttaacttccagagggcccatggttctgaaacagggttacctaggaaaatgtagaaaagcgtacttttcaaataagagaataatcaaatgtaacatgtctttttgctatggtctatcaaatttgctttaatacatatttttaaaaaagtttttaaaaatttgctaatttcaagtttgcatttgatggtatgtattactgaatttatcacttaatttatctaggcttcaggggctagtatagacctaggtataaaacagaaactgaatgaatgctgctgaatgagaaaaatgtgcaaatgaataaatgagggagagactatgttccaatctaattctaaaaaaacataattctcagttcaaatgtgaagaacaaaggaggacaatattaaaatttttccctcagtttatgttaatctaatctctagaacagtttacaacagaattgacttgagaaaaaaaaccacacttaaaaattgaattataacttaaaggtggttactaatcctctgctttaaaagcaaagacataaagtgactgtataaaactagcattgtccaatagaaatataatgaaagtcacatgtaacttaaagttttctagtagtcacatttaaaaaaataaaaataggttaatttaaaaacactttgatctgatccaatatatttaaaatattatcctttcaacatgtaatcaatattaaaattactaacaaaatattttaaattattctttccatgaagtctttgaaatgagtatgtactttatccttctagtatatctcactgtgcacgctaaattttctacagaaatacttgatctgtaatttcatacaacttaagagtaaaaaatagtattacatacctaagtcgttccaaacatactttgagtcaactatgttttaaaatctaaattaaaattaaataaagtttaaaattcagttcttcagttgtataagccaaattttaagttctcaatatccatgctgctagcggctaccatacgacagcacaggtgtaaacaatgaaaacatactccaatttctatcttactgccagtcagatatgtgctttgagtttgttttctgcatacaaataaatttacagtgacccattcacatattctttccaatgcatactgtagctgatgtatatttttgcaaagtcctagtctttggcaggcagcctgtgctgtgaagatagctggattaagtagagagtatatgagtgaatgaatttatcctcttttgtagcaagctctaatccactcagccaatcaaacagaaaatacaagtaaatatcacatttcagatgtgacataacatcttaatataataatccccaaaatacagacttacttcttttttttgtttttccccaaagagacagagtcttgctctgtctgtagcccaggctggagtgtagtggcgcaatcacagctcactgcaccctcgaactcccaggatcaagtgatcctcccacctcagcctcccaagtagctgagactataggtgcgcgccaccatgctcatctaattttatttttattttttggtagagacagggtcttcctatgtagcccaggatagtcttaaactcctcgactcaagggatcatcccacctccacctcccaaaaatcttttcttattttaatgtccataagctgaatttcagttatgagatttgtgaaagatatgaaatcacaaagcagtctcagcaacttaaatgctttaagtttatgtattgtacataaacatgtaaatatacaaaatagtaaaatgagaacaagatgaagattaataggatagaattcaatatactcctcccttgttaaaaaaattccatacttgttttatagaataaaacaggagttaaactgaacacaatgtatgtgtccttactgttgcagttttacctcatgtaaagcttttgcctcctgtaagttttgtatgctgactttgaaaccgtaagtattgtttaaagatggtccatcaatctgagaagtttctttctgtggggtatttactgctgcaaattgattctataaaaaaaaacacacacacacacagccagaaaaagatacatgagcaatcatttttcttttgattacttattctcagataatatgctttatgtgtttagtaataaatggtaaactaatatcatctctaagttcaagaacaaactgtattttattaatgttattttcatgctaacaaagatatcagaactggatacatgtagaaatataagcaaaccatatgttatctctcagttcagaagccctcaatactgaaaataacagttttgtagggagttgacatttataccacatggacatttatcttgacctttcttggaagtaagaaagacaagcaagcaatcaatatatttccaactactttggctaaagtttgtaaaagatttgaaatactgatttgtattttactctaatataacatgtgtctgaaagatgaattaaataaaacaatgtaatcttcaaagattcagaaaaaaatggaatctttccatttcttacaaaattattttttctgatttctaaatctattaactgttttccccaaagtgttatgttcacaacacactgatatagtattttttaatatatatagcttgtaattcaacagtattttataaatgaaagtttaaaaagtttgataatctcagaaatattaaaatatattttatgtagttaatgacatttataagaagtggccaatatataagtgatttctagcatatatttccaaggatgtatgtctaatgtatacttctttcacataaccatataattctaagttttgtcatatttttagtatttgaataaagacatttgtgactttccagagtttcagtagtaaataatgttgctttcttttactacttagtaaaataaattttaaaaaatcaataaggttatattttagaaaaaagtaataaaccaagaaaaaggatatatttttggtgggatcaaaaatcacttacttgagctctgctgtcattggattgttctgattttgccagtaatcagttaatgtatttgtatcctcataatccacattttggctatcatattcactttctctgtaatatttgtatttacatataagaatcttttagatcccaacatcaaaaaaaaaactaaaaaaaggcaaatttttgttgtctcaaagatatgcaaataatgatgcaaaaatttaagtaaccaaaattttttaattgagacaaagttaacaattatctaactgaaatctaggaaaaagactggctcttccactgatctttaaaaatgtttagtatagttacctttgcttgtgttaacagtactcttctaagagtgtcagtattacttcctttcttattactcaacttctgtgtttttggttctgtagaaagaaatttaatatttaacatgtatatcaaaattacctgcttctggtttttaaaaaaccttttgttgttccaaacacttaagtaccacttgtgggtgctgtcctatgaattccccccagaatttcataatttaaaaatgaaattcaaacctctgatcccaaccaaaataacattttgacattttgtattttaaatgtttatgttttaattactgaattttatacctcagtcattaacctagagaactgtttaattcatttattcacttatttatcaagtatctatgatgaggaagaaaagacataatctctgcccttgtggggtctagagagagaatcagacattcatcaaacatactagaaaaataaaattataactgcactaatacaacaaaggggaatataattgggaatttttatgtagtcaaggagattagggaaggtttcctggaggtaaaatctgaagagagtagtaactaactaagaacagagtggggatttttccctgattactgtgcaaaagaattggaagttactaagagtagataaaatggctggtgcaggagcccaggcaagagatgatgacagtttggcctaaggttgtggtggaagaagtacaataaagtagatagatctgggttacttgggagataaacaagtgataaggcttggttagggactagaaactacaaggtgggtaatgagggaatgaggtgagtgttaaaaataaattctatgtttctgacttgtgtaactaagaaatgatggcactattcattgaaataaggaaaactgaaagaaggccagatgggtttttatgtggaggcatgtatatataagtgtgttggggaagtggtggtgaatgtatgcggtgagatcatgaattggtttttaaaatactaatcttgaggtgccatttagcattcaagtggaaatgtcagataggtagttggatatagtgttctggagcttaaaagagagatctgaactgggaatataaatttgcgagttatctgtagtaatcctgtagacaggaattagatcatttagagaaagatataaagaaggcttaagaccaagccttaataaactccaacatttagataacaactgagaataatgagaaaatcaagtgggaaaaaaacagagaagtaggaggaaagccaagtggagaagctccaagaaggaaggtaaggtcaacaagaaaatggctgcttagaggacatatgataagactcaggaacatctattggttttagctataagtttactgggaatctttacaagagctataatgtagaatgacaggggcagaattcagtttagagtgggctgagaaatgagtaggaggtaaataactggagttgtcaaattagataaatcttttaagaaatttggctttgaaggggaggagaaagagtagaagctggctggagacgtgaggtcaaggcaggttttttgtttctgttttaaaatgtgggagacctgggtatgtataaaagccaacaggaaagtcaagttgagaagataagccttttgagagggctcctgcatttcacccacaagacaggatggaagcaaatataagtagatttcacagcagaaagacagttgccatgtgacgactttctaagacatgacgaaaaatatttgctgagctataccttcatttaaaaagctctgattttcattacagtctaatgttatcttcatttctatttctgaagaacaattatggagacttcctgttatttgtacacttacctgttgataatgggctaaggccaggtgcttcaggaagcctttccagaagttttctctgtatgattggtgtactatgaaagcaaagtgattcacatttcccagttcttgccctagtattaattggagatatcactagaggctcttgaggctcactgcaggggcttttttgtataccatcttttattggctttaagaagttctcaaaagccaatgaaggcagctcctctactggtgatgagggtctatcatctccatttaatgctttggaatctggggatattggttgttgccaagggggaattactggagaatcaggggagctataactaatgtaatagttatcatcatcatcttcatctttttcgggatcacttgcagaggcaactggtggcagcatctgactttcacttgcagtttgactacatcccgtggttggtgcttgtaaagcaatctgagaattatcaacatcctccttggtatgtgctgtagtggggagtatacatggacttacatccatttttggaggcactacaggtttgtcatctgggttaactgaagagctaaagttctcagcagattttacaactccagttggcttggttttaggcagtttcttggaacgttcgtattcttctttggcttgaagccacacttgaaccagttgtcgacttggggcacatttgcaaggcataatcacaatttttttatcttcaaccatcttagggctattacttgaccctttattgacaactccttggccactgcgaaggggtgaccctggccttggattctgagtcattgctgagaatgctgttttccaaagacgaagtccttccaaggaaaagtctccctcaaactcagccagatcatttgcaagtcgagtttctaccatgaggagccgtccaccaatctccctataataacatattttagaacaactgttttgtttcaaagagcaattaccaaaatatttaactccatatcctagataaagtcccttttggagtctcaaaaatgtccatgtctatcttccctgccccctctatattgtgcaggtacattctatctttagtctcaatatgcttttcctcacaggtatatgactactacttaatttcctttggaaggtaccattaatcttagggagagaaggtattttttgttttattttaatgccccatgaagccttctgtccttcaaggagatgacacaaacttttcagattcctttcctctcctaatcttaaaataaattttccattattaccacatatgaataaaaacaatgaatttatcattcaaatactatgtccctggatattattcatagcttcttcctatattctccagtatctgtagtttaacaaagccagtcaattcaaatgaatcttcgtactctcaaattcccttaaacattaaaaaaaataccaactgaggtaaattactctaattctttcttcccattccatggcagggattaacactgacataacttaggagctggcagagcccacaggatgcatggcttaaatgttaccaatgcatgaatatgtgggaaatcactaatgaaaacagtctggtttcatttccaatagttataaatattaagtgaaacctctgtctttctccaatcccttgatactatttctgcttactacagcaacataaaataattctacttcttcatgttaactttattatggatataaagttaattcatagttttttcaatcacttctcttagggcatgattccccaaatgtccccatcactctctatgtaaaatccactaactggatcatgttttcagatttgaagctgaaagaagagcattagggctactctgtctcctttatatgaaaagacttaagcccctactagttaactccataaccagcatccagcactgtccctgcatccactcttggcaatgtgaaaaaacagaaacagaattaatgctgttgaaggaaatgaatacacataccaagtgaccatacccaactctaatactaaggatagagaagtcataatgaggtcaagaataaaaaatggtgaggtgtcgggaggctgaggcaggagaatggcgtgaaccagggaggcggaccttgcagtgagccgaaatcacgccactgcactccaacctgggtgacagagccagactctgtctcaaaaaaaaaaaaaaaaaaaaaaaatggtgaggtgtggtgaattcagttttcttacatattgtcagcagcatggtaattgctataacccactgggaaaaaaaatctcctaatatgtatcaagagccttaaatttttcagtaatcctacttctagggctataaggaaaaactccaaaatacaagaaatgctttaagaagaaaatgctaatatcttcttaacatacataataatatacataatatctatagtggcaaaattgcaaacaacctttctgtccaataatatatacatgatgcaacatatgcagcgattaaaatattcaagaaactcatttggaaaatgtttacaatataatgttaagtgaaaaatttggatataatactgtgactatagtaagatcacacttcacaaaacaaaacaaactaaaaactatactttttaaaaaagaaaacagaatacacatcaaaatattatggtggctgttactacatggaaaaatgatgtaatttttattttttcttctttcatacttcctaaattttctatattgaatatacagtttcattttttttttttgagacagtcttgctgtgtcaccaggctggagtgcagtggtgcgatctcagctcactgcaacctctgactccctggttcaagtgattctcctgcctcagcctcccgagtaggattacagactcatgccaccatgcccagctaatttttgtatttttagtagagatggggtttcaccatgttggccaggatggtctcgatctcctgaccttgtgatctgcccaccttggcctcccaaagtgctgggattacaggcgtgagccaccgtgcccggcctacagtttcatatttcaaaaatatttttcaaaaatgattattttttattttagctgcaggacaagtgtcaaagttggacaataacaacaacacaaaggtaatgactagcacataaagtttggtaactaaaagtaaatataccataatcactactaataacaccaaagtccccaaaatgatggaaactaacgtctaaagaacagatttcatatgctccagcagtgaaataaagagttccatgtgggtactaaacaaaactgtgtgttgaaaaggggctgggaggtggacatttctacctttcacttcaagtcattacaggagagaacttttattctgcatttctgataaccttttctcacccctttattaaaaaaataaattttattgtgtatatttaaggtataaaatatgatattagtatatagtaaaatggttcttacagtgaaacaaattaacatatccatcatttcacattctcaaccctttcttaaatggattcctataggaattattgtgaatctgctgggtaaaagcctggcattcactgtcgtgtttttttaatttaaacttttttaaaaagatattttaacagctttaggttgacagcaaaattgaaaggaaggtacagaagtttcccatatatcccttgtgcccccacacatacatggcctccctcattatcaccatcccctaccagagtggtacatgtgttacaatcgatgaacctatgttgacacatcataattgtccaaagtccacagattacatttgggtttgttcttggtgtggtactttctatggctttgaacaaatgtgtaatattcatattgtatctttcttttttttttttcccactggagtcaggaacatggtactgccacaggtcagtgcatacatgcagtgtgtcctctgctgcttttcctatctctttccaagatttagactaaggcagggcctgccttagcagttccagccatcctcttctgcttctgaatggatggctgaaatgaactgcctgctctgcaactggttaagtatatgagatcatggacacaagggcaggaacaagagccatcatttaaactttctggattaagccacattacccaatttagctttcatcagttatgtcctaacttggtgatgaaagtggtatacaccataactacttaactactgataaataaaccagtactctgatttctattttgctatttgctgtgtgtgtgcgtgcgctcacatgtttgtctatcaattccctgaagagattttttttttgagataaagtctcattctattgcccaagctggaatgcagcggcgtgaacacagctcactgcagccttgacatcctgggctcaagtgattctccttccttagcctcctgagtagctgggaccacaggtgcatgccaccatgcccagctatctttttttttttttttttctgagatggagtttcactctttattgcccaggcaacaaagtgcagtggcgtgatctcagctcactacaacctccacctcctgggttcaagtgattctcctgtctcagcctcctaggcagctgggattacaggcacctgccaccatgtccagctaatttttgtatttttagtagagacagggtttcaccatgttggccaggctggtcttgaactcctgacctcaggtgatctgcccccctcggcctcccaaagtgctgggattacaggcgtgagccactgtgcccggcctaattttttgtagagagagagtctcactattttgcctgggctggtcgcaaactcctgggctcaagcgatcctcccacctcggcctcccaaagtgctgggattacaggtgcacaccaccatacccagccacctgaaaaaattcttaaaagaaaggagaatggaaaccaaagtccatttgctaataactgcataaactataataacaataacaatataatacaagatattgaaaccacatgaaaagtggtttataatagaaacaacttacaataatcttcacttagagatatatcagaggaatacttaaaacacatacatgctcattttcaaaacacttgaaaatgaagttcttttaaaatggtataaaagtttaacatttaaaaattaaataccatttaaacaatgatcattgtaatccttttaaagtatcatgacatctttacagtgagcacctctaatctttaatgaagacatagtgttaaataatggtagatccaagtcaacttaaataaatttctctaggtgtaaccatccagttagtttttgaattttcttagtaagtctgtaattagaaatactttccacaatgatatacttacaaatacggtatcacagaaaactagcagtcaggtaaccaaatgttgcatacattctttttttttcaatccccatagcataattttatatatcataataattcagagtgacccaagggaaaaaataactgattacctgggcttttctggtacatcagaaggattactgcaaaatggttcctggtaaatagtctcagacaggtcatgatccaacaaagttgccataatttcttccctacttgggggggacataagtggtttcagaatgttagcagttcgaggggtgaagctgccatttttagattgtgaaggagagctagtagatcttggtgaactatcaggagttggtgtcaacatatcattgtttcttgaaacatacagttctaaatcttcacaggccacgtctacaagttcaccatcaggggaggagagtattgcagtaaaagaggtattggctgagtcaagagactgtcccatttcttttctggtgtgaccttgaatccagtctgaattgtttggctgtgggaggctaagaaacacttctttgcttactgaactcctattcaatctagatttttcacttagacagtcttctgcctgctgaacacagaaagaatccattattgagttagaccgagttgttagaggatgaaagctatttttccactggttgtggcgacgattctcattgctatctatggttgacttctcaaaaatttcaggacttaaagtaccagatctaatccatgaggctgagtctgtggtatgatgcttgtcttcatcacatttctggttgtcatgacttaaaaactcatttttttctatagcttgtcctggaaaaagatcctgaacagcatcacttaggaacttctgaggcaaattctgatcagctgggacaaactgacttccagaataaaagctacaaaatccagtctgacctattgtgttaatatcaaaattataattatgttcaggagataaactatcttcaagtgagtaacaactttcaaagcctggatctgaaaaaaagatgggactatcatctgatacagagttatccaactggctagagttttgtaaatttaaagagtctactttgagaagtttggggattttttctttttgttttgtacttctgggagttcgaggttttcttggggacgttaccgatcgtgtccgtttatttgctttgttatgctcaagggaaccagaaatatttttatttggttgatgtttattggataatgggtcttgtgtagtatttgcattttgtgctttctgctgtcttttttgtaacaattcttttagaactgccagtccagactgtccttcaccaaatgctgaaggtgttgacacatttcgatttttacactgagaaagtgctttggtttgtgaaattgcttctgataacgacctcggttttactctttcaggtttaaaatttgacatatctaaaataaagcccctttgcttttgctcccatgctatttgtttgattggacttctcaaggaagttacaaagcaattattaggcatttggctttcctctgaagctgtatttcccggagaacaagtttcactgtgctttgactgttccgctatgcacacaatctgctgctgactgtctttgcaatgcaaaaaattaggggtatatgcttggtccagctttgattctagggaattgcgatattcacttaactttccgattgatgacaaatagtttctttgtatattatttgcattatcttctatctttgaggacataccagaagatatctgtgtattctgtgctacctgagataaatgattggaaaggtcaaatatatttttttgaattaacgttgattcctttagagtaaacatagcactttgattatgaggcctttgaacattaatttttgagactccaggtcctatagaattacaaacaactgatggatgcaaatcatctcgtgaactggggaatgtctgcaaatctacagacttcttgctttctaagaaagaagaaaagcagccagataacttctgttgtgcattaattccagtgggtagggaagcagaaaggggatgatctacagcagagcccattagtggcatatctttctgtttaaaaagtagttgagagcctccagaactacttgcaaattcagacacattctggtgtttcagtacaaacttaacctcagcaccagactgagattttattttttcatccttaagtgttgtatgctttctcgatgtacctttctcatttgttttttgttttgctcttggtttcttttttccatcatctactagtttatttgtctgatttcgtttgttccttttcttagtaactatagagggattagcaagctttgcttttgatttcttaatctgtgctcttgcgcgactagtttttcctatacgagaattaacagtcttcttatatacattaggacccttaaaaagcattgcctctttttctgcagcagccatgatttcttcagctcttggatctgtgggagaccagcagcgaggtggagaagaatttatgggacttgtgcttctctcagaaagaaaacctagtttagacataacatcactataattcaggtcacaatcttcggtttcagcattgtaagatggtgagggaggagaaagaatagcatgtgaccgttttttcctgaaagacaaagttcttttaatattttcattatttgtcctttgttgtttaccagtttttttcttagcagatttatgttttgactttcttctgtgacttttctttggtgttagtggataaatgggatatttggttgcaggggagtcgggaacttttggccaaaagtccttcaaaggtgcaagctttttatatagttccattttttcttctgttaatattacttgtttttctttagagtctatttttcctagcttcacaagcatattttttctccctctaaatctattaataataatatactttatgatgacagggggcagctttttagacatttttcttcgttttcgggatttgagagttccatctaaactttcaccaatttccatgggatgaggtagactaatttttgagttgtgagttacaaaacttgactcactgtcttcagtctcataatttaccttgcgtttggctctaagtgtgtatttatttccatatagtccaaaggactgctcagtttctaacgttccatctccaaagtgacagtctataaaaccatctgtgggtgttttattttcaaaagctccacgagtggttttagttaaatcactagccaatgcattatccttctcaggattactattacaaggattattttgtataaaattatcttttgtggatccagtctcactacttttggtagaagtctcctgatgacctgcaagtttccttttattcaattttaaccgggatggtttattgccaggttgtaatttatatgtgacaggagatagtttctgtggtctagtaagacagttagaaagaacaacactgggaaaaaacatatagtgtgctgcttgctggctgaggcttggcttttctgttttatgttcttgaaattcttcatacctaattttaagtttatttagtccactttcatcagcagtgctattaagagaatgcaccatagttctattctcccctgagcatgacagtaattcacaattttcagtaaatgatgaagggaataaactactcagagctgtgctgtttcctttttcatttccttcagaggatactttattttttgaatgatttaagtcagaaaagttgaaagaatttttgcccaatgtattctcgttagggtgacggtgcatatgtataaaaggggaatccttttcgatttttctaatgtttgtatattttctacttggtacttgtcttgtaacagatggaatatcttcttcataatcaaaaatactactttcacaggaagatactgggaggatctctttcttactattctctttatgagaattttctgaatgaacagtactgcttaaagatccagggtatttcatagaataagtgctttcgtttgtaaaagaagtgactgagttatctagacctttttctgtatttttgtttgtctgtgaaaggtcttcaattaaatcttccttgttcaaaacatgggaagaaagggcacttgtgtgtttacactgaaaggtaatcttagcagaagatgagggttctaatgtagcagcatctttgtgaaagatggagggtttaactgaaagcttgcttgttgcaattacagaagagtgggttctagaattttcattgttcaatggattgtctgaaatgaggagggaaaaacagtttatttcattttactcttttaatttttaagacattttcccacaccaagatattaatgctatcactatgaaaaaattacatcaaattaagtttggttatcttaacaaaaaggtaatgcttatcattaatgactcaatctaaatatagttagttacaattattagtcatcattttaaacaaatattccattgatcagaaatagattatattactatttagttcctttggggcataagggaaaaatactgtcactttaaaaatgttcataaaataatatgctttacattatcacttcaaataaactgagcatatttttcagtttattattctacttgcacaacaaacattaaagttttcaaagcttgaattcagtggtcaacaaatgttatatccttttagaaatgagaagcaaatcatgtatctaattctttcaaaagaaaaaaatcctgaaggacgaaacatcactatagcctcccttagccaactatatagaaagtatgattacagtttcaaaatcaatagaaagtatgattaaagtttcaaaatcatatttatttatttattattttttttggaggcagaatcttgttctgttgcctaggctggaatgccatggagcaatcacagctcactgcagcctcaaacccttgggctcaagtaagcctcccacctcagcctcctgagtagctgggactacaggcatgtatcactatgctgggctaatttttttagttttttagagacgggggtcccactacgttgcctaggctggtctcgaactcctgaattcaagtgatcctctcaccttggactcccagaatgctgggattacaggtgtgagccagagcgcctagcctcaaaatcaaatacatttttagatcgtgaataaccaatttctcacagtagacttgtttacttaccactattttcatctgcagttccatctaactgaggtatagaaagactggctagaagcaaactgttatcactccattccatttcttctcctgaagatgagtcatcatcttcagttgaacttctgtgggtatttctgcacagtgatctggagaacattaaaattcactggtgagcatgatcattagtaaagaccatctcagatgcaaataatgcatctaagttaactctataataatgtatctaagttaactataataatgtatctaagttactctatagtaaaacaatacaaaaaatctgaaaattgtaacttctagaaaagcatatttactttgctttattaacatgtcttactatagtaacttacaaagagttattataattagacttcataatccctttcatgtgagctaaaatacaccacaattcctgcattctgaattggaagaaacaagaataaaaagatgagtgaaggggcattgaggtcagggctgaagagaaaatgctgaagaagagagagggtaataggaagtagtaaaggtgttcagtcaacctgacaataactacaaagggttactgagaaattcagatggacagtgaagtccagtctttaagtttcatctcatattggtattaacttgatgttttcccttttaattgaatgggcaaacttttttcctatccatacccaattttttctttcactaatctcaacaatttgaaattattattattttattatacttattatactggaactgtttttccattaagcctttccaaatcacaatttatcataaaaatcactcccttaagagctgaaagaggtatcagaggtccagtccaactttctacccaatgcgaaaacctcatttttaacgaacctgacacaatctctgtttttacataatctgtataaggggcttgctgtctcacagggcaatctttccactgttaatggctttaattattcatagttgtcttcttgtaatacacaaactctttcaacttccatacatgattcctattttgttctctgtagctatacagagcaggttgatgtcattttccacatgataatctttaaaatacataaaggcatttctcattcatcttgtaattctaattagatcaaacattctccattcaaaagttcttcaaaagtgacaatgctcacagatccttctagttttcttcctcttctttccctttcctttttcagtattcttaaaatatggtactcagcacagaatataatatccaatataaagagcagaattaactaaacccttttctagacaccatgcttctactattcaatctctctctaatatatgtgtacaaaatgtttaggtttgttttcccaaggttaaattgggcatggttttcaccaaattggttcagccactgaacatacaaacataaatttaatcataggattgactatgcctattattacagcagtgacaatgttagaggaaagaatttaacatcacatctggagatttctatatctgatttattaagtagaaaaataaaaactttcatcatatacatgtaaacactgaatttatggattaacctgtttcacctttcagtgatggctttgggttggaaatttcaaatacagactaaaaaagttctaatctagcctatagaagtttaaaggagaggcatactcagtctttcaggctcataggcctagatttttctatacacagagcatataactaaagggcagactcaaaccaatcaagttcacagagactgatttagaaaaccacaacaccaacttattcatttattttgagaaacaaaccacaacaccagtgtttgcttcttagtcttttatttatttgtttttaaccttagttcccttagtctaatcagagcccaaaaccataccctgtcttcaggctgactctatacattgttgttctgatacccaacagttcaactatcacagggcattctttttcttaagttctaagataagaaggcacttcaattttgctccatttatcactcacatatgttaatactgtgtatataaatggataacttctaaaagttaggttaatcttttaaaatgtagcaaaactttattttgcttggaatatggagtatacgccatatgaaaaacagatcactaaaggggaattttaaaacatcaatttagttcataaggtattttatatcatgaacaatagtaataaataatttctgattgaaggacaataatgataaaagttaataaaacaactgcaataactaaaaaattacctctttttggcacaatgttcttcaatattgctgtcccatctctgggacatcaccaaactaagctccatttcctctttttcaatctgtggttcattttcttcatcatcactattttgtggatatttattatttccaaaggagcgacatggtgatggcatcctatttctttccccccgatatccatcactttccaaaccagcaagaagatgtaccagagcctcatcaggactactgtccactataaaacaagtacaataatcaccaacaaataagttttcttttttttttttgacacggagtcttgctctctcacccaggctggagttggagtgcagtggcgtgatctaggctcactgcaagctctgcctcctgggttcatgccattctcctgcctcagcctcccgagtagctgggactacaggtgcccgtcaccacacctggttaattttttgtatttttagcagagatggggtttcaccgtgttagccaggatggtctcgatctcctgacctcgtgatctgcctgcctcggcctcccaaagtgctgggattacaggcgtgagccaccacgcccggcctgttttcttaataatccaacaattcagatcactcagaataaaataacaacatcatagatactggcacaggctgaaagaatacagttggtacaaaggctcaggtgttgaggtagctctcctatcaaagttgatccttggaccacctgcattagagtaatttagggacattattaaaataacattgttgtgtgctccagccagggctgcctgggactgcacagggtcttggccgtgggtacagctcagcactgtcagcccctagttgggaggccttgccagggaaggctggcagtggctgcaggaagcctgagatgccactcaaggggaggccactgaaggactggttgagtgcagccctggccagtgagatgaggaggctgggaccatggccctagccacccgtgtttcctccggtgaaatttgtgatactcaccaagaaagaaccacttatggtgttttagtaatgtactgaactttgcaaaatattaattcaaaataaatgcattttccttcttaagtaatacggttttccgtgaatcaaagtacagttaaaaaaactattttctttcacaaatttttttaagctgtatagaaaaaaagcaaagctacttgatttaatgcaaggtttcattttcatattcagtagagtgtttactgaacatgcaacatttacctcttcaagtcaataaaaaaaaaaatgcctcttcacaacacacattttctctgaattacaatactgaatatttatggtagcactgttacttactgaaaacaggtgactcactcagtctttgggtcaaaggctgaaaagtctgactattttccataaggttcaaaattgcttcttcattaataagagcttcttccactttgtgtctagtgtgaccttaatttgacaaagaataaaaaaaattgaagcaatggcctaaatccaaaatttatcatttagaatttgtgtaaatttggaagcattaccatataaacctattttaaatttcaaaatgttaatgatgcatgccaaataaaaacataataaaaagccacagaaatatttaaccagtcacatggatttatcaaaacaaacactgaatctataaatcaccaaatatttataacctctttaatcctacttaatgtgtgtagttatattactctgataaaaatcactgcatattcaaatatataaagtgaaaaggaaagataaactatcttatttgaatactaaaattctttattctctatggttcaaaaacaacaaatttagaataaatgtttttgaactctcctagaaaaaaaaaattgacagtgctcattatttgacacatgtgtattggactctcttttgaatgcataaaaaataaagagcttagtgtaatccctaatggggcgtgtgttggtttttcatgcctgtttgtgaactgtagttgtggtttcccatttcattgccataactgggcagaaatagtttttaagtgctataaaaatacaaagaaatggttaagcaattaaaaaattcattttacattaatatttttcagaaagctttcattatatatcacattcattacattttcatgatatcaaaaaatattagtccatgtggccatatggaatcctccaacaattgccgtcccctgaaggaacaccaaactgaactacccacacaagaaagcgccttcattagaataaaaaatcaggagagcaatcacagtacttggttttaacaacgtatcaaggaaagaggcagcgaagagggtagaaaagacagtcgtgaattgctgacagcacctcccatctctcaggcagtggtcttgaggcacggagagagaaatctgtgcttaggagagacagaacagagtgaatatgggactttgctttgcattggaactcagtgctaccctgtcacagtggaaagcaacgtccctgtcacagtggagagcgacacggtatagaatttagccagcacccatgaggagaggatttgaccagccccagccagagggaaactgcccatcccagcagtccagaacctgagttgcagccagccttactactatgggctaaagtgctttgggatcctaaataaacttgaaagccagtcttatccacaaggactgcaattcttgggcaagtcccagtgctgtgctgggctcagagccagtagacttggggtacacgcgcctggtgagagagtagctggggcagctaaagaattatttgtgtcaccccccctcccccaaccttcacagtcccaggcagcacaactcgcagctccagaagactctttcattccacaagaggacaggagaggaaggagtgaagagaactttatcttgcaacttggataccagctcagccacagtagaggaggtagagtcgtgacacacatattccaggccctaactcctggatgacatctctaaacacaccctgggccagaagggaacctgctgccttgaagagaaggactcagacctggcagggttcatcacttgctcactaaagagccctttggccttgagtaaacacaagtgacactcaggcagtacttgctgcaggcctcgggtgagacccagggacatgctgacttcaggtgtgacccagtgcattcacagcactgggaaaaattgaaagcccgttctctaagatctggaacaagacaaggatgcctagtttcaccactgttattcaacacagtactagaagtcctagttagagtaatcagacaaaagaaaggaataaataaagtgcatccaaattggaaaggaagaagtcgaattatccttatctgccgatggtatgatcttatattaggaaaaacctatagactccaccaaaaaacaaattcagcgaagttgcaggatacaaaatcaacatatgaaaatcagtagcatttctatatgccaacagtgaacaatctgaataagaaaccaagaaagtaatcccatttacaatagctacaaataagatacttaggaataaacttaaccaagtaagtgaaacatccctacaatgaaaactataaaacactgatgcaagaaattgaagagtacaccaaaaaatggaaaagatattccacgttcatggattggaagaatcaatactgataaaatgtccatgcctacccagagcaatctacagattcaatgcaatccctatcaaaataccaatgatattcttcacagaaacagaaaaaaaaaatcctaaaatttataaggaaccacaaaagatcccgaataaccaaagctactctgagcaaaaagaacaaaactggaggtcacattacctgacttcaaattatactacagagctatagtaatcaaaacggcatgatactggcataaaaacaggcacacagaccaatggaatagagaaccctgaaataaattcatgactgcagtgaactcgtttttgatgaaggtgccaagaacataccttgggggaaagaacaatttcttcgataaatggtgctgagacattggatatctacatgcagaagaatgaaactagaccctgatctctccaccatattcagaaattaaatcaaaatgaattaaagacttaaatctaagactcaaactatgaaaatactaaaagaaaacattggggaaactctctagaatattggtctgagcaaagattttttgggaaatatccccaaagcacaggcaatcaaagcaaaagcagacaaatgggatcatatcaagttattatacaaagcttctgcacagcaaaggaaacaatcaacaaagtgaagagacaacccacagaatgggaggaaatatctgcaaactatccatctgacaagggattaataaccaaaatatatataactcaatagtaaaaaatctaataatccaattaaaaaatcggcaaaagatctgaacagacatttctcaaaagaagatatacaaatggcagacaggtgaaaagatgctcaacatcactgatcatcagataaatgaaaatcaaaattacaatgagaaatcatctcaccctagtaaaaatggcttttatccaaaagacaggcaataatgaatgctggcaatgatgtggaggaaagggaactctcgtacactgttggtagaaatgtaaattagtacagccactatggagaacagtatgaaggttccttaataaactaaagatagaactaccatataatccagcaatctctctactcggtatttatccaaaggaaatgaaattggtatgtcgagttgaagagatatctgcactcccatgtttatcacagtcctattcacaacagccaagatttggaagcaatctaagtgtccatcaacagatgaatggataaagaaaatgtggtacatttacataatggagtactactcagccataaagagaatgagatcatgccatttccaacaacatggatagaagtggaggacatcatgttatgtgaaatacgccaggcacagaaagacaaactttgcatgttctcactcacttgtgggggctaattaataatttaaacaatggaactcatggagataagagagtagaatgatggctgccagaagctaggaagggtagtagggtggggtggggaagtggggatggttaatgagtacaaaaaaatagaaggaataagatctagtatttgatagcacaacacagtgactacagtcaacaataatctattgtatattaaaaaataactaaaagtataattggaatgtttgtaacacaaagaaatatatgcttgaggttatggataccccatttatcctgatgtggttattacattgtatgcctgtataaaaatctctcatgtaccccataaatatatatgtctactatgtacccacaaaaattaaaaaaaatttaaaagtaaaatgtaaaatttcaaatgcattaaagacctaaatgtgaaaaaccaaactgtaagcacacgtaagccttaaaatgaatacttaagagaaaattttcattacatcagggtagggaaggtctcataaatcacataccaaaactaaaccataaaggaatattggtaaacttgacattaaaactgaagacatgtaaaaccccaaggataacttttttttttaaatggggggaaaagaagttaacatttttttttgaagatttttataagataagcctagatggagagaaaacatctctacaataagtataactgataaagacttaatatctagaaaatatgaagaactcctacaaataagaaaaagacaaatgactcaatagaaaataagcacaaaatgtaattcacaaacagagaaacccaaatggcctttaaagatgctcaaattcattagtaattaggaaatgcagattaaaatgcagagacactatttcaaagaatcagagcagcaaattttttacatctattattttatccttattatttgatgctatcaaatgttgaggctttgcttgcctagtaaaattgcgtatgatacaatgtgacttctgagtaaaacttttattattgtcttgtttactaaccatgtataagctaattgcattatagaaaaactgttagaacagatgctatctaggtagagtacaatgcatacaccctaacattcagcaactcactcttctacatgtgtttggtagagaagctcctgcacatagccataaggagacagatgtagcactaagtgcaaaagtaaagaccatctaatacttgtagagaaatagctaacattgttgtttagtcttaaaatggaacagtcatcagcagctaaaatgaatgaacaaggataaatttcaaagttataatgttgacataaagatgctcgacatcagtagtaatgagggtaacgaaaattaaaaccacagtaggattctatttcacacactaggatggctacattaaaaaaagacagataataacaagtgttagtgaggatatagagccagagaaactctcatatattgctggtgggaaagtaaaacattgctgtcactttaaaaacagcttgggagtttatttaaaaattaaacacaaatataccacatgccctagtaattcttttgcttggcagaggtaatctttttagtgacgtttattcttaaactgtttcatttgttactattgatatcattttacaactttatgatatttatcctaaaatttatgctttactgcttataacagcactattttttttttttttttttttttgagatggagttttgctctgttgcccaggctggaatgcagtggcatcatcttggcttactgcaacctccacctcctgggttcaagccattctcctgcctcagcctcctgagtagctgggattacaggtgtgcgccaccacgcccggctaatttttgtatttttagtagagacagagtttcaccatgttggccaggctggttgccaactcctgacctcaggtgatccgcctgcttcagcctctcaaattgctgagattacaggcaggagccactgctcctggccagcagcactattcttaccaggcaaaagtgaaaacaactcaaatgctgatcaactgataaatggattaacaaaatgtggtatctccatacatactgatagatactacaacatgtataaaacttgaaagtattatgctaagtaaaagaagccagacacaaaagactatatattgtatggtttcacttacataatatacagtatctagacaaggcccatgtattattagtggttacttggggtttgaggtggaaataggcataactgtaaatggacacaagggatcctgtggactgatggaaacattctaaaactggattgtggagacgtttgcacaactttgtaaatcattgaattatacgcttaaaatgactgaattttatgttatataaattaaacttcaagctgcttaaaaatataatgctgagtgaaaaaagcaagttgcttcatctacgccaagcagaacatcatttacgtaaaatttaaaacttaaaacaatggtatatatggtgggcaaacattataagaaaatataaaattatatatggtaacagtttgcactaacttcaggatactgcttacctttagagatgtagaaagggtgacagaatgggagaaatttttgctatatccacaatatttatttcatagggaaaaaaatccctagcaaactcaatcaaatattaacatctcagtgctagatatctgttctagtagtttctgtatacatgaaaagaaaatcttacctttgcttgactctttgtctttgtgaacttctaccatattggctggtgtacactgaagcatttcaggagacagaacctcagagtgcaatgttaactcagcagagaactcctgggatccatcgctgtagtccacagatcctgataatgttctgcttaattaaaacatatcctttataacagactacataacaaaggaataaaattagttctgagatctataataaataaccacttacacagagaaatcattctgtttgagaatttcctgaagtctcttctgaaattttttttcactttctgttgctggcacaaacctgtgatctttgaattttaaaagtgcattaaaaaatgtaaatagcaaatgaatgaaatattttcccttctcctaaagtagctttaaaaatggtggcaatttcctatctttctctagatatacataatacaacctaactgtagttttaccatagaatcacacaaaagagaaacggttgttactaaagttataaaattaggcacttaagtcagttcaagattaagttctataattataatctaaatctaaaacagaaaaattgttctctacctataaatatattgtatcctaaagctaaaaatttcccctcataaaatatatttctatttttaaaagtataaaaggcactcaaagtttatcaaaacatttttagtgcctaagatataataattttaattgaacttcaatataggcttactgctgtattttgaaataatatatctgccttttgaatgatgtcgttcactcttttacctttatttttaaaactgttgtatccatggtattatctaaaccccctcgaattctttttgaatgtggcaccatttagcaataaatgtttctttagagctgtacatattgaacaaagtgagagcttatatgacatactcagaaaataaactgtgggcagcatttcaatggctacattttcaaagcttaatgtattaaacagtgtttctaagttgagattcatgatcttctgtgagttttctatagctcatttggaaatacagagggctagaacatactagagaatgaaaacaaaaaagtgaggcaagaggacaaggtacattaaaaacaaagaacagtaaaaacgtcaacttcttacaaagagataataagcgacaattggagacagctgtaaagataaatagtggctgtacagcaatgacaacaagaaaaatacatacaaaatataaaggtcatttgaaaagtaaaatctaatgtcaaaggaacaactcaatgacaaacttttccattaaaatacttgatttaaaagaataatcagagcactattaggtttataccttgtgactcaggttggctcatttgagaagtttcatttctgtttcttcgccgttgcttttcatcttcccatatggcctgtagaccagggtttccaccaatttgagctgtaatcacaataatacttcaatactacagggtcaaagtaagaaatgcctaaaaaatctaaacttttctttaacaaatactgcctttaaaaaaaccaatcacatattttgtgtaataaagtggacaaattatcccaacctacacttactatgttactccttttttagttttcttcctagtggttccccaaaatccagcaagtgaatacaattcaaacatctgatgatagtcaatagacctaagagtccctttgctgatatataatatgaaaattaagaaattaaaaggcacagtacattaaattgctttatattagctaattttatttagtgtcacacttattttagtatcatctattcaaatatagtcatttggacaaaaatataaacaaaaaattaatacctcatcagaagtatagaagcaatcttcataacattttgtatcctccttctataatatcttagtttcctcgtaaagttttctttcctactttttctattccattttggtcattaattttttttttttttttttttttttttttgagatagagtcttgctctatcaccaggctggagtgcagtggtgcgatcttggcccactgcaacctccgccacccaggctcaagtgattcccctgcctcagcctcccaagtagctgggactacagacgtgtgccaccacactcagctaatttattttgtattttagtagagacggggtttcaccatgttggccaggatggtctcgatctgacctcatgatccacccaccttggcctcccaaagtgctgggattacaggcgtgagccaccacacccgccggtcattaattttaaaaaataaaaacatatattaagaataattgtgtatgaaccttcaatgtccagacgatttaagatatcagcagctacagcatccacttctaattcacatgtactctgtggttcaacaccttccaatattaaagagctgcaattaaaggatataaaaaacataataattatgtgagagcaaactttctaacatttttcttacttatacaattatcttacatttagcttgtacccagaaaacctgatatattaattcacaattattctgacaaaattgatactttatatgtatatataatgaaaaataggatgagaaaaatacaaaacatattatactgactaccctagatccttttgaagtaaattctacgtattttggttcattatattttatataaaaggaatataaaacgttttagcatatggttatacccggggcagaatgggataggataatataaaaacctcagaggaatgcataaaaaaccatacacatatgaaatcagttgcctagagacatctttttcagtattcaaaaaacaagggagaacatgcaataaaagggaaggtgagcacactgagaaatgggcaaacgatattcaccattcttcctgccctcaactactgctgagatagggaatactttaaaattcttcataactacagaactgataaaatgtatgaatgatcaacagtgggatcatagctaggaaaagtaatgatatcaccaggtcattaatttttatgagaactacaaaggattgtttcccagtctggatctttgactcaaaagcatttgcttttcatcagtgccccaaaagagaagataaagaagacaccacataattgaccctacttaacagaatgaagagataacatctagtgtggatcctagtttactcattccaaaatttaggccttgtacaaaaatggacaccaagtggaaaaggggagatccttaattttactacaaagtggttgatgacatatttcattaacttttgatttgaaacactttggtatttttttttttttttttcagatggagtctcgctccatcgcccaggctggagtgcactggtgcgaactcagctcacctcaacctccacctcccaggttcaagcgattctcctgcctcagcttcccaagtaactgggattacaagcatgtgacatcatgcagagttaatttttgtatttttagtacagaaggggtttcaccatgttggccaggctggtcttgaactcctgacctcaagtgatctgcctacctcggcctcccaaagtgctggaattacaggtgtgagccattgcgccctggccttgaaacactttttaatgttttaagaaaaacatgttagcaaaaactcattttccattgtctattttaaaggaaattttgatggaatattacatgttagttgttaaaccacagaattttcacaactcaaataatatacgtatatatgtactcacaagtatatatttagatgttcaaacacacgtatcttttcaccattgatagagaaggaatataattagccaacctatcataatatattcctttctctttcagaaaaaatatttctcaatatagattgtcagctgcgcttggtggctcatgaatgtgatcccagcttcggcttgggaggccagcctgagcaatatagtgagacctcatctctacaaaaaatttttttaaattagccaggcatggtgctgcacacctgtagtcccagatacttgggaggctgagcattatagtaagacctcacctctacaaaaatttttaaaaactagccaggcatggtgttgcacacctatagtcctagattcttgggaggctaaggtgggaggatcacttgagcccagaaggcggcggtcgtagtaagctgagattgtgccactgacctccggtctgggcaacagcgtgagaccttgtctcaacaacaacaaaatgtgaattgtcctcttcattcatacaatttaacacacattgaagtatcaaatttaaaaatgtttatgatccacagttttctcatataaaaaagttttataatttgaaataattatgttgtaaatgtcaaggatgaatattcccgaagtagcacatttgagagaaaggagggaaacaataacctcaaaaaatataatctcacagtagaaatttacaacttgcccttatacaaaactacttcagacattcagaacaggaggtgttcctatggaggggaagtagttttcagaattaaaaattagcaccagtagacagaaaatgtatgagtaaaaaatttgcataagcaaatacatagctgctttgaaatagagaaatccaagcatttggaatatactgcctccaaaaaaaatctaatcaataatgaaacaaataaattacaaattatattattcaaaaccagagcatgtcaaaatactttattacttatttaatatttataaattttaggggttattaaaaatatttagatttttgttttaaattactattttatcataaatgtaattgttttacttgacaagttataggatatcaaattagaatagatgatgaagatgaatgttgcagaaaagtataacaatatctaccttgtattccttttgttaattaggtaataactagtacattttcatggtttgtttttaaaatcgtttattccttgtaatacactaatgtcaaggtttgtttctgttaagtgtatagattaaaaagatccaatacaataaaaggttaaaatttaattatggtaaccactgatttctgatcacaactaggatatatgtaaaattttcatttcctttacaacattaactaaccttggtatttcatcttgttcccaccgaaataaagtatcagcaagagaatttcctgataaatgattcttgcaggatccagttgcatgcaatgtattacctaggaatagaaaggtaaaaggaataaattctactttcaattttcatataattactttttagaaggtaaatttttttttttttgagatggagtctcgctttgttgcccaggctggagtacagtggcgcaatctcggctcactgcaagctccacctcccaggttcacgccattctcctgccacagtctcccgagtagcctccaagcgcagcaaattttttttgtatttttagtagagactgggtttcaccgtgttagccaggatggtctcgatctgaccttgtgatccgcctgcctcggcctcccaaagtgctgggattacaggtgtgagccaccatgcccggctggtaaatgttctttaaaaaattttattactcataaattacagatccctttttattgatacataatatttgtacatactcatagagccacatgtggtattttcatacatgcatacaatctgtaatgacaaaatcaaggtacttaggatgccatcagcccaaacattattcaccatttgtgtcgagaacatttcaaatcttctcttctagttattttgaaatatataatgtattgttgttaactacagtcactcctgtatgctatcaaacactagaacttatttcgtctaattgtatgtctatatccattaaccagcctgtcttcgtatcttcctggaacccttcccatacacccttcccagcctctagtaactacctttcttctttttatttatttttttgacatgacatcttgctatgttgcccagactggaatcaatctcctggactcaagcaatcctcctgcctcagcctcccatgtagctgagactacaggggtgcatcacgactcctggctaaagacgaactttttttagttcccacatcagtaagaacatgtgatatttgtctttctaggcctggcttatttcatttaacataatgatctcaattctatccatgtggctgcaaatgacagaatttcattttcataaaaaatatggtagaatataattccattgtgtatatataccacattttctttatccattcatccactgatgtgcacttaaggttgattccgcatcttggctattataaacagtgctgcaataaacatgggggtgtaggttatctatctttgatatattgaattgatttcctttcctttggataaatacccagcagtgggattgctgtatcatatggtagttctagtttttggtttttgagaaacctccatactgttttgcataatggctgtactaatttacattcccaccaacagtgtataagagtttccttttccttgcatcctcaccagcatttgttggtgtcttttccgtaacagccattctaactggggtaagatgattgcttactgtggttttgatttgcatctccctgatgattagtgatgttgaacatttaaaaaatatacctgccggccatttgtatgtcttcttttttgagaggtgtctattcagatacgaaactattttttttcctgttgagttccttacatattctggagattagtctcatttcatgaatagtttgcaaatattttctctcattctgtaggctgtctctttactctgttgattgtttcctttgctgtgcagaagcttttacacagtcccttttgtctatatgctttggttgcctgtgcttttgaagtcttagccataaaattttttcccagaccaatgtcccagagtatctgtcctacaatttttttttttttttttgagacagggtctcactgtcatccaggctggagtgcagtgtatgattatggctcactgcagccttgagcttccaggctcaaatgatcctcccatctcagcctcccaagctgctggggcaacaggcatgcaccatcgtgactggctaatttgtagagatgggctttgactatcttgcacaggctggactcaaatttcttggctcaagtgatcctcccacctcagcctcccaaactgttgagattagaagagtaagccaccatgctcagcctatgtgtctgtttttataccaacaccatgctgatttggttactaaagctttgtagtattattttgctcagcctgtgtgtccatttttataccaacatcatgctgatttggttactaaagctttgtagtatcgttttgacctcaggtaatatgatgtctccaactgttctttttgctcaggattgctttggctatttaggctcttttgtagttccacatgaagtttagaatttttttttctatttccatgaagaatgtcattggtattttgatatgaactgcaatgaatctttagattttattggaaaatatggccattttaacaatattaatgtttctgatccatgaacatgggatgtctcccatttgtctatttccactgtctacttcagttaattttatcagtaatttctagttttcctcctatacaacctttacttccttggttaaatttattactattctttttggtagccttaataaatgggattgtgttcttgttttctttttcagctagttgttattggtgcacagaaatgctattagttttttgtgggttttaaaaaaaaatctgcaactttactaaatttatcagttctaagagttttttgttggagtcttcaggttttgccatatatatcatgtcacctgtgaaaaagggacaatttgacctcctttttcccaatttggtgtcttttattacctgattgctatggctagaattttcagtactatgttgaacaggagtggtaaaaatgggcatcctgtcttcttctagttcttagagggcaggttttcagcttttccccattcagtaagatgttaaatgtgggtttttcagacatgatgttcattatttgaggtatgatccttctatgattaacttatcaagagtttttaccatgaagggacattgaattttatcaaataacttttctgtgttagctgagatgatcatatggtttttgtccttcattctgttgatgtgatgtatcacatttattgatttgtatataatgaacaatccttgcacccctgaaataagtttttttttgagacagggtctcactctgtcacccaggcttgagtacagtggcatgatcttggcttactgtaacctccgcctcctgggctcaagccatcctcctacctaagtctcccaagtaggtgggactacaggtgcatgccaccatacccagctaatttttttattttttgtagagacagggtttcaccatgttgcccaggatggtctcaaactcctgggctcaagtgatctacccacttcagccttccaaagttctgggattacaggcatgagccactgtgcctggccctaggataaatttcacttgatcatggtgtatttttttttttttatgttttgttggattcgatttgttagtattttgttgaggatttttgtgtctatgttcatcagtgatgctgacctgtagttttctttttttgttgtgtcctgtctgattttggtatcaggataatgctggcttcatagaatgagttaggaagaatttccccctcttcaaatttctagactagtttgagaagaattggtgttagtttttctttctaagtatggcaggattcagcagtaaagccatccagacctgggcttttctttattgggagacctttaaattacagattcaatcttgttacttgtgattcgtctgctcaggttttcttttctaaaaatttaaaatagagacaaggtctcactgttgcccaggctggtcttgacctcctgagctcaagccttcctcccatcttgaccttccaaaatgctaggattgcaggtgtgagccactgtgcctggccaggtttcctatttcttcctggttcaatcttggtatgctgtaatgcgtccaaaaatgtacacattccctctaggtttcccaacttgttcacatatagttgttcatgatagtctctgatgatcctctctatttgttatataaattgtaatgtctcctttttcatgtctaattttatgtatgtcttcttttttcttggttagtctagctagcgatttattgatcttttcaaagcaccagtttttcatttctctgatcttttgtatttttttttttagtctctattttgtttagttctactctgatctttattatttcttttcttcttctaattttggctttgttcttgcttttctagtttcttaaagtacatcattacattgtttatttgaaatcttttttttgatataggcacctattgctataaacttacctcttagtactgtttttgctgtatctcataggttttggtatgttgtgtttccattttcattggtttcaagaaatttttaaatttccttcttaatttcttcattgatccaataaaggttcaggagcattttgtttaatttccatgtattggtacagtttccaaagtttctctttttattgatttctagttttattccatagtggtcagaaaagacacttaatatgatttcaattttctaaaatttgttaagacttgttttgtggcctaacgtatgatctttcctggagaatgttccacatgcagatgaggagaatgtgtattctgcaactactggataaaatgttctgtaaatgtctgttaggtccatttggtctaaagtgcagtttatttatttattgagacagtgtcttgttctgtcaccaggctgcagtgcagtggtgtgaccacagttcactgcagcctcaatttcccaggcataagcaatcctcctacctcagcctcctgagtagctgagaccacaggtgtatgccaccacacctggctgatttttatcttttttgtaaagatgagatctcactatgttacctgagctagtctcaaattcctgggctcaagcaatcctcctgcctcagcttctcaaagtgtcaggcttacggtgcccggctctaaagtaaagtttaaatccaatgtttcttttttgattttctgtctagattatctgcctaatgctgagagtggggtgttgaagtccccagctatcactgtattgtattggctagttggggacttcaacaccccactctcagcattggacagatgctaagaatcaaatctaataacatttgctttcaatctaataatatttgctttatatatgtgggtgctctggtgttgggtgcatacatattgagaactgttacatcttttcagcactctacatgttcagagaaacttctctagtagcaaactataggaatgttccctttaagtaaaataatatataacttatgtgactagttactaaaattgtatcctaaaaattcatatacagcaagaaatacatactcagttgaaaaatgaggatgttaaaaaaatataaaatgcttctgtggtgctcaaaacatttgctccatttattcctcttttacccatgtggggggaaaaaaagaaaaaagaaaaaaaaaattgtcccatttacatactttatacacttcattttaacaactacagtaattagcatcatttccatttcatttgaccactgattatacaactgagtgctgaggcaaaactgtatatgcacatataatattcaaatttctaaatcattttcatttttgaatgtattttactttcaaaagtaaaactccatgtattatattaatttatcaggtaaaatgaagttatgcatacatgtaatacatatatttacttacaagaagtttactgtcaagttaaactgtaatgtgcctgagataacatgataaaataaaataaaaaaaattattcactgattttgtacatgatttcagtataatcttttatctcatactaaacaaaaacaaaaacctgagggctaactatatgataaaagaagatgtaaatttttttatcatactgcaatttccctgtttttaacttcctttctaccaaaactaattgtgatttttgccattgaaagtaacagcaaaagctgcaattacttttgcaacaacctaataaatttcacatgatgccttcaaatctgtaaacacttccgatattctgaaaaaaacccttctgagtaccattccaataatctaacttttataaataaaataaatggtttctgtatatttgctaattcaaactattcttgtgctttttcacctactggaaaaaactaattatgaaaattatctcctctttctataatatctaatgtatatactctagaaactcttccattcctcaatctgtcttaaattcttggttatacttgacaatgataactaacttattattttccccagtaacctttttattttttaataactttagatttacagaaaagttccaagttccaagggtaccacagagagtttccatataccagacacctggtttccctcattgttatcatattatcatggtatatctgtcaaaacaaagaaactgacactggaagattactattaactaaacaaaaccttttatttgaatgtcaccagtttttccactaatgtcctctttctgttccaggatccaatctaggacaccacactgcattcagttgccatgtctttccagtctcctctggtctatttatctgtctttccttgcttttcatgacctttgcagtcatgagaactgatgagataacctgtaggacaactcccaatttgggtttgtctgatgtttttctcatgagtagactggggttacgagtttttggcaagaatatcacacaggcgaagtacctttgttatcacatcacatgaggggccacatgacacccacatgacataataactggtgacattaaacctcatcacttggttaaggtacatcacgtggttatagagtttgatgaatgaatagtcatgtaaccaccaacccaggactgtacagaataattccttcactcttaaaaagttcccctgtacatcccctttgcagtcaatacttccctctctcctaaaccctaacaactaatagtccattttctacttctatagttttgccttttccagaatgtcatgtgaatgaagtcacacagtttgtatccttttcggtctggcttctttcacttagtaaaatgctttaaagattcatccatgttatatgaatcaattgtttgttcctttttatcactaaatgttatcaaagtttatccattcccctgttgagtggacatctcggttgctttacatttttggcagttatgaataaagttgctataaacatttgcatacaggtttgggtggacctaaatcacttaggtaaacatacctaggagtgccatcactgggtcgcactctaagtctatgtttagtgttctgagaaactatctgtcttccaaagtgactatattattttgcattcccaccagcaaagaatgtcagcgctgctgttccacctcttggtcaacatttgttattgttagtcttgcgaattgtagtcattctaataggtatatagtggtagccctttgtagttttaatctgtatttccctaacgacatataatgttgaatatcatcttttcatgtgtttgccatccttatatcttctttaggtcttttgaccatttttaattggactgtttgctttcttattgttgatttttaagaattcttatatattttatacacaagtcctctatcagattgtaatttgcaaacattttctcccagtccatgacttgtcttttcattttttaacagtttttcacaaagtaaaagtttttaattttgacaaaatctaacattaatttctcttttcatggatcatgcttttggtgtcatatctaaaacttcattgccaaacccaagactgggtacattttcccttattttctgctagaagtttgataggttcatattttacatttaagtttgtgaagtattttaattattatttaaggtgtgaagtatgtgacgtataaggtgtgaagaacatacaaaaatatgttcttttatttttattttctggcatatggacatccaattatcccagcactatttgttgaaaaggctatgctttctccattgaattaccattatatctttgtcaaagttaagttgactatatgggccaattatggattatttcaaatataggtctatttctggactctattctgttccattggtatatgtgtttatctttttgccaataccatgctgtcttgataactgttgctttatagtaagtctcgaaagtgggtaatgaactccctaaacctcaacttttggaagtctccatactttaaaaaaggattatctcctggacatgaaataatacaaccttcacaaagatgggagaaattggtggacagttgtctctgtcctgcttttcttctatcttccctcttccttcctttcctttcagtcattatggagaaaaagccaagcctacttcatccttcattatatgattccctcttgggaattctaaggaccaagggcaagttatttgctcacatactttggtttactgtgggaattttatactactctaagatacagagaagataagaaaaactggcatttagtaaactataagttgtcatctaaacctgaggttattatccagaagaattagttatgaacaaatgaattactctgctctaaaagggaggcacatgctagtttcaatgcttcaatatttgtgtatttaaaataaaaatgtaattttaacaagttgtcaccacaaaacattctcttctgaaaaaaagtttaaatgcataagttgttccacataagaaaattactagcatgctggagagacaaaacaaataaaactattagtgaatataacatgacattagagcattgcatatagcatcattatttgataaagattctggaggccaggcatggtggctcatgcctgtaatcccagcactttgggaggctgaggtgggtggatcgcttaagcctaggagttctgagaccagcctgagcaacatggcgaaaccctatctctacaaaaaaaatacccaaattagctaggtgcggtggcatgcacctgtagtcccagttacttgggagactgaggtgggaggatggcttgagcccaggaggtggaggttgcagtgagccatgttcacactattgcactccagtctggtgacagcaaaaccctgtcttacaaagaaaaaaataataaaaaataaaaataatatcctctagggaggatttgcacttgctgcttctgtcagatctgagtctattactagaccagcaccaccttagatcaagctctggatttgggaatctcttttagtcccaggagattcaaactatactgaaaaaaaaatgtctgaagtatgttccatttcccagtctgtgctcaccttaagagaatatgcatttgaggccctaccttaacctgcggagggctcccacctgctgggcaggacccacttctgcttttcatctctctcacccagcatggccttcccaaagaaggttcttaattttccaagattagtaaatgccctcaggtcaaaagttgctttaagcgttctattcccttttggcctgcacttctttattgttcataaactcttcaatgtatttaaatttttttatttcaatgttgcctggcccttaaattgtttttagcagaagggctgatcccactaacctagcccactattcacggcaacaaaaagaaaccctccctggtgacttttcagagcatagtttgggtatggtagaagaaatgcgaggagttaaaccaaaagtgaactaagagacaaaaaatgctaacctctgcttcaagaaggttgacagtgatggaaaagaaaaaaaattatggcagttagaaaggatattaggactggaagtgtcagtttcattttaagagaagtagaagggaaggaattcaatgagaagaaaaggcaaaagatgctaaaacacttgacacagaaattctactcccaggtaggtgtccaagagaaatgaaaatatatagctacacaaaaattcataaatggatgttcacagcagcattgttcataatagccaaaatatccattaactgggataggaataaataaaatgtagtgtattcacataacagagtattatttggccataaaaagaaacgaagtactgatataagctacaacactgatgaaccgtgaaaacattatgctaagtaggaaaaaaccccacatattatatgattccacttacattaaatgtgcagtatgggcaaatatacagagaccaaaagtagattagtaaggttgctcaggagtgggaaacatgggaagcttgggggtgactgctacaggtcataggatttctttcagaggtgatgaaaatgttctgaatttgtggtgatggttgcataactccaaatacaggaataccccattaaattgtgctttgctttattgcattttgcagatattaaaatttttacatattgaacatttgtggcaactctgcattgagcaaatctattggtgccatttttacaagagcatgtgttcattttgtgtctctctgtcacattttggttcctcttgcaatatttcaaacctgtgaacagtgatctctgatgttactattgttaattgttttcaggtaccacaataaaccgtgcccataaaagacagcaaacttgagtgtgttccaactgctccactgactggccattcccgtttctttctttcctagcaccttcctattccctgagacactacgatattgaaattaggcaaattagtaaccctacaatggcctctaaatgttcaaatgaaaggaagagtcacatgtctctcactttaaatcaaaaactaaaaatgattaagcttaccaaggaaggcatgtcagaagccaaaataagccaaaagctaggtctcttgtgccagttagccaagtagtgaatgcaaaggaaaagttcttgaaggaaattaacagtgctactccaatggaacacacaaacgatgagaaagtgaaatagccttactgcagataggtgaaacagcaggggctgatgtagaagctgcagcaagttctctggaagacctagctaagataactgatgaaggtggatacactaaataacagatttgcaatgtagatgaaaacaacctgagagcagtcaatgcctgatttcaaagcttcaaaggactctcttggtagggttatttaatgctgctggtaacttgaagttgaagccaatgctcatttgccattctgaaaatcctagggcccttaagaattatgctaaatctactctgcctgtgttctataagtggatcaaaaaagcatggatgacagtataacagttgcagcatggttgactgaatattttaagcccatttttgagaactactgctcagaaaaaagattcctttcaaactatttctgctcactaacaatgcacctggtcacccaacaggtctgatggagatgtacaagacgactaatgttggttccctgcctgctaacacaacatccgttctgcagcccatgggtcaaagagtaatttcaactttcaagtcttattatttaagaagtgcatttcataaggctatagctgtcactgacagtgattccactgatggatctgggcaaaatatattgaaaaccttccagaaaggattcaccattcaagatgctctaggctgctctggtctgtaactttccattccaacagtaaaaaatctgggatctcctacttttcacctcagaaagctacaaatgtaaaaggaaaaataaatttgttttgagaggaaatcacttattcaaatagccatgttattctgttttgttcataatatcaacggctctataaataaagaactttaaagaaatagcaaattcacccagagaaagctctgcctgcaatatttttcaggtcatgtcacacaaagaaaaataacaatgcttgcacagcccactgagataaaatggacaaggatgttcagtggtggaggtgatggctcaagggacttaggaatccgtctggaatgctgagagaccaacacgtccactaacctacagctattcacaccatcagggaagtgctggactaaagtaacaaggctctaacaactccagggatttctagaattgtgtatcatatactattcctaaaatataaaaagtaacattaaggtctgaggttaaaaaaaaaaaagaatcacaatacatatcaattgctaagcagtgtaaagggttcacttttgcagtggtctagaactaaacccacaataccttttaggtagcctgtatactaaaaaccatcaaactgtcctctttaaacggatataaattataactcaataaagctgttaccaaaaaaaattttttctgagatgcttttcctgacaatctctaatcccactttgcatgtatttcttttcattctttagtcactcaacatttattttctaaatatatattattttataaatcactgactatataacacttgtttcaaaactttaatttgacaaaaatttaatttgactgaaaattaaccttacttttccttcttgcttttcggaacttgacagcagccagatttattaaattcatgccataaagattgtagtcaatgaagagctgtaggaggtagggaatatgcgcttcatgaggctggtaaaatttattcattatggctccgctttgcaaaagttcacatatcctaaattagaaaaaaaaagttttatcataaaattatgttccctaaaatgttaaatgaaacaatgattatagaaatatacagaacaaagcacttattagcacacaaaatttccatctcaattttaccggaaatttgtattttgttagaaattaaaagtttcaatcaagttttcaagtaagcaacatgttctgaataacaaaaaactgcatggatgaagaatattttgtcttaaaccaatttgatactaactatatttaaaaattaaaaggtttttaaaataaaatttttcttttaaaaataacaaataattttgaaaagattaatattcaaaaaaggaaaagaaatcattacttataatcccaccactcagaggtattgccattttgatatttttctttcctgagtattttttttcccttcatgatgacgaatacaaacaacagacaattatatacagcatagttaagtactatgtggggaaatacattaaacatctagaaaagatactaaacagatagaggtacagaggtggtttctgcaaaaccttagagaaactctctaagcaagagactaaatgatgaactagaggcacttttttctctgaagagagggaagagtattcacgtaaataaaactgcacatgtaaagggtcacgagaaaacacggcttattcaggaactgaaaccactgagtaagactgtgacctagtgtcagaggcagggatagagaagtaatgagaagtaagagcatgaagagcctgttaagacatttgaagaggtagtgaaatttgtctgagaggtgaatagcagaaaagtgacatcaccagactagctatagaacacagaagactacaggtaaggagtaaataggctgttgtggaaaaactaaggatggtggctataacaaggatcatagaaatgtactgattcaggagacatataaggggtgaaatgatcaggccttgatgactaactagatgtgaagggtgagacagaaaaggggctgagggtgatgcctagatttcttgcttaagcagctggttagtggtggtgcaattatttgaaaggggaagaactgtaagaaaaattggtttgggattttttggaaggggaataaggataaactcaatttagacacaagggcatttaggtatagtggggatccaataataatattggaaatgaatcataaagaaaataataatcattttattaacacagcagaggtaactaacatttctgagcactatatattggatactgtgctaacgtactttattacaagtaatgtttattacaagtctgtggtacgatcatctccattttataaataaagaaattatcttagatttaaaaatcacacaaaagatagaagagctctgaggtgggaggaccacctgagcccaggagttccaggttacagtgaggtatgatggcgccactgcatgccatcctgggcaacagagcaagatcctgtgtcttaaaaaaacaaaggggctaaaattcaaatcaaaatttctctgccttgtgagccctcactcttaaccactcggctattccatctatccagtagatggtttgatatattgtttagaagctctagagagaaatgaggctattcatatacatttggaagtcaaaagcataaagataaacaaaaacaaaagttaaaaccaaacaaacccatgggagtaaataagtctgtagagggaacagaaaatatacagagtaaagatgaaagtctaaggcagaattctaagaaacaaccatagatgttaaaatgtaaaccaacaaaatggcagaaatatgattgatcacactggaatgagaaaaactagaggtggtatatatcacagaagctaacatttaggattgttttaaggcaccataagcatcaccatgaggtcaaaaagtaaggacctaaaattggatttagcaacacagaggtcattagtgaaagcaattttcagtaaaatggttggggtagaagccatattgtagtaagttaaagagtgaatgggaaagccgagcacagtggcttgtgcttgtaatcccagcactttgggaggctgaggcaggtggatcacttgaggtcaggggttctagaccagcctggccaacatggagaaaccctgtccttactaaaaatacaaaaaaattagtcagacgtggtggtggtgcctgtaatcctaactactcaggaggctgaggcaggagaattgcatgaaccccggaggatgaggttacagtgagctgagatcgtgccattgacctccagcctgagcaacagggcaagattccaattcaaaacaaacaaacaatgaatgggaggtaagaagttggatacacaaagtatagataaatctttcaaggagaatggctaaatgagaaaggtgtttctatgagtatgaatgtgtgcgtataattagcaaagttttattaatattaaaatggaattggaaagaaagacgggaatagccgacagatggaagcgatccttgaaaacatcaaagaagatgaatcttgagcctcagaggtgaggaggaaaaatttctttcacggaataggcagcgaggagagaatggatgtaaatgcaatttaaggttaagaaagccttaagagagctttattccagtggttctcaaactttttggccccagaacccctttcattcttaaaatgttattgaggggctgggcacggtggctcacgcctgtaatcccagcactttgggagcctgaggtgggcggatcacctgaggtcaggagtttgagaccacctggccaagatggtgaaaccccatctctactaaaaatattaaaaaattagccaggcatggtggtgggcacctgtaatcccagctactcaggaggctgaggcaggagaattgcttgaacctgggaggcggaagttgcagtgagccgacatggtgccactgcaccccagcctgggcaacagtgagactccatcttaaaaacaaaacaaaacaaaacaaaacaaaacaaaacaaaacaaaacaaaaacaacattattgagaacactaaagagcttttgtttatgtggtttatatctactgatatttaccatattagaaattaaaacagaaatgcagtggtgcgatctcagctcactgcaacctccacctctggggttcaaacgattctcccaccttagcctccagaatagctaagacgataggtgcttgccacaagcccaactaatttttgtattttttggtagagatggggtttcatcatgctggccaggcttgtctcaaactcctgacctcacgtgatctacccacctcggcctcccaaagtgctggaattacaagtgtgagccaccgtgccccacctactaattttaaagtaacaataaactcctatgttaacataaataacattgttttaaactatatttttcaaaacaagaacaacttagtgagaaaagaaacattgttttacatgtttacaaatccttgtttttacagaagatagctggattattacatcagcttctgttcaatctgttgcagtatattgcttttgttgatgtatataaagaaaatctagcctcacacagatatggagttgaaaaagaaaataatttaatagcctttcatgttactttcattttgtcacataaatgttacaaagatatataaccaagggtcaaaattcaataaaataatttttaccatgtcctaatggatattctaatgtgaaaccggcttttttttttttttaaaggtgagtacttagtggtagaaaacacaatgattagtagttgatgtcattaccctgatttgagacaaggtgccagattaacccactatcaatgaaaacagtgcaaaaggaaaatcagtataatcttagtataataaagatcttagtattttagtataataaagagaattctgaccatacaaatcccctgaaagggtttcagaaatccccacttcacactttgaaaaccacctctctagaatgatgggttctgttttctctaagaaggtaaggcctgagtagaggatagagaatagtaaagagacaattaactagaaaaaagtagacatacagcacgcagggaagggtctgggtgaagttgaaaaccatgaatttacagtggcaccagtgtgtaatttttttttaaatttttttattctgcagtaatcagaaactgaggcttagtggagagaaaataaatggatgaattcagaactgacgttttcatttggcagaccaaagagtaccacaatttttgcttatatatttgggttacctgtgtattctctatctccccagcttgttgtaagttccctgagggcatgaaccatgcacactttgctcaccatgtctgcccatcaacttccacagagcatcaagtaatgtaggtactttgcaaatatttattaaacatgcataaacaggtctggtatggtggctcaggcctgtaatcccagcactttgggaggctaacgtgggaagatcactggagcccaggagtttggggttgcagtgagctatgactgcaccattgcgtactccagcctgggcaacaaagcaagactgtcttgaaaaaataataaatgaacaaataatgatgaataaatgaatgaatccattaataaatcaggaattttagaatggcattgtgataagctgactatataatttaaagcaaacttactgagaacagtttagtgtttgctatggttgcaaggaaaaaaattgattgtatttataatttgtttataggttatttataaaacacttaagcctcttttaatcatggctcccactccagcacaacttgtggacgagaaagggaaaaatgactgaggtttactctcttaccactctgtatgtgtgtgagagaataagagtccacagaaattgctcttttgtactccacgaatatgaggaagtatgagtagaggggaactggtacagaacagaagttattttgggtaagatcaagggcaggatgtaagaaaactagttttcagttacaagggaataaccattgggaatagagctgtgcttcagtgaagtactcaaatggtttaatccagggtaaacctcatgttctgggcagtcgtgccccctgtagtgctttaattcactatgggaaaacatccaatctgtgttttacaaaaaagttactttttggaacccagtacctactagcagagaggacctcctgaaaaaataatactcagtacacctccgaggccacttttaccctagcttcccactatacatagtgaaaatccttgttttgaatctgaaaggatgattaaaatcttccatatatgtgcccttccctgccctccaggatgattgagaggataagctagaggcagggagactaactgagggaagaaaaaacaaccaaaaccaaaaccaacaaaaaacctggaatataaaatttcaccaacatctagtaaacagtcaacaggtttctgagatctcaaaagccctctcactctggactcactcctacatatttccccttgctttgaagctaaagagcaactttctcttaatgctgaactaaggtctggccagaagaggcctaacatcacacaaggcagccgtaatctctcctaacctacttctacgaactctctaatctgtaacaggaaagaagcagttgggagcctccacctctaaaatatccttcatagagtccaagccactggtctctctctatacacgtacatgtgtattttacggtctctgtctttaataagactacaaactatagaggccttctttctagattttttttattattaaaatacttcaatgatagttattcatattttggtttcatttatctttgtaccttttcaccattgtaggattgtaaagatagatcttcataaagtgtctttccttctcatgataaccataaaaaggcctgaaatataagaaaaaaaatttcaaattattttcataattcagagatgaaataatgcaacttattgccctaattagattcagctggccaaattcagtcttacgtttaatattatccaccccccaaaaaacaactaaaaaatcccaaacctttcagttaaacctagcacaggttaacatgaaatactgaagcttttttaaaaagtgtaaaaaatatcactttctttaattactgacgatgggaattaaaaattatcactctgaaaaaactatggacaaaaaggaagaacaaaccatccaccccttaatctcaaacatcaagactctttaagtggctttttgttttctttactccacatataagaaaacatatttttgtttgctttactccacatatgagagaaacagacctttcagccgccttcttctggctcccatttttttgttaaaaactgaagttcttcttcaacaaagtcctttacttaacaacacttacattactttccttattcagctgtttattattattttataagttcaataagcagagacaatgtacctattatatgtacacacagcatgtatttcagtagctgatatgaataaacctgtaacacacaaccatatcaagtgcatcctgtgaaaaaactgtgtagacaggaacttaagagactgaaaaagaccatggacttacttaagcaacataatcatgttatggctgagttttttctcggggtatcagctggaatgaggaaagggggaagcaaaaggctatataacaggaagagaaatcctcggtgcaagatgaaataagctgaactctcacatcatttcaggaggatctgaaactacactacaacctctgatatacagaacactattttcaaggatgatgtaattagaaacaatacataaacaggcgtaaatttgtgaatgaaataaaaggctttgtattggctgaaaagtggtctgttaatacacggttaaatctttaggtggataaacccaatcactctttatttaaaaacattgttcccttatgacaggcagcagataatagaatttactctcataggacatcacctctctgtgatgtctaatagtgtagtggacatcaaataaaggactaatttggtagcagagacattattttgggtataattttttagttgttttaagccatctgtattattgttataaagtaatttctgttaaaaaaaaaaaaaaacaactatttaccaaggtctaaagggttcctcatctcatccttgcctctcactccaatctcaagtcataccattcttccttctcctccaaccactctaaacatttcagaccctctaactcgatccctcaagtggaaagctccgctctggacttttgcatggcttgtttaatcttcattcagaactctgcttaatttaccttctcagaaaagtctcacctgaccatccctccctcttactcttcacccttttcttaactttttataataccacttcccgtctagtttgctgctgtataccctattttgttgccatgaagaattggttaaagaaagacatattacataaatgatatcattctctctcattggcaaattcaaccttaactgtagccctttcctgctatggtatttttcatatatacaaaggtagttgtctggaaacatgggttatcttcagccagatgaatggttttgccaaaagaattcctcatcagggagactctttgggggaaaaaagtagaatggaggagtatgaaagcagatgttttcatgtttaaaaaattatatctcgtaattagttttttaagtatatcaataggaaggaaaatgagtgtggatagcgaaaaatctcacctaattaattttgatggattgagaatctctttatagaagattctctaaaatcatgagtgagaaggaatcccagaaattagcccaaggtcatgatcctatctcttaactcagcctcaggatagtgatagtctaaaaagaatagagttaaacctcatgtaaatgttaatttggtagctagatgcaactttatgtaacttaagtaggaaaaattgaaggagtaaaggaattagagaaggtagaatgaatgggaaggaaaaaggggatctagggaagaaaatgaccaaaaaattagaagaaaaaagaaaactgcaatgaaaaattagagtgagcagctcatctgttgccccatgtatccagatctgtaactcaactactctcaaaaatgtggcaatgtctttaacaaatacaaaaatacaggaagataagtgactatgtatttcactgggctgtttggagacttaactttgaaatgaggatatatataggaaagttattagaaactatcaagaataaacaaaactaaaagataaagtagataattatccctaacataattgctcctgttataggatgagtgtaaactttcacctcattcatttatccaaccaaacagttattgagtcatctcatacatgctagtgcactagcatgcagtttacatgctagtggaagaaacacataaaaattaagtaaataaataaaaattaaaatacctgcaaactgtattaagtgctaaagaaaacaaataatgggctgagatacagaataataaaaacagtaataataataatgccctacttaaaataccttattttacgtgggatagtcaaagaaaacttctctgaagaggtcaatgatctggaggattggggaagggtagaacactcaaggaaagaaaattgtacatacaaagaacttaggtgagaaacaacttggatagcagaggaactgagagaaagtcactgtttctgaatggaatacagaaagcagagtttcagaggtagatggggtgaggtcacataggttatggctagaagtttaaattgtattctattaacaatatgaagccactcaagaatttttaaatgattttaaatttacagtataagagtacttctgctgctctggaatgagataaaaatagaaggaaattcaattaaaatgatactatcatggtccagaggaaagcctagattaaggtggaagcagagatttaaggtctccacttggatttcatatggacataaaacaactcaaatgttcctgtatgagctccagatctttcctgtcagttgactctacctctaccttccgtcttcctagcagaacacccttaaacttttgcagtcaaccttgattcctctctcacaatccttacccaaacacaaagcaaagctaatacattaactcaaccttcagaatagatccagaagctgatgattacttccctgctaccaccctagttcaagccacactattttcttttttgttttaattttaattccttggtcttttctaccttaatatcaagccaccatattttcttacccagattaatgtcctaattctctccctgctcttattctcgtccccctacaatctattattaatacagttgcttaagtaatcctttccagtttaagccagatcttggctgctcaaaatcatgtaataacttacagtaaaagtcaaagtccttacattagcctactgagtgattaacaaacttaagcatgcataagaatcatcagaaaggctttattaaaacacaaattgctgggccccaagaatgtagttctaccaagttcccaggtgtgtcagtcccagtcctccaagaagtaaatgccaaatgtgagagaaaatgagaaggcagccagaagaagccggcatagccaccagacctagataccagtctcatctcaagtggacagagggatgttttacagatctgctttagtatctttgccatgctcagtcatagggtaagagtagcctatggaaagcagctcatgtggagtgacagactggaattgagtgtatagtagctggggccattcactcattctctgtgtatttggagatctgagaggtatattctcatggctgtaaaactaggtaaagctaatgatagtaggtgatactaggaaaccaaagtatggaaaccacactttgagaatcattggtcctcacagtctctaccctctcatctctctcttatctcatttagtccaactctcctttactcttccactctagtcacctggcttccatgctgttcctactcccttacctccttcaggtctttgctcagatgttgttactttgtcaatgacacattccctgattactctaaaattgtcactagtctacttccttaccccacactactattccttcttatcctgcttgtatagattctttccttccacacgactaattatcatatagcaaataaattaatttaatgttgtatttattggttattatctgtttcccgtagtagaatgtaacttccacatgggcagggctctttgttttgtccagcagtatatcccaaacgcctagaacagtgcttagcacataaaaagtatttaagaaatatttgctgaataaattactatatgaattactaatgaatttctatagttacaggaagcagagaaatgggaaaggaaacaacaaaaatcactgttgactctctacctttcattgccataaaaattcatgttaaaaagttacagcaaggaattcactacagttccattagactagaagtaaaagaaatagagtttatcaactgagtatgttttcctctaaatagaatagcaacataaacagaaattataaaatatattatcatatacttacattcctgatactaatgacactttgaacacatgctgagcagtggaagatggattgcctaaagccacattaagtgctctgtcgatactgaatgccatctgagaaagatagctttctggctgctgtccataaccatcgtatggcacatagaggtaaggaaagatgccatgtagatgaagacatgtcttctgacctaaaatgtaacacattataaagtttagtttccagacacagtttaacaatacaaaactcagaatgaaactcatttaaatgttctaatggcaacacagcttatctaagggaagagttgaaaaaaattaacccatagttcaaagtaaccagtattaactacattttacaacagaacatttggaaacattgtgtaaacacaagcattgtataacagtatgacttaaacagtagttttgatgaaagtattttcactatttaaccctcataatccaactagtcttgtgtacttcactgaatcatctataaataccagtgttatgaaggttataagcacagtgttatgaaggttacaaaaattcacaaaaagtttactaaataaatcaatgaatgcctgtcttggcattaatgttttcaaacaagagccttccctaaaagagaggcagctctgggagaaaggggaatgtaaaagcagttccagtgtgcagaattttgctattgcagtgggaaggagggtaaaaatgaaattttgccattaaaaggaaaaaaaaaaagacaaaaccaaatcaaaacaaaatctctacagatcaattatctataatggatttcagggtatctaaattttatatttggtggtatggaacaaggggagacaaaaggccaacatgcacacttctcagaaaaccaatatatcagtcaaggtgcagaaggggtaaatggtgctgacttgccaacagacaatccagcacagccatgataaagaaagtaatttgagtgagaacccacaaaagaaatgccacagaaacgataatctgtccatgacaagattaagtaacaacaatggcaacaaaaagcagatgcaccattgctctcatgaatctggcagggctgtatggaagtggttactgtcctcagagcattgtccctagttccccttgggtatgtgccatttgtctaatccaaacagagaggagaacagcagtgatggaagaacacatccatttttctcatgctgtcacccgctctcactgtgctgttcctgccaacacaagcctcaggcttcttccccaccccttatccctcctcactctgcttcactgggccttttcttttggtaggaatgtaaatatttgtttgatcactatttcccatttatgatttagaatgatttatataaaatatatagaaagtagttctacactgtgttgatatcttaatgtttacatttcttataaagaataacattagcttctcttatttttaaggtacacttacgacagaaaaataaatctggaacagttattacataaagcagagcaaatttagaaagatcagtcacataatgaaacaagatctgattctccgaactgtaatattctgatttgaactaccaactgtcgtgcttttgaaaaattacaaattgtgttgctgttatacaaatttcagtttccagtttggctatttcatttctaaatacaacatggtattaattcctaaatttcatagtttttcaattcttcaaatagagaacattcaaactatattaatgagtcttaatagatttaatcaatttactgatgacttacttgaatgctttttaaatatctcatgaataaatgttataaccattacccttctggacaaaaaccacaatttgactaagagtaactggtatgctaaactacaggttgagggaggtgggaagacagtgaattatttcctcttaagttgacaaatgcaagaccagtgattacagaattactagtgcaatgccatattttacaagcaatactgtaaattcctaaggtatttgttttatagtcaatatatctcaataatggaattttgggtaaattttacaagaaacaattacaaaattggactgtattaatagtttctttatggtcagagtgttcacaaagtgtcttaaaaataattttatatccacttttcacatctcctgtgaagtagggaccagaagaattacctttctatttataggcttcagaactacaacaattttgggatgtacaatttaggaaaaaggaagaaatgatttactcagcaggtaatagggtaagtgctttacctatgtatttctaattaggataatcttgcagtattgatggaggttaacgttcccaaagtcacataactattaagcaatagaatccagctcaacaaaacctaaaaccaatactctttccatttaaccatgctggttcaatgtttttaaaaagtcaatgttggcttccttaattcctcagtttttattttttattataattgcctgtttccttatctaactttcccatttcatggcaaaaactcttagggaggtgttattgtgttcaaatgaacactatgtccccagaactcaacaaaaaacacatggtatgtgcttaacaaacatttattaaatgaattaaagaacccacaacaaaacagaataactgcttaaggacaaaggaatgatgtgaaagcctttgaatatctgaagaaacacatccacgaaaaaagagggactctgatacaattaatgtaactaccatcagggttagaggaggacatgggtgtgtggggttgagaaggatccccaacatattgcactttcctaccctgaatgacctgaagtgccatccaaatctgtagtcactctatcaacacagacgtacctctctctccagtgctcctgcagctagagatggctcagtgccttactcatcacccttcctcaagaacaacctcctgaagaacaaccacaacacaaggaattcttggcatagcactaacagctctaatatagaataagaatgatataagagaaaatgaaagaaacaggataaaataaaaaactcaaaagttaaataaggaaagagaaatgtgtaaaaatgaacacgagagtcaactgctttttggaaatagtatgtcttttattaccataaaatttgtagttctgtaatttgctttatcttgacaagatacagaccacttctatttatttccctccgctagctctacctcacacaaatgtgtggagatacagagctgtaaagtctttagagataaaccagtctactacaactcccgttagttaggattaggttaaattgtgagaaaatgcccccaaatcagtggatttagcattaaaattagtggcttctctcctaaaagaagtccagaggtaggtagctggtactagaaacccagcttttttcaacatctagttagtggtctaattaagaacttgtgacttcagtccaggcgcttttccactatacttctagaagttccacatacaggatgctttcaagaatgtttttataaaattagtgaaagttatggtattttgaaaccttctactaaatgattttggattctcttttttttttttgagatggagtctcgctctgtcacccaggctggagtgcagtgttgcgatctcggcttgctgcaagctccacctcccgggctcacgccgttctcctgcctcagcctccggagtagctgggactacaggtgcctgccaccatgcccggctaattttttgtattttttagtagagacggggtttcaccgtgttaatcaggatggtctcgatctcctgacctcatgatccacctgcctcggccttccaaagtgctgggattacaggcgtgagccaccgcgcccggccattttggattcttaaaggagtcagggtattaggtatttctaggtaacatatagatttaaggaaagaaaatatccctaccccttcaactctattaacgtaaactgatacataaaaattgtacatatatatggtatacaacatgaaactttgatatgtatacaccatgaaatgattaagtcgagctaacatatccatcacttcacatacttattattttgtggtaagagcatttaaaatctaatctcttagcgattttcaagtatataatacattatcaactacagtcaccatgcagtacaactgatgtccagaacttattcatcatgtctagttgaaacttcatactctttaaacaacaactccccttcccctcctctgaaggttccctcttactatcatggcaaactgaagttagacaacaagtccaagagaaataagatcgtctgtggctgaacaagcccatgtacacaggtttcaaaaatttcagagtttgaattttccaatttgattgatgttccctaattcagaagctgcaaaagttattttaaaaagcgccaccaaaacttgacaccatggcaaaactctgtggagctggctacttcccattgtgtgtaagtacataacaaaaggcagatgcctcttcaacaaggagtatgtgggtgctctgaatttcatctttcacggaacccagaattatactaaacattaagtccttggctgggcatggtggctcacgcctgtaatcccagcactttgggggctgaggcaggtagatcacgaggtcaggagatcaagaccatcctggccaacatggtgaaacccctctccactaaaaacacaaaaaaattagccaggtgcctgtagtcccagacactcgggaggctgaggcaggagaatggcgtgaacccgggaggcggaggttgcagtgagccaagatcgcgccaatgcactccagcctgggagacagagcgagactccatctcaaaaaaaacaaaaacaaaacaaaacattaagtcctttatatcccaacatttcttattgtcatttttcaacattttattctgcaatttaggtgtcttgatttggtctctaaattgcccatctaaaatcttgttagcctatttgtagtaaaattacttggggtatttttgtagattcagtttcgataaacacaaagactaaatgtaccattcctctaatttgggggtctgaaaactttttctggaaggtgacagtaaatattttaggctttatgggacatgctgtatctgacacaattacataactctgctgttgtagcctggaagcagctgtatgcaatacttaagtgaacgggcatgaccgtgttacaataaaacttcatttacaaaaacacgcaacatgagggatttggcccatggatagtagtttgccaatctctgctctaattaattagacttctttctccatcatcatctggaatagaaaagtttttttttttttaaagctgatgggtaatcaaaatcaaaatagtgatagcctaagagtatcttaggagaataagaaatactcattgtgtaatttgcatatcccatctcccaaatctcaaattcaatctaaacaaggttttaaacaaacctcgacagagctataaaacagaaaaacttggtatgtgagcaagaacatttacgtttacaaaaattttcatattttcttcttcctggaacatctcaagttttatatcactatcattaactccatctgtttccttccagtctttctttgcttctgtctttctaaattttactccatctttcttttcccatctccacaaaaccacaaaacgaactaaacaaaactcagtcacagaaagtgttaaattatctattctcatggaaaaagaaaagttgtaaggatgtactcttagccttggaaattagattttcagaatttatcttacagaaaaacttaaaaatgtacacgaagattcagatactaagatgtgaggtatgactaacaatagtgaaaaaaatgaagataatctaaatttccaaaaatagggaaataagtaaaattatgttatatctgtataatagctctgtggctctgtagcaaatcctgcttcctgcctgattttctaaataaagttttataagaatacaccacagccatttagaatggtctatggctgcttatgctatagacagagttgagcagttgcaatagacaccctacaaccctcaaaacctaaaatatgtgctttcttgttctttatagaaaaagtttgctaacctcagcaacagaagatgtttaagtgtatttcctagtataagaaaatgtttatgatgtctttatagtcagatgaaaatcagttataaaataacatagtacatgagaccaggtgatgagtgattcttttatatatatatgggtgattcttttatatatatatacacatatatatatatatacacatatatatatatatacacatatatatatatatacacatatatatatatatacatatatatatatacatatatatatatatacgtatatatatatatatatatatttccccccactaaatatacaacttgtgtaaacaaaagggaggaagaaagaatttacctacttttaaataacccagaaacttaaaaggcaaaacaaagcataatatataacagtttcctttcattttctccttttatttgtaaataatactttggagtttcaaatttatttatgccattttatttcttcaaataaaatatacagaactttatctagaatcattggctttaaatgattaatcccaaattactaagagaaactatatcgctgaaataccagatgtttcaaaagtctattttattcatacatttgtctaatgtgtctttgtatatacagtgcagggtatagttggttcctttattcataaatgtagtcataatttctctactcaagtaatttgtggagacccaatgtttggtgctaaaccataggctgcttataacacagccactaacttcatgactataaagccactaactttatagtctacttggagaaaatgatgaataaataggcaattacagtatggtatgacaggtgctcagaagcacaaaatcctatggctatatccacaagtatctaactcagacttgtgagaatctaggaaggcttaccagaggaagtgacatttgagctgatatctgaactatgaatcagatttagccaagcaaatgaggaagaatgttttcagtatgtacagaaacctgacagcaacagaaacatggcatctgggaacaggaaaagtgtaggtgggatgaaacaaggagtgcagtggagagaaaagaaaaagagtatgagaaggagagaaagaaaaagagtatgagagagagaaaaacagtgtgtgtgtgtgtgagagaaagtctgtgtttttgtgtgtgtgcgcacatgcatgtactaatgacctgtacagattcgcattttataaagttccctgtggacacattgtggggacactagcaacagaactacagaaaggaaaatctgtttaggaggctgctggaggaattcagtcgagatgtcagtagaggtggagaaaaggtcaaggatttagggagtagaatcaagaggctatggtaactggaatttgagagtaggataaggcagaaggaatcaaagatgactcttatttttggcttaggcaactggacggatgataatgtcactcaaagaaaactgtaaaagaggggcgggttgacttctgttttgcatttatacaattttacatgtctatagaatttctaaatggatatttaaatgaaacacatacagatatggagcttaagaaagagatctgagctagagaagaagacagatttgccagtatgagcaacaattgggtaagatttctcagggaaaatatccaatacccaatacaagagaagggacctaggcaagaatcctgagccgatatttaagagaggcactaaatattttgatttatgtgaaatgtgacagacagagccctgagagggctaccaggcaagaaagggaagctaatagtgaaaatttgataatataaacatattagccatggaaccagtgttccaaggatccagtggaaatataagagataggcaagtaacgagaggctggatcagagattggtggcaggatgtagataaaagtatataggactgaaaagaggcatttacaaaattgctgagtaaggacctttcaatatctgttcctccataaaagcaacaagaacactggcaaaaactgtcaaaagcaactttttcagaactctggaaattaaaggtttgcaacaattcaaggcgtatttattcaagaacaccagatgaatgctaaaacagcaagctttgtggcattttaacttgttctaatctgatctctccctctgcagcttcaaaacagtcttgaaaatcaaagccttgcatccatagcagctgtaaaaaccagcagccaggcagccactggaggagccggaacccatttggagctcctccaaagccctaccctcagaaaactgccactattggacttgtctggcagcttgctgaacaacactccattcccagcacttgcctttatttgatttgaagaagggctcacactatgtgaagagccctatatgcggcagggtctttgtggaaaacaatcaacagcaattatttaattgctgtagctgcctggagaaattttaccagttgggtctaacaagaggctgaccaaaaaattcaaaagtacaaacaggaatgaaatgtccaccgggggcttggaaaagctttgatacagttaagggaatttagaaggccataagcatgtgtagggctatgtacatgcccaggaaagatctaagaagactaatattttgcctctggttgatcttgaggctctgccccaacatactcacagagcccctcagcaaaagctgagaaaagaggcatttaaagaaatctctggtcaaccattaactgaccactatgctagctgagcagagatttcaaatagagactgccgggcgcggtggctcatgcctgtaatcccagcgttttgggaggccgaggcgggcagattacgaggtcaggagatcaagaccatcctggcgaacatggaaaccccgtctctactaaaaatacaaaaaaaaattagccgggtgtggtggcgggcacctgtagtcccagctcctcgggaggctgaggcagaagaatggcacgaacccggcaggcggagcttgcagtgagcggagattgcgccactgcactccagcctgggcgacagagtgggactccatctcaaaaaagaaaaaagaatagagactatacaaaataagcccatgaaaatcactgaagaaataaactgcagcaacaacaaaaataaactgggtgggtagagaggaatctaacttgagaactgctacataatttaaaatgtctggttttcaacaaaaataaaattataaaacacacaaacaggcaaatatggcaccatatatatatatatatgcacacatatatataaaagcagacaacagaaactgttcatgaagaagccaaggtgttggacttactggacaaagattttaagccagctatttcaaaaaactaaaagaaacatgtcaagagagttaaaggagagtatgagaccaacatcttaccaaatagagaatatcaatgaagagagagaaattataaaaaaagaaccaaatagaaattccagaattgaaaagttcaataactaaaatgaaaaatttacaagagggggtatgatactatgatataagaagaaatatatatttggtctttgtccctcttcctggtacacagctcctaaaacgtttggattcttttaagtgttaagtgtttacatgtgtaccaatgagatgactggtagctgggggctcctggatagcctcaggtagggcagaagtgcagggagcctagggactccatttgtggctggtgtctgaagtgagcagtactatcggacagaacccttaccctgtagggtatacattagtagtagttagtgtcagaattgaattcaattgtagaacacccacagttgatgtcagaaaaccgagaatttgttactgtaaaactgatgcacaggatgtctttttcaaattgggtggcctctaagaaggctttcaactgagtctagctgaaaatttgatggatttaaatcttactttctccttataaactattttctttctccttataaacaatgaagatatgtataatgtcctcacatctcccctttatggaacggaactagaagggaatcaattaacccatttatgccagaggttgcaattttttgtgtgtgaaaaatcagactttggtgatgaccctgagcagtaggatataaataactcccacaagcttagcagcccaataatggaacactaggcataaatgggttaagggccaacttccaaactgaacaacagtagtttgatgattaatatgattcttttatgattaatatgtcagaaatctgatgaaatgttgtatccaaagttcataagcaatttaatctgcaattattgttatagaaagtaaatcaacaattcccttgattttcaataactatgaaactatatgggtactgctcaaaggcacacgccatggtacaactatttctaaaaagctcagtcttaaaaaacaaagcttctaacagtagtttcaagcacaaatctccaagaaaatgtgcacctttcagactaaacgtcataaaaataattagtgttattaaccttagtgaaaaataaaattctggcttgtaaaacaaacactttttagtttcagataatttagccagaatggtcacacacattaatttttgtggtattttaattgaaaggtaaataaaccaaagtctcaaaaaaaaattctgattatgacatgaaaattcatctcaatttaaagcaatatcaaaagttaatcaaaacaaacttactgtctggtcaaatttgtacataaatacctaaatgctccttcaaatgcaaataaataaaatattattggtaattaacattatatgcaagtctagtaaattattcaaccatattttatggtagctgaatactaaaggaccttaagcttttacctgtctaaaagaaagttgaaaagacaatgcacagaatgaaaaaaaagttgtgaatcatatatttcataagggacttgtatctagaacaaacaactctttcaactcaataataaaaagacaataaaattttaaaatggacagagacttctggttgtaaaacggtggtacagaagtaacctggcttcactcactgccacaggaaaccaaaaccacaaatacagtgctgacacgatcatgagcaatatcccgaactcaaatatgaggagacagttcccaaggccacaaagaagtgaaaaaactctgagcaaaagaaagcaaattagactttcataatcacagtgcccctcccctcaatctgtccagcaccaagcatgcagaaaactttcccaactcagagttgctacactggaaaaagtataactgaggtggacaactggcttctccaccatcttgggtttgttggcaagagacctatccctgtcctaataactgggagcagtggaaatacctaagggagaaataatccctgaaaaccaccagaaataaagagaagaggtcggaggtgggactaccatccctagtcctggaaactctgctatgtaactcagccaaaagagatgccaagttggagtggctgttcagcagcaccacactgttaagaggttcatttcacaggttcattggacatgaacctctacccagaggttaggtgctgaaaaggaggcagcaacctagcagatttaagaaaaaaaaaaaaagaaagaaaattaacaggtaaacttcaaagaatctctaagcaagcatattcgataaaaaccaaaacaagccagatagagaagactagaataaataactaatccttgaatgcaaagacacagatgtatatccacaacaaacaacagaaaacagggaaccatgacctcaaacagacaaagcaaggaaccagtgactgaccctaagaagacagtgacatgagctttctgatcaagaattcaaaataccaggtataaggaaattcagtaacttttacaaggcaaagcagaaaagtaattaagaaatttattagagaaatttagcaaggagatcaaaataatacaaaaaaaaccaaacagaaatcgaaattgagaaatacatttggtgaacagaaaaattcattagatactctcaatagcacaatggaaactaaataacctacaagacaacacagaaaagtaatacagaaatttattagagaaatttaacaagaagagtgaaataatacaaagaaaacaaacagaaatcaaaactgagaaatacatttggtgaactgaaaaattcattaaagtctctcaatagcaggatatatgaaacaaaaaaaagtcagtgagctcaaagacaggctatttgaaaatacatgaggagaaaaaagaaaaaaaccaatggaaaggaatgaaggctgcctttaagatacagaaaattacctctaaagacaaaatctaagaaatttattggtatttaagagtgagggctcttgttaagcaagggaaaggggcaaaaagcttatttcaagaaataacagaaaaaaatcccaaaaacttgagaaaaagataaatatccaggtacaggaataaaggtaagacaacaccaaatagatttgatgcaaataagactactcccaagttatataataatgaaacactcaaaggtcaaggacaaagaaagcagcaagagaaaagaagtaaatgatgtatacaagtgctccaacttgtctggcaacagacatcttaagagaaactataaaggccaggaaagagtggaatgccatcttcaacgtgctttaaaaaaatgccatctaagaataaagtattgagcaatgctatccttcaaatataaaaaagagggtttttggtttgtctttttattttttaaatcttcttttgtagtgatgggaatcatgctatgttgaccatgctggttttgaactcctggactcaagcaatcctcccatctctgcctcccaaagtgctaggattataggtgtgagccattgtgcccagtcaaatacatagtctttcccagacaaacttaagctaagagaattcaccaccaccagaaccaccttacaaaaaaatgcacatgggagttcttccaccagacagaaaaaaacactaacttacaaaaagaaagcttgtaaaggtataaaacccactggtaaaattaagtacacaaacaaaccagaatactctattactgcaatttgtagtgtacaatccatttgtaactctgtttggtatgaagtccaaaagacaaatctaccaaaaacagtaatacttatagcaacccattaagagataggcaatataaaaacataaaaattaacacaacatagtgtcaaaatgtggggggcggggtggggtggagttataggaaagagggttttttagcttctcgagaggggcctcgcgggccccgctcccgccctcggctcgcctggcccagaccggaagcagcgccgcactgcctgggcctggcgcggggggtgagcacaggggcccggtcggacatggacaagaagcacaagcacaagaagctcaagtcggacaaacacctctaccaggagtatgtagagaagcccttgaagctggtcctcaaagcaggagggaatgaagtcaccgaactctccgtgggcagctcggggcacaactccagcctcttcgaagacaaaaaacaatcatgacaaacaaaaggacagaaagtggaaaaagagaaagaaaggagacaagcaggttccaggggaagaaaaggggagaaaacagataagagttaaggaggataaaaagaagcgagattgagacggggtggagaatgaggcagaaaaagacctccagtgtcacgcccctgtgggattagacttgcccggtgagaagcctctcacaagcactttagccaaacaagaagaagtagaacagataccccaccccttcaagaagctttgaatcaactggcgagacaattgcagagaaaagatccaagtgctttctttcatttcctgtgactgattttactgctcctggctactccatgatcattaaacacccaatggattttaaatgaaagaaaagatcaagaacaatgactaccagtccatagaaaaactaaaggatattttcaaactaatgtgtactaatgccatgatttacaataaaccagagaccatttattataaagctgcaaagaagcggttgcactcggggatgaaaattcttagacatgaaagaattcagagcctgaagcagagcatagacttcatggctgacttgcagaaaactcaaaagcaggaagacagaacagacacctcgcagagtggggaggacagaggctgctggccgagaagagagaggactctggagatgccaaagcacacgccttcaagagtcccagcaaagaaaataaaaagaaagacaaagacatgcttgaagataagtttaaaagcaataatttagagagagcgcaggagcagcttgaccgcatcgtgaaggaatctggaggaaagctgaccaggcggcttgtgaacagtcagtgcaaattggaaagaagaaaaccagacggaacaacaatgttgggacttctccatcctgtggatctcattgtaggagagccaggctactgccctgtgagactgggaatgacaactggaagacttcagtctggtgtgaatactttgcaggggttcaaagaggacaaaagaacaaagtcactccagtgttatatttgaattatgggccctacagttcttatgcaccgcattatgactccacatatgcaaatatcaacaagaatgattctgatttaatctattcaacctatggggaagacacagatcttccaagcgatctcagcagccatgagtttttggccacgtgccaagattatccatctgtgatggcagatagtttactggatgttttaacaaaaggagggcattccaggaccctacaagagatttagatgtcactgcctgaagatggaaggccatactaggacacctgacacagcaaaagaaatggagattacagaagtagagccaccaggatgtctggactccaatacttcaagacaggctcatagcgctgaaagcagtaacaaactttggcgttccggttaaagtttttgattctgaggaagctgaaatattccagaagaaacttgatgagaccaccagattgctcagggagctagctccaggaagcccagaatgaatgtttcaacaccagaccccctcccaacatgatctgtctcttgggtccctcatacagagaaatgcatctcactgaacaagtgaccaataatcttaaagaacttgcacagcaagtaactacaggtgatatcataagcacatacggagtttgaaaagcaatggggatttccattccttcccccgtcatggaaaacaactctgtggatttgacagaagatactgaagaacctaaaaagacgaatgttgctgaatgtggacctggtggaagttgaggccacctgtatttgattatatattatgtacatactttttcattcttaacttagaaacgctttttagaatatgttaaatatttgtaaattgtgtttttaattaaactttgcaacagtgaatttgaatgttccagaggttggacttgtattaggtaataaagcgggacctgaggaaaaaaaaagagggtttttaaaaaaaatttctattctttgttttgtaattaagatgtttttgtagtctcatggttaccacaatgcaaaaacctataacagattcactataactaaaaagcaatgaattaaaacatactaccagagaaaatctcttaatcacaaaggaagacagtaagaaaaagaaaaaaggaaggagttctaaaacaacagaaaacaagcaatgaaatgacagtagtaagtttacttggcaacagtaacactgaatgcaaatggactcaattctctaatcacaaggcagaatgaattctgtctaaacagataaagaagcaagagttaaactatatgctgcctataagaaacttacttcgcctataaagccacacacagactgaaagtgaaaggctgaaaaaagatattccatgcaactggaaacaaaagcaggagtagctatatttgtatcagataaaacagactatcaagactgtaaaaagaaacaaagagggtcactatgtattgataaaagggtcaattcagcaagaggatataacaattataaatatctatgcatgcaacaccagagcatctgagtgcataaagcaaataatacatttaaaaggagagacagactgcaatacagtaatagtaggggacttcaacaccccattttcagtaatggacagaacatccagacagaaaatcaagaaagaacactggagttaagctacacagtacacaaacaggcctaatcaacatttatggaacattttacccatggctgcagaaaacacattcttttcatcagcatatggaacattctccgaaacaaatcatatctgagacaaaaaacaagtctcaccaaatttaagtaagtagaaatcataccaagtatcttctctggccacaatggaataaaactagaaattaataacaaaaggaagcttaaaaatacacaaacacatgaaaattaaacaacattctcctgaatgaccaatgggtcaataaagaaattaagaaggaaatttaaaaatttcttgaaaccaaaggaaatgaaaacacaacatacccaaacctatgggatacagcaaaagtggtactaagaaggaagtttataacaataaacacctatgtcaaaaagtagaaagacttcaaatagacaacctaatggtatacctgaaggaactagaaaaagaacaaaacaaacccaaaattagtggaaggaaataaatagtagcgatcaaatcagaaataaatgaaattgagactaaaaaccaatacagaagatcaacaaaatgaaaggttgttttttttaaaaagacaaacaaaattaactaacaaacctttagctaggctggaaaaaagagagaagatccaaacaaataaaaccagaaacaaaagaggagataaaacaactgagaccacagaaatacaaagagactattatgaagaggctaatatatgagagactgttatgaagaactatacaccaacaaattggaaaacctagaagaaatggataatttcctggacacagcctaccaaggttgaatcaaggagaaagagaaaccttaatacaccaataatgagtaaggagactgaagccataacagtctcccatcaaagaagagcccaggacctaatggcttcattcctaaattccatcaaacatataaagaactaataccaattctactcaaactcttcaaacaaaattgaagcagaaggaatactttcaaactcattctatgagaccagcattaccctgataccaaaaccagacaaggacacaaccaaaaaaagaagactacaggccaacatccctgatgaacacagatgcaaaaatcctcaacaaaattctagcaaaccaaattcaacatcacattagaaagatcattcaccacgatcaagtggaattcatcccagggatgcagattgttcaacataagcaaatcagtgaacatgatacatcaaattaacataatcatgaacaaaaaagcctattattgtttcaacagatgctggaaaagcattaaataaaattcaacatcacttcatgataaaaaccctcaacaaaggaacatccctcaaaataataaagaatatatattacaaacccacacctaacactgtactcaatgtggaaatattaaaagcctttcctctaagatctggagcaagaccaggatgcccactttcaccacttttattcaatgtaatactggaagtcctgtccagagcaatgaggcaagagagagaaataaagagtatccaaattggaaaggaagaagtcaaattagccttgcttgcagatgacatggtcttatactcagaaaagcctgaggaactcaaccaaaaaaactgttaaaaatgattaatggtccgggcgtggtggctcatgcctgtaatcccagcactttgggaggccgaagtgggcgcatcaccaggtcaggagatcgagaccatcctggctaacatggtgaaaccacgtctctaataaaaatacaaaaaaaaaaattagctgggcatgctggcgggcgcctgtagtcccagctactcaggaggctgaggcaggagaatggcgtgaacccgggaagcggagcttgcagtgagccaagattgtgccactgcactctagcctgggcgacagggcgagactccgtctcaaaaaaaaaaaaaaaaatcaatgaatccagtaaagttgtaggatacaaaatcaacatacaaaaatcagtagcatttatatacaccaacagcaaacaatctgaaaaaaaaatcaagaaagcaaccccacttacaataactacaaagaatagaaaatatctaagaatcaatccaaccaaagaagtaaaatatctctactagaaaaagtataaaacactgatgaaagaaattaaagaggacacagaaaaatgaaaagatactccatgctcatggattagaagaaccaatattgttaaagtaacaattctggctaatgtggtaactcacgcctgtatcccagcactttgggaggccgagactgaaggactgcctgagcccaggagttcaaggtaagcctgggcaacatggtgaaaccctgtctctacaaaaaatacaaaaattagctggacgtggtagcacacgcctatagtcccagctactggggaggctgaaaggtgggaggattgcctgagaccagaagtcaaggctgcagtgaactgtatgtaattgcaccactgtactccagcctgtaagacacagcaagatcctgtctcaaaacaaaacaacaaaacaattctacccaaagcaatttacaaagtcaatggaatccctatcaacgtataaatgacgttcttcacagaaatagaaaaaacaatcctaaaatatgtatggaaccataaaagaccctgaatagccaaatcaatcttgagcaaaaagaaagctggaggcatcacactacctgacttcagaatatactacaaagctatagaaaccaaatcagcatgctattggcataaaaacagacatacagaccaatgaaacagaacagagaacctacatataaatccagacattaacagctaactcattttcaacaaaggcatcaaaaacatacaatggggaaaaaaacagtctcttcaacaaatggtgctgggaaaactgaataaccacatgcagaacaatgaaactaaaaacagaacctccttatctctcaccatatacaaaagtcaaaatggattgaagacttaaatctaacacctgaaactatgaaactactagaagaaaacattggggaaatgctccaggacattggtctgtgcaaagatttttttgggtaagacctcaaaagcacaggcaaccaagccaaaaatagacaaaaggattacatcaagcttctgttgagcaaaggaaacaatcaatgaagtgataaagacaattcataaaatggaaaaaatattcacacgctactcatctaacatgggattaacaaccaaaatatataaggagctcaaacaactcaataacaacaaaacaaataatctgatttttaaataggcaaaaggtctgaatagatatttctcaaaagaagacataaaaatggccagacacatgaaaagatgctcaacatcactaaccatcagagaaatacaaatcaaaatcataatgcgatatcatctcaccccagttagaatggcttttatcaaaaagacaatgaataatggatgctggtgaggatgcggataaaggagaatcctcgtacaccactgctgggaatgtaaattagtacagttactatggaaaactgtgtggaggttcctcaatccaacaattccacttttgaatataaacccaaaagaaaatcaatatactgaagatatctctgtactcccatgtttattgaagcactatattcacaataacaaaaattattagaatcaatgtaagtgcccatcagtggatgaatggataaagaaaatatggtatatatacacaatggaatgttattcagccatataaaaaaaatgaaatcctgtcatttgcagcaacgtaagtgaaactggaagtcattatatgttaagtgaaaaaagccaagtacagaaagacattattacatgttctcattcatatgtgggagctaaaaaagtggatctcatgaagatatagagtagactggtagttaccagaagctgagaagggtgggggtgcagggatgaagagaggttgattaaggggtacaaatatagagtttgatagaagaaacaagacctagtgtttggtagatcagcagggtgactatagtttacaataatatgttgtatatttcaaaatagctagaagagaataaatcaaatatttctagcataaagacaaatatttaagatgagatgaatatcccaattacactgatttgatctttacaaattatgtaaatgtagtaaattatcacatgtaccccaaacatatgtacatctactatgtctcaataaaaaatactaaatattataaatgggcaaaggatgtgaataaacattttcctgaggagatatcaaatggcaaataagcacattaaaagattctcaacatcagcagccatcagcaaaatgcaaatcggaaccacacgctcactaggacagctataattaaaaagtcagacaataactagtgttgtggagaaactggaaatttcatacactacttctaggaatgttaaatggtgcaggtgctttatagaatagtctggtagttcttcaaaaagttaaaaaaatagagttatcatatgaccagcaattctactcctaggtatatgtctaagagaaatgaaaatacatgtccacacaaatacctgtacatgaatattcatagcagcattattcataatggtcaaaaggtgaacacaactcagaagtccatcaattgatgaatggataaatacaatacagcatatccagaaaatagaatattattcagccataaaaaggaatgaagtgctgataaatgctatactatatataaaattaaaatatttcaattaaaaattgtatactaaaactttttaatttttagcatttttagtatacaatttttaattaaaatattttaattttatattatatagagaaaaattttaaatattatgctaagggagccagacacaaaaaatcacatattatatgactccatttatgtgaaatgtccaaaataggcaaatttatagagaaagaaaggagattaatggttgctggggcttagggaattggtgggaaatgagtactgactgctatttgagacggtgtttctttttagggtgacagtgttctaaaattgattgcgcttatggttgcacaactctgtgaacaaagatcactgaattgtataaataggtaaaatgtatagtatgtgaactacatctcaataaacttacataattttttttttgagacagggtcttcctctgtcactcaggctggagcacagtggcaggatcacagttcactgcaggtctgaccacctggctctagtgatcttcctgcttcagcctctcgagtagctggaactacaggtatgtgacacctgcctaatttttttttttttatttttattttttatagagacagggtctcgctaagtgcttagactggtctcaaactcctgggctcaagtgatcctcttgcctcagcctcctgagtagctgccttgcctcaaagtgctgggattacaggcatcagccacctcacctggcctattatacaatcttttaaacttatctatactcattgttttctttagcagttgctaatgagatgacctaattttgaatataccattagagaaaatgcattcattaaattattcaatttatatcataggaataaattatgaatatacagaaatataatcatttgccactacaaccacttacatatctttatttttatttaatgatgcactaaatatagtatttttattttaattatttttttagagacagaatcttgctatgttgcccaggctgggactataagtgtgcaccagtgtacctggctttaaaccctgaatcatattaagattaaaaaaaaaaaaaaagaggtaaagtgatcattaccaaaaaataaactaacaagaaagaactgttaatgttaagaaagttttctcagacaataaaactaaatgacaaaaaaacaatttaatatttgaacaggctcctcacatccctcaaaatcccatatcccaacccgatatcctataactttcatacatgaattaaagaaaggttttcttaggactatgtttaattatttagagtcctgggttgatatggcaagtgagttctactaagcatacagttgatctcacggggtcctgaataaggcaaaatgataaatcataaaaatccaaagtccaaagctttgggcaaaaacacattaactaaacttgtcaaaaacagtgcaaaccagaagtcagtggagcaacatctttaatgtattaaaagacaaaaaaaacagtcaattttttagtggttaccctggagtttgaagtatacatttgcaactattctaaatccactttcaaataatactatactgcctcaaaggtaacttatattaggttggtgcaaaagtaactgtggtttttgcattgttggaatttgctgtttgattgtaatacattcttaaataaatgtgattatgttatacatccttttaacaggcatttctcactttatgtttttttgctaatgacttattacttgctgttcattttatgtttagagtatggaaatgacgtcagacaaaaagcaaatttgagcgattttcttatttgagttcaaaatgggttgtaaaatagcagagacaactcacaacatcaacaatgcatttggcccaggaactgctaacaaatgtacagtgcggtggtggttcaagaagttgtgcaagggggacaagaggcttgaagataaggaacttggtggctggccatcagaagtagacaacaaccaattgagagcaatcatcaaagctgatcctcttaaaactacacgaaaagttgccaaagaactcaacatagagcattctacagtcattcaacatttgaagcacattggaaaagtgaaaaagctacataagtgggtgcctcatgagctgcatgaaaacaaaagaaatcgttttgaagtatggtcttctcttattctacccaataacaacgaaacatttcttgactggatggtaacatgacagaaaatggattttatgtgatgaccagctcagtggctggaccaagaaaaggtcatggtcacagtttggtggtctgctgcccgtttgacccactacagctttctgaatccaggcaaaaaccaatacatctgaaaagtatgctcggcaaatcaatgagatgcaccgaaaacagaaagggcccaattcctcttcaagacaatgcctgaccgccaaccagcgcttcaaaagttgaagaaattgggctatacaattttgcttcagccatcatattcacctgacctcttgccagtggactatgatttcttccagcatctggacaactttttgccaggaaaatgcttccacaacccataggatgcagaaaatgctttccaagagttcactgaatcctgaagcacagattttttttttttgagacggaggagtttcgctcttgttgcccaggctggagtacaatggcacaatcttggctcactgcaaccaccgcctccggggttcaagtgattttcctacctcggcctccctcctagtagctgggattacaggcatgcgccaccatgcccggctaattttgtatttttagtagagacggggtttctccatgttggtcaggctggtctcaaactcccaacctcaggtgatccacccacctgggcctcccaaagtgctgggattacaggcgtgagccaccacgccgagtcccaaagcaaagatttttatgctacagaaataaacaaacgtatcttttggcgaaaatgtgttgattataatggttcctattttgattaataaagatgtgtctgagcctagttacaatgatttaaaattcctggtccaaaactgcaattacttataagggacagccctcctgtcccttataaaattgctgccattaatttcacttatccctaagctataactgaatgcattactgctattattattttgaacagttacctatcagttaagaacaagaaaataaaagattttacctttacttattccttttctaatactcttcctttctttatgtagatccaagtttctcacctatatcatgttccttttctctggagaacttctaacatttcttataaggcaagtaacatttcttactggcaacagattccctcaatgtttatttgtctgagaaagttttttatttctctttcattttgaaggataatttcactgcacacagaataattcgaggttggtgtttttctttcaacacttaaaacacttcactcctctcgcttcttgcttgcattgtttgtgaacagaagtccgatgtaatttttgctttcttcacatagaagtaaggtgggttttttcgcctctggtttctttcaaaattttctctttatctttggtttcctgcagtttgaatatgatatgtgtaggtgtttaattttggaaaattctcagtcattattacttcaaatatttattttgttcttctgaaaagcccatcaaaggtattcttcatttctgttatagattttatttctagcatttccttttcttacaattccaatccctatgcctctattatccatctgttctttttgttactgttgttgttgtcgtcattgttgtttttgagacagggtctcgctctgtcactcaggctggagtgcagtggcgtgatcttggctcactgcagccttgacctcatgggctcaggcaattctcccacctcagcctcccaaatggctgggactacaagcacatatgccaccacacccagctaattttattttttatagagacaaggtctcactatgctgcccaggctggtcttgaactcctgggctcaagtgattctcccacctcgcttcccaaagtgctgagattacaggtgcgagccaccacgtccagccactcatctgttcttgtatattgtctacattttttattacagaccttaccatgttactcatcattattttaaattatcaatctgacaattccaaaatctctgccatatctagctgggagttaagactgtcatgtttactatttgctgtagttataggtgttagaggctaatattttctctactgtccttgtttttgtctcatactgtctttgggtttccctagaaactctttacatagtgtgagtctaagccttgcagttctttcagctgtaatcttctgttattatacaggagcctgctgacatgaggggaggggaagaacctgttgatgtggggtatggggagaagataaagtgttctatagtcctatgattacgtttcagtctttaagtgggcctgtgtcccgggggtgtgaccgtcacaagtgattttcagcttttccccccacttaggtgaaacaggaagaataaagggggctggagttagatacttccctttccctgagttggttacggcgctggtggtttcccttggcaaatgttacatgtgaccttgtaaacaatgtgtattctgaaattattaggtaggtgtagggttctaaaaatgtcaattagactgagttggttgacagtgttgttcaagtgtttcatatacttactgattttctacccacttgtttcaccaaatgctgaaaagaggagtgttgaagtctccaactgtaacactggctttatctttttctctctttagttctcccttatgttctcccttgatgtcagtattgcatcaagttttttgaactttttgtctttttgaaaacttgaactttttatcattttgaaatatccctctttaattctgataatatgtcttaccatgaagtctactttgcctgatctttagatacgccagtgttcctagtgacttttccttgcaaagtacatttctccactgttttactttcaaactgtctatatattaagtatgattcttatgagctgcatatggtagtgctttgcattttaagttagaataataagtccacgtaaaactaatccaattatttaagtaataaggtttgaggttatgttttgccattttgttttctatttttcctgcttattcattgctcatttttttcccctaacctgctctcttttggcctgaaaaaattttagattcaattctgccttatcagttgtcttattaactacatctctttaagtagttgttcttatgatgatttccctgtatatggtttgagagatttttcttggctgctttaaagatttttattaatttgcaacaattcaattatgatgtgccatggtgtctctctctctgtgtgtatgtgtgtgtgtgtgtcctgtttaggatcggtggtggtgttttttgtttctgggacaggatttcactttgtcgctcaggcggctatgttgtattataagttttgttctattgtgttttcattaaaattactaaatacacttaaatacctatcttaaagtccttttatttgaatttgatcacatattgcattctgggtctgtttttattcacaagactttctcctttttatagattacatttgcctacttctttatatatctagtaatttttttttttctcagacagagtctttctctgttgcccaggctggagtgcagtggctcactgcaacctccgcttcctgggttcaagccattctcatgcctcagccttccgagtagctgggactacaggcgccgccacctcgcccagctaatttttgtatttttagtagagacgaggtttcaccatattggccaggctggtctcaaactcctgacattgtgatccaccgcgcccggccatatctagtaatttttaaatagatggtgggcattgtagatacctgcttatatgtggattttattgtcttcctttcaagaaaggtttgtcccagcaggcaactaatttacttgcagatcaatctgattgttttgagcctcgtttttaaattttgttagtgcaggtccaggaaagcctttacgctaagactacattagccctactcataagatgtgacctttctggaatttctactgaatgcctggtgtattcaagaaggtctcaatactctgaatagacaaaatgttcatattttgcagatgtgtgcaaactttggtagttgcttaatttatggttttcagtagctatcctttcactgaaaattggcctcatagggtcttaacctgtccatacacagcttaacattcagccataggctgttcatttattcatttcatgaaggaatttagaaaagatgctatcctttagtctgatacatgactttaatggtgtaggccagaaattcttaattgttttataaaaaggagttaattctatttcccaaagctctgaggtcaaagagaactgattttaaatattccaaaccaaacagaaaacagagtaccattattgtccatgttccattccctctataaaatatgggcaaacaacagagaattaacaaagtgtgtatagcaatggtaactgacatggaaatgtaacatgtagacaggccttcaaacatctactggcagattaggaagtattggttaaaaacacaggttcataaaactatagatcagcagaaaaggaactgattgcccattgcatagtgctagaccaagtggttatcaagctgggaaaaaaggtagggttagatttccaaaatcatactgcccaagaaatcaatccagatagattcaaatccaagtatatacaaaatatttttaaagtctctgtctagaaggagatttttaaaaacaagcataaaaggcttaaactacaaaagaaaaagctatgactttaaattaaaatggccacaaataccacaaattaaaagacaaagacctgaaagagatgtttccaatacacttaaccacaaatgatcagtatccagaatatataaagaactcctacaaatcagtaagaaagatagcaacccaaaagaaaaatggtgaaagaatatgatggggccatttccacagaaaaggaagaaaaggaaagtagaacgactgataatatatcaaatgataatcaacctttaggttttacgttctgaaaattcctacaaacttctttcactcaaaacaaaactttttgatacagccaagataaaatgcctaacgggttagttgcttggtgtaggctttctctactccagtacaataaaattagacttatttgaaaggaaaaaaatgccagggctataatgtcatctgctaatttgtcctttttgtcattagaaaaatttcacaaagcaggttaatgtttaaggtatattttcctcaactggcaaagagaactgaatactgttcatcctacttctttcccagaagtatagtggccaaagcgaaggagatttatggaaggcaatgattaacccagagaactaacctaggcagtcaagcaaccgatcacctcatcgttttcaagaatcaactacagataataagacggcaacaggagagaaatataagaagctctcggcatgtggccaactgccttggaagggaagaagaaacaaaaacttttggggtccacttaaaaactcaatgagaatatacttctatctgaagaaaaaagtgttaacaagaatgcaggtggcaacaatagacagtgggaactactagaaaggaaaggtagggaggggggcaaggattaagtaaccattgggtgccatgctcactacctgggtaacgggggtaaatcatgtcccaagcctcagcatcatgcaatatacccatgtaacaaacctgaatatgtacccctgaatccaaaatataagttgcaatttttttaaaaaacagctaaaataaagaaaattaaaagtattaaatatatttagaaattggagtaaagttactcttaaaaccttataaagaaaaccattttttaaatattttctggttattctaaataaattagggggatataccaacaattcaccatacgtttttactgaacacctaagtgtgtacaaggctttataaaggtaatgtggatttcaaaatgaattaagtacaacctctacctttaaagagctggggatggggttgttgcaaaaagttatactgcaagacagagatggaaacaaaatgcttagggagcccccctaaaaagggaaactaattggaatggatgtggcaagaaaggattcatagaagtgttatttacaccagtctttaaaggatgggtaggaatttaacagacataggaaaaggagactggaaaaggtaaagcagacaaaaaaacagagggaacagtttaagcaaaggtatgggggttagacaaagcataggatatattcaggaaatgccaagcatatgagtggggctgaaatataagattcatggtaaagagaaagaaaaatgggaaataagcctagaaaagaacaatggagacagactgaggaagtccctttacacaacacaaaaagttcattttcagctgtggggattcaaatgattttgtgctgtacagacatacataatgtagccctttactgtcagatgggcctgtgtatgagttaagtctcattttaacaattgtgctgtcttgtggtcatcaatccaccaactcccatgagagttaacagttaatcagaataaatgctgaggttggttaaatgctaaattttaaaacagatcctgctgctccataatcaatatgattctattaatagagtaacaatataatttcttgtacaaactggattgttgagaataaaggtggttcctattaataataatgctagtgtaaattaggaacatcccaacaaactgggatgaagtgactttagttataaaaactcccaaatcagctgggcacggtggctggctcacgcttacaatcccagcgctttgggaggccgaggcgggtggatcacctgaggtcaggagttcgagaccaacctgaccaacaaggtgaaaccccatttctactaaaaatacaattagccaggcgagttggcaggcgcctgtagtcccagctactcaggaggttgaaacaggagaattgcttgaacccaggaggcagaggttgcagtgagccaagaccacgccactgcactccagcatgagcgacggagtgagactctgtctcaaaacaaacaaacaaacaaacaaacaaacaaacaactcccaaatcacagggactctacttttcttccacaaattcccttcagtgggaatctccttttgtaaagccttaggagaatctagtatttgatactgagattagtggctatggcattttaaagagataggcatatattaaaaatgaataaatctactctttgtatagtagcagagacttgaaggatgaataacttcgtgtaaatctatatgagacttctttaccttaactaatgacaaccatgaagacacaagaactacatactgatcactaacctcacaagtataattagactcagatggtatttcctgagcttcggtgttttttatatttgaaaacagttaattttcaactatacctaccatcccaaaatatatcagtctttattttagcatactgaaggaaaaaaatctgtttattgctaaaattacagaatacacctgatggtttgcaaaagacttaatacgggtggctgcaaaacttagcctttagcctcttgccaaataccgtaccagatgtgttctgaatcaccagtaaaccgggatgccctcgtgtgagattatttcaactccaactttcaaatgcttgctattagaaaacacttacagagaaaaatgcaatctcactaactagaaattaataaagagacaaaacaaacctgtggtctttatgagcaaataaaaccaaaaacttcaaatgtcacgactctaaggaaagtaatttaacctctattaattttcgtcaaagtctaagacctgattaaagatggttttcaccctgtaaaaagttgttaaccttttcacattaaaaaaattcactttacgtcaggggttggcataaggtataacaggacaaatggcaaatattttaggcactgtgggtcacagtgaacctttggtgcaactacctcctgctgaagcatgacaacagccattataagtaatcgatgtgaggggcagtgatccaataaagttttacttagaaaaataggtggctggactggatttggctcacagactatagttggtcaacccctctttcagaatataagctctgggcagtccttgatacataatagatgctctatatatgtttattgatgaatcatattatttaataagcaaaaaacttaaccaaatgtctctactactatacaaacactgtgttcattgagtattgagactcaacttcctaagttagaatttataggttatttccccacacaaaatccttactttaaaatttttttaattaaaaattttactttaattgtattatgaatcatggaacactatcatgtcagtattgaactctgttcacccaagatatgaattttctggctccttggggctgttcatataaataagcaatccaacgatcaggtataaggactagagctgaatggtcatgttgagttaaggccacagttaataccttaacaggcaagtgagagccaaaggcaaatgggaagaactgtgtggaaactggtctgcagagaaaacaatggaagagaagtaagacttgtttataccatgcaacgaagatctgtgagatttctctatactgtaataataaatcccctttttattggaggttttcttttttttcttttcttttttttttgagacaaggtctcgctctgttgcccaggctggcgtataatagagtaatcttggctcactgcaacctctgcctcctaggctcagatgatccacctcagcctcctgggtagctgggaccacaggcaccggccaccacacccagctaatttttgtagtttttggaaagatggtgttgcccaggctggtcttgaaattctgggctcaagtgatccacctgcctcggcctcccaaagtgctgggattacaggcgtgagccactgtgcctggccattttcttttctttccaagacagggtctaactgtcacccaggctggagtgccatggcacaatcacggctcactgtagcctcaacctcccaggattaaatgatcctctcacctcagcctctccagtgtatgggactacaggagcacaccaccacacttggctattttttttttttttttcaatttttaacaaagatgaggtcttggtatgttgcccagcctggtctctaactcctgcttgaggagttagagactcctcaagcaatcttgcctcaagcaatcttcctgccccggcctcccaaagtgctgaatgggattacaggcgtgagccaccacacctggccaattacagcttttttgaaagagcttgtggtctttgcaaacaaatcattcctgaatagaaaatggaatatgaaacactttggagaggatttaatgcttgagcttaaactttaaaaacgagtaggcagggttttgagtcaaggtgaaataatagggaatacatttacccactgcctgaaataattaataaacagaaaagcatgtaaatcaatggtctttacacattagacattggccagcataggacagtaatccctgagagacgggaaacaaacattgtaagtccttcttcaatagctccccacttaacagcttccacggagcagagggataagaaacccaggtggaagctggcaatctccctgagttgaggaaacaaagttgaaggccatgcttgttagaatttgcctagtagaataccgggagaagagaactgcagagacagacaggagtagatctgcagagggttccctcaaggttttactgaaagtatcagcacgtgctttgtgaggaatgtacctaaagcagaaaaataagtaactaaaatgggcagagggaacaatcccaagggctcacacagtagcaggaataacttatgtttcatctaagaaggaaacatacttcacaagacatcgagtagaataatcataagattattgactcagtagatgggcaacattagccctagttaagtttgttctgttcccacccaactaagcataaaaagacttgaaaggattacactatctccaaataacttaagtgtcccagaataaagctcaagaatatttctaaaaatacaatgatatccagaacacaaggtaaaatccaccatgcctggaatccagtgaaaaaaactaggcatgtaataaacagaacaatgtgacccattatgaggaaaaaaatgtagcaatagaaacaagccaggaaatgatacagatgatggaattagtaagcaaagatattaaaatagttattgcaactgtaaactatatgttcaagaagtagaagaatgcctgaatatattaaatagagatgtggacaataaacaaacataaatcaaaattttcatctcatgacggatgaaaaataaatgaagaggaaaaatatgagtagaactaagaatatatcagaaatgccggaattaaagattaataaacttgaagacaaagccatagaaaccgtccaaaatgaagcacagaaaaagcctgaaaatacatgaacaaggctgggtgcgggtgtggtggctcatgcctgtaatcccagctctttgggaggctgaggcaggagaaatgcttgaggccaggagttagagcccagcctgggcaacattgtgagaccctacctctactaaaaattaaaaaattagccaggcacggtgatgcgcacctgttgttccagctattcaggaggctgagatgggaggactgcttgagcccaggaattcgaggctgcagtgagccatgcttgtgccattgcactccagcccgggtgacagagcaagaccctgtctcaaaaaaaaaaaaaaaaaaaaaaaaaaaaccaaaaaacattagtatcctatgttacatctttaagcaggcttatatatgtataacttaagttcctgcagtggagggtaagtgctatatacaattaccaaaaaaacaaaacaaaacaaaaaaggtagaaaagtatgggcttaaaatggtactacaagagcaaactattacatattatggagaggaagaaagtaatgagaaaagctgtacatttggataattaaagaaaaaaactgtgaaaagacagaaattgttttacatttttgtaaatcactctaacgtctgggtttcagaagagaaagctgggttatcatatccgcttttgtccaatctgttgcttatgctgttttggctgggaaagacaaccaaccagtctgtgttatgcagaaaagtggaatgagatattacctataaactatcctagtcagctcacaacagaaagaaccagagaagctatttgtttatgaaacttatcccacacaggtgataaggcagaaaggagacagaatcataatgagtttccataaaaaacattacaggttcacagttcttcatgaagtgtaagtggatgccatgggtctgagctgggtgttagttaagttctaagtgtaagaagccaaattgccagaggtcatagaagaaaaaggggaaagggaccaagtaatggaattacaagggaggaaagccagagcagagttgagtctagttcagaatatctcacaatattatatttattatatagtccaacatatttcaagttgagtcagaacattttaactggttttgtcactcgcatttatataaatctgtcactttcccaacttcttctgggcttaaattccctaacaaaaggcattctataacattcataatcctctcagatctgattcacacagtacctatgttcctatcagtaactcagaaaatgactgaaagagaacttttaggtgcacttttgacaggctggcttacatgttaaaagtcttaccctaagagcaattatccctgggcagataccaactataaccaggaggtcagaaattaaaatcctagggcacagaatagctctgtgttgccttctactgatactctgcctatatttaaagcaaattttgggcccaataccgaagggaatttttataaagctacctcacagcttaaaaagcctatcaaaataatctccattaatacttctaaaaagtaccacctaatgacaacttagaaatcaaaccacaatctggtaagaacagaggacataaactacaagaaaacagaaaacatttgatattttaggttaggcaaagatttcttaggtcaccaaaaagtatgaatcacgaaaggaaaaaaaaaaaaaagataaattggactttatcatagtttaaaaccttgactcttcaaaagataccactagaaaaataagaatgcaagccatagattgggagaaaatatctgcaaaacatgtatctgataaaggacttgagtccagaatgaataaagaaccctttcaactcaacaagaagaaaaacaactcaattttgtaaaaaagatttggatacttcaccaaagaagatatgtgaatggcaaatatgcacactaaaagatgttcagattcttagaccttagggaaatgaaaattaaaaccacaatgagatatcattacactttcactagaaaagacagaattttaaaagactaaatataaacaaatgttggagagggtaggagaaactggacctcccatgagttgctggagctaatgcaaaatggtacagccacactgggaaaaaaatctggctgtttcttatgaagtaaacttaccattcaacccaacaatcccactcctaagtatttataagagaaatgaaagtatataatcacagagacttgtacataaatgctttattcataacagcccaaactggaaacaatccaaatgttcagcacctagtgaatggtatatccatataatggataaatgcatataatgcaattaaaaaaaaacattaactcatacgacaatgtggatgacacttaactacgtaacacatggttccatttataagaaagtctagaaatggcaaaactataagtgattacagtgatatagcagataagtggttgtgagggaccaggaatagcgagagaggttttactaaaaggagcacaagggaactttttagggtgatagaaatattttatataccatgactgtggtgatgatggttatatgacggcatacgtttgtcataactcgtctaattggtccattttattatatgtaaattatacctcaataaacgtgattaaagaaaaagaacaggggaataaacatatttgcccctcatattacctgtcactcaccagaatttatcaacacctgacagaaaatagcaataggtaggaaagtaaaaatgtggaaatcactggaaagagcaagaaattgataagaattatgcagtcaagataaaagcaatgtcattctttacatattttaatatataataatgtaatacataaatatatattttaaccattcaataataagaacaatctgattctaaaagagaccttcatcaatccaaaatatcacctgctttatcaaaacagtatttcttagagtagattctaagggttacctaaatcacaggcatcaacatatttctgggcaccatcccagacctactccatccatcacacactcttaggtaaaaataagaccccattttaaactgtttccagataaattattttgcaaatttagtctcacagaatgactttattagaagttctaatgtacacgtgtgtactcacacatatatatcaactgggtttgcaattatgccaggttgatagtattcaatagcacatatactttccttataggaaaatagaggtatctccatttcatggagacgtagggggctcaaatgagattatctataacataagatacactcaaggttgtactgttccccagtcatcctggacttggataggaacatcattctaagcaggtaaaaaagactttttgaccttaccaagcctgaagtctcacaatgccatactgcctctcttttaccactatatactgcttagtagcaggtgacaaccactttagttattaattttagttaatatttatattatcacaagaatatttcctttaaatatgtgatattttaaagttatgtgctacagctgggtgcggtggctcacgtctataatcccagcactttgggaggctgaggcgggtagatcacttgaggtcaggagttcgagaccagcctggccagcatggtgaaaccccatctctactaaaaatacaaaaaaattagctgggcgtggtggcgcatgcctgtggtcccagctacctgggaggctgaggcaaaagaatggcttgaagctgggaagcagaggttgcagtgtgctaagatcatgccattgcactccagcctgggctacagggcaagactcagtctcaaaaaaataaaaaataagaaaataaaaaagttatgtgctatgtttcctcccttactttatagattcagttggtttcttagacaatatcccatgcgcttacacacaatttaatttcaaactttttttttttttttaataatagagacagggtctcactatgttgtccaggcgggtctcaaacacccagcctggagcaatcctcctgccttagcttcctgaagtgaggggattacaggcttgagctactgtgctggacccaatttcaaacacttaaaaaaatcaagtactaccatgtcaaaagaaaacaatttaacaataaaacaaaacaatgtgaggaactacagaaaacaaagctgagtaaacaggccaaggtccttaccttcatgaattttttttttttaaatgtggtaaaatatacgtaaaatttaccatcttaaccctttttgggtatacaattcagtggcattaagtacattcacattattgtgtaaccatcatcactatccatctccagaactttcccatcatcacaaactctgtacccattaaataataataaatccccattcctcctccatcccaccctcagtaaacactattctattgtttgttctctataaatttgactattgtaggtatctcatataagtggaatcatgtatttgtccttccttcctgagttttttctaactttttttgagatggagtttcgctcttgttgcccaggctggagtgcaacggcacgatctcggctcaccacaacctccatctcccaggttcaagcgattctcctgcctcagcctcccgagtagctgggattacaggcatgtaccaccacacctggctaattttgtatttttagtagagatgggatttctccatgttggtcagactggtctcaaactcccaacctcaggtgatccacccacctcagcctcccaaagtgttgggattacaggcatgagccaccgcgcccggctgttttttctaatttttaatgcatgtgtaggcaataagcactaaggacacaaagactggcagcatactgaatctgccctcatgaaacgcacactctaagaggcaagtcagacatgttaaaaacaaacaatcttgcaagttaatgtgataactgctttaacagggatacaaagtacaatggtggcacaaaggactgatatgactaagggtagttgggagaggcttcacagtgtagatgatgtctcaggacagtcttgaagtgtgaagaattcaccagtagaaaaggccattccatccagaggaatggcattcagtcatttcataagggatgacaccacaccagacactgaacacctaggacagccaaggtacctgctttcattaagctaacagcatatgcaaagtcatgaggtacatacatttgagcaagagcaagcagttcagactgaaaagcaaagtgcttgagggagaagcagaagatgatgctgaaaaggtaggcaggtgctcgatcatgaaaaaactttatgttgtctagagttttattttagattataggccagggctataatctaaaatatataagggctgaatttgaaaacaggtaaagttagagacaaactgggaggctattatgatgatccatgcaaaaataatgacacctcaattaaagtagtaaccatggaaatggacagagaatggacttgaaagtccacaaactacatgtaagtgattgttacctgtttatgattaaataaaaagaaataatttctcttcttcagtaaatatctaccaaagccccataatgtattaaaaattattgacaaaaacatattaggataaaagaacacaatgcattttcacttttcttttatgtatgtgtaggtgtgtggaatcagggctccaattacaatcctgtgccacataacaatgtttcagtcaagatggaatgcacatgcaatggtggttccttaagatagagcatcatatcgaaacctcgtatatggcacttgatattgacactgcagatcaagtaggggaaatagctgatattcagtaatggtgctgggacatttcgttttctaatgtaacatacaaatatatttttatttatacatattttttctaggtttgtgtagtatactctatgatgttcacacaatgacaaaatcgcctaccaatgcatttctcagaacacatccctgtcgttaagcaacacacaactatacctttaagtaattttagagtcggtcttcctttttaccagaggaaaaacaattccttgtttctgttctacaactgcaagaggagtgccagaaagagttaacagttgtcaacagaagcttgaccctctgttctcaagtatgtgctggggatgtagtgggaatttaacacactaaacaagaaactgtccataatccagtttacttcaatttttaagaagaaatctgtatataaatactgaggctttctgccaaaaaagcaaatgcttcacggatttggctccttgtcttttcttgtggctgttctccaatatcaacttggagatgtccctatctcaaaatctgccagctactgaaacatgggtcaaacaaaacactttcctctctgtagagtataatgtatcaagactatgaatcctattaggtaaagcagagatcacatttaaaaatgcatataactagttcccccaaaacaatcttttctcagatactaatactcattccacaatattaaacttcagatttcaaatataaggttttctatgattaaacttttagacactggaatcagacatatccaaagaatctctggtaaatctgacacacctgaattgatgtaaatttaatagaagcgtatcttgcttccctttgcaggtaatattccttttcacttgactaccacataattttaagaagaaaccagaataactctcattcatcacttttagtagttcaaaaagtctgaatctactcaaaaaaatctccacactttgatatttctaagtttaaatttgttttatttacactaattcagtttattaccttttagcggtcttaaatattttatgcattacaaaaatccttctttaaaaggcatcccatttatactttcaaaccactttcttaacataaatgcaaattaacacactccagaaaaaaaaattattgttaattccttaattgtactgtacctcaagtctatttaattctacatagttataggagagaaaaataaaaacatctaggtctagctacttgataataggtaatactctttattccaaattaaatatataacagtataataacgagcataattccgaagacaatcaaatgacattcaagtgatctaacagaaaaataagaaaatattttgatacagaaaactaaaaacatagcttagttcataagtcattagggttattacattacattttatcatcacaacaatagccacaaccccaggctatatctcatggtccctaaatctaagcagattgtttttagttgggaaaaagattatcataaacttatattttactaataatctgaaggatctcaaatatgccaagaagcctatgtctctaaaatatagcttcatcttttgaaataattgatgcttcaggaacagcaacaataaccattatcatcaaggtaatctccctgaaaaatctcatcatgttagaaaaaaaacaagtattaaaaaaacaaaaatgaaagcagaacaaagcatacaagagcaattagacaattattaaatggcccatatacctgcaattgaaatcacagaaagagaagacagaacaggtcaaatgaaatacatgaagagacaatggctaagaattttccaaattaagtaaaagatgctaaaccagagaaccaaaaaactcagagaagaccaaacaaaccaacaaaagaaaacagacacatcacattcaaaataaagataaatcatatctaaagatagagaaactcttaaagacggccaaaagaaaaataaattaaatgaacaaaggacattatatgcaaagaatcaaagacaaatgacaaaaatatgtaatagatgcaaaaaatctcaacaaaataccagcaaaccaaatccatcagcacatctaaaacctaattcaccataatcaagtagactttattcctgggatgcaaggttggttcaacatatgcaaatcaatcactgtgattcaccacataaacagaattaaaaagaaacacgatatgaccatctcaatagatgcagaaaaagcttttgataaaatccaacatcccttcatgataaaacccctcaataaactaggtatcaaaggaatatatctaagagccatttatgacacacccacagccaacatcatactggatgggcaaagcctagaaacattctccttgagaaatggaagaagacaatgatgctcactttcaccactcttactcaacatagtaatggaagtcctagctagagtaatcaggcaagaaaaagaaataaaaggtatccagataggaaaagaagaagtcaaactatctttctttgctaatggtatgattctataccagaaaactccgaagactccaccaaaaggctccttgaactgataaacaacttcagtcaagttttaggatacaaaaatcaatgtacaaaaatcagtagcatttctacgtaacaataaccttcaggctaagagccaaatcaagaacacaattccatttacaagagccacaaaaacaagaaaatacctaggaatacatctaatgaaagtagtgaaagatctctacaaggagaactacaaaacactgcttaaagaatcagaaatgacacacacaaatgaaaacatatttcatgctcatggattggaagaatcagtatcattaaaatgaccatactgcccaaagtaatttgcagattcagcattattcctatcaaattaccaatatcatttttcacagaatcagaaaaaactactctaaaattcatatggaaccaaaaaacagcccaaacagccaaagcaatcctaagcaaaaagaaaaaacctggaggcatcacattactcaacttcaaactacactacaaagctacagtaaccaaaacagcacagtactggtacaaaaagagatacatggaccaataaaacagaatagacaacccagaaataaagccacacacctacaaccatctgatgttcaacaaagttgacaaaaataagcaatgaggaaaaagtccctattcaatacatggtgctgggataactggctagccatatgcagaagaatgaaactggactcttacctatcaccatatacaaaaattaactcaagatggattaaagacataactgtaagacctaaaactacaaaaatcctagaagaaaacctaggaaattcttttctcgacaacagccctgtcgaagaatttatggctaagtcctcaaaaacaattgcaacaaaaccaaaaactgacaagtaggacctaagagcttctatacagcaagagaaaccattaacagagtaaacagataatctacagaatgggagaaaaaattcagaaactatgtatctgacaaaggcctaatatccagaatttataaggaacttaaatcaacaagtaaaaaacaaataaccccattaaaatgtaagcaaaggacatgaacagacacttctcaaaagaagacatacaaatggccaaaaaaaaattgaaaaaatgctcatcactaatcatcagagaaatgcaaatcaaaatcacaattgaaataccatctcataccagtcagaatagcttttgttaaaaagtcaataaataacagatctcagtggggctgtggagaaaagggaaaacctttacgctgttggtgggaatgtaacttagttcagccactgtggagagcagcttggagatttctaaaagaacacaaaatggaactaccatttaacctagcaatcccattactgggtatatacccaaagaaaaatatatcattctaccaaaaagacacatgcacccatgtgttcatcacagcactattcacaacagcaaagacatggaatcaacacaggtgtccatcaacagtaaatgagataaagaaaatgtggtacatatacaccatggaacactacacagccacagaaagaacaaaatcatgtcctttgcaacaacacggatgcagttgggggccattatcctaagcaaactaatggagaaacagaaaaccaaataccccatgttctcacttacaagtggcagccaaaccatgagtacatatggacattaagatgggaacaaacagacactggagaatacaagatgggagagggaggcaaggatggaaaaactacctattgagtactatgctcacttcctaggtgacgggttcagtcgtacttcaaacctcagcattatgcaatatacctttgtaataaacctgcacaggtacacccggaatctaaaataaaagcggaaaaagaaaaaaaatttaattcaaataaaaatatatacgtaaaagccatataacaaacagtagagtgacatcttttaagtactgaaagaaaaaaaaggcaatccagaattctatattcagcaagaatattttagaaaaataaagtctttttgagagaaacaaagataatttattactagcagacttggcctataagaaatgttaaaagttcttcaggtagacagaatgataccagacagaaaacttggatctacacaaagacatgaacaacagtataaacggtataaatgaaagtaaatacaaaacttcatatttttcttatttgcaattgttctaaaagataactgtctctaaagcaaaaatgcagtcatgtactgcataatgatatttaatcgacaagggaccacatatataatggtggtcccataagattacgatgaagctgaaaaattcctatcgcctagggacatcctagttgtattaacattgtagtacgatgagttactcacgtgtttgtggtgaagctggtgtaaagaaacctacactgccagttgtataaaagtatagcatatacaattatgttaagtacataatacttgatcatggtaacagttactagcttatgtatttattatatactttatcattattttagaatgtactcctacttacataaaaaggaaagttaactgtaaaacagcctcaggtaagtccttcaggagatattacagaagaaggaactgttatcataggagatggcagttccatgtgtgtaattgtccctgaagaccttccagacaagatgtggaagtggaagacagtgatatttatagcttgactctctgtgggcctagggctaatgtatttgcgtcttagtttttaacaaaagttttaaaagtaaaaattaaaaatttttaaatagaaaaaagcttacagaatgaggacatacttttgtacagctgtacaatgtatttgttttaagctaagttattgtaagagagtaaaaaagtttaaaaaactaagaagttaataaagtaaaagttacagtaaggtaaggctaattattgaagactttttaaaaataaatttattataacctacatgaacagttctataaaatctatagcaatatactgtaaagtcttagagtagtaatatattgcatgttgattgcatatatataaaagtaaagtgtatgacaacaaaaacataaaagatgaagaggagaaatgggagtatagaactataaggtcctaatactacatataaagctatgtattattatatcaagaaaactgtgattaattacaaatatacggcaaaccctagggcaaccactaaacaaatttcagaaagaggtataaataaataagcaaaccgcggagagaaatggaatttttaaaaagtccaagtaatccaaaagaaaaaaagaacagatagactaacataaaccagataccatagtggtagattttaatccaaccatattaccaatgttgataaatataaacaatctaaacacactaaataaaagagacatgtcaaaatgaaagacagagattatcagactggataaacaagtaagcccatctatatgctgactataagaaacccatattaagtgtaaagatacagataggttgaaagtgaaagtaaaacaaaaaacaaaaacagaaaaaatatgttgggagacaattctccatgggtctctgttgaggtagctgcctttgaacctacttctcagtatctggtctgcaaccatctccccagttactctttattaataagtgatacaatggagagatggaaatctcatgtctattgctaatatgtatgaaattcatggcaaacttcagtttttgacatgatataccatgtaaatactaatcaaaaggaagctgaagtggttatattaatacaaggcaaagaagatttcagaacaaggaatattaccagagataaagaggctgtccgccagaaaggcacaccgatcttaaatatgtatggatctaacaaactttcaaaatacatgaaaaaaaaactgatagaactggaaagagaaatagacaaatctattaagttggagacttcaacacatctctcagtattttatagaacgagtaggctataaacatatggaaaaactcaatctctcactagtgatgaaaaatgtacaaacccacaatgagatgttttaaattaattcctaatttaaaacttaagtctgacaatcctaaatattggtgaagatgtggaacatcagaaactcacacttctggtgggagtatagattggtatgatcactttggaaaacaatttggcattacttagtagagatgtgctcatatttataatttaaaattcttatgacgaataaatagtaaatatagattcactcagcaaatattaaaaacaaaataaagccacagaatgtaagtacaacaccccgttaggcctaactagacaccgagactcacataacccaaacaggctggttatacttaacatgtcaggcaggagtcctcattgcaattcgggggctagtatctttggccctctcaggtggcagatcaagtgtaagagaatgagagcataaggtccttgcagtagctactctagcttacaggtaccaaatagcaaccaatatctccagtctcataggcatagcttcctgagcttcagcaacagatttgcttagttgcaagagttatcacactcagggaagtccaaagctgttaacggtataagtaccagtatttacaattcattcacagtcctcctctggtccttatgcaattcagtaatcatgagtcattattaccataagcaatggtgctcggttatacaactgatattctaccttatcaagcttccaagtgaacaaagctaggaagttaagccaaggccaaaactgtccgaagagaagaaaggttaatgttacaacaaataaagagattcaatttagaatggcactaagctaaacaactattaatatatttcactgaatccaagatgctagtgattatgacataattaatttttgtactaagaaaagtgctgttaagtaaatatggtgcactactgattgtaagacatatcctaattactgagatgcacaaggagggaaaatatacttcttagaattgatgaaatacagaataatccttctctaaatttttcactaaaatatttaagacatacagtaaattttcacttaactttgttgataggttcttggaaacctaaactttaagaaaaactttgtagcagatctccaaatgacattttgttcaacttcattttattataacaatgagaaaaaaacggtttcattatatgtgatttcacttaaagtcacaatttccaagaacctgtcatggacattaagcaaggacttactgtgtaactcttttctctaccttggggacacggtctgctccaacagaaaccagtcccctactaaaaattttctaagacatgtaatacctctgttcatctactctaaaaacaaccaatatcaacataattgacgcagcatagctgtcttcatcctggcatgttaaaaagcatccaaaatctaaataaatgaattagctcccatcactgattaaatcactaaaagtcctaagggcctttacaacctggaggcttgcatgcaatgttctggtaaaataaataaataaataacaaaaatttaaaaaaaaaaactgtttcaggttatccataaatatgttagttcccatataccagcgaactgtgcaaggagaaaagtggaaaaaaccttaaacctcaatccagtagaggtacactaagtgaatgttttcatctaagtgggttgtatacgatcattagttctttatgctagggaaggcaaatctatctttttataagcagaaaataaatatgattaaagtgaacttgccataccctacctactggcaaacactaggcttggaaaaatagcccttgttcatagataggtatgtatggaatgggacctaaacaaacattcagcagcatagataaaacatcttcttaaaaatgccaaagaaaagaatctgtgataatttatatttagaaacagaaaaaatgtaaaaagtatatgctgtgtgttctcaacaacatacatataggaagaaataaaaagacagacttatatgcagtctaagatataaatggaactcttaagagataagaaaaaagaaatgaatagaaacaacaatttaaaaaactacattttggtacatacacttttaaaaatgagttctgttatctatgttttccaaaaaggaaaacagggccgggcatggttgctcacgcctgtaatccttgcactttgggaggcctagacaggtggacttcctgagctcaggagttcaagaccagcctgggcaacatggtgaaaccccatctctactaaaatacaaaaaactagctggacatggcagcgtgcgcctatagtcccagctacttgggaggctgaggcagaagaattgcttgaacctgggagacggaggctgcagtgagccacgatcgcaccactgcactccagcctgggtgacagagcaagactccatctcaaaaaaaaggaaaacacataaaacggtctatgctgcaaaagtcacacactaaaggaaagggtaaaataaagttatttttatttgttttttttttttttttgagatggagtttctctcttgttgtgctggagtgcaatggtgcgatctcagctcactgcaacctctgcctcccgggttcaagtgattctcctggctcagccccctgagtagccaggattacaggcatgcaccatcacgcccagctaatttttgtacttttagtagagacggggttttgccatgttggctaggctggtctcaaacttctgacctcaggtgatccacctgcctcagcctcccaaagtgctgtgattacaggcatgagccacagcacccagccaagttattgtaaaaatataaaattacaagagtgaaaaacaaaatcaaacctcaattatagcaaattttgttggctgagcgcagtggctcacacctataatcccagcactttgggaggctgaggcaggcggatcacttgaggtcaggagtttgagacaagccagaccaacatggtgaaaccccatctcttctaaaaattcaaagttagctgggcatggtggtacgcgcctgtaatctcagttactcgggaggctaaggcaggagaatcgcttgaaccagggaggcggaggttgcagtgagctgagatcgcgcccgagcactctagcctgggcaacaaagcgagattccgactcaaaaacaaaaaccaaaaaaaaaaaaaaaaaaaaactttgtttaaaatcttcagatgggtttaaaactgaactgacataaaaagattaaaaatagtgatgaaaaacgatttatacaatatatcgcagaaatagtcaaactgaaaggaaataggaataataattttgacacaggacaaaaagattttaagaaatgaattagtctttttatattgctaaaaagatctctacagtgctactcaaatgccatctatgaactagctgtttgctacagctatgcaacaagacaagaacaaagctcgaaacttagcatttagaaactcttacagcagtctgagagggaaattctatacctgttaaataaaataatttttaaaaatggaggttatattactattttgtcaagttattctcatttcatttcatttttctagtaattcatttttaatgtattttaaagaagtattgggaaaaaaacctgattcttcaccacaaataatttgaaaagcactgtgataaaagacttatcggtcatgaagctgggatgtgccaaacaacacatcaaaatatacaaatttaaaacaattacagatgcaaggcaaaaatgaaggacaaatgtttatttgggaagcaaacccattccatgacacattagattttttttaaaaaaagcacatagaggaattttaaaatgtcacgttttctctaagaagtcactgattataaatgtcctatcagtttaataccagcttttcaggagggaaaattactgtattaaatgtacatactgtgagacacattacaaactcggaaatgttaaaattgggccaggcgaggtggctcatgcctgtaatctcagcactttgaggggctgagatgggcagatcacctgaagtcaggagttcaagaccagcctggccaacatggcgaaaccccatctctatgaaacatacaaaaattagacaggtatggtgtggtggcacatgcttgtaatcccagctacttgggagactgaagcacgagaatcacttgaacccaggagatggaggttgcagtgagccgagatcgcaccacagcactctagcctgggcgacacagtgagactctgtctcaaaaaataaaataaaattagaaaaaagaaattttaaattgtttaaaaaggattaaccaagaaaataacagtaagtcaataatttggtattaaatgaaaaacttcctttcaattttcagtgaaacatgtataaagatgttagtaataaagcagacgctaaagaatacatcaataactttgaaaaactaaaaactatgtaaagcatggtaaaaaactggctttctgccatgccccactaatcacttaaggattcctatttgtttttgatgctgctgggtaaaattatataagaagaaagggttcgacaactttaaaatgtttaaaattatattaaattactcaaaacatataaaatgtccagcctcgcagttttctaatacctttttatacaaaagtcaagggaaaaggtcaaagtacttcatgtcagatgtggcataggaggtcacagatgtctctgccaccttcttcctggcttcccacaatctcagaaaaaatctaggatattatttgggcagtaggtagcattactgcattctcaaaagagtctacattctgtgtgtttttcttctgtgtggtccactgctaatggctagcctaatctagccatcctaacatacccatgtggttgattaggttaaggttggctgaacagattgaaaattatatagctggccctccatatctgtgggttccacatctgtggattcaaccaaccacagatcaaaaatattcagggaaagagttgcatctgtactgaatgcgtacaaacttttttccttgttattactaccttaaataatacagtatcacaactattacatagcatttacaatgtattaggtgtaagtgataatttgaagtactatataggagaatatgcttaggttattttatgcaaatactacaccattttatataagtgatttgagcatctgtggatttttatatcctcagggattcctgcaacgaatccctcacagatactaagggatggatacagagggaagactgtacgtaagagtagagcattgctagaagcactaccatgatctatgcatgttttatacacatcacacacacaaacacacacacaatgaaattaacgagactcaaagcaacattattaacaatttcttctaagttacacagagtattttccatctatactatacaatctcatcatctaaaaacagccctccagaggttatgatcctactccttggactgcccggtcaaaacgactgatgtcataataaaaccaaacctagaagaggaaaaaataaatcaaagacaggatccttttgaagtttttcattttaactatccagagttttaaaaagttctctacaaaagatttgataatgccaggatcttttccttccattcccatgcctaatacttaaacctaacttcatctaaatgtgatttaaaagcctaattcagatataaagattatttatgaaatgaaaaaaagatactacttaaataaaaagtaatctaccataagaactaacggaggaaaacatttggaactcaatttacagatggagatgaactttactaatatatgaaggctctttggaatcagtaaggaaaagaccaagagtctcaacaggaaaatgggtaaaagataaacagtacgctgagaaggaaataccataagggcctctcaagcatatgaaaaaacactcaatctcactcataataaaaggaatgcaaattaaaactacactgagatccattttatgtctattagattggcaatgatcaaaacatttgagaacataatcttgatgaagacatggaaaaagtctcctattgctggtgggagtacagatcaaaacaacctctgtattagtttttctcatttgaagaaatccttgtaagatgtttaaaaatgtagcatgtaagataatatttagcctggtgtgggctgttggtcattctcaaaaaattgttaaaagttttctacttttatagaattctgtttacataatgaagcagacaggtaggccacttttaaaaacttggatgactggtcgggcgtagtggctcatgcctgtaatctcagcactttgggagggctgaggcgggtgaatcatttgaggtcaggagtttgaaaccagcctggccaaaatggtgaaaccctgtctctactaaaaatacaaaaaattagctgggtggggtggtgcatgcctgtaatcccagctactcaggaggctgaggtgggagaatagcctgaacccaggaggtgaaggtggcagtgagccaagatcacaccattgcactccagcctgggcaacagagcgagactgtttcaaacaacaacaaaaaacaaaacaaaacaaaacaaacctggatgattaacacagtagtcttgctctatctgctgctcacctcttgataccttattgtgcacttaatgggtgctcaataaatatttgttgagttgaatgaaactaagaataatgctgaaggatgacaaaaatggaataaaaacaagaacaatgaattaactaaatttatctgaactgttgaataaattgcttacataaacactacttcaagaaaggagcaatgccacgctagttagtgcatgtttcctgaaaaatgagttagccagcaacagttggataatagattgttgtagtaatggccccctaattagccccactcagttaggaaacccctcccataccaactctggaattggccatgttgatctgctttggcctatggacaacagaaaatatacgaggcttgctgtcactagttacttctgtaaaccctactactgcctccaggtgaaagagccacgcctagcctgcgggagacacatggcccccatcacccaagcaaacaaccagtacggattatccagacatagctatcctagaccaaccagctcccagctgacccatcagctgactgcagccacatccgcaaggccagacataagctgcagcagaattgcttaattgagcccagcccagaattaggctaacaaatgcctattgtttcacagcactatgttttggggagatttatcatacaacaaaagctgatccaagtagagaggggaataggtggtcaaagaagatttttcccttacctgttctgcttttcaaatttcacaatgagaatatatccacatactatttaattacactgaacttataaaaattttatatcagattgatattaaaatcttactatcaccttgtaaacacaaatacattaattcagtccaaataggagcatgaatttgagaggagacattaatattgcttcagaaaaaaaaaatgggttaagagtaccagggtttactatctctcacacacacacacacacacacacacacacacacacacaaatgtgaataagaatatattcacggtcactgtcacatctcaataatggctattatcaaattctggaagtgttagaagacactcatctcaaattctgcttcactgtttcttctgtttaagtgggtaatggcctaatacatgttttctcatttaatcctcacatggtatgaggtaaacattatgctgcatcactttaggcaaagttaattaacctctctatgcctcatttcctcaactgtaaaatggggataacagtcctattttatagaactgttgtgaagattacatcgcttataacagggcacacagtccttaataaacggtttaccacctcgtttagtaaaatgacgtaaaattaaggtcttttaactataataacatggcttctattttcaaaacactaagcattatcaactaaggtgtgagacatcataattaatttggatatctttctaatgacctcattaaaaaattaaaagacatgccggggtgtggtgatggctcacgcctgtaatcccggcactttgggaggccaaggtgagcagatcacctgaggtcaggagttcgaaaccagcctggccaacatggtgaaattccatctctactaaaaatacaaaaagtagccgggtgtggtggcacgtggctgtaattccagctacttgggaggctgaggcaggagaatcatttgaactcgggaggtggaggttgcacggagccaagattgtgccactacactccagcctgggcaacagagtgagactctgtctcaaaaaaataaataaataaaaataaataagtaaaagacaatgttattaaacaaaacctaggaatgtatgtagaaaatatatggtgatgagaggtgaagctctgggcaataataaatcatttagtccacattccacaatcctaagtacgtttaaaatacaaaggcttccatttttgtgtgtgttacaaattcacaagagagcaataaatcctactgacatgtcacctttactgtgacatctagcatacatactttcaacatgttctatcacctttttttttttaaggcactagtgatggctttggaaaataaggttcttttcaggtcctgatggaccacttataaaacatagccaaatttttaaaaagtgttttaaacaggcaattacctagactgtagatatgtcactaacgaaatgtaaaaaatctcataccacaatgtgcagatgttttagtttctcctaatgtgaggaatacctgctacaaaaattccatgtttcatttcaattcaaacattttaaagagtactcagtatatgaggtaatgtagcagattctggagataagacaggtaaagaaagtaacatttatgttactatgtatgccagacattagctggttatcttattcaatcataataatgctatgctgtagaaattattaaaactcactttacagaggaggaaattaaggctaacataagtataataacttgctcggggtctctcagcaacagaaggcagtggggttgagaagtatgaggtggggcccatgaaggtagtgccacatgactattcttagagacaaacacaatatccattgtaacagatccttttttaacagcaatgtggaaggggatgaagacttggaaaaccaaggagataatctttgggaatgggcaaaggagtcacagaaggctttaaagaggttgatatttaagttgttagttaagggtgagtaggatttaccaacttcaatgccaaggctcacccccacccccctcacccccaatatattaaccaaaataaattacttacttgaaattgagaaaaacaattttgagagaaatcttcctcagatatattattccatagttttaaaacaaataatatgatgacagtttaatttttaggttgcttttatgtggcttgtcttgggttttattctgaaatgaaatttagattagtcattttcttgttctgagaaactgcgagtatgccaacatgttttaactttacatttttcacatatcaacatgtattcttatttacaaagtctttcatttcaccatctcaaacaaaacctaatttagtatataaattactttgaagtataaatatatatgcaaaataatatatttcttttaattcttgttatacttctttgtaatcgtaataaatggaagaaaaatagtattcttgtgaactgttatatattacacaaggcatttttgaggtaacactcttttattatttgaattgtttatatagtagtaatgctctctgaacccaaagaaaattaaataactgccccaaagtaaattgagctcaaattcttagtatttcccaaaactatcatctaaaaaaatagaattggccaaaaaagaaaaaaaaaaaccacgaaattttccattgacaattactactcatttttctcagaatttactttgctaggcttgtattcaatttctgctacagaaaacagtccagtttaccaatgctaattaaacaacaaagtatttttcatttataaaatgaaatatttaaaaacccacagagagctggaagaaacacaagatcatctggaaaacttagaaggaacgacagaaaacacacacacacaccaaacaaaaacaccaaaaaggttaaataggctgtcattaagagggtcttacttttacttataatttgttttggtctcaaaatccacatcatgtttggacagtagactgagttatttctaattgcctaagacactcattcctgccttatctgtatctacatggaaattacaagttaacacaatttcacccaaagtttactgttccttaactcccattatttcctcttattatcactatgatgttaaaatggcagccagataccagagtgacatacctcataccatggcccatttcttactttataagtaagttcaaactatttctttgaaatatccagcaccaatgacaacatcctctaaaacctactttaacccaacctatttagacttgaatcatttttcacttagatttttttttttttttaaagagacggggtcttgccatgttgcccagactggtctcaaaatcctgggctcaggcaatcttcctgcctctgcttcccaaagtgctgggattataggtgcctggccctagattatctttaattgcgtgaattctaatccaatcaaaagcaagatgagagaaaatgtaattatagtaccagaggaacttgaaaggtctcatatattccctcctcccttttttggaaatagcatacatacgattttagtatcaatttttatttatgtttgccctaaactccttttgctataatcttttgttttcttaaagatacagcccaagtcatcataaaacgaatcctactataatctattctagattatagaatattaataatattattatataagaagattctaagcactattagatacagtagggtctcaaagatttctgaactacatatgtgcagttcttttaataattcctctgaggttctgtatttttgtctttcaattatcatcaatgccttcctccaatattccctcatgtttcggggggagagggggtcagtgtgaggtgatgagagctgaagagtcaagatccaagatccccaattttcaaatccagcctcacaccaaccaactgtaggacactggacaaatccctgagcctgctatgtagatttcagttttcttcatacaaaatgagtacatttgactagaatgatgcttctcaacccttttaacattgcaaacaaaacttgtcagcaaaaaaaaatttagcacactggacaacaggagggcatttggaggcatctacacagtgcctggtgaaaaaaaattatcatattttctaattacagaagaaaaaatgtaaagtgttatggtagatattttttgacacatgtaatgctgaaaattttaatatgaatttcaaaaccaaacattttcacatcaagaatatttcaaaattaaaatcatgctttatttctgacaaacatacatgcactattaggcagtcaccttgcagagcatatcaaacgcacgtggtgagcagcatccaatacaggtgaatacagatagtcaggcctggagctgggccaccagagacaccctccctgcttccttgtcctctcattgtaagtgggttgcaccttgtggtaggtggcatgttccttcggcaccgtgaatacaaactccagtaacaattccatgatccctttcccacaaaaggcagctgtacactgtggctggctgctgaagtagattccaagtagtaaggcacacctcatttaatgcacttaaaatatcaaaaggagcagtatgctgcttttaactgttggttgtcactcaccatgctatttgttcacaggaaccccaacgccttccttcagcccccattctactaggactacccttctgtgagccatgtaacatcaactgaaaactttgaattagaagatctctaacaataactaaagttaaaaacagtattgcagtaatcatttgtttgtaacaactattatggtctcttattttttccttcttaccaattcctgtaagcaaaacataacttaaaaatattaactttgaatagtattacatgcacatgattttaaaatactgaaaaattaccaaacagtatactttaaaagttagtccatctttgtcctctaggcaaccacttctacacactggagcaattactgtcatcagactctcccgtatcctcccatgcacattacattctatagctgcctatatatacacacacacacacacacacacacacacacacacatatggattttattataataaagaattttattctaatacataggcatatatagcatataaaaatatatattttaaccacacgaatggcagcaaactgcacatgcagtcatgcctcttgctttttttcctcatatctttgacatagcaccacagcagtacacatagtattctctcattatttttaaaggctgactagtattctgttgaatatatacaccataattcacctaactacttccctactgatatgtttagcatgtttccaatcttttgcagtaacaaataatgctgccacaaatattcttagatatttatttgacatatatgcaaaatcttctagagaataaaatcctataatggaattactagaacgaaataaatctgtgttttaatttttgaaaaccattttcaaactgctttctatagagtatgaatactttataatcccaccagcaatgtataaggctgaccattttctcttctcacctttcccgagttatactatacataacctttgctcatttgataggtgacaaagagtatgttgtagcttgaatttacatctttattatattataaataaagttgtacattttttcatatgaattctctttgctaatttttctactggattattttctagttctttgtattaagaggaacttagccctttgtgaagtatacaaataagttttactagtctgtttctcttttaactttgtttgattttttcccctgtacagaattttatttttatgtcctaaaatccagcaacccagtatgctattaaaggacttcaccaatcctggattacgtaaaaaataattaccctaccttttttgtttctttgtttcatatttaaatctttaactcctctggaagccaacattatttttccagatgactaactggctatcccaacactgtttattaaacaattcttcttttccctactcataaatgaaggtgggatccattttcatatacaagttgaataccccttatctgaaatgcttgggaccagaagtgtttcagattttagaatatttgcacatacatgagatatcctgaggatgggaccaaacctgaatgtaattttatataattttaaataatgttacacatgaaacaaagttgttttgattgtttttgagacagggacttgctctgtcacccaggctggaatgcagtcatacaatcatggctcactgcagccttcacctcctgggctcaagcgatcctcctgcctcagcctcccaagtagctggaaccacaaacgtgtaccaccctgcctggctaacttttgtatttttttgtagagatagcgtctttccatgttgcccaggctggtcttgaactcctgggctgaagcaatcctcccaccttagcctcccaaagtgttgggattacagacatgagccactgcatccagcctgaaacgaagttttgactgcgacccatcatgaggtcaggtgtggaattttctacttgtggcatcatgttggtgttcaaaacatttcagattttgaaggatttcagattatggagttttagataagggatgctcaacctatattaagctctcatatatatttaagttaattctagtctttactctgttttagtgctgtcatgtgccaaaaccatgttacttttcaaaacattttaaaattaaaaccactttacatacaagtaagaataatacaaccagaaattactggcttgctttaatttatgaatcattttgcaatttctaaatggaatttatataattaagttcaatatgatcatcatgcaatcatgcattttggttgacacatattttggagaccattacgaatctcatgtctcccactacatttctggaaccatatctagaaaatcaatttttccttaattttgtacatggtttttttaaattataaaatcagcacatgttatctgtaaaaaatctgaaaatataaaacataccttccagagataaccaacttttatacttcggtgtatttttttccacacttttaataagtgactattttgtaaactaattttttcacataatatgacagcactttcccatgttattacacatacttctacaacatgttttaaacacatcctcccaaatgaatatacccagtttatgcaaccatttgccaattgttgaacacttagagttgttctctgtgatgattatcatctatttattaatccttgccacaaatgagttccaagaattaatagacgagtttcaagcactgtggtaagcattaactctataatggtgaggaaaaagaaacacattatcaggatttctggaggttacaatctatttggaaaaacagatgttaatctccaacacatatgaaattacaatgacagcaagtgctatgaggagagttcatggtgctctgagagtctgtgatagggaagccttccctgaggaaagataaatcgaagtttaggtgaaagaaaagtaaaaacattctcagcaggggcaacggcaggtacaaagccctcactgtgggaaggagcatggcaagaacaagggactgagataaggccaacaaggctggaacaaaaagagtaagtcaagaacatggctcaagtcatgactagacagaaaggtaagggccagactatgcaagaccttgtaagacaggcagatgccaccatataagacacagagttctgtccatatcctgaatgcaatggaaagctactgaagcatatcaaacagtagggtgatgtaatcaggtttgcatttttaaaagatccctctgattacagtgtaggaaacagatcagaaggggacaaagtagattgggataaaccaagattaggaggctactgtagtaaacctgaccaaaaatgctagtagtttagggtggtgatggattatgaaaagaagtagacggattcaaaagacaaccagatttgccaaaagatttatgctcatagattaaaatccctaaaactagaattactgggtcaaaaaagaacacttcaaggattctaatatacattgccaaactgccctgcaaagagcagttgtcttcatctgtcaattaccttgtagctgttcctctatctgaaattttaagttccttaaaaattcctttaacatgactaatccatatttccttcacgaagtcttccctgactcccctttttgcctggatatagaacatgtctcccaatgaatccttgctttgtcttatacacatttctatagtccagtcatactgcatttgacttacgtttacatgcccatcatctctactacattgtgagcttctggagagtaaagctgttcttaaggcacttaaagctaaaacaacttgctactcagggcttcaaatacctactttaaaaaaagtgaccaatttgtttgtgatgagtcattacatctccatagcgttcctgaaaatctctccaataattgtaatcaaataggtgttatatgatcttaaaatatttttaaatagcttagtaaaaaacagactatgaacaaagcagattctattagagaaacttttgaacctgagttgttgatacacgctaattttcaaaattattcttattgcaaatttaactccaatttaccaaaaaaaaaaaaaaaggttattctggtagtttcttatatttaattttataaaatataaacaatgagaatatatttataattggataagcatctacataaacttatatagcatttcagaattatcaattccttatgttgaaaagcttgatttcatggctaacagtatctagaacaatctaccaaaatattcactaagctagaggaagtggcagagttccttagagtaatcttaaagacaagcagctccctctatagtctgtctggcctactttgtttaattccttgctttgtggacatcccacactcttctatttactcctactctgcatctcagcagggaagctctttgaaaggatagttctgtttaacctggtgctgaggaaactgtgagagctgtctaaactcagcatgaagtgagttacatcaagcaactaagcaaaagtcgagatgtggaaaatggacagcttcccaagtccacctcagtcaaatccttaaatgaagcctgatgatttcatttgtagtgaatcctctgagtggtcacacctatattcaaatctaaatgaaaaaacattgtcctatactttattcacaacctttcttccctccattaaaacaagttaccaaaatgttgttctaaaagaaaaaattaacaatttattctacaaatgatactgctcaatttgattatgtcaaaataatgttcaagacattttaaaaactagttaaaaaaatggagaggaaatttgtttttgttttttaaaaaattccataactcagatgaagaaactttaagtgattcccttaggaatcaatatcctcagttggcaagggattaaatcagtcaggatttaccattcaaatctgaatatccccccccgccttttttttttttttttttaagacaggctcttgctctgttgcccaggctggagtgcagtggcgtgatcttggctcactgcagcctcaaccttctgggctgaagcgattctcctgtctcagctttccaaatagctagtactacaggtgcacaccaccacgcccagccaattttgtttgtttgtttgtttgttttgtacagactatgtcgcccaggctggtctccaactcctgggttcaagcgatcctcctgcctctgtcttccaaagtgttgggattacaggcatgagccacagcacccagccctgaatatccctctttttaaaaataccttttcaaatttcaccaacttaagacatgggagcttttaaacccaaaacactttatttcttaaattactcaagatacgtcctcaaaacacagaacaatcaaaagtcaactggactgttttctaaagcagaaaaatgcttttcaggcaataatagaaaaactaaactagtaaaagggtattaatccaatcagttcagaatttgtaatataattttgaaacggccacttcatttgagaaaaaatatctttggttgctatttttcaggatctcatttgtaaagcaaagtcaattttaaaacattttctctccaaaccaaagtaaagcattaaggacctcccaaagtaattcttatatatgaaaaaagtatgtttatgctattttatgtagcataggtttatcatgtgttacacatttttattaccttattttacttgttagtaaagatataaactataaagatataatacaaaccatgtttatatctttgcattatgtttacatctttactttcaaataaatctgtcttcattaaaaattctagcattcagagttttactaagtcagactggcctctcttttatattaataattttcaagttttattttattggactagttttccttggggagataattcaaaagcaggtaattctgcagtttttgattatgtttaattaatattaatctcactgggagtttctgacgtgctaataaaaatgctggcttggtttatgaaaagtgtaaactctaaatgtatgccaatgacttcaaattttttcttgttgaaacaaacattttgttggaaactgtgaactacatggcaaattcaatttgataatccttaacaatttaaaatttgactttctctgtatcaagttttatgtctttcaatgtacatataaaaagtgttactttttaattcatttaaaatataaatttcaaagtatgtaccaaaaaaaaaaccccaatgggggtttttagtctttggttttttcgtttttgtttttttttttttttttaaggtgctggtaatctattgtgggatgtccatgaaggattaaataggaaatagttaatgtgtcttttaaaaaatattcaggaaaacaacagtatataatattctttattttttaaggaacatttcctcacgtaatagaattacattagcttacagtgaaactcatttatttccacaaacgaaactttcctatacaacaaagcttgactatctctcaggaaaacatatttaatgacttgtgtggaggagaaaaaattatgtgtggaaaagtaactcaaaccatacaagctgtaatacacagaaatgccacagtatatcctattagcatgtcactttatgattcggaaatttggctgaacagggccatatcaacttcactattttatccttcctctgcatctgaagtgagaacagtgcattacactgaaattccaattggaaacaaagacagcaccactatatttaaaagggcagaaaacctatcttatagaacacttcatcgcctcgatttcccagcctccaaagtttcaagtgttacactttcaacacgttaaaagcactcaaattccccatctttcaaggttcatatcaaaatcatattcactagtttaaataggaatatgctaccaaatctcacaacattgacattttaacaaagagaattcacattaaaagataactgctttaaaatgagtgcttgtgtttgggaaagcgctattatcttggtagtccacagaaactgactgtagtaataagatgaatggtgatgagggcaaggagcatcaagtgggaaatgctatctaaaatcccatagggcaattcatagctagagggaagaacaacctttcctaagatgcattatttcctagaactccattatttcatggaagcagttcaaagcatgcaaaaaagcaaaaccattttaaaacacctagtaaactgggcctctatcttttttatattatcataagccccaggagtttttgagaacgtaccttctgtcacggctgtctccccttcccatcccttcttcaacatagttgtgtttaaaaaatatatacctgtacttaaaacgcaatcctacagcccagcctaggagcatttcaaaatgtctgtgctgctgagtctggctgtggttcctaataaattcaccccattaagtgtgatgttttaggttgggcaacataaacacgcatttcctacttccatggatgcacatttcctgaaagcactgcacctaaggatgctgccctgtcccccgacgctcaggcactaaactctaaggagtcacgacctgcactcacagcagagccacacggtcaccccagtgagaaagattatctggccccaagcgccactctctccggcccactgcatctccggaactggcagaggagagcgagggtgagaagagaccatggggagcgactgacaacaaggctgacacttccccgtttccagaaagcggcacttgggggacacaagggatgtcccactagcgaccgacctcagagcaggccctacgaacccgtccaccgatggacatggcgcggccacctggcccgccgtccggggcgcccgcggctttcgctctcccggcccgcgccctggagtgcggctcccgctcccggccgccacacgcagtctaaacacgcggcgctcgccacctccctgcccgggggtgggggcgccgcgcagcgctcgcgcggacccacatttttgcggctcttgtcacgcacgagagaaaaggcgaggagggcggaggggagggaagacgcggcagcgatccacggagacggccggcgccggtggcgtgtgcgcgtgtgcgcggcggggagggcggccccggcgccccgccgactcccgctcccgccccgcgcccggcgcccgcttacctgccggggtcgctccgaagactcgcaccaccggcaccttcttgacaggggcctgggtgaggggggattggcaggtatccagcccctgcagcgggctggccatgtagtagtctgcagtcactatccttactgaaaacatgttcgccgccgccgccactgcctcccttcactggcgacccggcagcggcagcagcagcggcggcggctccctccgcagcggcggcggcgccccctccccttctcggcacggccccctcccctcacacagaggcacctcgaggagcggcgggcggggcggtgtaggcgctgctgccgccgcctcctcaggagcacccggcaaggggccgcaggagagaagccctcgagctttcgtcggtgctggtgctgccgccactgccgccaccgccgggaatcacacgggctcctcggtcccaggctgcagctcttgttgccatgatgatgatgtcacggacgcaaccactggggggaggggagaggggggtgtgtgtggcgaagggaggctgcgagtagtgcgggggagggggctcggcgggaaaaggagcgagagggcgggcgcccgggcgggacacggagggcgggggccgagaaggggctttctccccctccccgggcacgcggcgagggaggcggccggcggccggcagcgcccgcgcgggatcgatgactcggctggcgggcacggtcacctgggtgaggggcagcggaaggggcggcggagcaccgatctcatggatgggctccgaggggcttgcgggaggggggcgccagtgttcggggccgttttggcggctatgcaggattggcaggagctgcgatgctcacacttgcctcgccgaccgccatttcacatccagcagaggaggcgggggcagccgctgagacggtttttcacaaggtaagaaaatccgcccgcgtgaggagggaggcgaggcgcagatctcgtgc

SEQ ID NO: 143 - DNA, 17309 bp, Homo Sapiens
tcagcccagcccttggggcccctttattgaaacaactcacagcacagtatttgagacagacagtgttggccggcggaaccccaggaggctgagaagtcgaggttgcggcatccctcactgccctcctgggggaggcatcctccaagcagacctgagcggccccgggctggggcgggcgatccacacacagaggcgataagagcacttggaatcagggcagccatgcagcactgccctaggcggggatcccccaaagtctgacagtttgggcatcagtggggtggcaggtgccccctcagctgcctttatgagcgcgctcttccacgtaaagctgcatctgacggacacaagcaaacagccacagtcagcaagacagccagggcatccctgctggaggacacagaagcccctggtgggcagacctccaccacaggtggggcctcgtggccatagccatggtggagaagagtagagatgggaggagccctccaccaggcactcccccgttctctcccgcaagccctctagtaaggcctcagcaccgggcctcacttcgttaagcagcccctaaataaagcttcccgggtccccacgaagctcacctttaaaatgtccgacgtcatggtttttagtggtatcagccgggggtcatgcatgtggacatcctgctcatccgccaggatccaggggaaatcctagggaggagacaaaggtcaggggggtgacggggctgggccctggcctgccctcactttgctgtccctcccactccagaccaggggcctccaacctgagcctcagaatcactaggaagctgttggtgatgcagaccccaggaccgcccccatcccccacagaggccaagtccatagaacccaagtgacgaacaggctccaggcaccaacgctgaacctggtgggctaggacccctccctggagagcccccacttcagaagagccaggatgagctgggggccccagtaggtggctccacctgggctcctcactgccccaagtgcccagatggagcagtggacaggcctgaggacctgctgggtgccaggcgctgccacaccaatgtaatgggtggctggccacaggcagtgcccctgcccgcctggaactgcgacatcacgtttctagagcctgcgcccagacccagacccatctcatctcaccttgatgacctggatcttctccatgttgcgagtggcggcttctctcgtgtgcaccaggactgtgaaggtacagcctggagaggcaagaggttggtggaggctcccccaccgccctggtgccagccactgggcccagcctcttcccacttcccttgctggctcagcagcacccccagagcagatggcaaagcaagtgctaagaaaagccccagtcaatagggagatggaagccaggtagaatcaatcagggaagcttcccagaggaggtggactctcagggttaggaagagatgagtctcagaacagccaaacatggacctgggaacacagaccaacccgagataaccatggaaatgccaagggaagagagggtggggagtggacacacctggggggttgtggtccaggacggcatcgcacacgctgatcttcaggatgaaggcccggagcagctgctccacatgagacaacagcgagtctgagctgggagtgagaggaggtcttcccatcacactggcgccctcccctccaccacaggcatcaagcctggatgcagacctggggtacaagaccccctccagtgcctgtgagagtgctgcatgcctaggacccagctccctatccggtccacacaattaaaccagcaagggagtttaaaagaaatgcccagccccaccccagataaagtcagaattcggcggggggtaggggacaggggaggtaggggcagcctgaggaggcctccctaggtggttttaatgtgcagccaggacccagaaccaggacaccaagccaggaggggaaagggcttgcctaaggccacacaggccgtggggacaggttggtgccagattccagtgccctgacctcaccattggaagcatgcagttgaccaactaacgcatgtgccagaggtcaacttcgagttgactggacacttgcctggggagtcagaaaactgcttctgtgtcctgggctctgcccccacccaggtgaccctgggtagctcatgtcatctctctggacccatctcagctgctcacaggctgtccccttgtcatgctggtgcttcttgccctttctcctcccaggcctttaccaaggtattcaagggccgccttaaaggggtgggtgtgttgccagagacacacctgatgccagctagtgggcgaggggcaggggcagcccacctgatggacagcagtggaggctgggtgatctcaaagacgaatttctccactgggcggtgctctttatccaaaatcaccaccaccactttctccacatcattctgcaaagagaggaacccccactgcagagccaggcaccccaccccgactacaccaccctgcctccacccccttgcccaaggaaggaggagaaacggcccactcacagccctgctcagctgctaggctgggggtccccaagaggccagatagcgagtttgagaagccggcaccctccagcatgagtggtgtaggctgagagaatgcccgggccccatagggaaggtcccaggaagtctgagatcaggactagatggggaagaaaccctgaggggctcagctcagacagaacgtttagcgtggagaacaggggacggatgtgagaagaaccccgaaccctctggggcagcccctacttagagccagctccaacccgggctcccaggcccaaggcaccctgaacatggcccgcatgccttggggcctgcccctgggttgggatggtctccagagtgcagggaacaggcttctgggtattggagccatgaagaccccacagagtcctagcttcaccccatcccagagttggactgtgagcacacagggacgggggtgagcatggggtgagatggctggggagcccagtgcaccctcaccttctccaggagtggcttgacgcagtgcagcgtgtcctggatatactgattcagctccgggtggcaggacatctgcacacaataccatgcggctcgtgaggcccaaagcacagatggggaaaccacccaacacaaccaggagcctaaggccccatctgccttcggtccgaggcccagcagctctccagggctccctacccaggagaccccactttccctcaagaggctaagaactggccgggcatggtggctcacgcctataatctcagcactttgggaggccgaggcaggtggatcacaaggtcaggtattcgagaccagcctggccaatatggtgaaaccccatctctactaaaaatacaaaaattagccgggcatggtggcaggcaccttagtcccagctacttggcaggctaaggcaaaagaatcgcttgaacccgggaggcggaggttgcagtgagccgagatcacgccactgcactgcaacatgggcaacagagcgagactccatctcaaaaaaaaaaaaaaaaaccagaggctaagaactgtgaacttatccatagagaaagaagttagaagataagaactcaggctgggcacagtggctcactcctctaatcccagcactttgagaggatgaggtgggtggatcacctgaggtcaggagtttgagaccagcctggccaaaatggcaaaaccccatctctactaaaaatacaaaaattagccaggtgaggtggcacctgtaatcccagctacttgggaggctgaggcaggagaatcacttgaacctgggaggcggaggttgcagtgagctgagatcaagccactgcactccagcttgggcaacaaagcaagactccatctcaaaggaaaagaaagataagaactcaatcccaatatgagcatttaatataccattaggggttcttaatgtggggtccatggactcctccagagtctgaaaaatccctaaagttgtatctttgtgcacttgggcatttttccagaaaaaggatccaggaaaatgtaatcagatgtcaaaagttaagaactaaggaactgtgtggcctcaggcaaattccttaacttctctgggcttcaatcacttcatcataaagaagaagtgagtaaatgtcaattgttttttcctttcccctctaaaggtgaccttcaacttactatgggtttatgtttggataaaccaatcaaatatcgccagcggaaaatgcagttaatacacataacatacagaacatcatagcttagccaggcctacctaaacacactcaaaacacattagcccacagttgggcaacattatctaacacaaaacctgtttcataataaagtgctcacgcctgtaatcccagcactttgggaggccaaggcaggtggatcaccagaggtcaggagatcgagaccagcctggccaacacggcgaaaccttgtctctactaaaaatacaaaaattagccagatgtggtggcacacgcctgtaatcccagctactcgggaggctgaggcaggagaatcacttgaacccaggaggtggaggttgcagtgagccaagatcacgccactgcactccagccagggcgacagagcgagactcagtctcaaaaaataaaataaaataaaatataaaataaaaaataaagtgctgactacctcaagtaatgtcttgaataccatactggaagtgagaaaacaatggtggtgtggggacttgaagcggggaccacctggatgtcctttgagcttctaccacttattctcatgtttcctgagtgccttccagagacaggcacttctagggactggagctacagtgcgatgcacactgctttgtctgccttttagccttaacccattgagtttaggataaatggtagggagaagatttggaggtttttggaaataccctcctcacaccaaggttcaccagcttcacgagctccttcaaagtgccaccatgcccccagggtaacttttttttttggagacatagtcttgctctgtcgcccaggctggagtgcagtggcacgatctgggcttacttcaacctctgcatcccgggttcaagcgagtctcctgcctcagcctccctagtaactgggattacaggcgcgtaccaccacaccaggctaatttttgtatttttagtagagacaggatctcatcatgttggtcaggctggtttcttgaactcctgaccttgtgattcgcccgcctcagcctcccaaagtgctgggattacaggtgtgagccaccatgcccggccacccccggggtaactcttatcaggcctggtccctaacttctggcaaggggaactctcttctgaggggtgggtaggcatcaccactttggaactggaaggcattggaaggcatgggcagggccctgcggaatgaggtggcttggcccgaagtggaagaggtttttttttttttttttttttttttttgagacggagtttcgctcttgtcacccaggctggaatgcagtggcacaatttcggctcactgcaacctccgcctcctgggttcaagggattctcctgcctcagcctcctgagtagctgggattacaggccttggccaccacgcccggctaatttttgtatttttagtagagacggggtttcaccatgtttgtcaggctggtctcgaactcctgacctcaggtgatccgcccgcctcggcctcccaaagtgctaggattacaggcgtgagccacggcgcccgaccaaagaatttttaaaagtccaccctgtacccactctgtggttctgggacgtgcctcacctggaccggcacgttgtacttcttgcgtttctggaagatgcccacggggtagacctcgcgcacgtagaggatgagatgcacagccacctccaggaactcgcagagcacatcggccaccactgcaggggggcacaagccggtggcgcgctcgaggaagcccgccggcccagacgcccccgcccccgggcccgcaggtccagcctccctaccttggccaaagttgaggtcttgtcgtgtgagcgtggtcatccttcccgctacctgagtgttggggcaagggcagagggtagttccagagacccaggagcccagaacccgctcgcttccaccgtctcttccctccccacagtctgtgggaactggggaaggacctcccgcttcgcacaggctcagggcagctggaagaacctccacccccacgctggcgtccgtgcttgggggcatcagcctctatccactggccgcccgcgccccctcgccccgctgtctcgcggggtggaaagaccacagctgtgcccccgaaaagggcagggccgcggacgcagagggaaacagcgggatgcccagggccgggagcgcaaagcgggacatgcggaaagcgaagcggggttggaataagactccgccccctgctacgccggatccctcccggcgggaatcccgccccctctcccctcccccagtaccggctctgcgctcggttcccgcccgagatcgggcccggccccgccgcggggagccaccgaccggaccgatcgcgcctcccgctcaacccggggcctcggcgccgctcggtgacgttcacggcgctccggtgggtcctagcgcccgccccgcccaggccacgcccattcccgcacggcccaaaccgggcctcgcagagggcggttccgcatgcgggggcgggtctccgaggggcgggggccgggcctcggcgtccgggaggggctgagacccgccgcgccacctcccttcaacttcgggtgggcgcgaagaaaacacaacgttgatctccacgttccattggatcgctacatatcttcccccgagggcatttctctcgctttagcaggcgccggaagagggctggggagggacgggggagcgcgcagctggggactaacggcagccacatctgagctagcccgagtcaccatccctgcagctgcccacgcaaaagcgaatcctctggctcgggggcgggaacaggggaggacaggattgtaccggttgtcaaggcccgggtgaaattttaaaaataaaaaaaagagggcgtgcaccggcgtcgcccctgctccgcccccaccgggtacctaaatgcagcctggcctgaccgcccaagaggatgaaccctccccgccctacgcttcataacaatagctgacctttttggagctccagccgagtgctgggcactgggctaagtgtgtccgtggattatctcagtcctgggagtaactccatgaggcagttactgtgactgttctctttatacagataagtcaagcgaggtgcagaagggtgaataacctgcccgagtctcccagctggtggggtgggcgatggccgaggtgcctcctgccactacattttactgctcccaagtcccccaggggcgtggactcggtctggaagtcctgtaagggccctcagagatgatattactaaaataataaaaaataatgactaacatcgagcacttcttatgtgtcaaacactgattccgttaattctctcattaaccctagcagctaagtctccattttatagccccactttacagatggttaaacaggcccagaaacgttctctaattcgccaaaatcacacagtgggaatacaaacccagctctgatgcctcttctgacaccagggcttccacttatttacagcccccttattttacaagtgagaaaactaagatctgagaagcagctacggagttagtgggcaacaagtcaggaccagaagccaagaggactttgtctgtgacctccagggacgtaagagcttgttagtcccatccgtctgtttggacacagatctagccagacttgtttatcgtttacagctcattatagaagacctggatccctccccccgccccctgatgccttcaaacctgcatttccagacttctaatggggagagaaaaagtaacctgtaagtaacccattaagctaggaatgtcagcaaaacatttcttcaaatgcagtcctaggaaatctgcatcagaatcccccaggagcccattaatcacagctgccctgctgcctagagcaacctgatcgaggtggggtgcacagcagggcactggccctttaacaagctccccaggggcccggatgcccagcaaagtgtgggaatcaccacagaggtttggactgttcccagagaatatcttcattttgtaaaaatgcgatgcattttgtaaaattgtgatgtaaaatcatccatccaaagggatggatgattttgttttaggaactggtgcacttggcagcacattctgggcacagcaaccattctcaagatatggggatcctgcacacatcatgccatttccacacagagctggccaagcaactcactggcttatacacagagttccgtggctccttgagactgactcattgcagaacttgggaaaagcaagggtctttcctttccctctctggaggctgcttaagcagcttttgcattggtgacaggcagtggcagtcatagggggcaactccttgcaaaggagcccttcagactggggcctggggtggggaaactgagagccaagtgactcctgtgggatggccttcaggacacagtgtgaggggcattggggctcaagtcaggccctccctccatgagctcccagccccagccctctgccctgagaaaacacaatacgagccacccgtagaactcctgacacacagagctaagaacgtcagaaaaaccttggaggacataaactcaactgtcatttttccttggggaaactgaggtcccaacagctcttgacactggagtacccaccctgtcaactagaaacctgtggataaaaatatctgggtttgcaaatatcatatgttctcacttgtaagtgggagttaacctatgaggatgcaaaggcataggaatgatatattggactttggggactcggggggaaggaagggtgggaaggtgagggaagggtgggaaggtgagggacaaaagactacatactgggtacagtgtacactgctgaggtgatggatgcaccaaaatctcagcagtcaccactaaataacttacccatgtaaccaaaaattattgcaattaaaaaaaaacgtcagctgggcacggtgggtggctcacgcctgtaatcccagcactttgggaggctgaggctggtggatcacctgaggtcaggagtttgagatcaacctgaccaacatggagaaaccccatctctactaaaaatacaaaattagccaggtgtggtggcgcatgcctgtaatcccagctactcaggaggctgaggcaggacagtcacttgaacccgggaggcggaggttgtggtgagccaagatcgcaccattgcactccagcctgggcaacaagagcgagaactccatctcaaaaaaacaaaaaaagtctgggtttggggccttgggttcagatccaatcacaaacagaaggaaggtgggttaggaagcagatggggagggattcaaacccatctgaccccaaacccctaaaaggcttcagtctcattagtgaaatgaacaggccagatagatgttccctaaacctctgatggcctcaggttccatgggggcgggggcaggggcagggggccgagtcagcatgggcccatccggggagctctgccaacactccatccatgcgctcttcagcatctggttttgcatatcttaatcgcatcagcatgatggatggttgtgggatccagattacattatggggttaatttattacatttttgaacatccgtctgctgggagactgttgttcaaagttatttgcatatttttcaccataatgacaatatgtaggagggcggctgggaaggaaggatgggtgtttagggggagcaagagtttatttgccaactagagcaggtccctgaggatctctgatggggacggagggaaaatcactcccaagagacactgaaatggaaactgagaaggtgagctgtgagcaccagcccagcaaagaggaagacctgctcgggcagaggaggactgctggggtttatggaacaaacccacagtgagtgaaccgggcaatgaagtttccagaccccagaaatgattccaagacccctcccatccccaccaggctgatggcagaatgaatcagctctcccaccctgcctaaggttcccaggacaccaatcacatgggtatgggggacatacagagtgagacacacatagcctggtgacaatctcctgatatcctgacgctcaggggcccatccagttgcaatgctccggggcagggacccagccctcattcattatttcaatatagtgcctggccaaattcaggttctctctctctctctctttttttttttttcccagagacagggtctctccttgtcacccaggctagagtgcagtggggcaatcatagctcactgcagcctgaaactcctgggctcaagggatcctcctacctcagcctcttgagtagctaggattacaggtgtgcaccaccacacctggctgatttttcaaattttttgcagaggcagggtctccccatgttgcctaggctggtctcgaactcctgggctcaagtgatcctcctgcctctcaccctcgcaaaatgctgagattacaggcttgagccaccatgcccagcccgaattcaggttctcagcaaatgtgtgtcaaatgagtgaatgaaagaatgaatggcagaggaatgaagtgatggtggacagtggctcattaccacttgcctgacttgaatcccaactgagtctggatgaggagcaaaacacgtcgacttcagtgcccgggctatgggtggcactatgcagagaaaagctattttcaaaaacaaaagcaagggctgtggcatgttccctatggtgtccccagcacccactgggcctgctcatgtgtccaacctgctgcttctctccccaacactgccccttaaccagctgcgaggcccttctttctctgaacctcagtttgctcatctgtaaaatggcataatggtagttctaatttcataggattgagcaaagagcaaatgtttatgtccatgttcatgtttataaaaaatataaagtgcacaatgccaggcatggtggctcacgcctataatcccagctttttgggaggccaaggtggacggaccacttgagctcaggacttcgagaccagcctgggcaacatggcaaaaactctacaaaaaatataaaaattagctgagcatggtggcgtgcacctgtattcccagctacttagggggctgaggtgggaggatcacttgagcccaggaaatcaacgctgcagtgagccatgtttgtaccactgcactccaacctgggttataaagtgagaccctgtctcaaaaaataaacaaataaataaagtgcacaatgcctggcacataaatgctcaattaatgactgttatgacaatgatattaaggtctatatacactatttaagcccccagaacaaaccctctggacaagctgtcacacttttcaaaaccccatccaaaccatccttagcggcatccccatagctccatttccatttcccaaggcagcaggcaactcccaaggtgccctagggaggacacgcatcatcacggaacaagatgcctaaagacaaggacttcctgctgacagctcctctccgctctcatctgccttctggtgtgaggcctgacctggacagctgtcccagatcccagggttcactgctgacctgagatggcttccgacacttcagccagagcaaagccctcacctgccattccctccgtggggttctactgattcccagtgttgctgacccctcagtggtcagggggaccttactgatcatctgctcttttttcatagagacagggtctcgctgtgttacccaggctggtcttgaacatttggcctccagagttcctgcttcagcctcccaaagctctgggattactggcataagccaccgcgcctagctaatttttttgtacttttagtacagacggggtttcgccatgttggccaggctggcctcgaactcctgaccccaagtgatgtgcccgcctccacctgccaaagtgttgggattacaggcttgagccactgcgcccggcccagagacactaaatgccttacacaacatcaggagtgtccagatatattcagaagccatcctgggccacaaggtaagaacttttgatccagctcaactgccactttaaaaaaaaaaaaaaaaaaaaaaaacttctctgtggagatataattcacaaaccataaagttcacattttccctgggtacaattcagtgatttttagtatagttacaatgttgtacatcgctactctctaattcggaacattttcatcactcctgatgtcttgagaagggttgttcatgcccaaagtgtgttgccaggtacatcagttccaaaactactaatctactttctgttctatggattgtccaatttttttatttttttattttattttttggagacagggtctcactctgtcatctaggctggagtgcagtgacgcaatcacagctcactgaagcctcaacctcctgggctcaagcgatcctcccacctcagcctccccaatagctggggctacaggtgtgcaccatcacacccagctaatttttatttcatttatttcttttttgagacggagtctctctctgccacccaggctggagggcggtggtgcaatctcggctcaatgaaatctctgcctccccgattcaagcgattctcctgcctcagcctcccgagtagctgggactacaggcgacctccatcacgcttggctaatttttaaatttttagtagacatgaggttttgccatattggccaggctggtctcgaactcctgacctcaggtgacccacctaccttggcctcccaaagtgttgggatgacaggcatgagccaccacgcccagactaatttttaaaattttctgtagagaaggggtctcactatgttgccaggctggtctccaactcctggcttcaagaggtcctcctgcctcaccctctcaaagtgctaggattacaggcatgagccactgcgcctgacctggacttgccaatacggaacattccatataaaagtaattgtacaaaatatggtcttttatgtctggcttgttccacttagcataatgttttcaagattcatccaggtcgaatcacatattgatacttcattccttcgtagaaccaaaatactcccgtgtatggatagaccacatctgcttatccagtcatcagttgatgaatattggagcctgctttggcccctcaagtacctcattttacagacaaggaaactgaggccctaaagtcatcataaactggatgggataggagtccaggcctctcctaacatccaccttttcatattgtgtcaccccagctccaagcacatcggaagatcacccagccaggggacagccacagtagcagcatttgaaccagagactccaaggtttttctcctggctcatgaatactggcccacagctctatccttggcgacgcaaatcatgctggctgcacactgccccctctcccaggcccaggtgaccatcatctcttctctgccacagtacttagctggtctcttgctttcacccttgtcccactgcagactactcccaaccttaggaatcagcacacgtggccgggcacggtggctcatgcctgtaatcccagaactttgggaggccgaggctggcgaatcacctgaggtcaggatatcgagaccatcctggctaacatggggaaactctgtctctactaaaaatacaaaaaattagccaggcatggtggcaggtgcctgtagtcacagctactcaggaagctgaggcaggcgaatcgcttgaacttgggaggcagaggttgcagtgagccaagatcgcgccactgcactccagcctggacaacagagcaagactgcatctcaaaaaaaaaaaagaaaaagcaatcagcaaacctgctaaaaacctaagtcggatcatgtctctgctctgctcatggtccctctaaaaagctcaagtcctccctgtggcctttgcaggctcacattgttagaggtgtctgaaccagagcaaccccatcttgagtaggggctgggtcaaatggggttgggacttgctgggccatattcccagatggctaaggcattctaagtcacagtatgagacaggagatcagcacaagatacaggtcataaagaccttgctgataaaacagtttgcagtaaggaagcctgtcaaaacccaccaaaagcaagatggccacgagaccaacctctggtcatcctcactgctccactcccaccagtgccatggcagtttacaaatgccatggcaacatcaggacgttaccctatatggtctaaaaaggggaagcaaaggccaggcacactggcttacccctgtaaccctagcactttgggaggccaaggcaggcagattgcctggggtcaggagttcgagacccgcctgggcaacatggcgaaaccctgtctctactaaaaatacaaaaaattagctgagcatggcggtgtgtgcctgtaaccccagctaactgggaggctgaggcatgaatcgcttgaacctgggaggcagaagttgcagtgagccgagactgtgccactatacaagcctgggcaacaaagtgagactctgtctcaaaaaaaaaaaaaaaaaaaaaaaggctgggtgctgtagctcgagcctgtaatcccagcactttgggaggctgagacaggtggatcacctgaggtcaggagttcaagaccggcctggccaacatggtgaaaccccatctctactgaaaacacaaagttagcgggcatggtggtgtgcacctgtaatcccagctactcgggaggctgaggcaggagaattgcttgaacccgggaggtggaggttgcagtgagctgagattgtgccactgcactccagcctgggtgagagcaagactccctctcaaaaagaaaaacaaaaggcggggggaggggagaagcatgaataatccaccctttgtttagcacatcatcaggaaataaccataaaaatgggcaaccagcaacccttggtgctgtgctgtctatggagtagtcattctttttattcctctactgtcttaataaactttttactctatggactcgccctgaattatttcttgtgcgagatccaagaaccctctcctgaggtctgggtcaggacccctttcctgtaacaacatggtcctatcccagctccctgtctgatgtcacctcactctgttccagactgactcttctccaccaaacacaccaagcacactcccgctccaggacctttgcagtggctcttctgcttgcaagtcttctccccacaaccacgtggctcattacctccttttctttgccaaaagaactgccccagcaaagaggcctttcctaataactttatgtaaaacaacacctcgtcccttcatgctttgtctgtaatgtgctttacttttcttcatagcactaatcaccacctgacatcatttatatttatttgttcacttatcttctgtctccttcactagaatctgagctccatgggggcagggattcttgtccatgttgtttactactgtacctccggtgccggcacatagtaggtgttcaataggtatttatgggatggatgactcaaacctttcagtgaataaacagttcagtgttctcatcaatccatcctggtgcccaccaagctaataatatcacggtaacaatggcagctaattttacaggagcatttcctatgggccagaccttagaaacgttatctccttacacagggcactgcattcacgcctagaacactgaaatttaggtataatcatgagctcagaggtcaggcgacttgctcgaggtcataggggacggcatcagaagaggaacacagacatttagcctgacggcagaactgtgttctaaaacctcaaagtcataatttgccacacgctggagaaagaaaacagtcgaaatggaagccacctggcgagctcagggcgccaggtgggagcgctgcttcccacatatgggagtccggccccatcgctctttgatctttgcagcgtccgtggccccaccgaccccgtcgtgagttatgggaggcacgggacccataacccagcattctcagactcccagggtcgtcaggacacggcgccccgcgcggtgatggatgagccggccccagcgctggctttgtccgggttgggccggtctgagaagcttcaggccggctttggacggggcgtggcgagagccgcgccgcgtgtgagtgtgtgtgtgtgtgtgtttgtgtgtgtgtgtattggggcggttgtctttctcccttccctaccgggaaagagggcacaggtgcgccgtcagcgccccaggtgagctggtagcactttgaagaccctttgtacccctacatccaggagcgacctctcggagaaccccgcctgcccactctgcgcactttctgcggctacaaaggccccgccgttccccgtcccgcctcccccgccctgggcatttcttccgtcccttttgacagtctaggcggaataatccttttgtggccccgggcccctgccctgacagacgcggccgcagctgagcgcgcagcctcgctccattgttggggtccaccgaggaccgcccgccgcggccctttgtcgcccgccctgcgcggggccgctccagaggcgccacaactgccggagcccctcccgtcccacgcgccctgggccgcgccgaggcggctcttacgcaccgggaggagtgggcctgcctcgcccggtgcccgcacggctgctgggctgcgcccgcctttgtctgcctcctttgtctgccccgcgccctcgcggcggcggcgcctaggcctctggggagctggcccagaactcagagcgcagctggcgagggcgcgctggccgggtgcgcgccgggcccggccccggggctgcccctcggctgggggcagtcgagcccgccacccgccgcccctcctctgtcccctccccgcgctcccgcccccttccctcctgcccgcccactcccccttccttccagtcccgctcagcccgggcacatcctccggctgcccgcgcacctctccacgccggccccgttccgcggctcgccctcgg

SEQ ID NO: 144 - DNA, 89648 bp, Homo Sapiens
agaattttaaactatttttattttaaagttatggcataacatataacataaaaatattttatatacgtttgaaaaatctataccgttcttttttatcatcaaagtttctcaatggccagtagaagcaaaaagacaacaccacctctgatctacgggacataatgttcccaggaaaaaaatcttcaagtgggtgtgagggtgtttctaattcaaaatatgtagatttctccgcatggaagaagtagtaaagattttcttaacatgctcctgtgttcatgcttggagacaagaataagatggtttagaagctttaccctttcttggaacaagtagaatcccggtctgagacctctcaggaatttcagagcttagcagtctggcctggaggtttttcagccttttagtataataaacagtagttgcttcctagagttgagtttttaaggattcacaaaaaggagcctgtacaaaatatacatacagttctttattaaacaactgtaaacacttcactgtaaaaatccataaaactttataaacaaacattttgtaaatagaatctatgctacagtaaaataattaacacaattatttacatgcaatactgacaaatttggcactttttgaaaagaaatgtacaaaacacttgctttaaaagaaatttaaaattataaaaactccgagcattactatcatgcactttgcaaatacctcacaagcacttatggcacagctatcagagagcatcaggctctctggtaatatttatgtaacttttaatgtgcttccataagtttgttgtaaaaccacctggacattgtcaagaataaagtcaaatgccatattccaaaccgattccaccgattgctgcatcagcctaaaggtggggagagaagaaatgtcattaggaattaggaaaggtccttaagactaattattcctttttatatataaaaattgactttggcaaaaaaaaaaaaaagtcctggccaggtgcggtgtggctcatgcctgtaatcccagcactttgggaggccgaggagggcggatcacctgaggtcaggagtttgagaccagcctggccaacatggtaaaaccccgtctctacaaaaaatagaaaaattaggtgggcatggtggcacatgcctataatcccagctacccgggaggctgaggcaggagagtcactggaacccaggaggcagaggctgcagtaagccaagatcctgccactgcactccagcctgggcgacagagtgagactccatctcaaaaaaaataaaatcctagaacactcaaatttttttttattttgttttgagacaagctgtcgatcaggctggagccatgcagtggtgcaatcatggttcaccgcagcctccacctcccaagtaactgggaccacaggtgggcaccaccacccccccagattatttattttttgtatttttcagtagagatggggttatgccattttggccaggctggtctcaaacgatccacccaccccagcctcccgaagtgaagtacaggcgtgagccactgtgcccagcccacttcctatggttttttaatcacatgtaagaccttgagggcaacatatttggaaccttatttgctacttagtcaacatggcaaaataaaggatatcactttctcattaaccctaatgagtacagtttcccagaaagtttaaaacaactcagtacaccctcagccattgtgacatgccattttttcccatttgataaaagtgatgaattactaccttttcatgtattttataactagatccagtttttccaaatctttttcttctattagatcagtacagtatttcacaacttggagaatgtcttcttccattggatctaggaagggggaaaaacttcaaatgaggaccagtctttttgaaggagaaagtcagagatctgcatggataaaggaaaactgcatttctacaactatgtcactaacagctatcaaaggaatgggctttgttacttttcaaagcaagtcccagaatttaaaagatttgggggtagctgctttaagcttatcagagttagagaaatgggttaaatctgcatagtttagtctgtttatgttctcaaatcatgagacgactacatctcagccttgggccatctaacacaggccaagccaacctgaaattgtagttatccattctctgagcaaggtcttcacatcattgaattcaacagctccagctagattgggtgctggaggtctcacacagccagctgggtcagactgcaaactagaaaggcctggcacacctgaagtagaagcagagagttcttcctgttaagaaaacaaaggataaaattgctatattcacacattatccaggtatattaagatctcataaaggtcaaagttaaggaattaccaggggtttctctgcaggaggtccttcatgttttagaaacccatcaattaacttctggggactgccacaggcccctggcagagtttttgcaggactgttaagcagcttgttattcaaaggactctgaatcctttttggtgaaccaatggtttttttcttcttgtttcttttcttttctttcactgctgcctttagatgaagtaaaggattctttggcactaagagcagatggatataagatcctcaacaaaatgatagtatggatagtctggatgacagtattgggttctcttttctcctcccaaatacaacaggctccctagcctacacctcccctcctgccccaagtgagaggcagtgaatggcaatggcccaaagtacaggctctccaattctctctttgctttgccacttactaatttgacctttggcatgttgctcatctatgatgggtagtactaaatgtgggtttgatgtttgtgatgcattttgaaccaacatcctttaatgtattcatctcaaaggacaactagctgaacaagtatttaagacatttgtggtaatgtcctattccaactttttaaaaagtaaaaagtggtgtgtttaaatcctgaaagtacagacacaaatccaactagaaatatgatgatatttactcatactgtatacttcagatattatcccaatatgaagagctcttaatgcaacagcttagactttgcccattatatactgcaataattagacaacagtgactccattactctttgtcttcatttttgttacatgccacttccaaggctcaccagatgcgctggctgactgctggtgagtgctgttctcgccctgcctttgtctttgatcatacgctgctttcagctccctctgaagttcagcaggaagggcagcaaatacctcagggtccacctagtggaaaagacgaggtcaaagtcaaacctgagctaattgtagatggtagctggtttctctttttcacaaaacagactttgttttcaaatctcacttttctgatctgtacgaattcttaacagttccccaatatcaaagctgattaaatcttcaaaatggttagagcaagaataaggaattaagagcaagaataaggaattaagagtactaacttaaagaaacccactacaacagcagaacctgggcaaaatgcactagtagaaaatgggaagcaaaacattgaaacagggactcaggttgttactgtcccccatgcaggattatacatctccgctctgttgtattcaagtgtggccattgatgtgtttgccccagatcagtgtgtttctgtcttagcatgccctcccccgtctcttccctgctgcttcagcgggaggctgctctgtgtctacatcctgcagatgcaggagatggagacaagcccactctcccctcccctcccctcccctccccagtggatgtggtgtcagatacagaggagaaagggaagtgagacaggtcctaagttggagcaggggggtgagaatattgaaactacagcagagggttcccatatttaacttacctgtgaaaatgctggaagggctattaaatttattcctgcgtcactgttcgattcttgaggttctggtatttgcaacaagactgtcccaactggttgtggcaaaattcctgtattacagccatttactggttctttctttttgtcgccatgtgactctgcttgctggacagcacagacttgctctacttgttcccggagatcaggtggaagtgcttctaaaacagactgatccagctataaaatgccaaacatatgagtaggaagttaaagcatgctcagagatgaggtgtttgggagttaacacgccactttaaatttcaatttgaatactgtggataatcaatgtaaggtacagaccatcaagctaggaaagccacctccaaatcagcacatttttggaacgtcttggccttttgtcattgaagcctgaagtactatgtgtagtctggaaagaagtgtatatatactaccagccactatcacatgaccaggtaagtccaaatatactcacagaatgtcctgcaattggggccaacagatatgaatagccttggtgaagctcaaattagatcccaccccagggaggggtgaaggcctgaggcacatgttaaaattctggacaggtaacagtcctgggtcaaaagttcacctttcagatgagagactgcccaaaaatacaaataattctactctgagagcagcacactggaagaaagggtttctagaagctgaattttctctaacttacaggacagaatccactgttcctttggccagggcctacctgtgcatccacatctggccctttggaaacatgcaatcccatcaactgggtggaccaatcttatcttgccaggagtaactaattgtgggtatctgtcgccatacaagcatatcagcattgccctttcccctagttttgcagccagtatttaacatctccttccgcctccttccatgcagggggagcagaggcacaaataaacttgcccaatatagcttaaggtgctaccttactttcaaggaccagcagtatatcacatgtacagcccacacacgctgaattaaaccatccaaatctccagagacctgtttgcaaatactgcaaaaacccttcgacataaggcctctacttcaccactaatcaccaaagctgccttgctgaatacagtaagtctgcatgatgaccactgtcacagacaatggcagtccacaggaggactgcctttcagctatgctttacaacttgcaagagtggcaaatctttgcaaaagcactttcactcaacccaaatattgcttatttagaatccaacatcatgatctacccaaacaagtggcccgttctccctttcttggttaaacggatgaagaaataaaaatgccattttcatttgtaaacttgtatttttgtatttatatttaggagtataaaatgtacttatatttaggactacaaaaatgtacctgggaaggtgacgggacctctatactcaggttaagtctcgactgcacactgacaggagtatgtagaccattccatttccctgaagactcagccttgttagtatcaggactggtcggcagatgtgcaggaaaaggtggcaagaaagtgcaagttctagaagcagatgatatttccagatccacagcagcccgaaatactacaaaaagaaaatatataaaatagcctcttcagatcatcgggcagggcctttaatcctctgtccattacaaataaaaaaactttattactgattcatcataatgaagaatataaatttttaaaatcacataaagctgtgtcaattttaaaaccaactgccgtctttccaaggacataagcagcacctaaaaaagaaccacattgatgaccaccaaccttctttgtgctcctcttcggtggatttcttagctttctgaacttggaagacatcacggacagagtatgacccactaggaaagtggcttgactgaactgatgggcgactgggacatgtggaagggttcagattagttggaaccaactgattcacgtgaatcccaacctagaacccagaataaagagtatgcttctaggaaaactaaagtgaaaatatgaattcagctaagcaaaatcctcagcaaatccttttcactatctcctggatcctgtttctagaataaaggtaaatgaaagtattcaaacagcattctatatgacttattacaaaaacaatttctaaagtagctagtgagtggtcattcatctcaaacttcagagtatccaattctcccaaaatataccaaaagatctttaaaatcagaaaatccaaacaagtggaatactgtattccactgatgttctcgtcaactaaggttttaaattaggataaaaaaaaattaagagaggacagtctacttggaaacttcactatttttatcttttttaaatgaaatacttctcaaaaaatattggcgggagtgatgaacagcaggtacactgcagacccctccataaagtgccattataacagtatttcagggagaaatcacaattacggctggcttagtgactaatctttcaacaaagcccacatcaagccagaacaaccctttacttacatatgcacacataaaactaaacctacaaaggttctttttttttttttttttttttttttttgagacagagcctcactgtgtcactcaggctggagtgcggtggcacgatcttggctcatgcaagctctgcctcttgggttcaagtgattctcctgcctcagcctcccgagtagctgggactatgaggcatgcaccaccacacccggctaatttttgtatttttagtagagatgggggcaagtgcctgtaatcccagcactttgagaggctgaggtgggtggatcacctgaggtcaggagtttgaaaccagcctggccaacatggtgaaacctcatctctaccaaaaatacaaaaaattagctgggcgtggtagcgggtgcctgtacccccagctactcgggaggctgaagaaggagaattgcttgaacccaggaggcggaagttgcagtgagccgatacaacgccattgcactccagcctgggcaacagggcaaaaactgtctcaaaaaaaaaaaaccccacacaaaaatctatggttttgacattttgatgcctcttgcctgtttcaaaggcatcttgatgtgcctgtggtttcactcccttctaggtcatcatacagcagatgcagagtatgtttctgattaaaaaggaacttaaaggtacaaaatttatgtattcatattcctcacagtcatatctacttctaggaaacaagaacagggaagacatgtatattagcccctggttaatcaggggtaccttggaaaagtacagtaagaatctaagaaaattattctaaaatgaaggaggtcaaaatggaggaagtcaagaatttttgtttctcttttccttgtattacaaagcagctaaagacctacatataaagtccctatacaccagcaataacccttttgagagcaagcctcaaaaatgagagatacattacacaaagtcagaatttacaatgttactatatacttacccctctcatatctgatatatttagtttcattgtatgaaacatgtttagcatcgcctttccaattatttttgcattatctgttgcctggtcaagagttacagtcctgtaagtgatagaattaaaaaacaaaagcttcattccatatgtattcactagtactaaagtagtatggaactgtttaaaagagttatagaaaagttgtaaacagttacaaagaagattataaaagtgaatgccatagtctcccttcaaggaagccagaaataccaaattagttacactggcaaccaagggggaaagaaaaattatggaacactagaactttaaggtaaaaaccgtaatggacacttaggtcaactaaaaataagttgagaaatttagaaaaaggtagattttagctaacatatgcacaaataaatacatattttccagctaaagcacaagtgaatggtaaacacaatgttcttgattccaagagaagttttaggttccaagattatgtatgctgaggtatagcaaatattcagaagagaaagataaattctctgtatgttgtttcttgactctcctttcattgtgtttacagtacagccaataaacaattcttagatctttaagaactcttgaaggaggaccaaatggtccatcagcattattaggtctcaaagatgtgctgacctcacccaccatttccttcagagccttttgagcttctctggcatgagcgggctgtcccattgcaaacagaattactaactcagtaacagattaacaaattactaccagttctctttccaaaggaaagttatttcgtgttttggatgatcctttccatgtataatgaacaaatgaagttccaggccattaaacaagaaatattcccagaaaaaattattataaattgaattggattttcccatagaaatgtttaagaagataatcacattacttcatctgcttatagaaataaccactaaaagctgagcacagtggctcacacctgtaatcccaaaacgctgggaggtcaaggcaaaaggattgttcaaggccagcctgggcaacagagcgagatcctgtctctacataaataagtttttaaagtaaataaataaatgaccactatttactatttgagatacatgtgtatcataacaggtaggtaaatataattcaagataaccaactgataaaaaatgtattttataaattatgttctctaattgtaatttataattcctgctttcatggtaacttgggagtttctctgtttaagagcagtcgtctcacgacttagcaatatcatcatatacatgaatgcaccatgtatggttggcatgagctaatctttaatgaaactatacttcatattgtaagtagctttcagtgtcaaaagtctcaaaattttggtttcacagatgaaatacagtgcaatataaaatgacatgtaaaaccacacatcttcatattggtcacgaatcttacatgaagtttaatattaagtagttggccctgacataaaagacgagtgtttcagaccgggcacattggctcatgcctgtaatcccaacactatgggaggctgcggtgggcggatcatttgaagtcaggagttcaagatcagccttgccaacatagtgaaaccctatctctactgaaaatacaaaaattcgctgggcatggtggcatgccccataatcccagctacccaacaggctgagacaggaggattgcttgaacccaggaggtagaagttgcaatgagccgagatcgcaccactgccctcaggcctgggtgacagagccagactctgtctcaaaacaaacaaccccccccccccccaaaaaaaacagcgtttttaaatgcttttaccagttttcagacattacagtgattcattcatctttttaccaattaaatgtatacacctatgtaaatgaagttgctctccttcaccatcatttttctagctactatagtctgcctttgtgtatcatttttttgagacagaatgttgctctgttgcccaggcaggagtgcactggcgcgatctcagctcactgcaacctctgcctcctgggttcaagcaatcctcctgccccagcctcctgagtagctgggactacaggcgaatgccaccatgtccggctaatttttgtacttttagtggaaatggagtttcaccatgttggccaggctggtctcaaattcctggcctcaagtgatccagctgcctcagcctcccaaagtgctgggattacaggtatgagccaccacacctggcctgtatcattgtttttaagaactacattgaaattttcctcaggaaaaaagtttcaccaagtcccgaaactatagcagtccctttggtctgcagccttgccctttctttctgtccatgcagtaaagttaacagcccaaagatgccaagcaaaggctgccaaggtcagcaatgccgtcaaaccaacctcctgtgtgtgggcctcgctgaaaccaagtgcattaacctaagctgaatgccttgggctgatgcctgcttctacagaataccagattaacgggtttacaggtctttattcaaactcctccttggttttcttcattttctattacttacaacaacctgtactgaaatataattaccaatatcatttctgaggtgagcttacctggcaatgttatcacaaattccatggcctccaaattttgcagtttctacaggagccccaggctttcgtaccatgattttgagagttagacgtttacccttcatgccagtggcttctagtcttctttgaatttcttctgaaagactcagaagaaaagcttctgcctcttttggctatggaaagacaaacgtggagaaactaccattccactttcctatatacctaataattgttctcaagtattttaactttgaatattaaacatgttggttactcactatcacgctcagcatctattaaaaagaaacgtggccaggcgcggtggctcacacctgtaatcccagcactttgagaggccgaggctggtggattcgtctgaggtcaggagttcgagaccagcctggccaacgtggtgaaacctcatctctactaaaaatgcaaaaattagcctggcgtggtggcgggtgcctgtaatcgcagctactcaggaggctgaggtaggagaatcgcttgaacccaggagacggaggttgcagtgagctgagatcatgccactgcattccagcctgggcgacagagggagactccgtctcaaaaaagtaaaactacaacaacaaaaactgtttggtataccctcaactattaaatacaaatacccaccttcccaacaaagtgaaagtaatgagtacttttaaaagatatttttcctttctttccttttttttttttttgagacagtctcattcttgtcccccaggctgaagtgcaatagcatgatctcggctcactgcaacctccgcctcccaggttcaagtgattctccttcctcagcctcccgagtagctaggattgcaggcgcctgccacaatgtctggctaatttttttgtatttttagtagagacggggtttcaccatgttggccaggctggtctccaactcctgacctcaggtgatcggcctgcctcagcctcccaaagtgctgggattacaggtgtgagccaccgcatagggcccctttctttcttttctatgccatcactgacttgtcgaaaattcttttgtaactatgttaataagttctgctaataaaatgtgtgttccaacactgtgcttacagcccaaacatcatctatctccatgcctaaggaaacaaaactcctgaggtccacagtgtaggcacagagggtaattaactcatcacatttcaaatccttatgatatggtgttgtttgtacatacaaattcaagacatatccagccgggcgcagtggctcacatctgtaatcccagcactttaggaggctgaggcgggcagatcacaaggtcaggagtttgagaccagcctggccaacacggtgaaaccacgtctctactaaaagtacaaaaaattagccgggcgtggtggcgggtgcctgtaatcccagctacttgggaggctgaggcaggagaatctcttgaatctgggaaacggaggttgcagtgagccgagactgcgccactgcactccaccctgggcaacaaagtgagactccaccctgggcaacaaagtgagactccatctcaaaaaaaaaaaaaaaaaaaaaaaaacatatccaaatccataatctgaaggaaaatggaaactactcagccatctgtgctgcagctttccaaaagcttgcataaggaggggtttgctgaaacttaattttaactacagcttaaaaaatatttcaacattaaaaatatttttctcatcttttttattttttcactgttaattagaataattataatctcaagttctctaataactggcctccaaagcataatcttttagtatatttccccaagagctaagtttcctcagtctcagtcttatctggggctacaccttaccacacagtgccttaaaaggccttcttaaggctctggggatacaacagttttaagacttaatttcaagcattgagggtctaatggtttagttgtagaggtaggactatgtaaaaatataaagagcaacagatggcaaaatctgttcaatgatcagtacctgagtaaaccttattccatagttgatctcagctgaaacagattttctttccttttcagttcgaactggtctatcatccaagccacggcagaacctataaagcatctgacctgttttgggaccaaattctttttggagttttgccatggtcatatactgcaagtctccacaagttttaattcccaaagatgccaacttagattccattgaatgtccaactcctaggaaagggaatatagttaagtatgcagaataagctactaataacaagtttattaacacaaaatacccaccatttatgcacaaaacaactagtttaaaataatctttaaagtctttaggcaacataactgaagcatccacaggctgaagaattttttggtgcaaaatcatgctagtagatgtatttctagactctacttctcaatttggactccacatatagatgaaccagaaacttttaaaatatgtataactcaagttatcaaaaatgtcactttctttattagtgaataataccaagatatgtatcttagtcacaaaatcaactaaggaatcaactgtcatttaaacaagtctatagtgtgacttacagacatactaaccaactcacgaaatgtaagggatctattatgatttcggtcatcaccaaatctcacagtggtatcagccacattttttcagtgaaaaacagaacaagaattcacaaaatgggccaaagtccagaaatgttacatgctatcacacataccactgacctgaagatgaaggaccctaaccaaaccaactggtggttggggtagaagacagactttttttttaatcaaaaggatgatctctctgaagagatatgaactctcctacagctgggccagcaggcagcagtccctatgtcctattctgcaagatgtaacgtttgagccccacctaaaggatactgattaattctgttgctctaagttggagtcttggttttcttcaatttgccctaaatgctttaaaaaggtccacaaatttgggaaagaggtttggagtaactgagggaaactataatgcttattaaaatggttccacaccatcaagtaaaaattttccatcaatgaggaaaagacagcgttgtgtttctggtcttctgtaggaacttatcaaaagagaactcaggctgggtgtggtggctcacacctgtaatcccaatactttgggaggccaacagtctgagtttgaggacaacatgggcaactgaggtagaccgtctctataaaatagaaaaaagaattagctgggtgtggtggtgcgctcctgtagtcccagctacttgggaggctgagttggaaagatcccttgagcccgagagtttgaggctgtagtaagctatgaacctgccattccattccagcctaggtgacagaacaagaccctgtgtttaaaaaagagagctcagagtgaagtctgctaacttctgttcatagctcccatcctcctgagtggtcttcagtagcagaaaaactatctagtccaagttctgccaggaaaacctctggaaccagtatataacacaaggttaggaagtcatcaatgtgggtcagacaagtttaaacccagacactttattccttaatggaagtgagatgaaggcgttaagcgtgctcgttcacaattgtgccattttaaagtccaagccagaacaaagggcaagtaaataccaaagaccccgagttaacaatttaaaaaaaaaaaaaaattcctccagagaagtaccattcaccaaaaggtaaaattttaagtgaaacctaagtgcttttcaaaatggggaggagaaacacaagggaatagacaaattacatacttgggtttgtcaaaggtagacactttgcacagctatttgcttttaagaaagacttttttcttcaatttgctctttttgttatttcttttttgtcataagacttcttaacatcagggaagactttgtgtctctcttttgtccctcccactattgcctcacttcccactcccataatctgaccatgatctttccgttacagttctggggaacaaatctgttctcagggacttccaagattagcaagagacaatcatcatcctgggttgtgttagtgtgtccatgtgttggggtggaaaccccatagtttaaaattttagagtatcttgagtataccacaacaaattatgcactacaggtgcaaaggaaaggctatattaaacatcaccaagttaaccgtaatcaatctaatctaagtggacatccctctatgaaagaagcacagttcttctccatgcaggctcatctgatggaatgaaatggcctgaaccggaggtgggggagggaggcagggcatgtggtgtacctccaactcctattgagtgggggtgggaaaattaaacttggagccaggaccaaaaccttgaagagggctgctagttttaactaaatacgtcaattaagtaggtgtttataagggaaagatggcaactctatggacaaagtaaggggggctccgggcccaaagagtgcagccacctattaaggaaaaggtgaaggaaaatatgctcttttagaatcaaatctcaacgaagagagagtcaaggaggctcctggtcaagcaactgggacaaagacttggcatctgtccttgaaggggaactattaccctaggttaaaagtggccaataatgtcccctccttggcatccagaacttggctatccaatacagacatagaggagtaaacttcaaagaataaagttttcaccatctacaggagtgctgttcaactgaactttctgcagtgatggaaatgttctcgtctgctatccaatacaggagaaccttgctccatgtgaccactgagcacttgccatgtggccagggcagtgaggaactgaactggtagttttatttaactttaatttaactcatattgtactagcttcacttggctacgtagctactgtattagtgcagactttatgaatgcctacatgatcatggtggttctctgaaaatgggatagagagggaatccatatgctagatgcacaaacctagcaaaggctgaatgaggtgcagagggcccttcattgaagagtgcatgcgcaggtaaaaagccctgcaaagatccagagaaaaagtagaaatggttcttcaaactgtaatagtcgttggggtcaatcctttctttcattaggtaaccggatcatattaagaaacgtatttattagtgtaatacacaattattattctgtggagtctcctaaagcaaaaacttactattgtgtttttccttcttatgtagttattctaattgtttattactgtgcgcagcacgtatgtggtcactaaacatttatgggtacaagggactaaagaggttggagatggggcaagttaccactgaatttctcctggttatggttagagagccaagttcctccaaagcgtgttccacaagatataaataggtactgtatatttatcaccaaatatctttgagaaattactagtctttaacaaagataaataggtttcttttctaaaataattcccaggactttcactgtacaaacccctccaccacagaaggttccctctcctatatgaaacccctttttaaaggaacagcttataatctgtggaacacacttcaggacaggagtaacaatggagaagggagatattttatagacctgaaatgttctataacagtcaggttaaggatttggggattttatgaaaaccacatgaaccactgtgagcaatacagaacctggctctgaagaagagaaggccaactctgctgccctatctttcaaatctcccttaggaaattcaaggctgtgcctcagcttggccaggacatgtaacttcacacttgcccttcaagaaataaagtctcactgggcacggtggctcatgcctataatcccagcactttgggaggccgaggcgggcggatcatgaggtcaggagaccgagacagaggtgaaactccatctctactaaaaatacaaaaaattagccggctgtgtggtgggtgcctgtagtcccagctactcgggaggctgaggcaggagaatggcgtgaacccagaaggcagagcttgcagtgagccgagatcgcaccattgcactctagcctgggcaacagagcaagactccatctcaaaaaaaaaaaaaaaaaaaaagaaataaagtctttccagccaggaagcaaatgaaggtgaatggtaggattactaggtcaagtagctaaaacgtccctatttctattaaaacaaagaaaactacaaaaagggttcgatttaaagatggtgttttggactaaactgtgtcttccccaaatttatatgctgaagtcctgaccccagtacttcaccatgtgactgtatttgtttttgttttgtttttttcaacacagtctcactctgtcacccatgctggagtgcagtggtgcgatcttggctcgctgcaacctctgcctctcgggctcaagcgattcttgtgcctcagcctcctgagtagctgggactacaggcatgtgccacctacccccagctaattttttttgtagttctagtagagacagggtttcaccatgttggccaggctggtcttgaactcctggcctcaaatgatccatctgcctcggcctcccacagtgctgggattacaggtgtgagtcaccatgcccggccacagtgtgactgtatttggacacagaatctttaaagggtaattaagataaaacaaggtcatattgatgagcctaatccaacatgactggtatcctcacaagaagagatcaggacggagacatgcatatggggaaggccatgtgaagacacagggagaggagggtcacctacaagccaagcagaggcttcagaaagagccaaccctgctgacaccttgatcttgaacttccagcctccagaactgtgagacaacgcatttctgttgtttatgcaccccagtctgtggtactttgttatggcacccctagaaaactaatacagatggctagtgtaataaacttaaaactcaaattttacatgcaactttaaatataccagttccttcttatataaaacttcagtaagatttcttattaaaaatgtttaaactgtgttgtctactacagtaatttgctagtttgattttataaagtattctcaaattaaatgtgaaactaaccatcaaaaatgtcatattacacatttctgacactaatacatcgttttaagttatatactacgggggtcaggaagctttaaaactaacctaccataaaatgccatttctgtcgtttaatatttatggcctgttaacagaaacttctaagttagttcggacatacttttattaggcttaaaaataggcatctaaaaatgccactaaatctacttttaacaaatgaattttaaaactttcactataaatgaagatggaagactttacaaagctgacagaggcactttataataaataggtaactacacaaaaatatgaaataactgaacatcctgccccttaggtgagaaaggttaagatggaaggtttttttccatgagtggagttaattgaaaacacaatccttctttacgtttcctttttcctaatacagctcacacacattctatttatacttttaaaagtacttgtttaataaactcagaaaactgtcgctagtcctgcagcatgacataggagaatcgaagctcaaaacttttatctttagcccaggagtaaactatttcaataatcatttatttaaaggactgaaagtcaatttcatcatcctcccttttaacattgtttcttagaatcttgctacttgagaaatacctaaagtaaaactgaatagaagcaaaacaaaaatgtaacattaaggtcctgacaaatcattttaggggatatttaatgcagaattccaaattttgtttttcatggcactcaataagacttaaaaatttttatattcatgtctgggcaaaaagaggtctcacagttctatattatagatatgaaaagtacttgtaatgcctgtaataaaagtattgttaaaatatttctatttacctggtagattggtcactagctggcctctgataaaatcatctacttcttctggttttaggtggtactgcccatctggttttgcttttctagttgccattctagccaggagaatattagaacctattaaaaaaaaaagtcatccaagaaatagtcacaattattttttaaatttctcaacaaagatctcttcatacaggttatccatcaagtttctaaaaacaatgaaaataaattttgattatttcaaataaggtgtagaattttgctaagtatttagattataaccaacagagtacctggacagaggtttctctttgctctaacgcaagtgccacttcagcatctaaccagaagcaggaatagagaaagcagtcctgattttttttttttttttttttttgggggatggaggctcactctgttgcccaagctggagtgtagtggttgtgatctcagctcactgcaagttccgcctcctgggctccagccattctcctgcctcagcctcccgagtagctgggactacaggcgcccaccaccatgcccggctaatttttctgtatttttacagacggggtttcaccatgttagccaggatggtctcgatctcctgacctcatgatccacccgcctcagcctcccaaagtgctgggactacaggaatgagccaccgtgcccaatcagcagtcctgatcttcagagtgggtgtctgtaggaattgaaggccatgatcaaagagtagttcatgttcccaaccacaggagacagaggaggtagggaaatgacaataaaaagtgcgcgactggactggggaaaccagaaagcccaaagcagcagtgggaactgagggtagaagagtcctcaaaacacagagacaggcagtgaggttcacggtgtaggtgtgggcaggggccacagaagcagtggaggaaaagggcaccaagccctgagaaggggcagggatctgcagagctcagctgctaggtgggcttctccgtgaataataaaatctccaaagggaagacttatattgaggacatatcttggttttatagaagacttatataaacagagattcacgaacagggaaagttctgggaagtcacaccaaaatgataaaagtagtgagttcaggggaggggaaaggcactgaggagtggaaatataaagtgggactttggcattacatatgcttgaacttaaaagaatggattcacatgatcacttataaatgaaaattaaggacaattaaaaacaaaaaaataaaattgtgcctgacaatggaatatagaattcctaagtgaaatgttaccaatgtctgtgggccaacatcagggggtaaaaggtaggctagccagtagctgtaggaatgctgggaatgtattaatcatactttttattttctgtatctcgcagtgttttgaaatcttaaaaatcctgctggctggggagagactgccctcccagggctggctaattcctaaagacagtaaacctcttacctggaagcacacttgtcatatgcaacctaaccacctcctgccctaaattgtcccagggccagctaccaggcaactagggaccacccctatagcccagagcccaccagaattactcaaactagccactcctaaagtgtttcctcagccctgccttgcctttctgaaaaaaaccctaacaaaggctctggagcctaggcgctccgtctgccactccttcagcttctgtctcctaaccaccctggtgcttccccagtagtcctgtgtagcacggtgtgcccctcctctcgggaaatggaagtaacaaattcttctttcaatggcattagcctctctgcatcatcactcagtcattagtaaatttcatgggtacaaaggagacagggaactttggaagaagaagggtttttggatgaagatggaggaataatggttgaaagtgacaatggcaagctaagacagttaactttaccttccaagcctgtggtatactgagtatggcagggacaaactggctctagtaacagaatggcaagaaaaggggtatcttgccagaaggtaatgagtgggttaagaaaggaagaggtgactcagggaagcttaagtatgaaagagttccagaggacacggctggaagaatcaacaaaaaagcagggtaagtgctgggagcagctgtggaaacaaagtacaaggtttaaagacagcatggatggagatggaggagagactggacagttactgagagcacttggagtcagggtgacttctagaactgagtgaagacaggaatagctccatgtgccgggaggctgaagtgcagagagtaacaagactcagacttaacacgcaactctaaacccataccaccacctagctttaaatacggtttccgttcacttttgggaaaaaaaaaactgtttacaaatgttgaatgaaaccttcccaattttttaagaataagtaagaaatattctaacttatttattgcgaagattatcaaccatttacttatatttccagcacttatctcgtgtgtcacacaattgtaagcaatgctaaaaacggttttacaagtgagaggaagctaataaaaagaaaaactccataaaattaactgatattcaagaatctcaaagcaactcttttgagtacaagataagctagatactaaccaattccaacagaggcagcacatttcgtctggtctttgatttccatacgaacagcatttgcaaattcatcaggagtaagtttggtctctgcaaggatttcggtaatgtctaccagcgcttcatcacaactgacagcttcaatgttatgagtgtagctatcaacacagagcaaaggcaacgaatcacagccacagccaccatctggtagacccaatgttgcaaaatagtcttcttatcctctcttttttctatttcctcacaaagcattttaaatgaattggctgaagtaccattttagtcacccaacttttaactgcaaagttaattagtgtgttctctttctccttattaactaccaaaatacagcatattggataggaaaatgtttgaggagtaaaataaccaacaaaaaaaatttaaacacaaaaaaacaaaaacacagcataaattattatttcagtttctctatactgacaatacttctataaacctttgaagagttgaaaaccggtgggtgaatttgaactgtcaaaacatttaatctaatggtttatgagaatcctttaaggaacagaaaaattagacaaatcagtaattgctactctcctaaaaccaaaatatcacagttaaattccactcactgtagcaggcctagaatacagaaggaaaaagtggccagtcatcccaactgcttgtctgagaatagttatctacactctctgcatgtggacatactttttaaaaaatcatctcataggatctatccacaaaaaggatttgttttaattagagaaaagaaaaaggaagacaagagttgctatgtggcccccatgctaatacgaggactaagaaatcacaaaatagaactggaccagaaatgggaggaaactttcccaagaggcctcaggatcaaaactatgtctttcataatccacttggtaatgtagactaggagggcggtcctcatctctcacctacaccttactgtaggtaggttacaatcagattaagatctctattaaagaaataatctattaaagaaataagtatgttttgtttaggcttaaagtatgacatttttaagaacagaagggtatatctggtatgaggtattttgcttcagagtgaaagctgccctgagacagggagaatatgaagctgagataggatttcccaagggtggtagaagaacactactgtggatatttttcccctaagaatagaaacatgccactgaaactgtctccagccttctactgggaccgtgtgcatgtgactgtgtaggagtataggtcacagctctctctcacatcctcataacctcaggcacaggctgatgcttgctctagggcttcaatacccaggacacaggagcaccacagtactgacctcagtcacccatccctatctagccctcgtttggatgctaccactgacttcctcctttcaaagaggatttaaagcacgttccacttgacaataccaacattcctgtatttgggatttatttatttagttacccaacttataactggaaagttaattagtgtgttctctttgtgttaatagaatagctataataagtgtcttatcattcagcactcactcctacataatgacgccaggaaataatcagttccttcacattttctctctctctcctactaaagcaagctcccacaagggcaaggattagatattcccttctggactagcagcatctagcagtcacctgtacttagcagatactggtgttcaaattaacgcataaaaaggaagaggcagaggtgaaaacagaggcaagaagtctatctcttggaacattaatactgcccaggagttgacaaaccttggcctaacatccagtaaatgcatttttactggaactacaccaagcccattcatatacattccccgtggctgctttccattcacaacgcagaactgagaacttctgttgagtgacagaaactttatctggctcccttcagaaaactatgctgacccctggtttacagcataataggctggttatacttttaagaaatttgagtcctgagttaatatggaatatatctacacttttaaatatttttaaatacatctacaattttaaatatttttaaaattaatcaccttttctcaagccaactcatcaaccattttgaaactattattaaagacccacttttatgaaaactaacttttggcatatccaatgattttaagaagataaaggttttaaagtgtctccacttgttatcaacccatcagttctaattttgaacaaaactataattaaaatgaaataaaagagaaaaaccaggttaaaaaattccatccttcatctatctggctccatgggaagaaaaccagaaccacagactagaagtaatataagcaaataatcagatcttacatcaaccaaggaagcacatgaacaattttggcaatacaaaactatcctttgagattgagctacctggaaattgcccaaagaaaggtctcaaactgggatgctgaggagtggttcctggaagataaaattctaacaaaagtgatcctgacaatcctaaagaaaacttgaactgtctttactattagctaaaagaaggaaaacacagacacaaaatgacagtttgatacactgtaccttgccaatgtttcatacaatgtttgtgcgacttccttatatgcatgaaaatcgtatggaacagcttgaagattaggacatagttgtttagcatgcccaaaaaacattccgttcttaatgccaagttgcctagagcgagaacaaaacacaatggaggttattctaggaagttttcaactcaaatatttatcaaatatgttgatatctccccatgccactaatttataatttccacttaactccattctcattagggattaaagataggcattaaaatttacagccttgttttcccccaaaagtcacaactgtctgaatagtgtaaatgacacatgtagatgtgccaactatgtcattaaaataccaggtttggctcttgtatctgaagctttctcctaaaactcatacctctggcccctttgcagagatgccagcatgccatatgctggtgatatcacaaccaccacagagcaggaatatgctgtcaaaaagaggttttcttcccctaatacaaggcacagtttggccagggttcatcccccaaagacaaagaatataaacaaaagaactacacaaaacagtgctatgtgacaaacagacaaaatgtactcatcctattaccacccaattcccaattgaccaattccatgctcctgaagtggctccacagtggttgagatgccaacagcattgtacatggtaggacatcactctgggcaggagccagggttccagaactttgagggacctaattgaaaatggtaaattttaaatctgtgtgtctcagtgccccacattacctttgacatttggagcattcaccacaaaactataattatggaattatacataattagtaaaattctattttatcactctgtaaagaatcaagaaaaaaaattatagtaaaaacaagcaaaataataaagcaatgtttcaccaaattacatattatataataggataatggttattctatatatatgttcaataaatatttactacacagcatggagacgtgccttgttttaagaaacgtatatacaaacagttgccaattactcataggcctctggcaccctcccaacatccagaccatgagagccaagaagaaagagtcctccaagttactcagcagtagatgcaaaatcacatgcatttttatgtttataaaaatagtaatattataaatggtctcagtgctaagtccctagtagataagaaatacctaagaggaaggaaaatgacagagttgtaaagaaaacaattcttgatgtgtcgaggacttagcgaggtgctgggtataggatggcaaataaagcaaactccatgacctccatggggacaaccttgcacttgcctagaaaaggatgacctatggtcaacaggctttgtccactaatgaagaaagtagatacctaacagtttagacatatatgtagaaacataaaatagtttagaaactttatcagaaagcagaaaaaaggtctggtgttgaaaagggtaaatttcaggtaataattatgccagatatatagattcagcatgtaaaagctgagtttacaaattaaagataacacattttttaaaaatgtgtttataaggccgggcacagtggctcatgcctgtaatcccagcactttgggaggccgaggcaggcagatcacctgagagggggagttcgagaccaccctgaccagcatggagaaaccctgtctctactaaaaattaaaaattagcgagaagtggtggcgcatgcctgtaatcccagctacttgggaggctgaggcaggataatcgcttgaacctggagggtggaggttgcagtgagccgagatcgcgccattacactccagcctgggcaacaagagcgaaactccatctcaaaaaaagaaacccaaatatgtttatagtccaggcgcggtggtacacatctgtaatcccagcactttgggaggccgaggtggatggatcacctgaggtcaggagttgagaccagcctggccaacatggtgaaaccctgtctctactaaaaatacaaaaaaattagccgggcatggtggcacactcctgcaatcccagctactcgggaggctgaggcaggagaatcgcttgaacctgggaggtggaggttgcagcgagccaagatcgtgccattgcacctcagcctgggcaacaagagcgaaattctatctcaaaaaaaaaaaaaaaatgtgtttataatccctataaatatcatgttcttatatttacaatattttcattttcaaaacattaatttacacaaaaattttccgaagcacattacttagtaaaatatagtacatctacttatgtactcatgtaaaatgtacccagagaaaactgtttaagagccattagacactataaggaagttacaaacaaaaaacgaaaacctttttcctttggtttgccttaggtttgccatactaagggaagccaaataccttgagttgatggctgggaaatgagctttgttccatagaaaataaatgagtaaagacaattacaaaaaagtccaaagtgtctcaaagtgtctcttcattaccgtgactcatctattacaactaaaatcccatacaggataaattaccaaaacttcgttaagtgtatgctgcaaaaacagcttattcctacatttaaagcacagaggacatattctgtctggcaatatgctttgttcagacagttgtatttggtgttggattcaacaatattaaaaaattgctggccgggtgcggtggctcactcctgtaatcccagcacttttgggaggccaaggcgagcgggtcacgaggtcaggagttcaagaccagcctggccaacatggtgaaaccccatctctactaaaaatacaaaaattagccaggcgtggtggcgggagcagtaatcccagctactcgggaggctgaggcaggagaacggcttcaacctgggaggcaggggttgcagtgagccgagatagcaccactgcactccagcctgggcaaaagagcaagacttcatctctgggggaaaaaaattgccatcaaaccactgtcactgtccattctacatactaaaatacatccataaagtaagaaaggtagtgggtccttacaaaagcacaagaaaatggggtttagaaattatatgactttaaagatctgtgattctaggatatctgtgtatcgttacctattcatgtacaatctaccttctcactgattccatataaagtttgctctctactgtaagtataggccaactactaacagcagtgcaaactgtgacccacatatacacattctactttgtatttctaccatttcatattcacattctatcctttgctggccccattattaagctatgtatagtgaaaactcaccagtgcatcaaactgagcagatcatccccacaatctagtccccactccaaactcagtaacatttctcttatgcaaattgttaaaaaaattttcctcagataaggaaaatataacctgttggatggccacaaaacaagtatccagaaactattttctagaaactttcactaggaatagccttctagaaaacagaaaatcacaattaagggacaaaaatcttacggctgcattttttttttcttcaagttaaattcattttcatcactttatgtatcttcttaaacatctgcacttaagtggcacttgaatggctcactatatagtattctgtcctcatatagtcaccccaattattttgcaaggcatgaagcttgaccaaatttataaaggtaaatttatatttaccgtgggtaaatataaatgcaccatccaaacacccaacagaagcctagtgcctacacacaattgtggctcctggagtccaaagccaccagagctggtgacactttcacctggaggcagccctgctccccagccagcattcatcttggtgggggactgggtatgaaggtataaagggagagaccctgcagaggcagccttagcaagggtaaacggagctcgcattttaccaactagcgaaattcaaggactgggaatatttctgggcttcatcacaccctccagatactgcacataactgtctagccatctgaagtccaggccaccattcattaacttagtagagaaaaagagactagcctactgagcacaacataaactcagctctagagtgcctgtggtaataaaaagcagtataacaattcaaaacgtatttgtatttgacttaattatcatttaaagtaagtttcaattccttggccacagcatcaagtgacaatgaaaaccattaaaacataattctgttaatgagaaaggcaaagttagctggggaggaaaagtttggcatgtcatgaatggaaaacagtttaaaatataagcatgcacgtttgaacttaatgctttttaacttaaatatactttaaataaaataattagcaaatttaaaaaaaactattatgattagacgatgctgagctcaaatattttttcttcagattagatgcctgaatagccacaactctgaatcaagactaaaaagatgtaactaggccaggcacagtggctcacgcctgtaatcccagcactttgggaggctgaggcggatggatcacgaggtcagttagccatcctggctaacacggtgaaatcctgcctctactaaaaaaatacaaaaaaattagccgggtgtggtggcgagcacctgtagtcccagctactcgggaggctgaggcaggagaatggcatgaacctgggaggtggagcttgcagtgagccaagatggtgccactgcactccagcctgggtgacagagcgagactccgtctcaaaaaaaaaaaaaaaaaaaaagatgtaactgatctaagactctgtttcgatttgaaattattgaatactttaacacttgccagcaatgtgtaagggcttgctgtgtgatataggtaaaaatgtctgtgtttggttgacaaggaaaaaaaaatgaagacttctctttttaattattactccctctacttttacaactattccaattatttcaaaacggttttttaaattatgaggaagatatatatatatgagtgtgtgtgtgtttcttcctatactgaaacagccaattataattatggtttcagatcactataagataaagacctatacaaaaagttggtgctaacaagttgacaacactcttaacacttttaagtgaagagatattaagaatgccaataattcaattatttacttataattgcataggcaaatgggttttaacactaaaaaaactgagtatcaggaagtatggattacaagattttttcttagcaataaaaacaaaagattagagggaataaatattaaagtcctcttccattaaaaaaaaatctaattcttttatttcactcttcaaaagacagtaaaaacgatgatccccaatttcttttggttcctactacatgacctattggttctcatcagggaactagtaagctgtttgtttaaagttatctagcactggtggggggttgtggggggcatagatgagatgattaaggctaaaacctcataacacgtctgtaacatttaaatccacttcaaaagattatagttcaagaaattatataaaaataattaaccaaattattcattaagaattgtaacacacaacttctacatacctggcctcataactacaagatgcaatttcagcccttgacaaaacagaatcaattccatttgcttgcgcagaatctggattctcccacaatgatgaatctggtatatctgctttaaaaataaaaaaaaattaatggttatatgttataaactgattttccctcactttttcaagaaatttgttttccattactttcatataaaaatgttcagtaaattccaaatacagttatctctattggtattatctccttatctaataaaagaaaactctaaaatggttcgcttccattatattcttcatcagcagataaaaacttataataaattcaaagtgtcctgggaggtttgttttttttttaaatacaccagaagataaatataaaatatcctataacacacagtccctggaggtggacatggatgagaagtgatcagggagatgaactccctcttataaccttaaaaggactgtacagctctcggtagtggggaaaagttaacgaaaaatataaatttctctgaatattctttgctgtttcctaaaagaactatctgtaaaacttaaagctaactaacgggtacaacaaacatgaaattcctaccatctatctgatcaaacaataatttagtaggtcacaaaacatgaagaggtttcatcctaaattcaagctttttcttttgtacacatgtcacattatcccccgctacaggtaattgtattttggtttaataatgcatgttcaattaaaaacattcaagtgtgatcagagtatcgatgctttagagaacacaactggagcctagtgtggcttaccaacatctcttaatatccaaaccaaatttacaactttacacaagaaaacaaaaccacacactctggagagcctactggctgcatgccactttacttcctttgccacctttagcttcactagtaattgagaaataaattaaaacacaacttcatcataggtctcttgggatactactattaggttccaggaagagtatgctgtaaaaaaaaaaatcacattctaaaaccacaacctcagccacatctctactattataaacaaaagtaccatgagtaaaacaaacccaaaatatatcacttcagctattccagacaaatctattttgagtgcactgtaacaacacataactaagaaacccagcatttctcttttgtttatttcagactcactgttctgtgaagtcagccacgttaatgcaccaccaggaaaactggcaaagtctctggcttcatgggcttaaacaactcttcctggtttgaccaataatcatcagcatctttcatctaactatgcaacccatacaagcatttctggatttcggcaaccatatatacacagcataaatgcaaatcaaactgactaacatctcgggtcaaatcctacttgcttcaaaacagcagagtgtgtaatgtgagctagtttctgacatatgaataacgtatgctagctatactattacaaattaaagacagaatcccaagcagattacccagtgtttctggagggttttaaaagggtaaatataaattttaatagtccattcatctaagctgaaaaactgtaagaatttcaggactgtcagtatcacacttcaacagagggtgctactagaccccaaaaaaaggagtgctgaagcttgaacagccacaaccaactgtctttccaaggtgtaaccatgagttatgccttacaagttggagaattacctgactttggtatctgaagggctagttatctaagatattgtcttgaaaataacagaaaacttatgcttgaggagagaacagtctctgtggtccatgcgcccccagtgccctggcctgagaggcagcaccatcgtgttcctctccattgggctggctgacctgttccacagtgcagcagagtgcgtgggtccctccacgagcggagtgagttgcttcatgtgagattcagggaaatgcagggacacactgtcctcactggagggcaaagtagagaactgctcatcaaaacttgacaaactagacgggcacatggagaatgtggaggaacggttggagaaatcagaggccaggacccaagtctgtgaaaaagaaatcgctgagaataaatctatgactaatacgatttttaaaactgttgttctttagaatgaaaactgaagttgtcgatgggatagaaaacatctgtatcctggaaatccaggaaggggtaaaaggccccaaccatgaaatttggagcataaattgttccaaacaatgagatcatcaatgagaagtgtgactactgagtactgctcaggaagcagcctccaaaagaagtcatggatggatgagataccctggttgcacggggctaattaaagagtttttggatacgacaactaagaaactaaagtttcaaaaaggactaaggatgctatttgtcctaatactttgtctagacatataagccaaacattagaactgatcttttttttttcaaagctagtgcacagaagccaaagattctaattcctaaaccgatcctcaatatttttatatttggtgccatgtctgataatgacccagagaaagaaagatcagggaataacaagcaaagaggaacaaaagcactgaaaaaagttctgagcacaagcttagttgtaatcaaactttataataaaggataatctattcattttatatgtagcaaatattctggtgagctcctaatacgtgaaaaggcttaggatataaaagtaaatgacatcaagttaaagtaagagtataaaatacaaactgtcatataatctttttctagtgacgggacaatctccttttgacaattttcaatggcaagtgaaatttaaatatttctcctaatattaccttctggtttaccacccacatttagatgtgaaggggatgtgattatagaaggtcattaaaatgttataaaaattaggtgactaaactgatgaagacaagtaaccaatgacagtactgtgttaataagccatttatagtaagattgtaacagaagaaaagacaaaagaggactagctctctgctactcctaaggaatgtgagcttgtcaaggttaaaattttaaatgtaggctgccgataaaaggacgtgtgtaacaagactacctaccagagagactctgagcactgaagatgctactgcaagtatatacatggtggtttttcttctttcagcattctttagtatttcataaatgcctaatatatgacaagtattgtgtacttccttaagctatttcttattttctagaacttaagatttcatctgtttaatagcacacagaaaatacaaaaagaaaaaccaacctaccacaaaaaccatactaccaatacctaagaaactacctataccataatacaagtaaatctcaacaagttcagtaacagctactccacatctactcatgacacacaaaattctagaatctcaaaaatctctgaaaagatttaaagaccaagaaaacctttataaaacttggaaataaatgtacacacaaagcataaatatgtatctgcaattatgttatttcatacttaagaccacataaacagatgatcaaaaccaacaaaaagactataatcccaaaaaaggtcctcagagatgttcgctggctttccttttgccttaatttcattggagtcattgtgacaagcccaacgttttataactgacaagggcactgaaataactgcaataaaactaaactgcatgctttccatttcactgtatatctaacttctgactactttctgggtaatatatttctgagaaactaattttaaaaattctctttggctttgcaaaacaaccatgagaaaactaatcagttaccaaaaaaaatttaatttctaagaaaacatttctcagtgaatttactcaggggaaaaaagcaatagacacatgaaaatcttaataagtattatgactagtacaacttatgattttgcttattaatatccaaaattaaaaagtcaagagaggcaacaaggttatttctcataacaggttcactaaagcatatggagaatgattactggtgtttacttttaattccaataaattaaaagttctactgtttgttattctacttcctcatacaaatcttgagcaagacaaactttaacattcttactgtgatacaataaccagtaattaactctcacaatagaaagaggcttctttaaattctgcccatgatttttatccccaatctaaatttatacaaagcaaatcaatcatatcttgtaaaacattcttcactctctacttcaggaaaatatcaccctccaattcaacaaaacctaacagtgacatccttaaaacccctgaatgaaaaagctaattgctacaactctgcactcatttctattaacaaccatgccaaatagcaaaatccagaagccatccacaggagcactaagacttcaaagagagctcatttgtacctgctttgcctttcaggattttattctggtaatactgccactccagctgggggttagcgccaggacgtaaaggtgcccttcctgtgcctctgttacttgtaacagccactggttttcctgtgaggaaaatattaaattatttctgtatgtggtacaggaatgttaacaacatgtaagcaaaaatttttcaaaggattttaaaaacatgccttttttttctttagctttacttagacattaatccttaaagaagctaatactttaaagattatcaatcaccatgtaaatgtcatttaagtttcttagcacctccagaaaagccaattatttgtgaccattttgatacatttattcaacctgaaagcagcagtcaactcagccttccatggtttttgtttgatttcgtactgtaggaaagaggcaactcaagagtctagattcagacttaagtagtggggaaagaaaaactaaatttttttttgtatttctagagttaacatctatacttatctctcaattttacgcaacagaaactaaatacatatgcataggaatcacaatctgacctaccacattatcaaacatgagcatacagcccctcaatttttgctttagtataaacttactttcctgtatcatttccttttgtatgcatgttaagttacaagattactataaatttgtaaagcaatagcagggataaatatatatttacttaatgcattattctgaggaccaagaaataaaatcaacaatgcattaaaaagctactctatgaaaatcaattatttaacattctaaaaactcctttcagagctgaggaactactacccatgacaaaaataaagtcctggttttaacacagcagcttctgtgccatagtgattccttatttaagggaagaattgattctcagaagaaaacactaagttatctctttcagacagaggtaaacactgaaaaacccagaatgtatgctttttaaaatactgactagttcacaaatatctgcaatttcactaagacaaagactgtccagacgacttaacacattttagcaatattcaataatgcaaaactatcctacaatcaaaaagttgggatgttcatgggcatcaggacagttaatcaagttatttgctcaagagaaagcatagtgacccaagtctcaaagacaagagccaccataaaatttccattcattaacaaggaataaatacagataaaaatttagaaaatgcccaatacagatcctgcctacattagtcttcgatgacatatccttcagctgaagatgaatattcttccctgaagatccctatagggagaaagaaaaactctaatttccctataccttccctgataatcgaatatagaaaatttggaagaaccgattttcccaaggaaaatcataattttttaaaaaaagattttgtaatctctttgaatatatatttataacaatatatcagttttcttaaaacataagcaagaatacagacctttgagatctggtctatttcgtatacccactgatacaaagaagcaatccatatcaacatgcattatacagctctgatgtctgggagaattcaatactgacatatctcctagaaggaaaaagacagcattcaaaccccaagctaatttttactatttaaaacatcaggtctagttaattttagaaattatatttaaaacatgcttacacccagaatggagtctttttaaaaaaccagaattgagtacagattatttctatcacctcaagagaagccaaatttaattaagtctctaattagtcaaaaagtgcatcttaaaattatttcactgtgctgattattttataaaaatacaaaggtgttggcatacatttagttacatgaagctaagtaaaactttttttgatgatcactattccatgcaatctacaaacgcgcctggataaaataacaacaataaaagtgactactattatccagtgcttggtaggtgtcaggcactgctgttaagaggtttatgtgtatgtatttatttaaattctcacaactatgaggtaggtaatcgtatcatctccatcttgtagactaaaagtttaagtcacatagcctattattaaatggttgagctgtgattctgtctcaagcagtctgatttcagagcctttaaactaccatgttgctgttctaagtacttaaaaacagtctataaaatgtaaatctgtacatttttatccttatgccattaaatactattaaagatcagagctgaatgacatataccacatttaaggagataaaggtgagtgtcctcacctaaggacaaaagcttctaatcatcctgagctacaaagagattcatcagggtcattttaaccctaatccaggcacaagcagagctttcctctattatcagtctcatccttagcctgttcgtctggtcctctaagatacacaaatcctggaaaaagaaccctgggcttgtaaaaagttctgatctcataaaggagtttttctcaggcttaaaaatattagtactgagggtcagtctttataataggcttccaaaaacagatatcccctaacagttttggaccactccatttaccaaactgtgactgtgatagcatgtacctaattctcccccaactttttttttgttttttttttttttttgagatagggtctcactctgctgcccagtctggagtgcagtggtgcgatctgcaacctcaacccctagggctcaaacaatcctcccgcctcagcctcccaagtagctgagaccgcaggtgcgtgccaccacgcccagctaattttttttttctttttggtagagacacggtctcactgtgttgcccaggttggtcttgcactcctgggctcaagcaatcctcccgcctcggcctccgaaagtgtgcgaattacaggcatgagccactgtgcccagcctgctcatgtattcttaagctcacaaccccatgaggcaaacatcatggactatctatcacttctattcacaaagaaaactaagactcggagaggtgaactaacttgcccatagtcctgcagcctaagagtggcagagtaaggatttagattcatgctaaactatctaactccaaagccagatacttccttactaccctctatattatctcaagaaatgattcataaaataatcttaatcacaattctgctgtataaaagtatttttcaaaatatcatataaacataatgcaaacaactcaaaataacgcttttaaacattcaagtagtacagaatgcataagccagtatctaccaaatgctttcatacaataacaaaatttctcattttattcccattcacagaactaattaatcatagttcttagaagcattaagaattaaataaccttcaggtaacaaggccaagacatgatgtaaggataatctagtatctatattattctgaaatatttcataaataccaaaaagcattttttgactaaaagcacataggaatacatcaaactcagtaaaacataacagaaaacaccccacatagagtctctatcactttctaggacagaaccatgagcttctctctatacctcagtttccacagctataaattatagagtattaatctctgaggtctctccccataaaaaaatcctataatctgtaaaaggaactaaaatttcaaaccagatactaatttataatgactggcccagaaaaacagtatgctactgtgtgtgcatttgtttttgatgacaagaaaagtattaaaaaacaaaatacaatgaaccaatgtacttaagatgtgaaataatctcactgaaagtttaccactgttaattacaacagctctatgtcaaaattaaaaaatcattatgatgcaagcttctagaaattaacaattactcttatcaaaccaatttcattcttacaggagtttaagcactggatagatgttatattaacacagttcaaaacttcaccaactgataaggtctacgtgaggaatgaatgctcagaatcccaaccatcttactgtttaaattctctgaaaattttcagtcagccacaattatatctaattgttttaaaaatattttaataaattagctttctatgttatgcttactgtaacttacatgatttgacatacttagagacttttatgagaacttcatattgaccagaaataccaataatagcataagagcaaaatgatcaagcatgactgtttcttaagaagacaattttaataagtatctacctgtgtcagttacaacaagtgcagacctgcctgttttcattttttttaacttttcccttcctggaaagataccattactttgtctttgtagggtattgacaaactcagtcaattcacacttccacattgatatgtgatgcagtcttgaatgagaatagaagtttgaaataaaattgcagtctgaaggtttggatggcactgaaggtgctgccttgctaaacgtagatactgaagaagtgctttttgtgcttgaaggcccctgaacagtggagtggtgagcaccattgattttagtgttactgtgcaaaggtgataatgagaaagaattagttctgtgtggattccgcaaagcatctgtgtttctggtgctttgctgcaactgctgcagagtgcagtctctgaaatcagtgctgctcttctcagccttatcctcctcctgggaaaaggctggagaaagcctgctggcaacactgttgaccatgggcaccaagcaatcctgtgtctttaaggcaccattagagctaggagtgtgtccattaaaaatggcagtgctccctctgggatgcggaattccattctgtttccttcccggagaggtctgctccagatccacaaaactaaaatcattattttcatcttcttcattccaactgttcatgccattgactttgacttcattttccgtttcaatcttcttaacgatgtgatttctaaagcaggaaaaaatttttgagttaataatatctgacttttaggttaaaacaattttttcatttcatcattttcttagtggtacacagtttggtatttccccctttaaaaacagaaaattcttatattgaatattgacaatgaaaaaaaaaaaccctgaaacttaaaccacaaactttatattctgatttgacaaaagatcattctttgcaaaagtagcaagataactagaaaaattctagaatattaacagccctttaggtgttttttgtttgttttttattttcacttcagatagtcccaaagaagaaataaaatagaacatttctcatggctgaagaaaaacccaaaaaacttttcagttatttttcccataaaaaattaattggaatctataagctgtaaatacccagttctgaagcacagtgcttggcatttactacatggtcaataaatatctgctgaattaatatactacaaataactttcataaaaatggatttaaaaaccttacttgaattcttattcctagttttagtttttatgaaaggtactattcaacacattaaatctaatacgaaaccagatggtttcagtaggaaaaaaactgactatattgattaacctattaatgagctaactgttgcacaaatagacaaaaagtaaagccatgtcaatgtgtgggggtaattcagtaaaatttacacctagaaaaataaggacgcttgccttactgagaagggaaattgcacttcatttctaagaaatgcatatttagatgccagggtggtacaaggcaatctggaccaagtttcctgatgacagctttataaatgcagaacccatgacaaatgttatgctaaagtcacatcctggctcctctagacgtttgtttagaaatgcattcacgagaatcatctaagtaacaaaaacaaaaacctgaattacaaagcagtaattcattctacttaggaatgtccaaatgtccatagcattaattcaattacagcgcaggctccagatgaagggctgccctacagagtagtaagccacaggtgaaattaccacagtattatcaggttccacctaaagcccctcaccctaataccaacttggtttattagtaatgagagcctgactacacagaaaagtcccacaagctggatgatcacccatttctgggttagctcaggctctggctaaacatcatatggaatgtgacaggcaactgtgagtagatgccatgctcacagatgatcatgccagtgatggggaaaaagacaaagtagatatgattaaaagaagaaaaaaagaaaacctaatttgtcacatgcagagaaagttcagcctcttgagataaacagaatgcaagggagcaagaagtcacagatgagcatttcaaagaaatgtacaaaatgtactgaatataccccccaaaaaaaccccagaaaacaacaaaagtgatgtacgtcagaaagtcttacatctagttttgtgtcaaaaacattcagaccctttacatgcattatagcaacacatgcaacagaaagccatatattggcaggaaaatacattgttaacatacattcttgctgtactatagtttctcagcctagacaaatggacatttgcaaagtagctgtactggaaatatcacgggtagagatacattttttaggcaatggcataaatgtattaagaagtaaaatctaaaaggtaatttcttcctaaagtgtcacaaagaagattttgaaaaaacatatctattttctacttttattaatgtgggtaagaaaagaaagctaaagctacgtattctgtgaaaaggttttctggtattatttgctatataccttgatagcacattaaaaaaaattaaaagctacaggtaacatgaaaaatatttgaatatgcttgtgagtacaagttaaattaacaaatgacaacaaaaattacagaaggcagtgatactggatcctctcagattaattagactcctggtgttttcgaaaaaaaatatatccaactcccaaagcaagcaatttaataaataaagagaaggctaaccataatgaaccacctgatatacaaggtaaggcaacccaccaattaattgtgaaacaatttatccagggttgcaattaaaagcttaaattaaaaaaaaaaagcagccacatggaatagtctagattcactttcaattctataaccaagggtcaccaactaaacttccatttatatatttacatatttagaatgttatgaattttgaatttttcaaaaataacccagaaatattaacattttcattgtctttctatgcatggaacacaacaaaaatatagctggtgcagttagttccatttttgagaaagcaatacagcaaattacttgtgaggaaataattactttcataaaaatccatgaaaaaacttattaacaattaagatccactagtttaaggtgagaaaccagtatgactgtaaaaacttacttacatttatgaaattatcattataaaaataattcatttttagataagacactcatacacacatatttcaacatgtttattataagtgaatggccagggtttgtatctgcttctgtctgactgtaacagagcaggggccatgctcactgctaaaaaccagctttgtggccaggcgtggtggctcatgcctgtaaccccagcactttgggaggccaaggaaggtagatcacaaggccaggagttcgagaccagcctggccaagatggtgaaaccccgtctctactaaaaatacaaaaattagccaggcgtggtggcacacgcctgtaagcctagctactcgggaggctgaggcaggagaatcacttgaacctgggaggcagaggttgcaatgagccgagatcataccattgcactccagcctcggcaacaagagcaaaactccatctcaaaaaaaaaaaaaaaaaaaaaaaaccaaccagctttgcagtaatccccaactagacaaacttacaccctgttgttgagctgtttggctatattgcttggacctggcagaggatcctcaggtctgcatacaggattaaagctgagacctttctgcacactggactgcttggtgtacagctgatatggaatgtaggagaggagtcgtccagctttgatgctgaaacaaaaagcaacaccaatttagagttccatacttggtgacaatgagcttcatgaaaaatattcaatgtccttaaagatacagtatttcaccaacaacaggtcatctgttttcctagtttattccttcttgctcggttttagtggtcctaatacaatatgatcttagagtggggaaaaactgcaagcacagagctgaactagtcaatattttaaacctcatgactttagtatttaccaccctgtcaacagttaacagagaatcatcaagacttcatcaaaatctcatctattaaggttttccaagataaataaactgaataaggatgctcaatttccaaattcatgtcagaaactgtaaaataaaaatataggacaaaataaagaatctcaacttcaagagtaataatttatactatttttatgtatacaagaatggttaagagccaaggccatttgaagatatgaactctacaagggccaaaactaccatgtacatcctcacagcatatcacacaacaccactcaaatccaggggaacaccagtgttctaacgctaggtggtactagcactgtaactgaagttcccaaatgtctgcttccttttgtacttcagaactaaaactaatttgattgcagtatctaaaactgacattttcttgctaataaactgagttatatatggctactctacctttaaaattatcatttcacttcaaatttaaaaataaccaatcaatatacttatgctatcatccaaatttcaaaacaagctactttaatattagaaaatatttcaaaacaacctctggattttaaacctaaaatatataccaaggaatcatccctcagttatttagaaaaagactgataaataacatgataaaaatatgtttcttattgtctcataaatccaagacttgacattttcattttcttaaatggtgtcacacaaaactttttaaaaaataatcatttaagaaatgactgaattggcttacagaatactaattaaaaataactgagtcaacaacttggaatacaggaaaacatactaacagattctaaaaacggaactatatatgatacagagtatgtcctttatataattatgtcaatatatatttaacaattctacctaaagtaccttaacctatatcaaatgctataactattaaattatgatggtaaagaacatactatactagtcgcaagacatgtaaccaaatggatttatgaccaggctaaatgttttaccaaaattcaggttacattcaaaatacattcaaaatttcaggttacattcaaatattagaatcgaaaccctaaaattcgactattttttactttattcttcctcaaaccaacttttcttccttttttttttttgagacggagtctcgctctgtcgcccaggctggagtgcagtggcgcgatctcggcttcacgccattctcctgcctcagcttcccgagtagctgggactacaggcgcctgccaccacgcccggctaattttttgtatttttttagtagagacggggtttcaccgtgttagccaggatggtctcgatctcctgacctcgtgatccacccgcctctgcctcccaaagtgctgggattacaggtgtgagccaccgcgcccagcccttttcttcctttaatagttggtctcaattgcctaactataaatctttgttctgtggtattatgtatatcaaactcacttgcttcccccaccaaaagaagtacagctacttaatacctgaaataaaatcctaaccttagctttccatcctttatcatagatagctataactaagagacaagtagagagtgaaactacacccactgtgccagctgcacatctcaggtaaaaccaaaagtgcaaggaacaaaacgccctatgatcattctcgcttttcctgccctactgacagcatgctggagtgatgcagactctacaggtactctctatggtcagcactgatcatatacaagggtgtcaggccttatccagctcctaacaagagccatgtggccacccacagaattcttaggcttacataagtcagtccatggagactgctacaaaattagacagccaatttaaatactgcaagtctcaaatcagatatcctcagagatactcaataaaaagaattaaagcccaatgcactacagtaatgttagtgaagtaatgtcagttataatttgaagcctaaaccactatctatcagttgtatactcctaactacccctgcttgcccatttatctatctatagatatatagacagaaacattatctgaaagcatatttgtataagacctttttaaaaatctctctgggattaatttctcacatttactatttcccctcttgttctaagcgcaaaggaactgtactgacattttctactattctttcaaaaccaaaaggagaggataataaaaaaatccatctttatccaaaagataatactacacggtttccttatacactgagttttttcatgtacattgaaactatattctgatatatacatgaaagagtttacattctatacaacgaatcaaaacatagtcatagcaagtgaaatattcatctattttgggaagtcttactcttgctttgtcctacagcctctgcgtttaggaacaaaaaaaaaaaacacaaggaatggcaaaaaaaactcatgagagataaaattgcaatcaacttttatttaaatgagttgcataagcactctaatatttaaacactgaatgtaattagaaaccaaagttttgactcatatgtaagcacatgacaaacgtatatggtttgggagtttagaaagaaaagataaactgaaagtcctactagtagatcccattgagctggcatgaaccagaacaataaattatcattctgtctcaactcccaacagatctatgtgaccatctaatcacgggatatacaaatataaaaaacccacgctacaaggttctcaatctacaaggatcaacacaaaatcaagaacaacaaaaacaagaacaatctgtagcaacttaggacaatatttttaaattatgctccatgacactcctcaggtttggtgggccagtggggtacgtcatagcagcttctcatctattccacatttcaaatttcaaggtaaaattgtctcaagacaaagactgtgacaaaaattttttaaaccattacttttaatacactatgtacaagtgtgagatttacaaaacaaaggttttagtaaaataatttcacactttaatgtacacaggctcctcatgaaaggattcccttgcctcttcaaagtcagggccctataaccatgcctacattaactcagatctactgacatacagacatcagggaactgaaattaaagcaacaccccacatacttacaagtggcagttccttttcaaactgctcgaataaaaacaaaaactaattattcagaagagtatgtaacgtttattaaatagctaatacatgttaaaatttttaagtataataaaatctcattaaaacacagctaagaagagatcaaccagggattagagtgtgaataaaaacagtgccatgatttaaccaaaaggattccctgttacaatgacataatggactcctggcatttaagatatatgccaacactgatccatttccacatgggccatctataacaagcttaattaaatggtaaaaagaggacacaaacaggattcagaacacctggactctaaaacctactctgttcttgggcaagtcagtgagccccactggccctgtctcctcaaatacaaaatgaggcccataggatatataatcatgctgtccaaaatcactcttaattatttaaagacaaatgattaaacctcagtccagactaagataaaatccattaaagtgaattttaactatctaagttgctttttctatcttatgatctccctaggcgcatctggcaaaaagaacacgtgcaaaacaagcaactgtaatggaaaatagcattttcttttctttttcttttttttgagacagtctcgctctaccacccaggctggagtgtactggcgtgatctcggctcactgcaacctccacctcccaggttcaagcaattctcctgcctcagcctcctgagtagctgggattacaggcacccaacaccatgcctggctaatttttgtatttttagtagagacaggctttcaccatattggccaggctggtcttgaactcctgacctcgtgatccacccaccttggcctcccaaagtggggggattacatgcatgagctatcgcacccggccggaaaacaccatttttctaagtaaatcaattccccccagcaagatcgctttcccctcaactctcctcctgtccacagaaattccccattccctccaaagcctaactattgcccccagataaaaactctagctctagtgacaacacagctcaactctgagtgatccaacttcatatactaagaccaagtcctttgaagagacacatacctaaaagccattttaatcaatactatatcattgatagacagtggttaggtcatgagaccacagtgcaaaggaaggaatcagtgggatgttatagggacgagcctttgactttatccctccaggtttaaaaaatccttaatatgtaaaatgttatttatttgacttttttttttttttagacagagtctcactttgtcgccaggctggagtgcagtggcgtgatctcagctcattgtaacctttgtctactgcaacctctgcctcccaggttcaagcgattctcctgcctcagcctcccgggtagctgggactacaggcgcgcgccaccacgcccagctaattttgtatttttagcagagacagggtttcaccaagttggccaggatgttctcgatctcttgacctcgtgatctgcctgccttggcctcccaaagtgctgggattacaggcgtgagccaccgcgcccagccaatatatttgactttctagagatagtaatgtacttttgaatttttggaattttctaataattgctaatgttacagaataaaaataaaatagtaacagtagcttcttatatattacacctctacaacatgctaggcactgcaccaggttgtatggacaaatgatttttatttctcacataaccacagcaggcagatattagccttctttcacaaatgaggaaacaaggtcctgagtgactgcataaagttttttttttttttctttttcctgagacggagtctttctctgttgcccaggctggtgcagtggcgccatctcagctcactggagcctcccatctcctgggttcacgcgattctcctgcctcagcctcccaagtaaccgggattacaggcacaagccaccactcccagctaattgtatttttagtacagacagggtttcaccatgttggccaagctggtctctgcccacctcggcctcccaaagtgctgggattacaggcatgagccaccatgcccggccaagcataaagtttctaaaattataccaggttatatggatactgaactgccgagtttggaagttctgaagccaagtatgtctccagagcccaggcccagccttttccaccacgctgcttctccgtgaatttatgcggctaaatacactatacaaaggaactgagttaatacttaatttgtggaacagttaatggagggtgttataattagtaaaagcaagaactagaaaaaaaattcagcaactgacttaaaaagataagcaatctctcatacactgattataatctatccatacataaaattactactttaatattttacttcttttataaatcagtaattgctcatatgtattacatacctcatgtcatttaaaaatataaaccacttaagttttagctcatctccaaggtttcagatgacatatttaaacttaggaagtcaatatgaatgtcaccactgatttacaacttatcatttccaaaccaacagcagagaaaccacaatataatcattaaaaaacagtaaataatactgcgactgtactccctcctttccccctactcctagcattctaggtccacattatcttgatgtattaccatgctaaaaacctatgtgatagacaacatggtataatgtactcatacattactcattctttctctcccaacagaatataaactccatgaggtagtgaagggatctttgctttgttcattgttatttcccaagaacacagaacactgcctagtctttaagaggtgcacacatatttgttgaataacacgcttgctccaccttctcccataactgcttcctgacactttcctgagtcatcacccctaattcctggcaaacacattaacatgctacttttattaggatgccaaatcctaggctatagtattatcaacatgagcttaaacggtagtgttgtttaagacattatttttcaccctgtcaatcaggaggcaatatattagttacaattttataaaagaaatagaaaggccatgcgcagtggttgtagtcccagcactttgggaggccaaggctggaggactgtttgagtttgagaccagtctcggcaacatggtgaaacccatctctacaaaaaatcagccaggtgtggtggcgcctgcctgtagtcccagctactctggaagctgagatgggagggctgcttgagcctgggaggttgaggctgcagtgagccatgatcatgccactgcactctagcctgggcgacaaagcgagaccctatctcaaaaaaataaataaataaaaagtattctaactttaaaaatttattaattaaatttaataaattaaacttacctttccacaatccattctggtcgaattactttttccccctttaattctttaattttggcattgggaagatttgtggcaataatatgtgttgttttagatctggaataatatacatggtattgacctccatgcaacatcattagttttctcaattcctcagcggaaggatctgcaaaatttatattaaaatatattaagagtcttatgtgtaagaagtagaaccctaatgaataactccttaaataggtcaactttaagaatgtcattggttcaccttctccttggctgtgttgccagtaaacaaagctgggaggtaaatcacaaagtgagaaagctatgttgcttttagtacatcccccttccctggctgccagacaaccaactaacacaaaaacatctaagaagtgcctagcagagcaaatagggacctcaagtaatgaatcaaatactaataacagtacaaatatttttacattttttactatacttagcatatgaccttgatattgtgtttttaaaaattaacaactataaacccatttatgaatcattttacaaagactaatccttccactcctccagagtatacaagaggagtcagataaataatagttactcatatttactaaaaaggagacttactgtagggcttattagtagattttacttctagaaagctttataatttttatttttatttaagaaaatatcttaaaacttaatcaaatagtaaatattatccagttccctaatatgaaatttcattaaggccaaaaaataaagtccagcaaaacaaaaaagactgcaaaccaagaaacaccaatttttttcaattttgtttcaaatgatttattcttaataaaactacagaaaatatcttatatgtcttaaatattggaaatattttaagaaaatatcttaaagacacaatgtgacttatgcttccccctaagaagaaatgtctgattcactaaagtcatattatggcctgcattactagcatcacattaatcatcactgttctctttctttcacctatcatcctaatgaatgctctaactcacacctcccctaacaacagctgtacccagggggagtttccacatgtggcttatcgcaagcttaatcccaagcaatataggtccaagtatttaaataaacattttcattatgacaataattaggtgagctttagtttctagaagataaaaaactaacagcacatacagacataccaggtttgtctaaattttacagcacaaaatttgacattactgattacaaatattagcactattcagtagaaaatattatgcaagccacataaataaaaattttctagtaaccttattaaaaacagtaaaaaggtgaaattaattttatttaacccaatatatccaaaatattatttcaacatgtaatcaacagaaaaaatctgagatatttactttcttttttcttcttaaatctctggaatccagtgggtattttacatttacaacgcatctcaatttagaatagccatatttcaagtgcttaacacatgttactagcagctaccaaactgggcagtgtcatacaaagagatttaaaagcatccttttaaacaaaatgaattcaaaattaataatggaagttttcagggttaaggttaagttaaaaactgaactacagcatcagagtgatttaatgtgaaacagtagaaattaaacagctagccagtcaggaatctacagttcagtttctttctctaacactaaagaacctggctgatcttatagaataacagtgagaagtatcaaattaaaggctacattacaatgcattaatatgggcaccaaatccaatgaaatcacagaaatctaaaaaattaatttgcaagttaatctgtaactttcctaaactaattctatttaatgacttaaatagaaaacggctgtcctttaccgaataaaaagacacgtcaagaacacattaactttccatatacatactcataaagtactcacccgtctactagctgctctttgaaaactaattactccagaaatttggaactggaaaatacattgcccttctactggatgaagttaagagggctctttgaagttcacttctgaaagctcttacatattcttcagtgtgaagtgaagcatgaaaaccaatctagttaaaaggcaagatcacataaactatggaataagaccgatctgagtttaatcttagctttcacactcctgagttgtgtgactttggagaagttgtttaacttctttaggctttctcctctttctccataaacaaagctgttacaatgaaattagtctggcatgtagaggtcactcaatatgaaaactgctattattataaactatgatcacactagaactcctttcgagtaatgtatatgacctcaggatcctgccctagactctacgaaaaaaaaaatgacagaagacaatatacataggctgacacatggtgacccaaagtttcaacaaaaacagacctgccaatagtgcactatggacagcagccagggaccactttgtcaggtccaacaggctggcatgctaactgttggcatgcatggtcgctggaagctaccctattttgaattttttttttttaatttttacagcagtattcctctctggttctatttcttcaatactagaacatactcccttattacaagtccaaaagaacatacacgataactgcagatttgcataataaattcatttttgtatttaacactctcctttaattcagcagatgtggggttaattagaaaaaaaattgggagccaagcacagtggctcacacctgtaattccagcactttgggaagccaaggtgggcagattgcttgagctcaggaattcaagaccagcctggacaacaaagtgagaccctgtctctacaaaatatggaaaaaaattaaccaggtgtggtggtgtgtgcctgcagtcccagctactagggagtctgaagtggataccttgagccagagaggcagagtttgtagtaagctgaggttgcaccactgcactccagcctggttgacagagccagagcctgtctaaaaaaaaaaaaaaaggaaaagaaaaaaaaagggggagataatatccaacatcatgaaagctatatgacattaaacattgtgtgacacactgcctacagaacccatctctgcaatgtactgtaacagttaactttctccatagcactgataatctgaaattaccatgtctgtttgtttacttgtttactgtcagattcccccctggaacatatgctctttgaaggcaggaaccttgtctgtcaagcactttcatatccctgacataaagcaggtgctcagtgagtatttgctaaattcattaacatcctcaatgcatcccagactcctgcctagaatccaccctccagcaaaagtggagtacaagtggtataaatacttaaaatctcaaaacacttattcactcactcacaaattagagacgccatataatgtattaagaggacagactccaaagcaggaatgactaaggtcaaatcctggctccatcatttgctagttacttggatttcaggcaagttatttaacttctcagaacctcagtttcctcacatgtaaactggggataataatagtgtctcaaaggacttctgtgggaattaagagctaaaaattataaattactgagaaaagtaacttgcatatagtaaaaattatgtggccaggtgcagtggctcacacctgtaatcccagcactctgggaggccaagggggagggatcacgagatcaagagatcgagaccatcctggccaacatggtgaaaccccgtctctactaaaaatacaaaaattagctgggcatggtggcacgtgcctgtagtcccagctactcaggaggctgaggcagcagaatcgcttgaacccaggaggtagaggttgcaatgagctgagattgtgccactgcactccagcctggcaacagagcaagactgtctcaaaaaaaaaaaaaagaattatgtgtcagctcttaacaatattatcagtattatttttaccatttcttaccccaaaccgggaagcaagaaggagctctagagctaaagctgctctctattcacacaaaacattaaattttgcaattcataatccctcctacaaatccttctcttgttgcccacccttcagtatatactccttcaagaatgtccttgatgtactagcaaagaataaacagaaaataaaaaatcaaaacaggccaggtatggcggctcacacctataatcctaacactgtgggaggccaaggcaggcggatcacaaggtcaggagttcgagaccagcctggccaacatgatgaaaccccgtccctactaaaaatacaaaaatcagctgggcatggtaacacgcgcctgtagtcccagctactcaggaggctgaggcaggagaatcccttgaacctgggaggcggaggttacagtgagccaagatcacgccactgcactccagcctgggtgacagagtaaggctctgtctcaaaaaaaaaaaaaaaaaaaaaaaatcaaaataaaacaaaactagattcagggaaattctatcctccaaatttttacaatcaatgtcactgttttgaaatgtcagagtgagtgcttttctcctcattgttctttgcctttttattttttatttagagacagggtctggctctgtcacccaggctagactgcaatggctctatcatagctcactgtaacctcaacctcctggttcatgcttgtaatttgaaagatttgggaggctgaggcaggaggatcatttgaggccatgagtttgagaccaacctaggcaacacagcaagatccgtcttttaaaaaaaatccacaaaaaaacaaaaacaaaaacaaacagaaaaggctgggcacggtgggtcacacctgtaatcccagcactttggtaggccacagcgggtggatcctctgaggtcaggagttcaagaccaagtctgaccaacatggagaaaccccgtcactactaaaaatacaaaattatctggatgtggtggcatgcgcctgtaactccagctacttgggaggctgaggcaggagaaccactggaacccaggtggcagaggttgcagtgagccaagatcccgccattgcactccagcctgggcaacaagagtgaaactccagctcaaaaaaaaaaaaaaaaaaaaaaaaaaaaaaaaaaaaaaaaacccaaaaattacgtgtggtggcacacacctctagtcccagctactcaggaggctgaggcaggaagatccgttgagctcaggagtttggggctgcagtgagctatgatcagtctactgcactctagcctgggcaacagagcttatcttaaataaacaaataaataaaattccacaatactcctactattagttttattttgcagaacattctatatgcaactaaatttgaggtttaactaaaaccagacatagtgacagacaattgaaagcacagtaaaagtaaaagccatatacaaggaccacaatttagcccacgtttagacctaaagccctacaagtaaaatgtcacaagagcaaatgccaccatataacatcaaaacagccatatgaagaccactttcacgtctgtaggcccagcttatagaaagttttgctcatctggttaaaacaaattctataaacaaaatttttaaatcttgcacaaaagctttcctagctagatctctattgagaaaacatttactatatgcaccatttcctcctgcatatccaaagaacttaattaattgttgactgtgctatataaatcacagaaagaagtgaggtgaatggctgcttatacctcctttgctcctaccatggcaacatcttcattatttcatttgagtttcacaatcttatgaattagaaaagataacttattgatgaggcaacagagaaaacttactgtgcatacccttctgtctttggactcctgtccctcagtttctgcagcagcaatactactctcttgactcttctcacccctaactacctcagacttaccaacagagtcaccacaatcaactaaaagccacggatacactcaaccaaacaaaaactgaagaaaagtttcaaatgcttagggaacaaatttttgagtaccaactaggtgcaaatttcacatcaggtactagcaaaattacaggaggtggcataaattaatatggtaagtcttctatgtcagaggttcaattcctccatctcttatctacaagatgagagtctcacaggaaatggaaggagagatattatatatccatacaaaataatatctgggaggcatttatttccaaaaaattagacttgtcaacactaaagagaatcctctcctaaaacaccacatttgtatgtttagaaaacatcaatgtaagctgtcagctttcaaacaaatccttatttgaaatataagtctgttacacttgcatattcccccttgtttcattttgtgaattgtgctaaagtacttgtccgggcccccctccacctgctttttcacaaacttcagcagtgccaaaatcaaaagacctggtcttttacccatgtactaaaggaagtagaaaataacctgaacacctctttccatatgaactgtcccaatctcacaccactaaagtgcaaccactgtccactaagtctgaagcactcactccccctgggcagctttcacaaaaataaacatgcccagagcctacctcccagattacaatgcaggcctcaaatgtggcccattccttaagactgagttgatttagcatctgagtgaaaatattttaacattctgatgtacaaatacaaaacctgttatttatttattcattcaactaatacttattgagtatctacaatgtgccaggcaaggttctaggcactggagatatggcaatgaacaagactcaagtctgtgccccgtgatagcacttgtattccactgaggagacaaaaataagtcatgcaagtaataccattttaggtgcaaataaatgaagaggaaggtggataaggggttagagagcgactggagggcaaagtacacctgttttagataggtgaagtcagggaaggtctccgtaaaaaggtaacatttgagcagagatctgaatgatgaagacctgaggaagcagaaggaactgcaaatttaaggccctgaggtgttatctctaatccatgtttggcaagggattactatacataaaacaggcttcctaacgccaaagaacttaatatagaattaagacctaacaacacaagacaaaatccaggtgtcaaaataaatgtttctagcaataatgctatgaattatatatctctctatataaaatactactactatggactggcttagacagggaaggaggcaaaacctaactatatctggatcttaatgaatgaatatacttccagttcacagaagtgaggagggaaggagtttttcctcagaggcaaaagaacaaacagaaacacagaactgtaaaagtaaaaagacaaatctagaatatcagggtaatcttgttgagcaaaatttaagaacatgaggttgaaaatgtaggtcagaattaggactagaatgtctttctccattttcatttggaaaatgcctatttatctaagaccaagctaaacatttcgattcctttatgaagtattcactcccactcccaaaggcaattgtttcctcttctgtgttggcactcaccctcctctgttgatgtctaaggcttagagattactttttcatcacaaaatccacattctccatcaactgctatctcttttcaaacatagttcctaacccacaagcagcatccaaaatatatctgttcaatcaactaaagaaaaataaaatgggatataaggtctgtaaactagaaaactcaacatagtaaagatgtcaattctccccgaactgatctacaggtttaatgtaattcctatcaaaatcccagcaaggtattttgtggataaatgacttattttaacatttatataggtcaggtgcactggctcacacctgtaatcccagcactctgggaggccgaggcaggcaaatcacctgaggtcaggagttcgagaccagcctggccaacatggcgaaaccccatctctactaaaaacacacaaaaaatgagctgggcatcatggcatgtgcctgtaatcccagctactcgggtagctgaggtacaagaatcgcttgagccagggaggcagagggtgcggtaagctgagatcataccactgtactccagcctgggtgacaaagtgagaccctgtctcaagaaaaaaaaaaaaaagagagagagaggcgtaggtcctagaatagccagaattatcttgacaaagaagaaacaagtgaaagcaatcactctacctgatatcaaggcttaccacataggtacagtatttgatatagtgtggtactggtgaaggaacagacacaaacatcaatggaagagaacagagaacccagaaacagatccaccaaaatatgcctaactgactgtgttgcaacaactggaaatccacaaataaaaaaaaaaaattgtaaaacctcaaaatgaaacattaacttcaatgtaaaacataaaactataaaatctaaaaatatagaagaaaacatttgggatctagcaccaaagtgacaagttcttagacttgcaagcacaatccataaaaggaaagatcaacatatcagatctcatcaaaattaaaaacgttctgcaaaagaccatttcaagaggatgaaaaactacagactgggagaaaatacctgcaaaccacttttatgacaaagcagtagtctctagaatatataatgaaatatcaaaactaaacagtaaaaaatactaaatccaattagaaaatgaggaaaaaaatatgaacaaatgtttcaccaatgatgatgtaaagataagaaataaacacatgaaagaatgttcaacattattagccacgaggcaaatgcaaattaaaatcacaaagagatacaacaccatctattaaaatggataaaatgaaaaccactgaatgctggcaaggatgcaaagaaagttgatccctcatacaaggctagtgggagtataaaatactacaaccactttgggtaacagtttggcagtttcttacaaaaactaaagatgtaactattacgggaaccaacaactgtactcttcttatactcatacaaaaactcatacacaaatgttcatagcctaccaagaaataactgtgatgtccctaacagatgaaaggttaacaaactggtacatccacactatgaaatataactgaacaataaaaaggcaacaattttgatgacctgacagataatttatgctcagtgaaaaaagccagccccaaaaggttatatgctgtatgttttatttatataacattcttgaaatgacaaaattataaaaatggagaccagattagtggttgccaggagttaaggaaaggcggagaacagaagtgggtgtgactatgaaagagtaacatgaaagatctttgtagtgtggaggccgggcgcggtggctcacacctgtaatcccagcactttgggaggccaaggtgggcagatcacgaggtcaggagatcaagaccatactggctaacacggtgaaaccccgtctctactaaaaatacaaaaaattagccaggcgtggtggtggccacctgtagtcccagctactcgggaggctgaggcaggagaatggtgtgaacccgggaggcagagcttgcagtgagccgagatcgcgccactgcactccagcctgggtgacagagtgagactctgtctcaaaaaaaaaaaaagaaagatctttgtagtgtggaaatgttctgtatattaactgtatcagtatcaatttcccagttgtgacactgtttgcaagtttattacatattaccatttggggaaactgggtaaagggttcacagtatcactatgtgctatgtcttacaactgcatgtgaatctacaattatctaaaaaaaaattaatttaaaaaatggataggccagccatggtggcccatacatgtaatctccacactttgggaggctgaggcagaagaatcgcttgagcctaggagtttcagatcagcctgggaaacacagcaagaccttgtctctacaaaaaattaaaaaatcagctggacatggtggtacacacttgaggtcctagctacttgggagcctgaggagagaggatggcttgaacctgggatgttgaagctgcagtgagccgtgatagtgccactgcactacagcctgggtgacagagggagaccctatctcaaaacaaagaaacaaacaaaacaaacaaaaaggatagaaggcaaagaagtcaatcttaacaagcaaaaaacatttttggggccaggtgaagggaagaataggttgacaggtgaactattagagggtcttccctccaagttcaagttcaatgttaactgggttggaaggtatagggactacgaaatcatgagaggctcaaatggctgaactgggagctttaaaggaatcaagaacacttggattattacagtttgtggggagcatggttaagaatcaacaagaagggacaccacagcttcttttacagtgaaaactgcatctcccaggtttgcaaactgttcactggaatgaagtctctttcctccaaattccttttcagagaactttctattttctttttttcactctatcgccaggctggagtgcagtggcgcaatctcggctcacttcaacctccgcctcccgggttcaagtgattctcctgcctcagcctcccgagtagctgggactacaggcgcacgtcaccacgcccagctaatttttgtatttttagtagagacagggtttcaccatgttggccaggatggtctcgatctcttgaccttgtgatctgcccgcctcggcctcccaaagtgctgggattgcaggcgtgagccaccgtgcctggcctgaaaactttctttcacaatagcaatgagcaaaactgacaaagtctgcacctttggtgcttacatgctaatggagaagaaagatgataccaaaatatatatataggcattttacaaaatagctgaccagtactcctcaagactgtgaaataaagcttatttttttaaatcaaaaacaaaatagcacctcctacttgtcttattacatctaaagagttatttttacttgctaattgttaatgctgttttatctataaagtggtaaagtattcactaaaacttaatttttctaaaaataaagttattttacagcaccacagtttggatatctcggtgaaattcagcataatggaactttatttgtacagttataatgaaatcttaataacaagagcaaaaatattatcatctctatcctgcagaaaaggatagagataataacagatctaaacagaaaatgttttacagtcacacaaaaattagtgataaaagcagatttagaattccagattctcaatcaaaaagtgattactgcaatattcatttttcttccctcacacaaagaatctctttttcttcctcctatgtgaataagggtgctctcttgaactggagacttccatgactggctaatgtaagaagcaatgcctgttttcattaacgttttaatttttcatagagcatctcaggaagtccacagagcttgaatttgtcaggataccttcctacacagaaaagttacaagctttctgcatgtgaacttcccaatgctgcaccagcatttattttgagatgacattcttggactaaattcatcatcaatgatgcctaataaaacacttaattacaagcaacacactcttctcttactaaaccagataaatgtaccagttaattaatacttaactccaattcaacaaatatgtcctgaatgattgtgtccagtcactgtagaggcactaaggatatagtgatgaaaatgtagctccagctcttgtccagtaaacagacaactatggaaaggtctgaagaattctaagatgcagattcattcagggagccatagctccagaagagcacaagaagtcacctaaatcagtatgaagacagtcaaactatcaagggaaagcgaggcatggagacctgaaagatagcaggtatcagccagctgagaaggggacaggggaatatgtaacagactgacacaaatatttacagccattcacttcaaaaaatacaatgaaatgataagaagaagaatccccaagaaaatagagaaaaatttaggcagaaaacctggtaactaacaggcaagtgctaactgactttacagttcagcgaaagataaaactgaagctggccatatggaagcttggaaagaagctgcttgttaccagtaaaacaaagagaaagtcatgaaataaacacacaggcaccttcaaaagtggatgtgtggataaattcatccttgaaactgtgcaacaggcaaagaagcatttgcacatttctttcctttcaccaagaataaagactacactaccccttccagataccggactcaatgacaataggcacagctggtggggaggaggtaggaatgagaaaatgaatagagagactaagtgaaattttacttcctaaactgtgagaattcaggtcctttccttccctgcttggcgacccaaatgctggcagtttacactcttctacagacaagagagtaaaagattcttctctaggaaatctgacactgacacacacccacacaccaccccaccctaaaggacctatggacaatgacatctagagatttaccaatgaaatggacctacagtgaagctcacagtttacaagtcctactacccatgtgtggtaatttcccgtttttcattttaaacctcacgtgactttttgaaactatgtactttgataaaagttaaagacaatggcaggtaaaagcaacatggaaaggaaaaagaagtatctaagcagatgatttatttcttctcatcttacaatcatttgtctataataaatgagtaaaaatagaattttaaaacaaatcattctcaatcctaataaaaatacatgccaaaatagggttaagtaaaaagtactcaacctgtgtatccattaacatagatggcaactccactaaaaattgtagatgaagtcccatccttctgcatagcagcatctgatcgaaactgttcctccaatttctggaccttggcagccatatacccaccctagaattaaagaaaaggtaaaccaatcacaaaggttacattttctccccccttttttgaaaaaaaaaaattttaaaaactaaataaataaatggaccttattctgtgctagtgaccagaacataatgatgacctcataaacataaaccataaggcaaggcaataaataaaacaggaaagttgggccgggcgcagtggctcacacctgtaatcccagcactttgggaagctgaggcaggcggatcacctgagatcaggagtttgagaccagcttggccaacatggtgaaaccccgtctctactaaaaatacaaaaattagccgggtgcagtgccaagtgcctgtaatcccagctactcgggaggctgaggcaggagaattgcctgaacccaggaggtggaggttgcagtgaggtgagatggcgccactgcactccagcctgggtgacagagcaagactccatctcaaaaaaaaattataataaataaatataaatacataaaacacataggtcaaagaagaattttccctctatcaactcaagttttaattttattacattcttatgattataaaagttacttttaaaaaaagctaagtcaataataataatactggctgggcacagtggctcacacctgtgatcccagcattttgggaggctgaggtgggcagatcacctgaggtcaggagttcgagatcagcctgaccaacatggtgaaacctcgtctctactaaaaatacaaaatcagctgggtgtggtggtgcatgcctgtaatcccagttactcaggaggctgaggcaggagaatcgcttgaacccagaaggtggaggttgcaaacgagctgagatcgtgctattgcaccccagcctggacaacaagagcaaaactgcatatcaaaacatagtaataatatcacaaaatattgttcttatgtacacaattgagcaagctacaccaaagtttaaaccaattacaaatttgacaagtggtctcagagcatattttattttatttttttgacagggtcttgctgttgtcgcccaggctggagtgcagtggcacgatctcagctcactgcaaactccgcctcccaggttcaagcaattctcctgcctcagttcccaagtagctgggattataggtgctcaccactatgcccagctaatttttgtatttttaatagagacgggatttcaccatgttggccaggatggtttccaactcctgacctcaggtgatccacctgcctgagcctcccaaagtgctgggattacaggtgtgagccaccacgcccaacctcagagcatattttagactggcttccactatctcccacatacagagggcttaaaatgaattatttcaggtaaaaatgaggcaactggataaaccagtgtagtcctccctacacatgggaaagaatacaatgaatgctccagtggctaaattctggatctaatcaatctatttgatagtaatattaactttcattagataacattcacctcacaataaatattaaaaaataattttttttgctaaacatcttgacagatctagggattcaactatacttttcctgaactttgatataattaagcttgatttcaattattaggtctttaaattaaaggtgtaggtggctagaagtacatgatgtttttttcccaaaatggaaatgactgcattatttttgctgattattaaaatattatatgctcactatgaagtttcttttcagaaaatacaggaaatatggggaagaaaattaaaactggtataatcctattcattaaaactttggggtgttgttttcaaagcttatttccataactcagagcacagaggttttacaaacatataatcatacaaaatatttctttgtaacacattgttttagtcaaggttatccttccaggttgagatatataaagctgaataatgactgtacagtgctccactatacacagataacttatttgaccaatcccttattattggatatttatgtgttttcctgtttttctgtattattagcaatgctgcaataaaatcatcatatagtaaattattgtgcactaggcatatttatttcctcagggtaaaattcctgagagtaaagtttaggggataaagtttataaacatcataaggctttcaatacactgtgaaaactcaaagatgtggtgtctaaagtaatttacaatttagaaaacaacttaaaccacattataacagaagaatgaaaaataactagacagttcgatataattatttttactcttttaaaacacacccatgtttcccagccatcattttcagctcgcttcctccatccacctcgcctcatggtggagcttctgtattggggaggaaaaaaaaaatgtcaattttataacataatgtatttctaaatgatattttatttcaatatcaagaaaatgagaaattaaattcaaatgtccaactgatgaaagtatacaatattaagtaaactttttctgaagttctccattctccagctttacaagtgaaatttgtctataaaacaccctcctacacatgtttaaattgtaactcttatatttaaaattcaatagaaaaatatctttatgcattcctgagcaccaatcctaacattcacttacataaaacaccaaatccaactaacatggccatgcttactttacttgttaccattatataagacaatctaacaaaacatttcccttcatgagttgtcctatagtgtggcttttaaactctgtctttgctattacatactggacacttaagagttcagtcatagcctgattcacatattctgccaaagccctagaagaagtcaattaaaaatgatgcagaaaagattatcattgataataaactataatagtaaatctgtcattctccttaaggcaacacttacttaactaactatactataaaaccaccaggatgaccaaatgatggctcacattaagtggcagctggctcagtggctagcaaaatatataattcataaaaagaggctaaatgaaaccccttgtaaagtcaaagccttttaacacaaacagctacattttgggctatgactacatttattcttaacaaaattaatatgacttctattaagataattttcttctagtaactatatacatgtgtatcaaatggttaccatatgaagccttatatattatccacgtcaaatcagctctgatatgatctatgagaattttttacttaacaacaccttaaaccatgacactttaccccacacacattagcagataatttctttctttctttttatttatttattattttttttgagacggagtctcgctctgttgcccaggctggagtgcagtggcgcaatctcggctcactgcaagctccgcctcccgggttcacaccattctcctgcctcagactcccgagtagctgggactacaggtgcccgccaccacgcccgattattatttttcttttttttgtatttttagtagagacggcgtttcaccatgtgagccaggatggtctccatctcctgacctcgtgatccgccggcctctgcctcccaaagtgctgggattacaggcgtaagccaccgtgcccggcctcttttttttgagacaaagtcttgctctgtcacccaggctgaagtgcagtggcacgatctcggctcacaaccacctccgcctcccgggttcaagtgattctcctgcctcagcctcctgagtagctgggattacaggcacctgccaccatgcctggctatttttgtatttttagtagagatggggtttcaccatgttggccaggctggtcttgaacctctgacctcaggtgatctgcccgcctatgcctcccaaagtgctaggattacaggcatgagccaccatgcctggccagcagatattttcttatgaatatttttattcttagtatactgcaggatttggtttttgtttgttgacatttataacaatttgaatttttactgtcacccttaaaagatgcctaaaagacatgcagaagtgttgtcaaaaggttaagtcccaacagagagacaagataatacaaacgttttaggggcatgtgcaaggtgctccgagaaaaggtggtaaactgattaaccctgaggagagatttcttttttaagtctgatgaaggcaggaggagcatgaatacccaatgtgctcattatcaagtcccagaagtaccacatgctctgttaaatatttctcctgttttcaagaggctcattttgtccagtcccaacagacttcagcccttaaaggaaatctgggagatacattaacacacagcactggactacatgtaaactgaatccatacacctgctggaacaagtaaagagtttgggagttctggccattatacactaaaaacacataccccgataattaaaggcagctattaaactgttaaataaaggtaaataaaggagtaaagtgtattttaatacatttggtggcccaatcatttaagagatccagttgtgtaacgtctgttgtatacctactgcacaaggccaataagaaaattccttaatgatggtttaatgaggctagaagcatgaaacacagttataatacaaaaacaaaaattaaaaaaaaaaacagctattaagggttctttcccccaactccaaagtaacaaaactattccagacaaatgtttaaaactttaaaaggaaaaggaaagaatgaaggactgaaaattttagcttcgtcatttccaataacttgactcatgaacaacaaactcctattgatccagaaatcaaacaatcaaaaattactagccaacattccaaagaggacaaaaatcttcagagatctgccaccccacctctcttccccaaaccagattatttttccctctgagaacatttggcaatcctagaagagtggctgggagactgggcaaagtttctgacaaacagtgctaggagagaaaaagtagagtccaagggtcttccaaggataaagattgccgcaattgctatcagaaccctatgagtaacaagaaattggaagtagacagaccaaactttgcagaaactgtattcattatttcaatctctgaaaacagattaaggtgatcgtgggccaggcgtggtggctcacccctgtaatcccagcactttgggaggccgaggtgggtggatcacctgaagtcaggagttggagaccagtctggccaacatggtgaaatcccatgtctattaaaaatacaaaagattgctgggcacgatggctcacgcctataatcccagcactttgggaggccgaggtggacagatcacgtgaggcggggagtttgagaccagcctgaccaacatggagaaaccctgtctctactaaaaataaaaaattagccgggcatggtggcgcatgcctgtaatcccagctactcggaaggctgaggcaggagaatcgcttgaacccgggaggcggaggttgcggtgagccgagattgcaccattggactccagcctgggcaacaagagcgaaactccatctcaaaaaaaaaaaaaagaaagaaagaaaaattagccaggcatgggggctgtttctgctaatcagcagggatcttcgaaaaagagactccgccaatgcctctgtaataacatccagggaaaagttctccacactaagatgactgatttgcttctttaaataggactttccctagaacggaggagggcatttaatcaggataccactacttgacagaaatatccttcagaaataacacactccctctgtttttatcctgttccaagcaacctcctgaattacaatgtgtcctcttgactaaacctactcactaagaagtgactgccctgtattgacaaaccatccaattatcaagctagacttgtaaacaaaaattgccttctagttttcagaggaactcttgcagaccaggctcccaatttaattccacataacttgatgaccttgaggaatgtgataacagtttctgaaactgtgattcacaacctaaaataacctgccaatctctccttatccagtaactttaacagggcagccaattactgtgtttcaaaaaattagtttaaaaaacggatgaagagtgaatacatgaatgcaaaagtacccttacccttaacatttagggtacaccttcaataaacattaactactgttatagtaatctactctgccagtctacagagtgaaaatcgagtgagactacacacgtggaaaccctttgaaaactataacacagagaacatcattattttaagtcagttatccatggtctacaacataatgataacagtagactagatacggactcaaatcccaattctacgactgcctaacaatgtgattcagagtgagtctaacagcactgagcctaacatttcttcatctataaaacaaagttcgactgcagaatctttgtggggccatgactggatgaagggtggatatggtggggagaagaaaaaagttgggggtaaaaacagcaagcaagcaaggttccagtctctaagcccaccttcaattttagcagccatgctttttttcccccgtaagttttaggtttagggtctgaacaagattgttcttgaagaaaaagcacgacaacttgaaaaagactgataactaagagtaatgaactaaaaactaagtacaaaatttcttggttcttttctgtttccatgtgactctgtaagacagtcacatgtggaaatctcccaaccctcgaaaggttcacaagctaaaactcacctaccagctaaaactcaagtaatcaaattataaagaccaactgaattacaggctgtcaatacagccatgtccagtccccagtgctaacatgcagtaacaactagccaggtgaggtaaggttaaggcaaatgggagagcagctctgtctatgaggagcccagggatcctgaatgcctacacaagacttcctctttccattctctcaatagggatgttcaaaactctatcaagagtctcatcaaggacatgcttatttaaaaatataacaagactacttatgcatgcatttttcctaatgttttatcttttgctggaacacactactatcagttcattctaaactttattctgctttctttttactatagttattggtagattttactatctaccccgagaattatgtttatcaccaggaacattcattttcatgtaaaaatgatatttcctagcactctggggggccgaggcgggcagatcacgaggtcaggagatcgagaccatactggctaaaacggtgaaaccccgtctctactaaaaatacaaaaaattagccgggcatggtggcggtcacctgtagtcccagctacgtgggaggctgaggcaggagaatggcgtgaacccgggaggtggagcttgcagtgagccgagattgcaccactgcactccagcctgggcaacagagcaagactccatctcaaaaaaaaaaaaaagatatttcatctatttacaaaataattactagcattacaaggttctaaacagttcatcacacactagaaaaacttccactacatatccacaaaatgttcaaatgttcagtgttaatctgatggttacatatctgtaactctaaagtctgttgattaactaatgaaattcattttgagtggcttttaatcagtctttattaatacagtcatatataaatgtatacatttgtaaaaagcaaagtagaggttcctcttcagactctcctccccgtgtaattaggaataaatagtaacttctcttagaagcaaaatttattcaaagacctgtgctaacattcttaaacatctgctagccgtaataaagaaatcaatgtactttatgttcttagctcccacaatttagcctaaatatttgccccggcaagcttatactggtccaagcaagcgttaggtcatagcctgttcctcttccttatttgaaggtgtttttacctttctctacattccacaagttacttcctccttcctttgttctcctctgcctttgcctcttttaaaacaagattggctaagttgctagccaatcagaacaaatacagaatgtgaggtcctgttccagccaatggaaaccgggcatagcagcagggtggacgcatcaggttataaatgacccggtctcctttgttcggtgtactctcatggcaaaactgctggcgagtgtaccctttctgcagaaagtataaaaatggccttgctgaggaaattaaatttatgttcaagtgctacttctttacagcaccagggaacaagcattccaaagaggtttatcctatctttatgtaatagttatctaagaaatatttactgaatgtagttacaaattgacatgcaaagaatatgcaatgaatgaatgtgcacattatagtagcataacataattcatgaatatgacacaaatgcaaagaaagcagcctgtggccaccccttatctaggcaaggttgaaacacaatttgcctttggtgccctgccatatctctactcaacacctctctgttttcagtgcctctttatcttacttagctgtcaattctctgctaaggcatttattgacaactaaggaactggttaataaagggcttaaggtatgatccaacccagggtcatctgtgtttaaaagaacctcttcatgaccattcaatgaggaaaggacaatcttttcaacaaatggtgataggaaaactggatatcacatgcaaaagaagttggacctttacaccatgttaaaaaaaaacttaaagtgtacaaaagacataaatataagagctaaaactatcaaactcttgggagaaaacataaaagcttcatgacactggattttgcaatgactttttggggaaaatgtaacagaaaaaaacagataaactggactacataaaaatttaaaacttctgtgaatcacagggcaaaaaagggttaaaaggcaatccacagaatgggagaaaatatctgcaaatcatatctgataaggggttcatacacttaccaatataaagaactcctaccataaactgtaataataaacacacaacgccactaagaaataaaaaaaggatctgaacagacacttctctaaagaagatagacaaatggccaataagcacacaaaaaaacgttcagtgtcattaatcactatggaaatgcaaatagaaaccacaatgagataccacctcacacccagcaggatagctactattaaaaaaaaaaaaaaaaaaaaaacaagtgttgataaggataggaagaaattgggcccccgagccctgttggtgggaatataaaatggtgcagctgatatgagaaacagtatggcagttactcaaaaaatctgaaatagaattatcatgtaattccacttgtgagtatatatccaaaggcactgaaacctgagacacaaagaggtatttatttgtacattcatattaataagcattattcacaatagccaaaaggtggaagcaacccaagtgtccatccacagatgaatgggtaaacaaaatgtggtatatacatacaacgaaatactattcagccttaaaaggaaggaaattccaaagcgtgctacaacttgcatgaaccttgaaggcattatggtaagtgaaataaaccattcacaaaaagacaaatactgtatgattctacctatatgaagtatttaaagtagttaaattcagagacagaaagcagaatggtggttgcgggtggagttactgtttaacaggtagagtctcaggcaaggtgaagagttctggagatggatagtggtgatggttgcacaacaatgtgaatgtacttaatgtgactgaacagttaaaatggtaaacttttatatgtatcgtaccacaattaagaagaaaagagttttttaaaaaagtagttctgaagctggaaacactgtataggcacctgcaagctgcagtggacaggatcttcaggtggggtgcaaagctgggaaaaaggctacttcaagaaatctgtacagcagtacctgggtgttttgtttgttttttactttgaattggcagtagtgggaggccatttgtagaatttacaagaaccaggtattgcctttatgagtgactaagtacataaagtgctagcacgcatgccctaaaaaaagtttggtaacagtctgctccaatgtgctcttattctgtcctttaatggtaaaagttttaacagcacaaacagctttttatgtaacatttagatataaaaatacagctgtttgtgggttttgttttgattcaaccttacagaccatcattgtctacggctacagttttcaaacaattgctgaagttgtacgggcactacagacatgcacatcccacaaactagtcaggttttgatcttgaagggactctcaccaaggtatataaaacaaaacaaaaggccgggcctggtggctcatgcctgtaatcccagtactttgggaggctgaggtgggcagatcatttgaggtcaggagtttgagaccagcttgaccaatgtgatgaaaccctgtctccaaaaatccaaaaaaaatattagctgggagtggtggcgcatgcctgtagtcccagctactcaggaggctgaggcaggagagtcacttgaacccaggaggcagaggttgcagtgagccaagatcgtgccactgcactccagcctgggcgacagagcgagactgtctcaaaaaaaaaaaaaagaaaagaaaagaaaagaaaaaagaaaaaaattcagacacctaggtgaagggcacaatttcccagaagtacaagtactggctctggaaacctctacttgcttttagcgactgattctaaaccaagccaacagttcacattctaagcatagtgctgcgtgtctttcatgtatttaagatatcttttaaaaatatacaagtctaagatatttagatcaggctttattcctaacctaataaaacccatttttgccactttatgtgttttttttacaccttcagcatactgaaacattttcctgttgctaattttttctgctgcaataaaacaatttctgtaccagatgagatactatcttgataaacacagaattcaaagaacttcaatctatcaaagtggcacacagcactctccacagaaaaaattacaggttttggtacataagccttttcttgaagtaagtatgatctttccatcttttcttgggacattctctattattccttcatcactgacttgtgtttatacactgctttgtaatgctaagtacagtatgcaatcctgctaggtgttccttttcaaaaatagtttttcttgctctatttataaaagcaattcgtgtttattgcagaaaattggaaaatacagaaaacagaaaaggaaagaattacccaaattcctaccacctaaaaaaattcacctattaactgacactttatatttccttccttttagtgttcctttaatttttaacattcaaatttaatttatttacatttcacattactagtaatacctttcacttctgaagtatccttagttttccaagacccctttacatctaccatttatctttacaactcatccatagagtgagtcagccaagtcctatttattttgcacacaatagttgacttctagggtagagaagctaaaaagttctgtaaggctgcactgctggcttgtggtacaaaatcatactcatcttctacaaaattatgttcccaaatcttcaatggaaaaaataataatggtatcaatatgaactgctaaaaagttaagaatactcctattgatctgaagtaacctaacacaattcaacaaaacagatgcttcttcaccaggtaatctagcaacagtctggatcataatagagccatatatgtaacaaaactaaggaagaaaacaggtcctacaattaagctccatctagaccccaactagtccatattgataagcagaagtcgggagcgatggctcacgcctgtaattccagcactttgggaggctgaggcaggcgaatcacatgagatcagaagtttgagaccagcctgaccaacatggtgaaaccctgtctctattaaaaagaaaaaaatcagccgagcatggtagcaggaacctgtaatcccagctacttgggggactgaggcacgacaatcacttgaacgcggtaggcagaggttgcaatgagccgagattgtgccactacactccagcctgggcaacagagtgagactccgtttcaaaaaagaaaaaaaaaaaagaagtagagattcaaagacagcatcaactttgttgctaaccggttctctgaacttaagcaagtcataatcagtcatattttagttcctccgtatgtggaaagagttggacctgtttgaaatgcttgttccccggtgccataaagaaacagcacttgaacataaatttaatttatttagtaaggccatttttatttcctgcagaaaaggtacactcgccagcagttttgccatgagagtacaaggaacaaaggagacagggtcatttataacctgatgcgtccatcatactgctgtgtctggtttccattggctggaacgggacctcacattctgtatttgttccgattggctagcaacttagaactttttaaaagaggcaaaggtggaggagaacaaaggaaggaggaagtaacttgtggaatgctgagaaggataaaaacacttttaaataaggaagagaacaggatatgacctaatgcttgcttggaccagtataagcatgccagggcaaatatttaggagcacaggtctttgaataaattttgcttctaagagaagttactatttatttctaatcagatggggaggaaagtctttgaagaggtacatctacttttactttttacagacctgacaaattctagagtcttttgcaattttttaaatgtacatgattctgcgcttgaacccaggaggcagagattgcagtgagccgagattgagccactgtactacagcttgggtgacaaagcaacactctgtctcaaaaaaaaaataaataggccaggcacagtggctcacgcctgtactcccagcactttgggaggccgaggtgggtggataacaaggtcaggagttcaagaccagcctggtcaacatggtaaaaccccatctctactaaaaaatacaaaaattagtcaggcgtggtggtgggagcctataatcccagctactccggaggctgaggcagagaactgcttgaacctaagaggcggaggttgcagcaagctgagatcatgccactgcactccagcctgggtgacagagtgagacttcgtctcaaaaaaataaataaatgaaaataaacaaatgtgtatgattctacacatctagttttaaaaacgctttcaacaaacacatacatattatgcaactttacgtaactttttctatgcttgccaaaaaacaacaagatgtacctatccacagatgtggctgtgcagtaagaatcctaacccaaacagatgtttggcctttgcccttggttcctgggaggtaatcctttcttttcccccccttcacatggtccaagatgagactgggaggtaacctctaagcccttagaacgtccaccttatgggagcagtgactcacgcctgtaatcccaacactttaggaggctgaggcgggcagatcacaaggttaggagttcgagaccagcctggccaacatggtgaaaccccatctctattaaaaatacaaaaattagccgggcatggtggcacacgccggtaatcccagctactcaggaagctgaggcaggagaattgcttgaacccgggaggcggaggttgcagtgagcccagattgcgccattgcactccaggctgggtgacagagcaagaatctgtcaataataataataataataataataatgtccaccctgttaagtgcttttgtttacctgggggctttgagccactccagatagttttgcactgtgatttaaggtgaagggctttgagccatgtattatcaacctcctgaagggctgaaaactaaaggtcaaccatgccaacagtcaatcatatctaagtgaccaagtcccagtacaaatgctggacaccaaggcttgggtgagcttccctgataggcaatctccatgagtagtgtcacacatcagtgccagaagttggcaccgtccataacttcgctggcagaggataactggaagtttcgtaagtggactcttctgtgtgccccatgcacctcttcccttggctgattttattctgtatcttttcactgtaataaatccaaccataagtaaaagccctttcaggagttctttgaacccttctagccaattatttaacctaaggatggtgtggatccccaaacttgcagttgatctcataagtgagggtggtcttgggaccccaactccacgatggcaaaacggcactgtcctccagtattcattcttctttcttacttttagtaatggaacacctctcccgcccctcttagcaggaggcagagtgggcaaccagagactacatttcccacgctcctctcaaaatcgggggtggccatgtgactaagttctggccaaggaggtatgagcagagtgatgtgtacaaaaatatgaaccatattcctaaagaaagctgtttacttctttttctgggatgcagttgtgaggtaacccagcttcaaccatgggaataaggacaataccctatggaagggctaagcacacagagaactgtggaacccctaaaacactgaggtgctcacctactacggactgcctatctacctctggactattacaggagaaagaaaaacttaaaaattgtttgttccattgtattctgaagtccctgttacagcagcttagcctgtaccctaatgcataagtacatctgagcattttaatatgattttgattcaatatctatataaattaaaaatagacaaacaataagatgtactgtataaaaaatatttggatatattaaacctgaaaatgtataacaaacatttgtatgtcccagtttgaggctgatctgattaaaaggaaagcgtctatcccaaacaattcaatacaacaaagagttttctcttattcttcttgttattcataactaccaaaaaaagatgcttgatttaacaaaatcaatagttaatacaaactgaagggggcttcctgaaacaacgactaatgcttttcttcccttcaattacagatttccatagaaagggaaagaagtagagacactgttttaataaagtacctaggaggctaggcacagtggctcacacctgtaatcccaagactttgggaggccaaggcaggtggatcacctaaggtcaggagttcgagaccagcctggccaaaatggcaaaatcccatctttataaaaatacaaaaattagccgagcgtggtggtgcacacctgtaggtagtcccagctactcgggaggctgaggcaggaggatcacttaaacccgggaggcagaggttgtagtgaaactgagatcacaccactgcactggccaacactgagactctgtctcaaaaaaataaaaaatagaaagtaccaaagagaactgccttctctagttttccagagtgcggccaaatcacccactttccaaacaccttcccctcaattttcctgctttcctgtgttccaaaccacatggcccaattgcatttattaagcatctccactaggatgttctacacatctcaaagtcagcatgtccataagcaggatcaagctacgaaggaacacaaaagaatgttctagagatgacatgataaaaattaagagtctagaggaaggaggaagaagccactgatcttcactaaggagaagtggtataatctcacaggaaagccaaatgattatctgtagaaaagttcaaggttgcaataaatcagggattccaaaggccacagcagaagagctagtaacaggaagaacagaacttagctgaagaataaaggaaataatatcaaagaagagggaaatatatctaaagcagtaattctcacacgtgagcatgcatcagaatcactagcacagggcctgttaaaacacaagatgctgggccccaactccaacgtttctgattcagtgagtctagggcagggctggaaatttgcatttccagctggactgcggcacacactttgagaaccactggttttgcctgtacctaaaaatgtatctatagtggtgataatagagaaaaggacagttcagtggtaacgagaaaggttatatacagtagagagaatgatgctacaacgtgtcctaagtagaatgaatttcacatcaggagtaatgcaattcaccaggtgaaggttttaattagattgcaggcgacaggctgggcacagttgctcatacctgtaatcccagcactttaggagaccgaggtgggcggatcacgaggtcaggagatcgagaccacactggccaacatggtgaaatcccgtctctactaaaaataaaaaaattagccaggtgtggtggcactcccctgtagtcccagctacttgggggctgaggcagaagaactgcttgaaccagggagtcagaggctgcagtcagccgagattaggctactgcactccagcctgggtgacagagcgagactctgtctcaaaaaaaaaaaaaaaaaacaaaaagattacaggcaacaaaatctcgcctgtcctgccccccacttccccttaccccaaattccaggtctgagctaatggtttttctccattcacttagaatttactataatctatagttttcaaggtgagtaaaatgagaataaaccacaatccaaggttatcagagatttgcatataactataatatgagatctgtaatcccagcatttttggaggccaaggtgggaagatctcttgcgtgagaccagcctgagcaacacagcaagacctcatctctacaaaaaaaataaaaataataaaaagagccaggcatggtggcacacacctgtagtcaggaggctgaggtgggaggatcgcttgagcctggaaggtcaaggctgcagtgaaccactgcacttggcctgggagacagaacaagaccaaaaaagtaaaaataataataataataataataatacaagatcctgcattataggcactaatggaatgcaataaatgcacagagaaaacagccataaatctcatgttcgagaagacacccaagaaagcatcactgagaggtagatctgaactaagaacaatcagtaggattttacaggatagaaggtaggatagaaggtaggtgggaaggggtgacatgaaggcaaagatttcaggaagaagaaaaattcataattaaaaacataaaagggccgagtgcagtggctcacacctgtatctcagcactttgcggggttacggcaggaggactgctcaagcccaggaattcgagatcagcctgggcaatgaagtgagacccttgtctccacaaaaaatttgtttttaattagccagtcatggtggtgcacgcccatggccacagctacttgggagagtgggatgggagaactgcttgagcctgggaggttaagactgtagtgagccatcatcacgtcactgcactcaggcctagactatagagcaagactctgcctcataaaaaatacaaaaagatgtttaggacaacattctagaacttaccagtatgtaggaacatggccagatgtagaggtagacaaactaaggtaggtggagaaatataacagaaggccttgaatatatcatactaagaagtttaaaccttactttgtaagttttaagcaagtgtaaattgggtgggagagtttctggctcctgagcctagcctacaccataacgtataaatcttagcagaagtcctcaccttgtgcattccacccacacaagtcattagatctctgaactcacaaggtaactggcataaacaatgacacataactaaaaacaaatccctcagagcaactgcaattcaaaaatatagtcaaactctttttttctggacctgctatcagttccagcattcacaaatcccttttctcacaaatgcttctattaaatgtaattccaaataaacataaaggaagcagaagttgtcactgcttctggaattttcccttgcttacaccaagaatatatttaaaattatatacttttaaaaaaacaaaaacattacaacatgctacattcttcaagacaccagaagtcttattcaatgtaacaatttagcacactataatctctgaggaacagtgagttccaagataattcaatataatcttcaagtgacaatctgaaataagattaggcataaataatatgcaaaagaatattaacctccaacacagtaaacttgaagtgttagtaactttgactcaagtgctaaaattcaaaacagcaattaagttactgaaacattttacaaccctaacacaaatagattatcaatgcctccaccctacccataaatatctcacttcataatttcttcttccaaataactaatgaataattacgtacatctaaaagtacaaattcaagaccaataccaaaattcagattttttacagccaattattaagctttaaagtatcaagtatacagtttataacccaagctacaaaatttatgtaattaaaacatttaactcaagtgaataacccaagttttaaattatattgtatcaataaaaaaaatgttatgtagtaattctcaacagaaggcaatccttctatccatattcaaatgcaacctgttccaatttttaatacaacagaggtaactgggttactatcactactactagttttagctgtcataaattgagcaagtgtctgttctcacttctttagccagcattgtgtaataaagaatttggggcccaggcacagtggcacatgcctgtataccagcactctgggaggccaaggcaggaggatcacttgaggccaggagtctgaaaccagcctgggcaacatggggagatccctacacacacacacacacaaaaatttaaattagccaggtgcggtggtgtgtgcctgtagtcctagctactggggaggctgaggcaggaggatcactttggcctgaaagctggaggctacagtgagctatgatagcaccactgtgacacagtgagaccccgtccctaaaaaaacaaaaacaaaaaaatttgactggccattgtctgattcctggaaaactctactcttggagtctcccaactgataggagtgtctttgttatccatgaatccataatgggtcctccttggcccacagctgagtttctattaacagggtgactcccagtaggcccctagtttcaggatggggcctggccatgctggaaatgccaaccatgtgaatagtgggttgggctttgagcaacctgacatcagcctaacaacttgacctccagggagaaggggactggggactgagttcaatcatacctatgtaataaaagtcccataaaaactccagatgctgtagagtaagtgaggtttcctggctggcaatcattcactgctgtactggaaggatgacacgtcctgaggacatggaagcttcatgtttgggaccctcccagatcttgttctatgtgtctctttaattggctggtcctgatttgtatcataactgtaattccaagaacagcactttcctgaggtctgcgagtcattctaccaaattatcaaacgtgaggtgtagtgggaactccgaaagttgtagccagttggtcagagtgtggataacctgcaagtcctggagtttgtagctaatataagaagtgaggagagtcttgcagactgtacccttaacttacgatgccttacctaactctgggtagcaggtgcccaaattacactacagctataaaataggatatgctgccttacttctcttcccaggactcttaagagaattaaatgagaaaaaagttaggtaaaagcactctttaagatataaaacgttgtgtttgcttcggctgcacatacactaaaattggaatgacacagagaagattatcatgagaaaaaattctgtattaaaaaatttacactttgggaggccgaggcaggcgggatcacctgaggtcaggagttcgagaccagcctggccaacatggtgaaaccccgtctctactaaaaatacaaaacccagctgggcgtggtggcaggtgcctgtaatctcaaccacttgggaggctgaggcaggacaatcgcttgaacctgggaggaggaggttgcagtgaaccaagatcatgccatagcactccagcctgggcgacaagggcaaaactccgtttcaaaaaaaaaaaaaaaaattttttttttgttacggtctttaagatattgaagaagaaattgttaaaacatttgtaaagttcagaactgtccaggttaaatgctttaaaaaaaaaggcttaaaataaaaagctaaggagtcatcaagaaattgaatttattatgagtaaaatacagaacttaatgaaaaccatttaaaagagcaaaaaatctaagtagtttcaactacataactcagaccagtgcctaaaagataaaaatgcattaagtccattcctagaaatagcaaatgtagaaatgatggagcttagagaatgtaagatgcagccattattttgtgactaaacctccaaaaagttcattttagccttgggtatgatcaggaatgactgaggtcagtaagcaacactttgcttaataggctatgagtttgaatacgaactactcacatcacaaccaactttttttgcccatcactacctaatattttaattcaagcacaaagccatgggacccgactagtctttaaaaggtttctcaaagcatcctatgtggataaggcagtctcctgcctatatgagaaagtatcattttcaactgcattataatagaggacaaaatttttttctattatgttccaatgataaaatcaagactttaaatcgtaattttacaagaacatatcgttttattttccaccctcttgaatatgagatactaagtgttgctggtctttccctcagtaatgcagggaacagtttggtgtagcagggggaaaaaatggccttggggggaaaacctagggtctcatcttatttctcctctttagcaggcaaatgactcttggggtctcactttcctccagtaagatataatggcattgcctctggagtctgtaagattcttcctacccctgacattctgaggtgttgagaagccaataactcataatttagatattcttacaaattaaaaaagccttgcaaggaaatgtcagaaaccattaaaatttatgtaaaaacatcccacctatgtgttcctccttattgaaggagatccaggtaaagatctcctatgtaggctattatccttagcaaactaacacacgaacagaacaccaaacaccacatgttctcacttgcaagtggcagccaaatgatgagaactcatgaacgcaaagaagggagcaatagacactgagtctacttaagcgtggagggtgggaggagggaaacgagcagaaaaagtaactattgtgtatcaggcttaatacctgagtgatgaaacaatctgtacaacaaacccccatgacactagtttatctatataacaaacattcatatgtaccccagaacctaagatagaagtttaaaaaaaaaattgccccatagtcagcaggaaacacatcactagtaacttttactaaatatttacttgctacctccaatttagccctgagcaaacttaagacatttatgttttcttaaatctaatgtattatatgcaaaaccttttcaaactatttacaaagctgaagcaccaagacacatgattctttgacttatttttaatgacttttaaatatgagaaaaacattaattacgatgcaagtcatcatcctattaaaacatttcacttataatacaagcatttaagtatagtagtagtagttaaatctaaaaaaaaaacaaaaaattagccataaataatgatgaagctgccagtagttaacaacacacactcacaaataatgagataaatttaacggcaagcttccaaacaaaaaccttgtcattttaaggtgtcccacagcagaccggttatgacctcgggaactggcctgaaatcttgcctcctttcttgtgtaaccagccaaataacaacacctctctaaatctgtttctttataatggtgccaaccttatacggtagctgtagatattaattaagacactgcacctaggaaagagcctagcacacagtaaataataactcacaattattaaattttggaagaaatgttacacaaagcagcagccctttgacttttaaaaaaaaatttacacctagggtttaggatcctattacttgttaaagttcagactgagaaatgaaataacaatcctacaaagaagcattttactaaggacaagtgaatttaaaataactggtattatgcaagttcaattaccacaggcagaatcttagtttatgagaataattcaagttgtattagctgaaaatatctattattacaaagtcactgtctccatcaattctttcttctcttatttctgtatctgctaaagaaaaataaatcattatgaaaagaacagaaagatacagagcacagctgggttactttaagttccaattaataaccaaatataatctgaggggaaaaacccagtgaaagaagggagaaactgaacacaactaaagatgataaaaatttccttcccaaatactacaagactcatatttcaactggatcttcaaggactttcctgtctgaagacacgaagcctccagcaagtcctttcatcaccacaatcagatctccagctgaacttcaaagggaactctataaaagccactctggtgggcggttgttgagataatcactcttagcatcttctacagattgaaaaataaaaaacctgacttacacattaagaccaaacaccagtcaccattctcaacagtttattttttaatttgctctagacatccacaaaatgtattttttaaaggcgttccataaatacaattttggtggctaacaaaaattcagcaccaaagtaataaatataaaatttagccagacacagtggctcacacttgtaatcccaccattttgggaggatgaggcaggaggatgaggcaggagactgtagcccaagagtttgagaccagcctgggcaaaacagtaggaccccatctttacaaaacattaaaagactagccaggcatggtggcacatgcctgtagtgcaggctactcgagcgcctgaggcgggaggctggcttgagcccaggaggttgaggctgcagtgagccgtgatcacaccactgcattccagcttgggcaacagagcaagaccctgtctcaaaaaatgttaaaaaagaaaaaaattcaattaacccacctttatctcatgccaaaatacaaaatcctaagtgaacaagctaatttcaaatagttcctagaaggtttaaaatttccctgttctgggctgggaccagtggctcacgcctgtaatcccagcactttgggaggctgaggcgggcggatcacgaggtcaggagaccgacaccatcctggataacacggtgaaaccccgtctctactaaaaatacaaaaaattagccgggcgtggtggcaggtgcctgcagtcccagctactcgggaggctgaggcaggagaatggcgtgaacccaggaggtggagcttgcagtgagccaagatggtgccactgcactccagtgtgggcgacagagcgagactccatctcaaaaaaaaaaaaaattaccctgttctaagcactttacatacattaactcaattattactcaccataatcctgtgaggtaggtattattacagtcatcctacagatgagcagaactgaggcaccaccaagttattaacttgcccacagtctcaatcagtaaatggtgggagccagagaattctgaccctagctgtctgattccagagccaatatttaaatcaactatactattcatttactcaacaagttttactgacagcctactatgtaccaggcacagttctaagcactggggataaagctgtgtacaagtcagacaagacctctgctcgcttgttgagaacagggctggcagcaaacaagtctaaggggggaaataaataagtgggaaaaaaaaaacagtgtatcttcacctagtaataaatgctatggagaaaaagagaataaagaataaaagattataaaggaaggggctggttcctattttagaattagaaaaggcctgaggcgatgacatttgagcagaaacacaagacaagacatgaagagccttgaccacttagaggaaggggtggtccagctaaaagaatagtaagtataacatcctaaggaagaaacactttgttcaagaaccggcaaaatgactatgggactggggtaggttgctgaaagtcagtcacctagtaagaggtaacgttagaagctggcagctgccaaatcatgctatgccctgatggcgactaagattcaaatgtaagtggttcacaggatgcttttagaggacactaagcaagaaagtgacaatctgatttacatttttaaaaagatccctctggttgtcaaggtgaatccctagggaacagtcagggagcaagagaaataaaccagtaaaggcactatggaaacactccaaccaagagataatggaacttagactaggattcatgtactgtttataagtagatgctaacagaagagcctgcaacctaattgcctctaaagagcctttttaatatcccttttcccgtctcgtctcctgacttgcctttggaaaaaaataagattattttttaatgtccatgttaacgcttcagttggtgctattatagtaaaaaaaaacttttcatttttaaatgttctgtttaatatactctatgattagtaatacgccacatatacacacccatacattcttgaaaagcagaaagacccacaatgctctttagtgtaggacttgttcatttatttggagacgagaggtacctgtcacctcttctgattacctttcctctcacgctttgtctctagcacatcctggctcattctagattgtgaactgcaataaacaggtataccaaagggaatatgtatttactgagcacctcctgagtaccatggtgtcactagatgtctcacgtttaagaactgatttaatcctcagctacccaaggtgggaaatggtatcttcattctacaaacgagaaaaaatcagagatactagtaacttaacttgtccagtcaccagctaacaatttgtagggccagaaatctaacctccatgtaactgtgaacttcctgtctttccactacagcagctatcaaagaaagtgctttcaaatatatattatatgtagtcactgcaacttcttatgaataatgaccagtttgttgctggtgaggacaacgtttccttaatgctcttatgtagaatcagagttttgaagttgcgagtgggaagttggaaatgtagtgatcttatatattcaagcacattattttttaaaaattatgttctacttgagacctcatagaaattaattttaaaagagcaattcccatctttacaaaaaaaattaaatatgtacggtttaccgtaaaatagcggttaaggttctacaacaaaagataggagtttggtacagactctaccctcaaaaggtcctacacagtaagagaagacagggctaaaaagataaacgcaacacaggaaaaggcgcaaatagcctaagaattgaatggaagagagccttgtatactggagaatgattcctggaagaggaactttaggtgagctcttaagtgtccagtacaggaaggcagggaacaatacgcagcactggtccctgcacgggcaaacccaagaatatgtgtgaaaggttggtggacagatagatggttcccacaggctgatttgctacatacagaactccatagaaagaaccaaggttatggttggtcctaccctacctaaacaggaaatggcttattctcggagactaaagtgccaagtccggaaagaccagacagatacacagaattacagactgttacataaagtccttaatagttacaagcccttgttgtgctatgtgctagtctgcattattttcacctaaatgaaaccatttctacttagtacatggcgtgagaagacgtggagataaagagaattagcagacgtatattatctgcaatttatcttacggaggagtacattaaggagtgttatgtgagattatttctttacaaactgagaataggtaggaagagcagcgaaacacagcgcggctcggtgcgcccagagcggcgtcactgtaacagtacagaagtgggcaaggggctctcggaaggacagttggggaacggcgcccagcgtatttagcgaacggacaagcagcaaggaaaaacaagggagcaacaaccgccttcggacattccgaccggttctgggatgcaccggggacgtcgaaggcggggtgcggaaaaacgctgtggctggagtgcgggtgggagcggcggctcgaccgggtcgacattctacaaacgcttgtggaacgaacgcccgaacgcgcgcgtgaatgaatggcgcggaactgaatggccggccgaggcgccggcgcaggaggaaggagtttgcggcgcggtctgaccgggccggcgggatgcggccgggcgcggagggaagggccgctgcgccaggggtcggcgcggggcggcccatggggctggcggcggcgcggggccggccgcgccatgacggaagggaaggggaggggaggtcacacattacataacccggcggctgcgagcgtcaggggaaggcgccgtggacagcccaggccgcgacaggacggccgcgggccggggccggggcgacgcacccctcccccgcgccacctcaggccgaccgcgctctggccgctgccgggcgggtctgcggcgcctccgggcgacgcgtgtccgatcccgcccctcccccaccccgccgccggcccgggggtcgctcaccttccgcgttgccccagaccaccatgcccgggcccggcggccttctccggccttgcggaccccggccccgccgccgccagtgccctcgccagggaccagggaggagggccgggggaaggcagccccaccgctgagcagcgccgcggtccacgctcccccacgctcgcggcaaccaaccccgcgcgcgctccgcggtggctctccgcccctccccctccggttagcgcgcgcgccgcagccacgccccctagcgttccgcgcgcgctccccggccccgctcgcgctcacagccgcgcggcgcacgcgc

SEQ ID NO: 145 - DNA, 44383 bp, Homo Sapiens
agccgcgtcaacggcccttcgcagcgggcgcgctgtcagacctcagtctggcggctgcattgctgggcgcgccgctctcgtctgatccctgctggggacggttgcccgggcaggatcctttacgatcccttctcggtttctccgtcgtcacagggaataaatctcgctcgaaactcactggaccgctcctagaaaggcgaaaagatattcaggagcccttccattttccttccagtaggcaccgaacccagcattttcggcaaccgctgctggcagttttgccaggtgtttgttaccttggtaagaaaatttagaaccgttcgctgtcactgtgttcagactttctatgttgccttggctattggttttataatgtagcagtgactgggccaaggttgcgtgaaatataaatcatgctaacagggataaggccctggtactgtcttctaagatttttcttgtagaaaaaagtatgtttttccctgtagttgttaaacctctctcttggaattactttcctggatgtattattacctggtgggcactaaacttgttttgtgcggattggggtaactcgagatgtttaaagggaataattgcaatcagtgaaggtttgtgcagttttgataattggccaagtgctatgtataaggtttcaaagtagtgtaatccttatccaaaagcatggcttgggcagaaagtcttcttcattttccatctttataaagctcttggccgggcgcggtggctcacgcctgtaatcccagcactttgggaggcggaggcgggcggatcacctgaggtcaggagttcgagaccagcctcaccaacatggtgaaaccccgtttctactaaacatacaaaaattatgtttgcatttttagtatttttatacaggcgtggcggtgcgcgcctgtaatcccagctactcgggaggctgaggtgggagaatcgcttgaacccgggaggcggaggttcagtgagccgagatcgcgcctttgcactccagcctgggcgacagagcgaaactccgtctcaaaaataaataaataaagctcttgctttctccagtaaatacataaacggaaaacctcaacagctttattatctgttaaagtctgcatgtctgtttttgtgattgtgtgcttagtaaattgtgtgctgaacataaatcactgcttcctattcttgctccacttctggtatttggatctaatatggtgcttagcctgtgtttttttgtgttacaatactatttgttggctcagtctgttccagtactactgaaaagccacttcaaagtagagggacttctggcatgttatagttttaacttgtaaatgtttaaagtatcacattctgcctgttttaggcgtggtcgattggaatttataaggaattaatgctttgactgctctgattttaattatttttctttccactcaccttcctgctttgcagttgtaagacgttttttttttcaaggtgaatgttagtttttgaaaaactttttttagaatacagttgggtgctcactcaactgtataacctgtgtttctcgtatttaaatcatggattgctggtgtttcgattgtcttatttaggtcttggctcccaaactgctgcatattggaattacctggagagcttttaaaaatccccggcctggcgcggtggcacacgcctgtaatcccagcactttgggaggccgaggcgggcggatcacgaggtcaggagatcgagaccatcctggctaacacggtgaaaccccgtctctactaaaaatacaaaaaattagccgggcggggtggcacgcgcctgtagtcccagctaatggggatgaggcagaggaatcacttgaaaccgggagatggaggttgcagtgagctgagatctcaccactgcacttcagcctgggtgacagacggagactctgtctaggaaaaaaaaaaatccccatgctaggccgagcgcgatggctcacgcctgtaatcccagcactttgggaggccgaggtgggtggatcgcctaaggtcaggagttagagactagcctggccaacatggtgaaacccagtctctactcgaaatacaaaaattagccgggcgtggtggcgtgcgcctgtaatcccagctactcaggaggctgaggcaggagaatcgcttgaacccgggaggcgtaggttgcagtgagccgagactgtgccattgcactccagcctgcgcaacgagaacgaaactctaactcaaaaacaacaacaacaacaaaaaactcatgcccaggtcatacccataccaattaagttagtatatatagttgtggaagtcaaatatcagtagtatttaaagcagcctggcggggggacaagagcgagactttgtctcaaaaaaaaaaaagtgtcatggtcatgaaaaacaaggaacaaccgaggaaatgccacagattggggggcagtaaagtatgtagttaataatatgccaatgttcatttttaaattttggtaattgtgttaagtaagatgttaacatcaggaaactgggagtaggagaactctaccatttttgcgattttctgtaagtctaaaagtatttcagagtaaaaggttgacatttttcatgaatgctatgatgttatatattattttctccttctcttttctctgaatttatacttgagatttgtctgtcaactgattccgtattggttctcttcccctggtgatgtgcattttaatttccatttccccatgactaatgatggtgagcctatttttatgtgccaattggctatgtttgtattttgtggttagttcttttaaggataagtatttttaaagcttttaatacctattgccttcataaaattgtactaatttatccttatgccagcagtacaggttgagtatctgtgatattgtgatatatgtatgttagtttttgtccacggttcctagctcataactcccctagctttcgttataatgttggagctcttgaagcaagcctcagaaaacagaatctctctctggccttctgccctcctttcacctgcccaaagcaggactctaatcttcccctgcctttctgattatgggtcataagactttcatttcagaagagttcctaccccataccctggagaaaggaatgctacccagagaggccaggaagaatctggacaggccttgctgggtttccccagtctattagtattagatcatatcttttttgtccagtcacatttctacacggatgtcagtcatgcctatccaatgaagtttccataaaaggcccaagaggagagggttcgaagagctgctggataggagcaaaaggaagttcctggagagtggtgttcccagggagggcatgccttgccatgtgtatctcttcatctgtatatcctttataataaactagtaaatttgattacctgagttctgtgagccactctggcaaattaactgaacccaaagaggggctcatgagattcccaatttatatccagtcagttagaagcacaggtaaaacaacctgtggcttgtgattggcatcagaagtagggggcagtcttgtgggactgagccatcaacctgtgagatctgacgctttctccaggtagataatgtcagactcgaattggaggatacccacttggtgtctgctgcagaattgattgcttgtttgttggtggggagaaatcctcacacatttggtcacagaagtctaccttattgattgttgttgagtgaaagaatcttttttttttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagatcagggattggtgatgactcttaacgagcatgctgccttcaagcatctgtttaacaaagcacatcttacaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcccgcctttctattccacaaagccgccattgtcatcatggcccgttctcaatgagctgttgggcacacctcccagacggggtggtggccgggcagaggggctcctcacttcccagtaggggcggccgggcagaggcgcccctcacctcccggacggggcggctggccgggcggggggctgaccccccaacctccctcccggacggggcggctggccgggcagaggggctcctcacttcccagtaggggcggccgggcagaggcgcccctcacctcccggacggggcggctggccgggcaggggggctgacccccccacctccctcccggactgggcggctggccgggcggggggccgacacccccacctccctcccggacggggcggctggccgggcggggggccgacccccccacctccctcccggactgggcggctggccgggcagaggggctcctcacttcccagtaggggcggccgggcagaggcgcccctcacctcccagacggggcggctggccgggcggagggctgacccccccacctccctcccggacggcacggctggccaggcggggggctgacccccccacctccctcccggatggggcggctggccgggcggggggctgacccccccccacctccctcccggacggggtggctgccgggcggagacgctcctcacttcccagatggggtggctgccgggcggagaggctcctcacttctcagacggggcagctgccgggcggaggggctcctcacttctcagacggggtggttgccaggcagagggtctcctcacttctcagacggggcagccgggcagagacgctcctcacctcccagacggggtctcggcagggcagaggcgctcctcacatcccagatggggcggcggggcagaggcgctccccacatctcagacgatgggcgggcgggcagagacgctcctcacttcctagatgtgatggcggctgggaagaggcgctcctcacttcctagatgggatggcggccgggcggagacgctcctcactttccagactgggcagccaggcagaggggctcctcacatcccagacgatgggcggccaggcagagacactcctcacttcccagacggggtggcggccgggcagaggctgcaatctcggcactttgggaggccaaggcaggcggctgctccttgccctcgggcccgcggggcccgtccgctcctccagccgctgcctcccgggcggcgctcgccggcgcggcggcaaagactgagacagctctgctgcccgctgaactccatcctcccggcggtcgggcggcggcggctgcggtcggtcgcggcagcggctccgcttcatatctgcagctggggcccgcgggcgtcagcgccgcgactgtcccggctccgcactgccccgggccgcagcgcagccgcgccaaccaccacccgcggccaccatggccggacgggctccctaagccaccgaccccagcccgcggcgccttcgagccttctagggcctccggcgccgcgacctcctctcaagatcgagtgaaagaatcttaaaaactgttttttccactcagggtatccctaatctgaaatttgaaatcttccaaaatccaaaaaattttttgcaccaacacagcattcaaaggaaatgtttattagagcattgtaggtttaggatttttggattacggatgcttaactggtgattataatgcaaatattgcaaaatttgaaaaaaatgcaaaatctcaagcactttggatcccagccatttcagataagggatactcaacctgtatatttaaatgcctatttcattcttgttagtttccatgctcccatgctcatggtaactcatcagtgaaagaatggaattacagttttccctggcattttggattaggtgtttttctaactgtccataaaatgttgtgttacagaaaaatggctactggacaggatcgagtggttgctctcgtggacatggactgtttttttgttcaagtggagcagcggcaaaatcctcatttgaggaataaaccttgtgcagttgtacagtacaaatcatggaagggtggtgggtatgtatcattgttattgtcacaactattcaatggtaacacagtggcactgtggcaggtcctttgttgttgtggtggtggtggtggtggtgacagggcctttctctgttgtcccatccagagcgcagtggcaccatcagctcacagcagctttgacctgggctcaagtgatcatccctcttcagtctcccaaatagttagaactacaggagcgccccaccatgccaagctgattttattttttggggggtgggtagagatggggattggttgggggggcagggctcactatattgcccaagcaggtcttgaactcccggcctcaagcagtccttctgccttggcctcccaaagtacaggaattgccagcatgagctgctgtgcctggccctatttttgagatttctgaactgctttgttttggattgaatgatggcatctgtggtcaaaaagtttctaatatgtttatagattacttgtgttaaatgttacttgtttttgcttgtgatcatataatatgttttctgtttccttttttttctaaccttagaataattgcagtgagttatgaagctcgtgcatttggagtcactagaagtatgtgggcagatgatgctaagaagttatgtccagatcttctactggcacaagttcgtgagtcccgtgggaaagctaacctcaccaagtaagaaaaaaacattatttaaggagacataaaggagtcgaaaataatactccatgaggctaggaactggtgttttgaatttgttccatgtaaataacaccggaaaaaattctttttggttagccatcttgtctctgtgaaatgaaaaacagattttaatattgtgttttggggacagttcaaaaccattataccatataagagttgctgcctttgatatctattcagttccttaattgttcaaaattggttgttaaattcagacttaataccaattcccatgttctccatccaaaaatctaaagtatttgaaaaattgactgtgaaactgagaatttttccaggaaaggctgagtcaaactgacattgtagtacaatatcaggaattagttgctataattgaacaatatcaagggagatttctctgtttttagattaagctatctctccgcaaatattagaagtttcaccttggaatgggggatatgaatcagcatagctaagtcagaggtaggcacaaaccccagcctttaatcctaacagctaatatgtattaaacatattatcacatgccaggcacagtgttaagctctctataggcaatatctctattaaatctgacattgttataaggtaggtactaatattactcccccttcacagataaggaatcaagttcagagaagttaaataatttaagttaggctggggatggtggctcatgcctgtaatcctagcatttagggaggctgaggcgggcagatcacttgagtccaggacaccagcctgggcaacatagggaccagcctgggcaacatggggaaaccccatctctaacagaaaatacaaaaattagccaggcatggtggcacacacttgcagtcccggctactcaggaagctgagttgagaggattgcttgagcctgggaggcagaggttgcagtgggcccagatcacaccactgcactccggtctgggtgacagagtgagaccctgtctcaagaaagagaaaagttcagacagctaagtgaaagactgaggattcacatctgttttttaagattctagtatctatgttctcaaggtacactatactatgtgttgtggtataggaatcatgctttgacttaggacctgacatacttctgaattctaattctaattctatgaattagaagtctaaaggtagagtggcatacagacccacattggaattattgctagaaaagaagatagacttgactgaagattaagttttccaaatactcttaaaaataccttgcagtgatttgctcaagaggctgtgaggaagcactgaaatagagtattgttttagaaaaactcaaactatggttttcctctcctctcacaccacaagaacaatcaacacagaagacatctgtgaccaaaggtgtggaagtatttccccacacaccaatcagcagacaccagctgcatgtcctcgcactcaattccaacactgtctacctggagatggcatcagattccacatgttgagggctcaataccacaagaacaccccctccttcctttccatcacaagtccaggcctttagaacgtctgaacagctggctttaagttggggttcctgcaaccccctctttggatttgattaatttgctgaagcgactcacagaactcaggagaacacttacttatgtttattataagggatattacgaaggatacagataggttgggcatggtggctcacgcctgtaatcctagcactttgggaggctgagacaggaggattgcttgagctcagaagtttgagaccagcctgggcaacatagtaagacctcgtctctaccaaaattaaaacaaaaacaaaaacaaaaaaatttagctagacatggtgttgtgcagctctagttccagctactcaggaagctgaggtgggagggtcgcttgagcccaggagattgtggttccagagagtcatgatcaaaccactgcatgcagcctgggcaacagtgagatcctgtcaaaaagaagatgaagatgaagagatatatagagcaaggcatgtgagaaggggtgcggagctttcatgccctccctgggtgagccaccctccaggaatctctactattacagctatttggaacctctccggaccctgtcctcttgggtttttagggaggctccgttatgtactcatgactgattaaaccattggctatgggtaatcaacttgacctgcagtatctctcttcctctcccctccccagaagttgagggggtggggccaaaagtcccaaccctctaattatgccgtggtctttttggtgacctgccctatcctgaagctattagttaacattagcatacaaaaagacaaaacttgggtgattccaaggatttttggagttgtatgccaggaaactgggatgaagaccgaatatatatttcacaatattataagtatccttttctggctgtgtgtatgagtatattgctctttcttttctttttttttttttttttgtgggtgggggacggagtttcactcttgttgcccaggctagggtgcaatggtgcaatctcggctcaccacaacctccatctcttggattcaagtgattctcctgcctcagcctcccgagtagctgggattacagtcatgtgccaccgtgctggctaattttatatttttagtagaaatggggtttctccatgttggtcaggctggtctcgaactcctgacctcaggtgatccacccacctctgcctcccaaagtgctgggattacaggtgtgaactgctgcgcccgatcttgctctttattttctttgaggcctatcctcttcctagttcaaataatgatttaaaaaaaaaaaaagtcaagtatttctctaattctctaatttgagagtgttttagaacaataattatattagtttttatgggtgtcatggtgaagaggtaccgatgttttcatttttatggtaaatataaagtcaataggaacaaagaactggacactacaaagcaggtccaagccaaaggaaagcaaatatctgtatattggccggatgtggtggctcacgccggtaatcccagcacttggggaggccgaggtgggtggatcacctgaggtcaggaattcgagatcagcctggccaacatggtgaaaccctgtctctactaaaaatacaaaaaaattcaccaggcgtggtggcaggcgcctgtaatcccagctacttgggaggctgaggcaggagaattgcttgaacccgggaggtggaggttgcagtgaggcgagatgccactattgcactccagcctgggagacaagagcgagacttcatctcgaaaaacaagaaaaaaaagaaaatatctgtatattgtcgtagaaaactaggtatagagccagaagagctgcttattaaagtttgaatagaagacatacgatgagattggtatgtataccctgaggaaggttgtctgcctgcccagacacatcaccacattctaggtgcttatcttcaacttgatcatttgaatattagtatatccgtaaatggttggttaaggcatgtgtgtgtatgtggtgatgaccagttcacatgttaaccaaactcaccgttgactgaagtataaaatccatatgccagtttgttaatttatggtgagaaatactatcctggggaagaccatatactctggttcactgatcagtgcagtgttgcatgtaaattaccctttttttgaagacaaaattagaagcagaagatttcttggtggatatatgaaaataaaaggaataggtgatcatagtaatacacaaatttgaggcatttctttattttttagagagttccttgtcatatagacgtgttcatagtctgaatgctttctgccttggtagttctggcattgtgctaaaaatgtttgcctccgtgattcttccttttccatgcttctattattgaccatctgcctgccgattgaccctttcagttactattgtctagtctctgttaagccacatgtctcttgattacgtgtattattgttcattatggcagggtgggagtggagcagacaatctcaaggttgcctctgtttattgcctgcatgaatgatccttatacttcttaggtaccgggaagccagtgttgaagtgatggagataatgtctcgttttgctgtgattgaacgtgccagcattgatgaggcttacgtagatctgaccagtgctgtacaagagagactacaaaagctacaaggtcagcctatctcggcagacttgttgccaagcacttacattgaagggttgccccaaggccctacaacggcagaagagactgttcagaaaggtacttccatagcatcatactgcttctgcttcctgcctttggaacctgctttgcttggtcatgctgattctccttggaataattgaaaggaaacttaaactacagcctgaatgaatcacaaggactcacatggaaggatatacaaattttcttatctttccaggtatatggctgttgagaagctgtgaaatctgtatgaaagtaaatttctctttagatataactagggcaggttagtgttatcaatagaaggcagagacctggcgcggtgattcacgcttctaatcccagcactttgggaggccgaggtgggtggatcatgaggtcaggagttcaagaccaacctggccagcatggtgaaaccccatctctactaaaaatacaaaaattagctgggcatggtggcgcgtgcctgtaatcccagctacttgggaggctgaggcaggagatttgcttgaaccaggacccaggaggtggagattgaggtgagccgagatctcgccactgcactccagcctaggctacagagggagactccgtctcaaaaaacaaaaaaatcaatagaaggctgactgagcactttgtcattggtagcttaatttatattattataacttagtgtcttggtttcttcatatataagaagggtgagctttttaaaggggggcctcaggtatagggagttgagtgattcaaaatttctaatcacttcttagcacattattacatatgggctgcacaaggcccctctcattgtattttgctacttttaccctttatagtgattttcccactccctctgtgccgcacctaccctcttgtacccacagatacatttgatatatcttagatgtctgtctttccttccttccttctttccttccttcctcccttcctttcttttctttctttccctttctttctttctttcttttttctttctttccttttcatttcatttcatttcatttctttattttgagatggagcgtcactctgtcgccctggctggagtgcagtggcatgatctcagctcgctgcaacctccgcctccagggttcaagcagttctcctgccccagcctcccaagtagctgggattacaggcatgtatccactacacgctgctaatttttgtatttttagtagagatggggtttcaccatgttggccaggcaggtctggaactcctgacctcaaatgatccacctgccttggcctcccaaagtgctggcattacaggtgtaagccactgtacctggcctatatctttataagttactcagtattgctttgtctatgtgctttttaattacaagatgattttgtgctattatagatctcattctttttctttttttttttttgagacggagtctcactctttcgcccaggccggactgcagtggcgctatctcggctcactgcaagctccgcctcccgggttcacgccattctcctgcctcagcctcctgagtagctgggattacgggcgcccgccaccgcgcccggctaatttttttgtatttttagtagagacagggtttcaccgtgttagccaagatggtctcgatctcctgaccttgtgatccgcccgcctcggcctcccaaagtgctgggattacaggtgtgagccaccgtgcccggccttcattctttttcttaattttccttcagtaatgaccttagagatgtgtccatgtggctgtatttatttgtaattgatggcttcgatggctgttacttgcagcgtaatccatgatatggatccaccatggttacagaccattttccctagtgacaaattcattggttgcttctaatgtcctgctctaacagtttacattccccctagcagtacataaaagttcctgtttcccccatattctcaacaacaactggtatcatctaatgtttaaaaatatttgccaatataatgtttgtttgttttgctttaatttacatttctctgatcactaattgagattgaagatctcttcatacacttgtaagccagctgagtttctgcttctgtgatttacttatttataatctttgcccatttttccatggaaaaatggtaaaattatttattttttgatttgcaagagttccttgtatatcctatcctaattattagttccttgtcttttttttttttttgagatggaagtctcactatgttgcccaggctggagtgcagtggctatcagtcgctattcacaggtgtgtaattatggctcactgcagccttgaactcctgggctcaaacaatcctcccacctcagcctccagagtagctagaactacaagtatgtgccatcatgcctggctaatttttaaattttttgtagagacagggtctcactatgttgcccaggcttttatatatttttttcattttctacttgattattgatgtgttgggaaatgataaatgggtttttttaatgaattcatttttatttactttatctaaaaaaaattgtgatataatctgtatgaagtgttttaataacatgtacttgaaggttaatttttttttcttagatttgaatagaattaggacaataaaaacttgcttttgtggctgggtgcggtggctcacacctgtaatccaagcactttgggaggccgaggtgggtggatcatgaggtcaggagttcaagaccagcctggccaagatggtgaaacttcgtctttaccgaaaatacaaaaaaactagctgggcatggtagcatgtgcctgtaatcccagctattcgggaggctgaagcagaaaattccttaaacccggaaggaggaggatgcagtgagctgagatcgtaccactgcactccagcctcggcaacagagcaagactccatcttaaaaaaaaaaaaacaaaaaacttgcttttgtgataatgttagattatgatagtcctagattccaggtctaagaatttgcataagaatgagggttttttttttgttttggtttttgtttttctttgagacagagccactctgtcacccaggctggagtgcagtggcgcaatctcggctcattgtaacctctgccagaatgaggtcttttttttaattgaatattatgaaagtggaattcagttgtatccccccagagcaaataattctgcatgtttcatgttttggctgggtgtggtggctcacacctgtaatcccagcactttgggaggccaaggcaggtgaatcacctgaggtcaggagttcaagaccagtctggccaacatggcgaaaccccatctctactaaaaatacaaaaattagccgggcgcagtggcaggtgcctgtaatcccagctacttgggaggctgagacaggagaatcacttgagtccaggaggcggagggtgcagtgagccgagattgcgccactgtactccagcctgggtggcgacagagcaagactctgtctcaaaaaaaaaaaagaaaaaaaaaaaaaagatgtaacatgtaaactttgcttttgctgctgaacaattgcataaaatgcctttaatgtgttgtgcagaagagtagtagtaaaactgcccagggaagcttgtgacttaaggaattattttattttctgatcctgataatgcaaagtatgtcaagctagaggctgcagatcctttagttctttggacaaaatataatggacaataaagatgtgccacttatagaggaagcaaaatcatggtacataagcttttgatatttgatattttattattctgggaccagagtcagaaatttaattatcataataagaaaggtgttctttggtcttacctttctgtaccacatcttattacataactttctttttttttagtttccatatgcaacactgatttttttggtgtcacccaggctggaatgcagttgtgagatcttggcacactgcagcctccacctccagggttcaagtgatcctcatgcctcaacctcctgagtagctgggattataggcatatgccaccatgctggctaagttttgtatttttagtagagacggggtttcgccatgttggtcaggctggtctcaaactcctggcatcaagttatccatctgccttggcctcccaaagtgctgggattacaggcatgagccaccgcacccagcctgattttttttttttttttaaatatttggaattggttttataatgccttgaatttgtggctctttaaagtttatttgagaattacatactcttaaaaatttgttgaaagctatagacccttgctggcctccgaaaaatttgtatctatacataagacaattttgcatgcagttttcaggagattcacaaaccctctgaaatccacatacctcagaattagaactagtcttacacattatattggtttttgctgcagagcattgttgaagcattctattatctctggctgaagatggtatataccttccttggtagttgaatgttaactcagatggacgtgttcctctttcttctacacttacttttcttacctatgtacatttttttattaaaaatgcccatgtttatagagaggtctatttctgtatgtcttgtgtctgttgcattagtgtgtccaacttaaatattaagctcccagatgcagtgccagcatcttattatatgtaatgttcagaacagtgcaatgtctaggaaatatttcatatcatattcctgaatctttgatgtgtgcaaccacaaaaacctgataacagaaattagctgatctaagtggatataaccttccagaaatcatttttcatggatacaatatatttcaaatctaagaaaagaggcgaggtatttgtaataccttgatactgagctttccatcaacttttccatcttgcctcctataagagctagcaatcatgctcagccctcctgcatttgcagctttgtatcttcttttttttttttttttttggagagggagtctctttctcgctctgtcgcccaggctggagtgcagtggtgcaatctcggctcactgcaatctccacctcccgggttcacgccattctcctgcctcagcctcccgagtagctgggactactgttggccgccaccacgcccggctaatttttttgtattttttttagtagagacggggtttcaccgtgttagccagcatggtctcgatctcctgacctcgtgatctgcccgccttggtctcccaaagtgctgggattacaggcgtcagccactacgcctggccttgtattttctaaaatagttatttgtgtgtaaagtttaagtagtaagatttacttaaagtacttctcagaaattgtcaaggtgaaactttcccatcattgccattttgtaactggtttgttagctaagggccttttcttttccctttgttttttcttaattcatttctttattattttaaaacacagagacatggtctcactatgttgcccgggctggtcttgatgagttcctggcctcaagcaattttcccacttcagcgtcccaaagtgccaggattataggcgtgagccactgcacctggccttacaaaacagttttataatgattatttttgagatggggtctcactgtgttgcccatgttacctgtgaactcatgctcaagtgatcctcccacttgaggcttccaagtagctggaactatcggcatgtgccactgtgtctggctttatcttataatgatcatataattattattaaagattataaaattcaatggaaagattatactatcctcatgtatcaaaagactaaatcttactagtgctcaattctccccaaattgacgtatagattcattgcagtcccttccaaaatcccacagaaattgacaaactgattctaaaatttgtatggaaatgcaaagaatgtggagtagccaaacaactttgaaaaagaactaagttggaagacatactacctgatttcaagatttaactataaatttgtaactagggaagtttggtattggtgtgagaaaatacgtagattaatggtatagaatagaaagtatacaagtagatccccacttttcaggctggggtgtgtgtggtggcaattcatttccacaaaggtgccaagataattcaacaagaaaaactcttggctgggcacagtggctcacgcctgtaatcccagcactttgagaggccagggtgagcgaatcatgacgtcatgagattgagaccatcctggccaacatggtgagaccctgtctctactaaaaatacaaaaattagctgggtgtggtggcgcatgcctataatcctagcttttcgggagggtaaggcaggagaattacttgaacccaggaggcagaggttgcagtgagctgagattgcgccactgtactccagcctagcaacagagtgagactccgtctcaaaaaaaaaaaaaaaaaaaaagaaagaaagaaaagttttttctcagctttcatgggcatttaacaccagaactacctgaagtatttcctgtagtccatttcatggtattgaagaaaaaccaaaattttatagatttttcttatcaactagagaaaaggtaaaaagcattgtagggaaataagggaattctgcttatcttctgtggtcccgttcagttaatacagataaaggattaaatttaaaaatctacattgccacaggattgcaacattacccaatctgggaaagcaatgatgaaaaaaatctaaagcagagaaaatttagctctaactgtttaaaaaggtccagaaagtcatacaattacagtaaattattcatatttttgtttcccaaagctaatatatactagtataaattgttttaaatgatggatgttttaatagtatttattgttcttaatatgtgcaagccttggtatttcaggaaaacagataattaaaaaaaaagcaaaaaatgcgcaagccactgtgctgaggaactttatttttaaaaactaccttttggccgggcacagtggctcacgcctgtaatcccagcactttgggagcccttgaggtcaggagttcaagaccagcctggccaacatggtgaaaccccatctctactaaaaatacaaaaattatctgggcctgaaggttcacagctgtagtcccagctactccggaggctgaagcaggataattgcttgaacctgggaggtggaggttgcagtgagctgcactctagcctgggcaacagagcaactccgtctcaaaaaaaataaaaaataataaactatcttttaatcctcataacagctatatgaagtgcagtttgtagacaaggaaattgaagcttagagaattatgtaacttgtccaaagtcacatggtcagtaggttatgaagccaatatttgaaccctgcttgactgcagaatgttcttttaacaattatgctctacttcttatggccatacatggtggtttacacctgtaatcccatcactttgtgaggccaaggctgggggctggggaggtggggggcatatggggggggattgcttgagtccaggagtttgagaccatccttggtgacatggtgaaaccccgtctctacaaaaaatacaaattagctgggcgtggtggcatctgcctgtagtcctagctacttgggaggccaaggtaggaggatcgcttgagctcaggaggcagagaatgccctgccaaaagacaggttttttttttttagtttttttttcttttttgaggtggagtgtcactcagctcactgcaacctccgcctcccgggttcaagtgattctcctgtctcagcctcctgagtagctgggattacaggtgtgcaccaccacgcctggctaatttttgtatttgtatttttagtagagacggggtttcaccatggtggtcaggctggtctcaaactcctgaccttgtgatctgcctgccttggcctcccaaagtgctgagattacagacgtgaaccaccgcacatggcccaaaagatagtttttaaaaataaagttccttggccgggcgcagtggctcatgcctataatcccagcactttgggaggccaaggcaggcggatcacgaggtcagaagatcaagactatcctggctaacatggtgaaaccccatccctactaaaaaaaatacaaaaaaattagccgggcgtggttgcaggcgactgtagtcccagctacttgggaggctgaggcaggagaatgacgtggactcgggaggctgaggcaggagaatggcgtggacccaggaggtgaagcttgtggtgagccgagatcgctccactgcactccagcatgggcaacagagcgagattctatctcaaaaataaataattaaataaataaaataaagttcctcagcacaatggcttgcatgtatttttctttttttttttaaattacctattttcctgaaacaccaaggcttgcacatattaagaacaatgaatactattaaaacatccatcatttaaaataatgtatactagtatatattagtgagccaagatcatgccactgcactccaacctggatgacggagtgtgactctgtctcaaaaaataaaacaattatgtctacttcatattacagataaaaggtaaagaactttaatgtggtactagaaagctagctagaatagttgaaggagaggacttcataatagataaacttgccataagccctaaagtatagatgtgtttaagcaaaggaaagaagaacagagttaaggggtaagagcttgccaggcgcggtggctcaggcctgtaatcccagcactttgggaggccaaagcgggcagatcacaaggtcaggagatcgagaccattctggctgacacggtgaaaccccatctctactaaaaatacaaaaaattagctgggcgtggtggcaggcgcctgtagtcccagctactcgggaggctgaggcaggagaatggtgtgaacccggcaggcagagcttgcagtgaggcgagatcatgccactgcactccagcctgggtgacagagtgagacttcgtctcaaaaaaaaaagaaaaaagaaaaaacctgaataaaatagggtggtgggttgcagtggatatgtgaaatattttaaagtaggttttgttgactaaatggctgcataatgaggaatgaaagagaaaataagccaatattaatgtggattttaagcccttaatagaaatagggagttggttggaaagaacatttgagaaggaagacaaagtttgattttagttatgtttagttggaaaccataattaaaaattcaagaaaagttcttctgtagggagtcaggaaaagttcttctgtagggaggtagagctaagggattagagtgtacatttggggataaagatttgtatgtactcagagtaagatattttcaaggtcctaagtcccaagcaacatctgacttaaaacagcttatcaagggaataaatctagtgcctcggagtggattttaagttactcagctggaatccacctctaaaaacatgtaaatgttaaagcttatattgaagcttgagttaattctgaatattttctaattgaaaaaaatattcttggagaagatgtttaagtgattaaatatagtaggagaaagaaaattcaagagaactggggagataaatgtgtttacattatttttttttatttttattatttttgagatgaagtcttgctctgtcgcccaggctggagtgcagtggcgcaatctcggctcactgcaacctccgcctcctgggttcaagcgaatctcctgcctcagcctcctgagtagctgtggttacaggcctgcaccaccatgcccagctagttttgtatttttagtagagacggagttttgccatgttggacaggctggtcttgaactcctgacctcaggtgatccacccgccttgctctcccaaaatgctgggattacaggcgtgagccaccgtgcctggccaaaaatgtgttttaaaatcattgctcatgaaagatgatattaatacaaaatatttgtcgtacattagcactataaaattcagcctatgctgaagctaagctgcgggaacactctgaaggagaaattgagctctcttataattggtcttctaagctggctgccatttttttgtgaaaacttatatgtctaaatacctgtaatctaagcatttctacattagatagcacaattaaataaataattttttaaatgtctaaatgtgagttcttaattcatttcagaggggatgcgaaaacaaggcttatttcaatggctcgattctcttcagattgataacctcacctctccagacctgcagctcaccgtgggagcagtgattgtggaggaaatgagagcagccatagagagggagactggttttcagtgttcagctggaatttcacacaataaggtgaaggctaatagtagatttcaaagagaaacattgatatccttagtcaaatacagtagggacagtgggacattgaaattattacacataggccgggtgcagtttcgcacgcctatgtgagtggatcgcgtgagcccaggagttgaagagcagcctgggaaacatgttgaaacccagtctctacaaaaaattagccaggcgtggtggtgtacacctacagtcccagctactcaggaggctgagatgggaggatcagctgagtccaggaggttgaagctgccgtgagccgaaatcatactactgtacttcagcttgggcgacagtgagactgtcaccaaaaaaaaaaaaaaaaagttgttacacatgtactttgaatggatttcttttaaaattcatgttgaggcccaaatcaaagcataagtaattctttaacatggaaatggacattaaatatgtactttcctaagaagcaagctgaaggccgggcatgggggctcacgcctgtagtcccagcactttcggaggctgaggcaggtggatcacctgaggtcaggagttcgagaccagcctgaccaatatggtaaaacaccatctctactaaaaatacaaaaaaaaaaaaattagccagacatggtggcgtgcacctgcaatcccagctacccgggaggctgaggcaggagaattgctttaacctggaaggtggaggttccagtgagccaagttgtgccactgcacgccagcctgggcgacagagcaaagactccgtctcaaaaaaaaaaaaagaaaaagaaaagaaaaaccatacactataagaacaatttatatagcatttacattgtacgttataggtgttataagaaattagagatgatttaaagtatacagaaggatatacaaaggttatatgcaaatactgcaccattttatattatgggacttgatcattttatatacgggacttggggttttggtatccactggaggtcttagaaccaatcccctgcagatattgagagatgacagtatttccttaatgactgaactgtttgttggaaaaaggaggctagtctttgcacttacatacattaatgtatttcttctattttcacttgctgaattttttttttttttttttttttttgagatggagtctcgccctgttgcccaggctggagttcagtggcccaatctcagctcactgcagcctccgcctcccgggttcaggtgattctcctgcctcagcctcccgagtagctgggattacaggtgcacaccaccatgcctggctaatttttgtatttttactggagacagggtttcaccatattggccaggctggtctggaactcctgacctcaagtgattcacccacctcggcctcccaaagtgctgggattacaggcatgagccaccgcgcccggccacgtgctgaatatttttgtattatcttgttatgtggaattgcctgggtattttatgcttttgcctattccctgttttcttatgagagcaataaaaggaataatacaattttattaatttagaccactattttaatttagggtacacagacaattctcaacaatccaggagcagaataactggttttctgattaattatgaataaagtgtagcaagagcccaggactttcatccccttctgaccaaagctcagtaattgggcagtggctgattttccctggttgataccttctccgcctcccttcaatacaaggaaagttgccaaactacccatctgaatttttttggtgtttttttttttcctggttggatgaagggaaaggaaacaataacttcaatgtaatttaaaccagactaaatgttgcctagtagaagttcttaacgaatctctctaatgaatttaataattttatattttaaaacatacaaatataatttttaaattatattaaaaaattaaaaattatatttttataatttgcaaaatgataccattgaagtgcttttactcttagaaaagatttctcttggccgagtgcggtggctcacacctgtaatcccagcactttgggatcccgaggctggtggatcacctgaggttgggagttcaagaccagcctgaccaatatggagaaactccgtctctactaaaaatacaaaattagctgggcatggtggctcatgcctgtaatcccagctactcaggaggctgaggcaggagaattacttgaacccaggaggtggaggttgcagtgagctgagatcatgccattgtactccaggctgggcaacaagagtgaaactctgtctcaaaaaaaaaaaaagaaaaagagttctcttgggaggctgaggcgggtcgacagatctcaaggccatcctggccaacatggtgaaaccccgtatctaccaaaaatacaaaaattagctggacatggtggcgcacacctgtagtcccagctacttggaaggctgaggcaggagaattgtgtgaacccggtgcgggggcggttgcagtgagccaagatcacgccactgccctccagcctggtgacagagcaagactctgtctcaaaaaaaaaaaaagttctcaaggatttaagctttttcattttttaagtgctatttataagaaggtgtttgttattggagggtggttttgagcccaatctctataacagatactatattatgataatttgtgttaaattggggactcaaaatggaccaactattaatcaagaaatgtaaatgggatagggtaaaacaagtatgtttcggcatttttgtatagacatactgagaaatgcatcttgcttgagtttctcctgcagtttctgcttttcaaacctcttgaagtaggaatagatgggaaggaaaaaatgactagaggaaaacagaatgggagagatgtgggaagaacagtgaggataatgatattgcgtcatgtttcccactggggatgttgtgggataccaagttttagagatgtcttgagtttctggttttatttttgtttttaatgtagaaaccattagttacagctattaagctctgtgtgtgtgtatgttatgtgtatgtttatattcaccaactttgatgggttgacagtaatgaggtttttatactttgcatgcttccaggtcctggcaaaactggcctgtggactaaacaagcccaaccgccaaaccctggtttcacatgggtcagtcccacagctcttcagccaaatgcccattcgcaaaatgtaagtattcaggcagcatgttaaatttcacttctatccatgtgtagaaactctctggttgtagtttcttgtgttactaattaaggactggagccaggggaaatacataccaggcagttagaaggaaaacaacacagaacattttgaaacacacgctgagacttttatttttatttatttatttattttttgagacagagtttcactcttgttgcccacgctagagtgcaatggcacggtgtcagctccctgcaacctccacctcccaggttcaagcaattctcctgtctcaggctcctgagtagctggaattacaggcgcccaccaccacgcctggctaatttttgtaattttagtagagacagggtttcaccatgttggccaggcaaatctcaaactcttgacctcaggtgatttgccctcctcagcctcccaaagtgttgggattacaggcgtgagccactgcgtccagccacgctgagacttttattgaaccttcaattctgggttatctgtggcagatacttaatcctgaattaaaaaaaaatgagccaggtgtggtggctcacacctatagtcccagcacttttggtaggccagggtgggtggatcgcttgagcccaggaggtcaaaaccagtctaagcaacatagtgagaccccatctctataaaaaataaataaataggccgggtgcggtggctcacgcctgtaatcccagcactttgggaggcgaggcaggtggatcacctgaagtcaggagttcgagaccagcctggccaacatggtgaaaccctgtctctactaaaaatacaaaaattagctgagcgtggtggcgggtgcctgtaatcctagctactcgggaggctgaggcaggagaatcacttgaacccaagaggcggaggttgcagtgagccaaaatggcgcccttgcactctagcctgggtgacaagagcaagactccgtcttaaaaatatataaaaaataaataaataaaccaagttttagctaaatgtttaacttcccgctagacttttttatttaagtctgttattaagtaacaaataggaattttacttcttttctttcctctaatagcatatcaaggtgttcagggctgctgaatttcagctctcaaagtaggcattagagaagaagccaagtcaaatgaacaggttgtgcctaccagttgtgtggccttgacaaggacttataatattgtagaaaggacaaggtaaaaagcaatagtaaaagtgctgtcataagactgcataattgataaatgaattgtgcagtagaacaaacttcacaaaagaagggagtatttggagatggatttataaaaaggcatgggattttgttttgagatttggcaaaatttggagagtcagacaaaaacagcaaagcagtactgatttggagaactttttagcacaaagaagggaaagtatgagatattttcagtgaactgggacctaaagtagtttagctgcaccatattgaggaggataatggaaatagactgaaaagatggtttaaagacagattacagggagcctcaaaggctgggctaaagaattttgacttttttttttttgagacaagtcttgctctgttgcccaggctggagtgcagtggcgcgatattggctcactgtagcctccacctcctgggttcaagcgattctcctgcctcagcctgcccagtagctgggaccacagctgcatgccactacgcccgactaatttttgtatttttaggagagatgaggttttactattttggccaggctggtctcaaactcctggcctccaatgatctgcctgccttggcctcccaaagtgctgggattacaggcatgaaccactgtgcccagctgactgtttatatttaggttatgtattcctttttttttttttttttttttttgaaacagagtcttgctctgtctcccaggctggagtgcagtggcacaattaagagctcactgcagccttaacctcctgggctccagcaatcctcctgcctcagcctcccaagtagctgggagcacaggcacatgccaccatgcccagttaatttgctggagtacagtggcacaatctcggctcactgtaacctctgcctcctgggctcaagtgatcctcccacctcagcctcccaagtagctgggactacagctacatactaccacacctgactaatttttttgtattttttttgttgagacagggtttcgccatgttgttcagactgttctcaaactcctgggctcaggtgatccactcgcttctgcctcccaagtgctaggactacaggagtgagccactgcacctggccttaatttttttttgtagagttagggtcttactttgttgtccaggctggtctcaaactcctggactcaagcaatcttcccgccttggcctcccaaagtgggatcataggtgtgagccattgtgcctggccagattatatattcttaagtaaagttttagccatggaagggatttattttgtgtttgggattttaatccccaaacaggacagcaggcgttgtacaattgaacgttttatatacagtttacttgatagttaatcaaggactttaaccttttggttatgttatttttaatcttcttctcaaattctaactcccagagtaactgaattcccagaatatatgctctcatttgtcctgaaccttttggagagctgtttacaaagtagaatgtcttacgtttgctgctaattagatagttatgatgtgacctatcaattctttgtctcctttgttatcagccgtagtcttggaggaaagctaggggcctctgtcattgagatcctagggatagaatacatgggtgaactgacccagttcactgaatcccagctccagagtcattttggggagaagaatgggtaagtgattcattttttttaaaatcataacctttatggagatgctatattcaaatatagacaaaaccatctagtaaaatccagacctatctttaggttaacatttgtttcttgagattatttcactggttcttcttgcttcaatatcttgggtcactatggcccatcagtctagagtagttttttccatgtacctaggtggttgatagataagatttgttactttgatgcctgagtatatactaattacatcattcatgcatgctgagatgctatattctcttaaaatccttgtgtttaatgccctagcaagcacacacacattttgggatatgaatcagtggcttgcttggcatttttccaaaaatacaaatgatgacttggctttagaagacaaaaccagtgttctcattgtccatatattgcactggaattcactgagaagggcaggggtttcgtcagaggtccggtacactaaattttggacaaggttttcctttttcatgaaaaagataaaagggcaatataatatagttatttggttttgttttaacaagaataatcatttaatttcaccttaacgttttttgctggtcttattaggtcttggctatatgccatgtgccgagggattgaacatgatccagttaaacccaggcaactacccaaaaccattggctgtagtaagaacttcccaggaaaaacagctcttgctactcgggaacaggtaagctggcattcttgacagaacactacctcttttaaaggggtcagtgggtaggttttggtagctgtggaaggtttaataggttagaggagacctttataaagtatgaagaaaacagatgttctgtccttgggttgaaaattgactagtttatgattattacttttttctctttcgtctatcgaaataaaatggaatttctcatttgtttagtagatggagacttggaaagcctaggatattatgcttcaagtttgggtcttgtctttttctcagagctggaacatgcttgaaagtcacctgatggcaaacaagcaggaaaagaaaatgaaaggcttgagctagggcaggacagaaggactgggaacatttctatgatctggtgatcctttgattatggggagtctttggtgcacaattctgtttgggagaaaaaaaagaacaaataacaccatctagttcttaatagacttcgagtgtttaaatgaaagattaaagtctcaatacttttttaggtacaatggtggctgttgcaattagcccaggaactagaggagagactgactaaagaccgaaatgatgtaagattttctttctttattcctggggtgggctttgcaatttacatatcagctgctctttaccttatggagcaggaacaaagacagaaaaaagtattagcataggaaatatccgttttctttcttttttttttttttttttttttttgagacatggtctcactctgtctcccaggctgagtacactggcacaatcatggctcactgcaacctctacctcttaggctcaagctctcctcccaactcagcctcctgagtagctgggactacaggtgcatgccactacaactggctaaatttttttattttttgtagagacagggtcttgctaggttgctcaggctggtcttgaactccagccaaggaaattttaagaaatctttttaaattttttaattttttaatttttttttgagacatagagttttccctcttgctgcccaggctggagtgcagtggcatgatcttggctcactgcaacctccgcctctgggttcaagtgattctcctgcctcaccttcccaagtagctaggattacaggcacataccaccacacccggctaattttttgttttgtattttcagtagagacggggttctaccatattggccaggctggtcttgaatgcctcacctcaggtgatccgcccacctcagcctcccaaagtgttgggattacagacataagccaccacgcccagccagtagtggcagttttaagcacattttattgtgtatatttgatgtttacaacatgatgctatgggatacatatagtaaaatggttactatagtgtagcaaattaacgtatctatcatttcacatacttttttgtaaaaaaaaaaaaaagtagttaaaatctacttaaaatctctaatagaattttattaactatagtcctcacttgtacattagctcaatagacttgttcaccctacgtgtctgctactttatatccttttacttacatctccccatttcctcctcccctcccccatcccaggtaaccactgttttattctctatctctgtatatttgacttaaaaaaaaaattctgagcattgtacatttttctttctaatgttaaagacatctgatgattagtttctctcctttttttttttgagactgagtttcgctctatcgcccaggctggagtgcagtggagcaatcttggctcactgcaacctccacctcccaaattcaagcgattctcctgtctcagcctcccgagtaaccgggattacaggtacctgccaccatacccagctaatttttttatttttagtagagacggggttttaccttgttggctgggctgatctcgaactcctgacctcaggcgatctgcccatcttggcctcccaaagtgctgggattacaggcatgagccaccgcacccggcagtttctctctcctttttaaatagctttattgacatatactttacataccacaaaattcacccatttaaaataattcagtggttttagtatattgcagagttctacaactattctacaattttagagcatttttatcaccccccaaaagaaatcctgtgcccattaccagtcactccccatttctctcccagctactccccagccctaggcaaccactacactgcttaactgttctggacatttcatataaatgtggtcttttgtgaaaatatgtggtcttttgtgactggcttgaagtctttcacttaatatgttttcaggttcagccgtattgtagcatgtattagtacttagtcattttttgtttgttttgtttttgttttttgagacggagtctcgctctgtcaccaggccagagtgcagtagtgcagtctcggctcactgcaacatccgcctctccagttcaagtgattctgctgccttagcctcccgagtagctgggattataggcacgcgccaccacgcccagctaatttttgtatttttagtagagatagggtttcaccatgttggccagggtggtctcaatctcatgaccttgtgatcttcctgcctcagcatccaaaagtgctgggattacaggcgtgagccactgcgcccggccaggactgacacctttttatggctgaataatattctattgtattaatatataccatattttgcttatctacttattagtgaatggacatttgagtatatttccacttttggctattatgaataatgttgatatgaacattcatctacaagtttttgtgtagacacctgttttctttccagcatataccttggagtataatttctgggtcatatgttaactctatgtttagcattttgaggaatcgccagactgttttccacagtggctacaccatttcacatccttaccatcaatgtaagagggttccaatttttccacatccttgttactgactttttaaattttagccattctagtgggtgtgaaatggtatctcattatggtttggcttacattctctgataatcttttcatgtgcttgttggacatttgtatatctttggggaaatgtttgttgaaatcctgttcctgggccgggcgtggtggctcaaatttttggaggccgaggtgggcagatcacctgaggtcaggagttcgagggtagcctggccaacatggcgaaaccctgtctctactaaaaatacaaaaattagctgggcgtggtggcgggcacctgtaatcccagctacgcaggaggctgaggcaagagaatcgcttgaacctggaggtggaggttgcagtgagccgagattgcgccattgcactccagcatgagcaacaagagcaaagctccacctcaaaaataaaaaagaaaaaacaaaaatcctctccccttttttaaattgggttgtctctttattattgagttttaacatgtcccttgtcagatacgtgatttgcaaatattttctcccattctgtgggttttcttctcactttcctaatggtattgtttgatgcatcctcttcttttgaaatgtcttggagttctacaagtcaactgtacatgtcaagaatagtccaaaactgctcgttgctcctttttagctggaatgggtggtaaatgtttgttcctttggtaggcatcataaagagggatttgatccagttgcgttatcgcccttttccgcttttgcccactaggtggcacttgtttctcatctctctctaagtccctggggcctttctttccacttttttttcctaagagacagggtcttggctgtcatccgtgctggagcacagtaatacaaccttagctcactgcagccttgtagcctcaacctcctgggctcaagtaatcctcctgccttagcctcccacagtgctgggagtacaggcatgagccactgtgcctagccttttcttccctctttgtatccagtggggatccctgaaaatctatcttttaagcttcaaaggactttatgccaaaaataattcaggacatagcagatcctatcacttcactgtttaaaacattccagtggtttcccttcacacttaaggcatattaaggaattttttaaaagtaattctataaagccaaatataatctaatttcttgctacttctctgaccccatctcttatcttcccctcacttattctagtctccacttcactggcctccttccctttatctaacacactaagtaagctcttactttagcacttcccgtttctttgccctggagactctttgttcatatattcttaatatttgcttccttgatttattcaaatctctgtgcatgtattacattctccaggaggtcctccctagttaccctatcacagcagcagcctccatcactctctgccttattctgcttttcttcatagcactcatctctgtggtcatttctgttacatgtctattttttattatctatagttcctactacaacataggatccatgaggacctggactttattttgttctctcctgcatctctaggcactgtctaggcatgcagttatagttgaataattttggtcaacaaggactcctttataattgctaatttgtattccctcaagatatataaatccatacaaatgtattttttatccaaaaagtagttcctgctcttagcttgtttgccttagggatacttcttctcactagcatcttttgataggggtcccttatgtagaattttcaccttcttatatttctgcctcttgaccattatgtctcagtttgctgagattacagcattcagatgcttcagacttcactgaaaagtgagtcatgatcttgctctctcaaggcaggctcactatatggtatcttctctagataagctgtaaaaaggtgttggtagaaacttctggaattggtggcgaatgtttgtttaccataagagccccagggcagaaaaaaagatatgacttgaagcctagttccactttgctttcagacaattacttacctgaaaccttccttcagtcacaaaatagtatctagtattgtagatatttgttataattgtcctgcttagacaccatgaaaaacatttaggggagtcccattttcatttgtgctgtcctgttcccatcatctgtcaaaacatcctaggatactccgatgttccataatccaaattatgtcttcttcagttactttttacacccagaaatagcattaacacttttttgtggaaccatgtaatcagatttctattcagaaaatgcattctgttgcatatatatagattctttttttttttttttttttttttgagacagagtcttgctctgtcatccaggctggagtgcagtggcaccatcttggctcactgcaacctctgcctcccaggttcaagcaattctcctgtctcagcctcccgagtagctgggattacaggtgcctgccaccacgactggctagtttttttgtatttttcagtagagatgggatttcgccatgtttgccaggctagtctcgaactcctgacttcaggtgatccacctgtctcagcctcccaaggtgctgggattacaggcgtgagccaccatgcctggcctctttctcttttttatattttatctttactctttgcagaactcagtttacctttattcttgacttttaaactactgtttccaaaccattgtcaccctggttcttttaatttcctctcctgcagttcagtacctagaattcagatgctcctcataactttatttctggtctccatcctttccacccacagaatgacagggtagccacccagctggttgtgagcattcgtgtacaaggagacaaacgcctcagcagcctgcgccgctgctgtgcccttacccgctatgatgctcacaagatgagccatgatgcatttactgtcatcaagaactgtaatacttctggaatccagacagaatggtgagttcttttctagctcatcttctcagaatagatgatgattcttagctctgtcttagctctacaagacataatttttatcataaagttcctcattgtgtctaatcactcaaattttcacatgagctgaatttcagaagatgaaatatgcttttatgtacagattagtccttcaatgaggtaaagggtaaatgtcattttaaagttattattaaagtatcggccgggcgcagtggctcacgcctgtaatcccagcactttgggaggccaaggtgggtgaatcacctgaggtctgtctcagttctacaagtagtaggaatctctgtcttagctctacaagtagtaggaatctgagctcttccatctgggatagactctgactcagactaccagtacctgttactctgggagaaaatacagtaccaacctcagaaacaagacagctcagcacagatcctttgccgacagctgatacattccagttcccaggaggttagacccttactctgtattggcttggtcagggaaatgaccagttgcacttggagaacagagctcaaatttcaaggatacatttgggaacttcaaactacttgattgttctatcttaaaagcatatttcttgattataaaggtgacctgtgttcactgatattctctatctgacatcccaactcagttacaagctccactggtattataccaaatgtcatattcattagtaaacttcacttctgttggtcatgaaatataagcctctttttggagcatcttcattttctgtccagatattaatgattttcaggattggaatcctttaattgcatatttaataaagcccttactttttttaaagtattccaaattcacaatagaaatataattatgagagagaggtaagtcagttgctcacttacagatgtatattgaatattatacaaaataaaatcaaagtttagttaatcgcttattacttatctaaatatattggcagtataattatgtgtacagacctataatatggtggagtctcctagtctttgttcatagggccgggcgcggtggctcacggctgtaatcccagcactttcggaggccgaggcaggcagatcacctgaggtcaggagttcaagagcaccccagccaacatggtgaaaccctgtctctactaaaaatacaaaaattagccaggcatggtggtggatgcctataatcccagctacttgggaggctgaggcaggagaattgcttgaacctgggaggtggaggttgcggtgagccgagattgcgccattgcactccagcctgggcaacaagagcgaaattccgtctccaacaacaacaacaacaaataaataaataaataaataaagtctttgttctgagaataatttacttaatacttcctgatatatttattttcaaatattgaagttttacaaaaccaaataacaaccgtggtactaatgtacacatgaaaccttatttgaaaagttataaattgacaaactataacaaatactactcaccaacggtgtgaaactccgtgatgcacagggaagcatcaaaattatctgattataagactgtcccaaagcatgaaacctgaggatattgggatactttttttttttttttttgagacggaatctcgctcttgttgtctaggctggagtgcagtgacgcaatctcggctcactgcaacctctgcctcccgggttcaagcgattctcctgcctcagcctcctgagtagctgggattacaggtgcccgccaccacgcccggctaaattttgtacttttagtagagacagggtttctccatgttggccaggctggtctcaaattcctgacctcaggtgtttcacccacctcggcctcccaaagtgctgggattacaggcgtgagccactgcacccggccaatagtgtaataataactttaaaatgacatttaccctttacctcattgaaggactaatctgtacataaaagcatatttcatcttctgaaattcagcttatgtgaaaatttgagtgattagacacaatgaggaactttatgacaaaaatttctgatttttttttttttttttttgagagggagtctggctctgtcacccaggctggagtgcagtggcgcaatctccgctcactgcaacctctgcctcccgggttcaagcaattcttctgcctcagcctcccaagtagctgggttacaggcgtgtgtcaccacacccagctaatttttgtattttagtagagatggggtttcaccatgttggtcaggctggtctcatactcctgacctcatgacccacccgccttagcctcccaaagtgctgggattacaggtgtgagccaccgctcccggctatcacaagaatttcttaaaatgtttctgaaattgggactagtaacgaaaagcagttgtggaatttcattctctagaaattccagagtggtaagtcagtcagggttaggtagtgccctgtttaaaaacaggataatggctaagaggattttttcaagtctttctagtctaaatattctaaagctttttgttgtcctgaataaaatttcttgccccaaccctgaattacagcagctttccagtggtaccttataaaaaacaataatctctagctgtcgggaggtgagtggttgctaaattagtggttctcaagacataacatcagcatcacctaggaaattaaattctctgtcatcccaggtctgttaatctctgatacacattaacgtttgagaaccactgcagtaaagaataatttctgtggcagaaccagaatgctagtcatctatggattaaatctgtcctatggtgaaataaaacagatacaattcatggaattagcaataggtcactattttaatcttctaaattgctaatcatcttatttctttactttctgtataggtctcctcctctcacaatgcttttcctctgtgctacaaaattttctgcctctgccccttcatcttctacagacatcaccagcttcttgagcagtgacccaagttctctgccaaaggtgccagttaccagctcagaagctaagacccagggaagtggcccagcggtgacagccactaagaaagcaaccacgtctctggaatcattcttccaaaaagctgcagaaaggcagaaagttaaagaagcttcgctttcatctcttactgctcccactcaggctcccatgagcaattcaccatccaagccctcattaccttttcaaaccagtcaaagtacaggaactgagcccttctttaagcagaaaagtctgcttctaaagcagaaacagcttaataattcttcagtttcttccccccaacaaaacccatggtccaactgtaaagcattaccaaactctttaccaacagagtatccagggtgtgtccctgtttgtgaaggggtgtcgaagctagaagaatcctctaaagcaactcctgcagagatggatttggcccacaacagccaaagcatgcacgcctcttcagcttccaaatctgtgctggaggtgactcagaaagcaaccccaaatccaagtcttctagctgctgaggaccaagtgccctgtgagaagtgtggctccctggtaccggtatgggatatgccagaacacatggactatcattttgcattggagttgcagaaatcctttttgcagccccactcttcaaacccccaggttgtttctgccgtatctcatcaaggcaaaagaaatcccaagagccctttggcctgcactaataaacgccccaggcctgagggcatgcaaacattggaatcattttttaagccattaacacattagtgctgccctcaggcttgcctgtaggatttaatattttttatctttacagatctttatctttaatattttatctttacagatttccctgagaaagggaattatgaaatttttaatacaaaaaataatccatttaggtgctgagttacggtcccatctcttcacaggcatggattctaatcccactgctgacagagatgtaaaaattcatcctaccagagtttttaatctttagcatttagggaggcagtgtcataaagtaaaaagtgtgtgggccttggagtctaagagacgtggttgcaaacttagctctggttattgcaatgagggccttgaacaagtcattttcttcacattctcatctgtaaaatggagataataccttacagattattgcagattaataacaatgtattcaaattatgtaactcggccgggtacaatggctcacgcctgtaatcctaacactttgggaggccgaggcagacagatcacctgaggtcaggagtttgagaccagcctggccaacatggcaaaaccatctctactaaaaatagaaaaattagccaggcacgttccaggcacctgtgatcccagctacttagaggctgaggcagaagaattgctttaaccttggaggcggaggttgcattgagctgagatcatgctagtgcgctccagcctgggcaacagagcgagacttcatctcagaaaataaaaaataggggccaggcacagtggctcatacctgtaatgccagcactttgggaggccaaggcgggcagatcacgaggtcaggagtttcagaccaatatggtgaaaccccatctctactaaaattacaaaaaaaattatccaggcgtggtggtgcacgcctgtaatcccagctactcaggaggctaaggcaggagaatcacttgaacccaggaggcagaggttggagtgagctgagatcgcgccaccgcactccagcctgggcaacagagcgagactccatctcaaacaaaaacaagaacaaaaacaaacataaagttggcacagaaaagggaccaagtttaaaaaagggttttaaatgtaatgagacttgcatagttaaaaaaaaaaaagggattatttttatttttattttttatttttgagacggagtctccctctgtcgtcaggctagaatgcagtggtgcgttctcagctcaccgcaacctccgtctcctgggttcaagcaattctcctgcctcagcctcccaagtagctgggactacaggcacgtgctaccacactcagctaatttttgtatttttaatagagatgaggtttcaccatgttggccaggatggtctcgattgcttgacctcatgatccgcctgcctcgacctcccaaagttgctgggattacagatgttagccaccgatcctggcccccccaaaaaaaggattttaagaaaaacttctcttggccgggcgcagtggctcacgcctgcaatcccagcactttgggaggccgaggcgggcggatcacaaggtcaggagatcgagaccacggtgaaaccccgtctctactaaaaaatacaaaaaaaaattagccgggtgcggtggcaggcgcctgtagtcccagctactcgggaggctgaggcaggagaatggtgtgaacccgggaggcggagcttgcagtgagccgagagcgcgccactgcactccagcctgggtgacagagcgagactccgtctcaaaaaaaaaaaaaaaagaaaaacttctctttaggctgggtgcggttcctcatgcctataatcccagcatttagggaggctgaggtgagtggattgcaggagctcaggagttcgagaccagcctgggcaaggtggcaaaaccccgtctctactaaaaaaaattagctgggcttggtggcaggcgcctgtaatcccaggtactcgggagactgaggcaggagaattgcttgaacctggaaggtggaggttgcagtgagttgagatcacaccaatgcactccagccagggtgagagtgagagactgtctcaaaaaaaaaaaaaacaaaagaaaaacttctctctagctctgtgacgggcagttcagataataccttcaccagatttacctgttttcagctgaagaatgtgagatgaagccttgaaaccctaaaagtgatatggtaactagggcaggtctttctgtacataaaagtgacttaataaacagtgaatttcatacaggtaaaccctattataccctcagttctaaccattggcctatctcttgcgttttgttctaatgtagaattagattgctacttgactagttcaggaactctgtttagatctgataagtcataatcaaatcttgccaggcgtggtggtttatgcctgttatcccagcactttgggaggccaaggcaggtggaccacgtgaagtcaggagttcaagacaagcatggccaacatggcgaaaccctgtatctactaaaaatacaaaaattagccgggcatggtggtgggtgcgtgtaatcccagctagttgggaggctgaggcaggagaatcacttgaacctgggaggcagaggttgcagtgagccgagatttccactgcattccagcctgggcgatagagtaactctgtctcaaaaaaacccactagatcatctctagaacattgctactcccaagtatgatttgaggaacagcagcctcagtatcaccagggaacttattagaaatagtctcagcctcaccactattcccacttaattgtaatctgatattaacaagatttcccaatgtgggtcaggtgtggtggctcatgcctgtaatcccacactttgggaggccaaggtgggcggatcacttgaggctgggagtttgagaccaggctggccaacatggggaaaacccatctctacaaaaaataacaaaaattaggtgtgtgtggtgacgcatgcgtgtaatcccagctacttaggaggctgaggcaggagaatcacttgaatctgggaggcagaggttgtagtgagctgagattgtgccactgcactccagtctgggcaacagagtgacactgtttaaaaaaaaaaaaattcccaatgtgggccgggtgcagtggctcatgcctgtaatcccagcactttgggaggctgaggtgggtgtatcacgaggtcaagagatcaaggccatcctggccaacatggtgaaaccccgtctctactgaaaatacaactgggcgtggtggtgcacgcctgtagtcccagctacttgggaggctgaggcagaagaattgcttgacctgggaggcggagcttgcagtgagcccagatcgtgccactgcactgcaccctggcgacacagcaagactgtctcaaaaaaaaaaaaattcccaatgtgtatcttaaagtttgagaaatgctgatctaaaagatactaatgaccaggtgtgtagaggacattttcttaagcccttaagtacaaatttaagaggtaagtgcttcagccattagggttactggcttgttcatctttcccactgagtgtaaatatttagcttagggtttaaaatttgttatgtagctttttgcacttgtccatgtttatactactgtattattattatttttttttgagatggagtctcgctgtgtagccaggctggagtgcagtggtgcaatcttggctcactgcaacctccgtctctcgggttcaagcaattctcctgcctcagcttcccgaatagctgagactacaagcgtgcaccaccatgcccagctaatttttgtatttttagtagagacaggttttcaccatgttggccaggctggtctctatctagacctcgtgatccatccgcctcggcctcccaaagtgctgggattataggcatgagccaccacgcccagcctatagtactgtattcttattctccactcttgtgtgtgaaaagtcagctcttttggcttttctgttatggggaaacttgaattacacagggaacccaactgaagaaaatgaactgaagtaggtggcgctgggtgaagtgggcccagagaatggtgtacacatccctcccatacatatacccaaacttctatttttttatgtgacggagtttctctcatcgccccggctggaatgcaatggcacgatctcggctcactgcaacctccgcctcccgggttcaagcgattctcctgcatcagcctcctgagtagctgggattataggcatgcaccatcacgcctggctaatttttgtatttttagtagagatggggtttcgccacgttggccaggctggtcttgaactcttgatctcaagtgatccacccgccctggcctcccaaagtgctgggattacaggcctgagccaccaggccagccccaacttctactttttattttatttataaattggggggggggttctatatttagtttgaagaggtggggaagatttgaaaaccactagatttaccaggaaatttttttcttcaaaaatattttctgcttttatgatacttgaatatctaataaaagacaatatttagccagtcacggtggctgatgcttgtaatcctaacactttgggaggctgaggtgggtggactactggagccctggagttcaaaaccggcctaagccacatggcaaaacagtctttacaaaaaatacaaagatggtggcttatgcctgtagtcgtacctactcaggaggctgaggttgggaggatcacctgaatctgggagtttggggctgcaataagccatgattgtgccgctgcactccagcctgggtgacagtctgagaccctgtctcaaaaaaaaaaaaaaaaaaaaaaaaaaaaaagactacattcactgtatacgtggccttttccccctaactagctatgtagcttcttaaaggcaaagattcttcatagtgctttgcacatgataggtgctgatactcattggatgaatgtatatagtgaagaattttagatctgattaccacaattgggatcataaacatgtataaactccttgggagtctgccttatatactttttatccccctaaatgttccattaatgttgcagagaggctcactagttcctggagatgtcttattaagtactgaaatgtgattttccaaaattttctttacaatacaggcaaaagataagtaaattgtggacaaagctttcatctctatcagcagctatagagaggaagtaaacagcttagcccctaatacaggaggaagttgttcaactacaggcttgttagtagcaagttaaaccagttacattttataaaacagcctgagtggtagggaagctatcactttaatactctagaggcagaatgccacataggactttgggtcacatatttcttttccagggtctcctcaaaatgcagtttctatttacagttgactttggcccctatttacccataaaatgtcaaaatcaagtagtatgaacatggaaacaggagcagggactaaggtttggtcaagtggccctcattgttccaagagtaatttaggctatgtaaacttgaaaaatatgggaccagattaccttttgtctctaaattctactcttctttaagtagctggcactgtatctctgccagggcacagaagtgggctccttactattctgaccactagcaagtggccaactcttcaaatacagggtagctacctatttcacgtgaaaggcctcagtattctgctcacttgaactacggaaaataggccacaatacttggttacaatactggaactctgaacctatgtggaggagagaaaaacaatggtgaacgagataccagctgggctctttccacattcagggctcagcagtgttggggtttcacttgtctctaatcctgaagaggtatctagccctggaaggaagctgagcctgtagctaacgcataagcacagtgtattcaataaaacatttttattctgtacaata

SEQ ID NO: 146 - DNA, 51788 bp, Homo Sapiens
agtcccccggtttccctggagaccaggcggaagcggccggaagtagcgctgcggttggcagcggcgggatggagaagctgggggtggagccggaggaggaaggcggcggcgacgacgacgaggaagacgccgaggcctgggccatggaactggcggacgtgggggcggcagccagctcgcagggtgcgccgcagccagaggagccagcggcctccttgggtgtaaatgagaagggtggggcaggcggacgctcggggcggcggccactggggcgcgaccgtccccgccccactcggctcctctaagagagggctgcctccctctgccttgtgttacgcggcgggtacctctagaggaatggcttcacccagcaggagtagggtggggcgcgtccacactacaaatacgtgtcgagggtttatctgcgccgtcctttcctctgtgaggggcgaggtggggcgggaatccctcagccagcccgacgaaaactgcagaggcttctgggccttttaactttggagaagttgaggaccttgtcgctcatttggcagaaggtgggacccggatctcagtcctggcaggaagggatggctcagaacctaggcggagtcaggtccgctgtggtcacgtctccggtgacccacttccagctctggtctttaccttgtaccgcccacctcagggcctggatgtaaaggcaccggttctcatttcctgctggttttgtttcattcattaatttagagacaaggtctccctgcagcctcgaacccctgggctcaagtgatcctccgccccagcctctccgtcccgagtagctgggacagcaggcacgtgccaccacacctggctgattttcagatttttttagatcaggtgtagctgtgttgtccaggctggtctcaaactccagccacaagcgatccttccacctcagcttcgaaaagtattgggattacagtagttagccatcgtgcctggccttttaaattttggaactttaggtttacctgaaagttgcagagctagatccccctagtgttaacataaactcagtacatttgtcaaaactaggaaattaacattggtataatactattaattgaactacacgctttattaatattctaccagtttttctgctaacgttcattttctgttccaggatcccaaccagaatattgtattgtattttgcctgtcttgtttttagccagtgttgagagaaggagtcgcctctgtcattccctccccgacaaataatgacctaacaactttttaaaatcaaagaactattcagtctttcaatttagtgaatatttattggtggtctgttatgtcctagacactgttttaggcactggcgatttagcattaaaccagataatcctgctgccatgggagctaaaaatagcccacacttgtacccactggttgtcttttgccattttgtatttcagtttttgttggtttgtttgttttaaatgtaagggcatgctgcttagaataattttcaagctgtgtgaaaatcaacgtcatttcaacttttctgccccttctggtttacactaagagctactataaacttccaggtgatagtattagctctttcatcatccattatttatcacattttttcccttcaaacttattactatcctgagaaaaacgcagtgcacaaacagtaattaagaggactgaagaccctaccctaagtggagtttcatgtctttgtaatttttcgatgctttcacacataatccaggagaaaacacgtcactctgcattcttccttcacaggtaccatgttttaaggaactgtcagttgctcagagataataagcagcctgaatttctttttatttctttgcatattgtgcaggagttcatgatcaagtgttgcccacaccaaatgcttcatccagagtcatagtacatgtggatctggattgcttttatgcacaagtagaaatgatctcaaatccagagctaaaagacaaacctttaggtaactgtagatttataatatttttaattgcataatgattagattagcaactcatcatgctcattatatactgatttattaaccttattaagaaagattttggaagcagttcttacagtgctttatagctggtcatttttgcttcactaccaagtgtaaattttacaagcctcatttaataagtggtgaatctgagaatagtgtagtcggcagaacaaatgaagagaaagcagaataaatgttacttttctgtgctggttagtagcttagtttgctggtcagatttctttttctcactatttgaaattttacaggctttgttctcaaaaacagcctcttattacattttagtggaagtgttcgtctgtcctcccctttctgaaattatctcttaaattgtgtaacatctaactaactagttggattttgaacataaacctaagtattattaagacagcaaacttgccgtaaaaacataagcatctttttaaataaaagccaaaataaattttatattggatatttgttgatatgctagcttgttttatcatttttattattcatattttaaattgagaaagataaagagattttctttcatgcatgcaggaaagattcctcttttagtgtaagcataaagaacatttttggttcacttgctgctaccctcttgtgcccactttggcttaataaatcccaatccagcctagctgatttactgaagaacaaagggatgactagtttttgctacgccaaggtgagtctaggatcttaaaacttttctaagggtgccaaggagttagaatcaggggacctaagttttttctcctgaaggcatttctgagtagtagcactgtgttataagatgttctgtagataatgcttaataaaaaaactgtaattaagtacgaatgaatgattattgggaagtgagggatatgaatgctccatgtttttgggggaaaacgaaagtagtctttcattttgtttttgttgttgttgttgagaaggggtctcactctgtagcccaagctgcagtgcagtggtgcgatcttggcttactgcaagctttgcctctggggctcaggtgattctcctgcctcagccttccaagtagctgggactagaggtgtgcgccaccatactcggttaatttttttgtatttttagtagagacggtttcaccatgttgccctgggtggtctcgtatgcttgaattcaggcgatccacctgccttggcctcccaaagtgcggggactacagacgtgagccaccgtgcccgaccagtagtgacatgcagtgatgaggccatataatgtaatgctctattaaaggactcctttttttagttaagaaatctagcaatctgattttttatgtagttcactgaggaatctcaaattattattacctttggttccatgattatatttttgggcattacctgatatatgaaaaaactttatataaaaataatgttgtttatgatatcaaaattttagaaacaatgtctaatagagaagtggacataaccttttttttctacatgtttgtattttacatattttaggtgaacattactcttacagtggtaagcaagtagtcaacttgtataaaaaaagagcaaataatttttagcaatcttgagtcaccaataaactagaattttttatgcagtctgtaaataaatgatcataatttaatcatttttgatagaacagttcaataagtagtacataactgttagatccctaaaaattgctgtagcccagcacttgttttatatattttatatacatattatattttatattgctttatattagcaagttacggagaagagaagttgagtttttctagcagcaaccagtatttagttgtactcaattattttcatccgttttttttttttttggtagaacatgccctattatatggcagtataaattaatctgcttttatattgtctggaaaaaaatcctagagagatttgatttgtatcttatcactgaagattccatagaatatattgatttaggttcatttttaaattttagaaatgtaatacatagattgccttttgtatatgaataattgatctatcgtctaacttttaattctgtgttattcagtgttttgttatttaataataactttccttcttcaaggagacaaaacaactagagattaaaagtggggtatggaaaaataatacattggtatattataattcataattaggagatagcttgaaaacctaatgtttctgcattatagagatttgatatatggaggctatgttttttaattgagacagggcttttgattcttatcaaaactgattgtcttacaatttagacaaatgtaatacggaattaataatatctttaaatgttttcttcaattgtgcttgggtttctcataaaatattttttacaggggttcaacagaaatatttggtggttacctgcaactatgaagctaggaaacttggagttaagaaacttatgaatgtcagagatgcaaaagaaaagtgtccacagttggtattagttaatggagaagacctgacccgctacagagaaatgtcttataaggttacaggtacaaatgataagcaatgtacttttagcattaatttttatgtaggatgcctgttcattacatgaattttttaataaatgtaaaataacataagtcaagatgctttttcctaataacttcttattttgggtcttgtcaactttaaaaattatgtgaaaggataactgtatgctatgaatagtatttttaagaagatgtatagttggaagtaattttaactcttattattgatgtttatataacagggaaaagtggaaaacaaagtttaaaagtgagaaaatgggaaactgtactgtaaaagatgccaggtctttaaaattttaagtttaaatgaattacgaagaaatatgttgttttctaatgcactaatgataattgaaagaggcttctgtaacatttgatcaacataattaaaaactgatttcttatgaaatattaataaaaatattggatatattaatattttcttaggttttatatatatactaaatattacaatgtagctaaactttcctatgctaaggtttgggtttaaatcttagtgttatagtaaattacaggaaaaatgaaaatgagtgtgcactggcacattgcaaatatagtaggttgatgcaaaagtaattgtggctttcacaattacttttaattgcgaaaaccgcaattacttaatatatagtgtaaaaatgtataatgatcagctttgcaattatttgtcttttttactttttttgtttttcttttatgatagcaattttcagatgactggattaaatgtctataatatacaaagacctcttagaaattaacaggaaaaataaacctaataacaaaggacaaaggatatgaataggcagttgacaagaagagcctaacccagtgtctaacaattatagggaaaaaatgctcaaattcattagtggccaaggaaatttgaattagtaagatattttatatctgtcatacttgcccaaaattaaaagcaatgtgagaaaaaagtatcaagaacacttactgagtttaaagatgaatgttcttcaatccagtgatatcattgctgggagtttatcaaatagaaataaaatcataaggctgggtattgtggctcatacctgtaatcccagcacttttggagctgaggtaggaggattgcttgagcctagaagctcgaggctgtgagccgtgattgtgtcattgcattgcagcctgagtgcgcatgacagagtgagactcttgtctctaaaaaagaaagagaaccacaagtacataaagacatatgtacaacaatgtttatcatagcatggtttatgattgtcaaaagtatggaaggaaaaatgcccatcaagagaaatagccaaataaactaaaacatctgtataatggatattatatagccattaaaaagaattcattggtgcaatactatttgactgatggagatagggcttgttgagtgaataaaaggcaaggtacaaagtcatgtatcatgtttttccaaatgtgtaaaattatggcctaaatgcctcctctcatattcatcatatagatgaagaagagtaaatcattgttttgatttgcagttttccatgagtaaggttgagtattttttcatatatttttggtcatttatgtatttttttctgttaacgtattcacttgcacctgtttttaatttgggttgttcatctttttctaagtactaagtacctagtactttttgtgttaggtattttttgaaaaaagttactttatcaatttttctcacagtatttttctgagttgaagtaggcgcgtagccagttagtcctttactgtatttatctctgatctgtttataaccttattatttatttcatattttgatgctactgcatatatacctttcttcaaggtattttttttttctgtaattacagactcctcttttgggccctatataattatatgtttaataaatgtatcttgcttatgaagttgataccaagaaagaggttaacttcaggaatggaggctgggcatggtggcttatgcctgtaatcccaacactttgggaggctgtggtggggtatcatttgaggtcagtctgggcaatataacatagcaagaccctgtctctacaaaagttaaaaaaaaaaaaagttagctggtagcatgtgcctgcagtcccagaggccgaggtaggaggattgcttgggcccaggaggtcaaggctgtactgagctgtggtgtgctactccactccagcctgggcaacagtgagaccctgtctcattaaaactacagcaacaacaaaaaccttcagggacgggataattagggatttgtcctgtgacctaaaatcagtcaatatttagtgatccaccagcttcgtgcatgattctgtatttaacttgcttttctatttagtgcttaaagccttatcctttatttttcttatgtagtattcttttgataaactcttgttttctacatgttactttgcatatcaggtatatacttttgaaaataaattgccgaaattgatgaaggaaatgcaaaacaatcattttctttgattagacatattgtcagtctgtcctgaaaggaggtaatagttttctctaggtaatagttttctcaggagtgatttttggtgtttgccatgtcacattgttacctttattggtttcccctcacattgtcaatgttgacatcaacaaaacaaaaaagcacctttggtgtttgtgaaaaaacatgatctatgtggaatgagatagtccttttatttctgagcttcagattatatgaccttaagaatctatgcatttttgtatactaagagacttgcatttgttttctcttatccagctggtgtcagtagaaagtgattcagagggaagtgaaaaactttctcaatgattttaaagttattagtctcaatgttaatatatgaaaattgatagtttttttgaatttattttgaattttggttcagcttaatctagtaaacatttgacttgaggactagatattgtgctagacgctgggcatttgaatacctgtaagttgtggttcatctctgcctctctgtcctaaggaatattcttgggaatggctaataaaaataccacgttatagtatattttgaaagttgactgactttctgttttattcagtaataattggacattttaaatattattttgttttgcctcttttaaactcttggagaaaatatagctaaaatatactattacttgtttttaactttcctgagcagcctatagtttattctttgacacatttcttcaaggtcaccaatttactataagcattgatatttaatgtactacagatataaaaattataggtgtagaagattgagctagatatattgccatgaataactgccctaggaatgtcatttttagacttttttgaaaatattgcctttatacaagatgtggtacagaaaaaacgtcaattaactgagggctttattaaagatattatggaactatgaatgtatataaaacctttaacaataaatttgataaatttttaagcactagatagttaaatttatcctagttataacttcatttacatttgtgctccaatattatttcaatttagaattactggaagaatttagtccagttgttgagagacttggatttgatgaaaattttgtggatctaacagaaatggttgagaagagactacagcagctgcaaagtgatgaactttctgcggtgactgtgtcgggtcatgtatacaataatcagtgtgagtgggttcttattcattctacctactaaccaaaagtacatacatttcttaatgttcagtgagttcgctgtgtgattctgaaagattcatgacttttgttggaggtatagttatatttagtcagtaatctgtctaggacagctaaaattaggtgctgctattccataataagtgttaagattttgatgacatgtagctcaatgctctgtgcacttttcatttgcacagagcattgttcctgttcatctgcacagagcattcatctgtgcagagttttcgtctgacacagtgcattggttcccattttagaaagccatacccagctgggcacagtggagcgcccctgtagtcccagctgtttgggagactgagctgagaagattgcttgaacccaggagtttgagtccagcctaggcaacagagcaagatcccatctcttaaggaaacaaaaagccatacctctgtaggtcattcttaagttgtaagagttggcttcttaatatgctttttggaataattttttattattctaaaacaatctctaagcagagttttcaggtaggctagatttgcctttgatgtgtcttttacatgttcccttcgattcccctttgatgtgtgttttacatgttcacttcgattcccctgagaccctcatgttgctctctgaattcccaagttagcacttttggaatgttgtccagggctatctgccatgtgctagaatcttctccaagctcctatttaatctgttcaaataatctttgtcaaagttagcaagaaagcagaatggtttgtctccttcatatattgagatatgaatgactgatggtgtttccagtgatatttacatttgaaaataagctgcagtaagcaccagtgaatatctgattaggctttcagacatcttatgactctgctggtgactcccctatcataccacatacaagacaaggtactctgctgttgtgtaagacttgtctgacccttttgctcttaagcctccccatgcatttcctcttatcctcttttttgagaactagacatcggtctacagaatagttctccacagaagaaaagcagtagaaccacagtttctagaatacatggagcttttcctgtatcttttgtacttgtgctcatttgtaacttaaaagggctaactagcaagaatatttcaaatatatttctgtataatttttaaggcaaacttggattttattggttagagtacattatagagagctaggttttatatcccaaaaagggaaatgtggaattattgattaattcttcctctttcatacagattttattaaaattttttgtaaacctacagaaaagttgacagaatagtacaaaaaatacccattatgtcttttctttttttttttttttttttgagacagagtctcactctgtcgcccaggccggagtgcagtgatgtgatctcggctcactgcaacctccacctcctgggttcaagcaattctcctgcttcagcctcccgactagctgggactacaggcatgtgccactacacccggctaatttttttatttttagtagagacggggtttcaccatgttggccaggctggtcttgaactcctaatctcagatgatccgcttgccttggcctcccaaagtgctgggattataggcatgagccactactcctggcccattatgtcctttcttgtagataaaccagttgttatcgttttgccacatttgctttctcttgttctctctatggattgcttggttggttgatgagctatttggaagtaaattgcagacatcctgacatttcatctctaaatacttttagcgttagtctctttgaggttaggatggtttcatgtcattccaacactgttttacacctaaagcaaatttatttttatataattttcttacacttttcataaaagagctctaaaactgtgtacaggtcagagattgtttctagcagcatatactgctagtgcgtggttaagatttagatctttaaagtataatgttagctttcttgttatataataatacttctatgcctacttacgggtaaatatgagtaaaagttttgccaatgtcagtaggaatttttttatgagatcagttttcacaatgtgttaattattaagcactcccactacacagtcactatcacaggcccttggaatttgcttattgaatttgtttacagtattcctatgaagcatgaaagagattagtcaagtggataacagggtggcagtgatctcttagtccatttagtgttgctttaacagaatacctgagactgggtaatttataaagaaaaaaaggtttatttggttcatgattcttgtggctggaaaagtcaaggttaggcctctggtgagggcctcaggctgtttccactcatggtggaaggcaaaagggagccagtgtgtgcagagatcacatggtgagagaggaagcaagggctgggggaggtgccaggctcttttaacaaccagctgtctttggaactaatacagtcagaaacttacccctgagggagggctttaatctattcatgagggatccacccctgtgatcccaacacctcccatttgaccccacctccaacactggggatcaaattacaacatgaggtttggaggggacaaatatcacaaccataccaggtgatgatggtggtggttgtggtggtggtggttgttggatatagactaagccctctaccttttaaaaattattttgtgaaaaagaaaaaggtttttcttgtgactttgaatgacatttgttgtttttaaagctataaacctgcttgacgtcttgcacatcagactacttgttggatctcagattgcagcagagatgcgggaagccatgtataatcagttggggctcactggctgtgctggagtggcttctaataaactgttggcaaaattagtttctggtgtctttaaaccaaatcaacaaacagtcttattacctgaaagttgtcaacatcttattcatagtttgaatcacataaaggaaatacctggtaagacaaatatatttgaaaagtacatatacgtcttattttatttcttttaatttaaaaaattatagatacaatgtaattaattcttaggtagagttgtctgtgagtttgtgtgcatgtgtgtgtgtgtgtatacttggttcctggaaaaaactaagaaaaactgtaatgttttctcaagcaaatttggattaagaaatatgtgaaggtacttttcttattttatctacttttgtatggttagaatatggtcatgaaagttatagcctagaaacatatggtcctttatttccagtccctgggtcatactcttatactgtacattgcctctagagaggggagttcgtcttttactaactcttttgggattacatataaaatattaaggctacaatggactttccaaaacatctaggccaaggtcctcattttaaagattaggaaactgatttccatgaggagttcggtgacctatttaggtcatggggcaagtttgtatctttgaagattaaatacccaagtttttataggccatcaatatgttgaactacatttctgtggtattgctagggaataagatgttataaaagagttctgtggaagtgaatttctaataccactgaaacttagatgtcatacttcacatttttaactgatacttgcgtgattccaaaatgtattatacactgccttgccttccttagtatagtataactataatttgaagttttttggatgactttggtagtgcattctgaagaacaatgtcaggttgtaataaactgaggactatatactggtgcaaaacattcttacttggctttactttcgagttcttgtatcttttttttttttttttaacaggctttctcctttctcacttattgccaaattgccaaccttcttttttttctgctgtgaaaaatctgtcactctactttaatagttccccctacatagccatctcctccaacttactgcttttactgtgcaagaaaaccagataactgtggaattactgtttttgaatgaaaagaataaggagacattaaatagcctgttttctcttgtgaataaagtatgaccgaattttagtgcaagaactttgtgacagttttgctagcaagattttttgtttgtttgctttctggctcatagttgtattctggatggtaaatgttagatatgacttatggataaatgtgtggtggtgcgtataggaatcagttaggttacctaatatgtacacttaatttattttaattgctctagtggcagcctttttgtatattaataataatcatgatttctgaatatttctggaatattacataacaggtggtaaaatttttgttttagtaagacagcatttattggctgtctctgtattcattttattttactgcattttgtgaggacttcaaagaggtgcatataattcaggagccctgagtggaagaacagcaacctagtttgcaatggggtttgatctttgcaaaatacagtagtcccccattatctgcagtttcacttttcacagtttctattacctgcagtcaactgtggtctgaaaataataagatattttgagagagagaggcagagaccacattcacataacttgtatattgtatattgttatagttctgttttattattattgttaatctcttactgtgcctaatttataaattaaactttatcataggtatatatgtaatgggaaaaacagtactgtatatatagggtttgatactgtccatggtttcaggcatccactgaaggtcttagaatgtatcccctgtggataaggggggactactgtataaattatagaacttaaagataagattgatatatttataatattttaattagctttgttttaaggagaaaagctattttaacattgtatgcatttctttttatttaggtattggctataaaactgccaaatgtcttgaagcactgggtatcaatagtgtgcgtgatctccaaaccttttcacccaaaattttagaaaaagaattaggaatttcagttgctcagcgtatccaaaagctcagttttggagaggataactcccctgtgatactctcaggaccacctcaggtacatgatgatacttattttaattaagtactggttatcacattatttgagataaagatttctagttttagtaccatgttcttactattctagtttgcttagtatgtgatccctttcctattagaaggctgatttattattaatagattggattaataagtattcttaaatggaatcttaagcattgatattttgatatcttaagttagctactatgattgaagacagtgcaacttaattttaatagcctataatgcatatatgaggcaaaatattttaatctgttaaaaatcttgttttcagagtagtccagtgatttagcaaatgggaaaggtataatcacccagttaacattgactgatttttttgctatgggacaagcactttactgagtgctttaaatatgttagtccatttaatcttcacaacaaagcatcaaggtaggtagtactgttgtttgtccattccttcttacttctcttctttccttccttccttccattctctctctctcaagatgaggataccgtactttagaaaggttaaataacttgtccaaggataaacttagattcaagtcctaggtgattaagaactcttgccataatcatacaataaagcttggagttggtactagagctttagagttttcataactttgaattattttatattaactgttttatattaactgttaatacagtaatattttatattaactttctagtgagtacaatagcttgcagataaaaaactgttaatataaaagtgaactaaatggctcaaactaaggacaagaggtaagttagtgaagaatgtattgaatatttatttgactgtacactgataataattagatatagttatttgagtttgtgctaatccttatttatgcttctttgatagtcctttagtgaagaagattcatttaaaaaatgttcatctgaagttgaagctaaaaataagattgaagaactacttgctagtcttttaaacaggtgattttcaatccattttgccaagtcatcctatgtattcattctatatacggtatgtggaaagaatatttgatgttccatcttggaactgacagattatctggagactaaacaatgtaaaaataatttatcatgggatttctctgctttataaactgttgtaaagatggtaatagggggtcttacctaaattgaattcattggtcttaattctgttaacactgtggttatgctatggatctaaagctgcagatagttacctaaaggggttttatggatatttctaacatttctagacttattctggtcttcaggtgagaagaagaagttttaatttttccctgtggcaattgcaaagcctctgccctcaacctaatagttagttgcatttcattaagttagtaccatgctaaatacaaatacatgcgaaatacaaaacccgtgaaattaaccatttatctgtgcctctgctaatagttacttgcatttcattaagaagaaaaaaatgcaaagaggaataatactgtcataattctaaaactcctgatacaggaacaactatataaatttgtgattgttgaggataggaaattattaaagtaacagtgatggaagaagcagaagaacccttgtatctcttttgcctcagactgtaaaataaaatggagtcgaaggaaagaatggctagctggcgctgtgtgtgagtagggtgagtgactgcaggtgtgtgcagggtttctgatctgtatgtaaagagtatcaactggggttataaatatatgagtagtacaagataaactgaaaaggaaatttaattttgtggtgctccttgtcattatacatgtatttctcaatattccatattccacagatgagtattatctgttttcgtcccatttctttgtttctcctcttcttgttagaaatttctcaaattgtggtttcagggctctaacagtttagagtaggtgtgcttctctaatgattctaggaggactaactgtatttagagaaaatggtttttggttggttctaagtctgagaaaactgaagaagtgaaatttcctccaactttgctgtcgtgtgcaatgtggcactcaaatgtcttgagcagagccatgcagctcattgttggctgcatgcagctggggctggctgtatgactggcctcccgtgatatgactcaggctgggcctgcgagtatgctagtgaaactgggtcatttgcttcagctaaatagaagactaccctgaaatgcctaacctttggagacagttcttcacatagaaaaaccacaagaagtataagttttacaggttctcttatttgaagagtcaacccagaagtgagaccaggtgctctaaacctgtgacatacaaaacctgtgaaattaaccatttgtctgtatctctgcttcccggctccttttctcccacaccacgggcccttatttcagtgactgaattataacaccatctaagtgacttgcaaaaaaaaaaattacaggagtgtgtgtgtgtgtgtgtgtgtgtgtgtgtgtgtatttgtgtataattagttttgttttctctagagtatgttatgattaatactataggtatgtaagaaatgtaaaaccgtattatttttaatccatcctctaggcactagtttaagattgcttacgatacagcctttttctaatgtgtcttaattagcatatcatactctttgaattgcataattaatataacacgtttaactggaagatatttaaactagtaaccatttaaggtattttatcctagttaagcagccatcgagaagttttgtcacaaagcagtaagagatagaaaaaattatttactacagaactatttaattttttatgtttttgcgatagggtcttgctctgtcacccaggctggatggcagtagtgcagttagggctcactgcagcctcagcctcctgggctcaagcaatcctcccacctcaaccgccagaatagctgggaaggcacctgccatcaagcctagctaatttttaaatttttgtagatgaggtcttgctatgttgcccaggctggtcttgaactcctgggctcaagtgatcctcccacctcaacttcccaaagtgttgggattacaggtacgaggcaccgtgcctggcccagaactatttttttcagatcagaatcttcaagttgagtgtgtttaacaatgtgcaatacttgcattttatgtttgagatttggttttatatgcattgccatgtgtataaaaagggaaatgttatcctttaatgacattttttccagtactacttaagtgaatttgtcatatcactaaaacctttgtttcaacaccaaaaccaagacatttgcatgaaactcttctaaaaaatgcatgtactcatattgtatattaattatatactaaatatagtatatgctcttttaagatattgctctaataagctatcatataatggtaatagtgattactctttaacaaaagtaatgtcattttgtaaaaaaaaatcttttttttggtaatctcgtaagaaaaaagtttgaaaaaagttcttttgttatttttcacttatttgcttttgtcagtgaatgattcagtttcttaaatttcctgctgattttaatttgttgccttttggttaggtgtgttggcttacgtctgtaatcccagcattttgggaggctgaggtggggggatcacctgaggtcaggagttcgagaccagcctggccaacatggcaaaaccacctctctactaaaaatacaaaaattagccaggtgtggtcacacatgcctgtagtcccagctactcaggaggctgaggcaggagaattgcttgaacctgggaggtgaaggttgcagtgagctgagattgtgccaccacattccagcctgggcaacagagtgagactccatctcaaaaaaaaaaaaattggttgcttttagttttgttttggatctgtattataaaacagtttgttatgattgtatcttatatctcttctatttctgacagcactcaattctgagtgaggcctgagagcttgacatctaaacattcagagttttagtgcatagactttgtgatgattatttggatactcagggacctttattgcttactattttgttatctgctatatgtataattgtcatatttaacaaaatctggcacctttagataaatgagatgttacataatttaaaaaggtaatacttttctaattccttatttccactttctctttatttttagagtatgccaagatggaaggaagcctcatacagtgagattaataatccgtcggtattcctctgagaagcactatggtcgtgagagtcgtcagtgccctattccttcacatgtaattcagaaattagggacaggtatggactagttttccaacagtttcattagcaggttgaactcttaaataagccaactttgaatgagaaatatgctccaaaaatggagggtcttcacagggaattagcaagcaattaaatgcttttattctatcaggaattttcactggaaaactttgttgtttgtttatttatttatttattttttgagacagggtcttgctctgcaccaaggctgaagtgcagtggtgctgtgatagctcactgcagcctttgtctcccaggctcaaacaattcttctgccccagcctcccgagtagctgggacagtaggtgcatgctaccagacctggctaacttttttgatatttaggatagacagggtctcaaactcctgagctcaagcaatccttctgcctcagcctccgaaagtgctgggattatgggcatgagctactgcacctggccttgtttttaaatagataattaagtaaagagtcatttaagaatgttttccaagttcaaagagaacaaaactgtgataactgtatagcatgagataacttctttatgggcatttagattgtttccattttgaagaacatttaaatgcaagtcattggatgggcatatgcatatgttttcatttatcttgggtagatttcaaagagtggaattgctggatcatatggtaacatgaactgtttaagaagctgccaacttttttccaaagtttgtgtattaatttacattttcatcaacaatatttgaaggttccagtttttcatattttcgccaatatttgtattatcagtctctttgattatagttgttctagcggtatatagtagtgtggtttttcttttatggatagtgtttttggtgttatatgtaaaaattctttgcctaactcaaaggtcacagatatttttttctgttttctgttagaagttttatagtttttaagctttatgtttaggtccattttgagttaatttttttatgtgtggtatacggtaagggtcttcattctttgctttgcatgtgggtatccagttgttcctgcatcatttgttgaagactattctccacccactgaattaccatgacatctttgtcaaaaattaattgaccataaatataagagtttatttcctgactttcttgtttcattggtctatatgtttatccttaacactgattccaccctgtggtggtctctgctgctctgtttatttttctgtagtctttttttttttccgttttttcttacaaagtggataatttgtattgagctgcctgtaagttctctgattcatctgtcatctcataaccgctgttgcccctgtagtgatttgttggttttggttactgtactttttaactctagaatttctgtttgtcttttgtttatatgtttggttttgtttctttatcaagattctcctttttttgtagtcattatattttactttaattctttaaacatggttgtctttaattctttggacatatctataataatgaatttgaagtctttgctaagttcacctcaaagtcaatttatgttaactgcttttcctcccaaatatgtatcacactttcctgtttctttgcatgttttgaactattttattgaaaactgaacctcatagataatgtattgtagcaactctggatttacaattttttcttgtagggttttttcttttttgtttcctgtacttctttttaggtaacttgtctgaacgtaatctgcagaatttacctcccctgtgctgtgtagccactgatttctctgctcaagtgttttttttttttttttccattcaaatttttattttaatactggcttctgggaagttgcccatgtctgtatagtttcatggttagccagtgattggcaaaggttttgctcaaacactagagtctggaagccgtctacctctgccagtggataagtgtatgggttggagagggcttaaaaaatttaggccattttcccatactgcccaaagtaatttataggttcaatgccatccccatcaagctaccactaactttcttcacagaattggaaaaaaatactttaaattgcatatggaaccaaaaatgagcccctatagccaagacaatcctaaataaaaagaacaaagctggaggcatcatgctacctgacttcaaactatactacaaggctacagtaaccaaaacagcatggtactggcagaaaaacagagatacagaacaatggaacagaacagaggcctcagaaataacaccacacatctacaaccatctgatctttgacagacctgacagaaacaagcaatggggaaaggattccctatataataaatggtgctaggaaaactggctagccatatgtagaaagttgaaactggatcccttccttacaccttatacaaaagttaactcaagatggattaaagacttaaatgttagaactgaaatcataaaaaccctagaagaaaacctaggcaatagcatttagtacataagcatgggcaaagacctcatgactaaaacaccaaaagcaatggcaacaaaagccaaaattgacagatgggacctaattaaactaaagagcttctgcacagcaaaagaaactatcagcagagtgaacaggcaacctacagaatgggagaaaatttttgcaatctacccatctgacaaagggctaatatccagaatctacaaagaagttaaacaaatttacaagaaaaaagcaaacaaccccatcaaaaagtgggcaaaggatatgaacagacacttttcaaaagaagacatttatgctgccaacagacatatgaaaaaatgctcatcattgctggtcattagagaaatacaaatcaaaaccacaatgagataccagctcatgccagttagaatggcgatcattaaaaagtcaggaaacaacagatgctggagaggatgtggagaaataggaacacttttacactgttggtgggagtgtaaattagttcaaccattgtggatgacagtgtggtgattcctcaaggatctagaactagaaataccatttgacccagtgatcccattactgggtatatacccaaaagattataaatcatgctactataaagacacatgcacgcgtatgtttattgtggcactattcacaatagcaaagacttggaaccaacccaaatgtccatcagtaatagactggataaagaaaacgtgtcacatatacatcatggaatactatgcagccataaaaaaggatgagttcatgtcctttgcaaggacatggatgaagctggaaaccatcattctcagcaaactatcaccaggatagaaaaccacacaccacatgttctcactcataagtgggagttgaacaacgaggacacatggacacagggaggagaacatcacacaccggggcctatctggatggagggctgagggagggatagcattaggagaaatacctaatgtaaatgaagagttgataggtgtagcaaactaacacggtacatgtatacctatgtaacaaatctgcacattgtgcacatgaaccccagaacttaaagtataaaagaaaaaaaattaggccattttcaagtttttcttgaattttaatttctgctaggccctctttatctccccatgatgtgcatgtagccctttcagtaaggagtgtatggggagcttgggccctctgtggccttccatttatttgcatgtagcctcctagtcaactagggttgtacggggagcctatgtagtccctctttggttctctcatttccaaatctcctggtgacatatctggctggtccactgatctgtccttcacccgaaccacgactgaagcttcagactagcagagctgtgggatcttcccattcgtttcctatcaaatttgctcattttactggcaacactgctgagtgtgggcttttgcccactgcctcaaatcaggtctgtcccctctggaagtgaaactgctggcttttgcagccttcaccctgtaccaactgagctatgtaaagggacattcgaacagtcccagacagtgaagctgctatctcctactttcttagctaacatatagcagctgttcatagatcagtacttctcactttgtttgcctttggttcatttccagatttccaccaaaatgattgtttttgacaatgttgttcagttttatagtagctttttgagagaggattttctgaccatatcagtgtagtataaccagaaatcccatatttcaaatcttttgaaaatttttaaccatttagtattaatattgaaatgtcttaatttggtatataatgtcaagatgcccagtgatatttaggattttaatttcttaatctcagcaatataaaatatattatgctcttaatattaattataatgtttattcttaaacattttatttaggaaattatgatgtgatgaccccaatggttgatatacttatgaaactttttcgaaatatggtgaatgtgaagatgccatttcaccttacccttctaagtgtgtgcttctgcaaccttaaagcactaaatactgctaagaaagggcttattgattattatttaatgccatcattatcaactacttcacgctctggcaagcacagttttgtaagtacactcttttttgttcagttttctaagtatactcttatgggatttgtgtggttacattacaaatctaagtgcttgtctttttgatatagtttagagattcttttgggtgatattgtttaggtgattaacttgtttataatacctatcttatggtttctggccttaaatatgctgtgatctaagaagaaaacataagcatcactggataaaagagagaaccattatggaggttctctattttggaattgttaacacattttatagtatataaaaatatgatggattagctcataagtattaaaatatttgcagatattagaaatcacatctttttgtcttttagctgacacatgagctactagtacctttcccatgattcttttgttaaagtatttacattttcttcattttgaaatagtattgaattttgatagcaatattgatagatttgactactgatttcatagttgtaaagttaacagtgtggcaatagaaaggcagaggccagtcacattttcagacgactaaaacaaaacccttttattaatagacaaaccactatttagtaaatgtgggttgccttaaaaacaattattttttactaaattgttcatgcctataattaactcaatttaaaatacttttgtgtttgtttagtcagtataattttagtaaccttttcattttcatttaagtttaaagtgagaacaggatagtgtatggaaatagtgaattaatgctctcttcaaattacttttttctgtgacccttcttattccatttattaaatttaaaaaagtgttttctttttacattttaattaatctgtgaaattggaattaaaagtgctcatttatagtggcattagaaaagtaaatataagtgaaagtaccttgtatgtatttgtcacacagtaggtagtcaataaatataagggcctgaatcttttctactacttttacttttttggagttcatattgtgttgatgtttacggagttatatttgactatgtttatatttttatggtgcttgaaactaaaggatttaaatgaaaaactgtatagaaaaattatgcaagttagagttgaaagtgtctttaaatttttattttatataaatataaactagtactatatcttgatgatgttgggttttgttataggctttttttttctttttgttaaaagttaccctttagaatagtaatttttggaaaactagcccttgatgctatatgtgtatgtttttttgaaaaatacccttaggtgaacttgcttttctaggccgccattcttttatttatagaattgaaagtttggttgcatgattgttacaatcttcccaggtctccaaatgcatatttacctctgtctcagtgctatctaggaaggaaacctcttcctggaatagtgggtagagattcacaaaatagtgtgaataattgtggtagtagatctctagttgtttggaactggccacaaagagttgtatttgttgagtaggttagaaacatgtcagataatagctacaggcacacagcagcagcagcgatatttaaaagatatcagatatgtaaattagtctgttattcttgtgttctagaaaatgaaagacactcatatggaagattttcccaaagacaaagaaacaaaccgggatttcctaccaagtggaagaattgaaagtacaagaactagggagtctccactagataccacaaatttttctaaagaaaaagacattaatgaattcccactctgttcacttcctgaaggtgttgaccaagaagtcttcaagcagcttccagtagatattcaagaagaaatcctttctggaaaatctagggaaaaatttcaagggaaaggaagtgtgagttgtccattacatgcctctagaggagtattatctttcttttctaaaaaacaaatgcaagatattcccataaatcctagagatcatttatccagtagcaaacaggtatcctctgtatctccttgtgaaccgggaacatcaggctttaatagcagtagttcttcttacatgtctagccaaaaggattattcatattatttagataatagattaaaagatgaacgaataagtcaaggacctaaagaacctcaaggattccactttacaaattcaaaccctgctgtgtctgcttttcattcatttccaaacttgcagagtgagcaacttttctccagaaaccacactacagatagccataagcaaacagtagcaacagactctcatgaaggacttacagaaaatagagagccagattctgttgatgagaaaattactttcccttctgacattgatcctcaagttttctatgaactaccagaagcagtacaaaaggaactgctggcagagtggaagagagcaggatcagatttccacattggacataaataagcatattcagcaaaaaggtctgaaaagcaagggaataccattattttcggattagcggtttattaagctcttctatattaaacactaatagatattcaataacggagtaaactgttccagataaagcaagaatagttgcaagaagtaaattctggcacaaagcgtaaaaatataacagaagaaataatgtaaaatactatcttttatgtctaaagccattttatattacttttcaataaaaagaatatcatggtcaacatagaatatttttcatgaattggtggggagatgtatatgtttatatataaaaaatagccaaatcgttgcaatgatatggtaaaggacacattttttttttttttttcctgtgaaatgtggaatatctcaaattcagcctcttaggctgaatagcaaatcctactgccaactaacctattaaaaatatagatagttttgactaaagtactacattacatttagtatgttgacttttaaaataccaaagcaatttatattcaattaatgcttcttcatacaccaagaatctaccacaatacacagcacacaaaggccgttcaataaacattgaatgaatgaatggtttggctagggccagggtggggagttaaagtgagaggagggtatatgttatagagaacagtggtagaaggaactctccgtgcaagtaaattaagggaaagatggacaccagaaaggcaaggtgatgggcctataagcatactggataatggaagaagtccatttctttctagctagtttgaagggcctaaaagcactgagatgtttttgtatcttccctacatttggagatgatattaggttgtcataacaaccacaaatatagaccattactaaattggtggatgtcctctttctcccattgttattgccttcctcttttgcctgctaaactaaaaattggatataagattgagaatgtattatataatttgcaagacatagaggatgtttatagaatatactaaagtatccctcagcaccaatatgggagtatcctggtctcaagtttataatttttgcacatataatctaaagaagagactttaaaaataaagtacacaaatatgaaccaaagagtagcttaaaaatactttcttctaggtctgaaattttcttttctttctttttttgttttggagacagagtctcactctgtcgcccagggtggagtacagtggcgcaatcccagctcactacaacctccgcctcccaggttcaagcaattctcctgcctcagcctcctgagtagctgggattacacgcatgccctaccacacccagcaaatttttgtatttttagtagagatgacatttcaccatattggccaggctggtctcgaactcctggtctcaggtgatcctccaccttggcctcccaaagtgctgggattacaggtgtgagccattgctcctggccccagctctgaaattttaacttagttttggattccttggaatttgaaaatatgctaacacgaaggattgtaaataggtagtttgaggttatcaggaacagtaacttgaagcaagaacatcagaaattgttcaccatgcaaatatttagtactctgaatcaaggaacatagtattttttacatgagtattccagtaaggtaattaaacttatgaaaagggtatataactttttgtaaatcattaaaacattttatagtccttgtaatgatttcaggaccttggacagctagaaggggcttaagaaaaaatggctaagaaaacaaagtaaatggttttggccagcttaaaaagagaaagcaaaatagttaaaaatacatttcatagattgagaatgtacgggctatgtcacagttacgctacttattttgtggttttaagttagtctcaacatctttgggcctcagaatcaacttttttatgggatcttttttctctgtttttaagattatctcttttttctttggtgctttgcaggtttactgtattatttggaagtgcgaatttatttttattcttagtatatactggcttcttcctgtatcttttaattcatgttctgtaaaattctcaaccactagctcttcaaatatttcttctctattctaggactgtatacaaatgatagactttcttactgtatccttcatgtctcttaatttctcatatttttcatcctcttgtttctctttactgcattttgggtaatttcatcagctctatctttctgtttactagttcatttttcagtagcatctcacctgctatttaaaacaatgatggttttaatttcaataaatatatttttcatttgattctttttaacttcccgtttactcattacagtcccttgtaagtctgtttctaatttttaaaagtcaaatatatgatatttttgataatttcaatattttaagtctttataagtctacatttaaggttattattgcatatcattgtgacttatttccttgagtatgtgttaatctgcgagaagacagagggcctaaattgtgtatgttttccttcagtatgatttgagttcgttgcttctctgggtgaggtggtacaaactccttggcatactctattcacctttgtggatcctgattgaatgccttgtcttaagtgtaagctccctgacccttactactagccgaaggttttgtctctgcaggtcaattccaaactaacaggcagatgctgttagctatctgcctccagggataaaccccatctttcaagcttgcttcttgcttgatgctttctgctgctttcttgcttttgtttcagctcgagtttgttgttgttttttttttttcctgtttctgtcttgaatgtagagggtatttttatttttattttttctgtttctctcttgagtgtatagtgtagagggggtttctgtcttgagtgtaggcctggagatttcccttatatggtacaaaccagcaatgaattaagaggtctcttttctccaagatctagtgttttgtactaggagaactctaaaaagtatctattccactgtagtgccaaagtacaaatttatttggatttattttttgccatcttattttttaatatatttctttttctatgttgtgcttctttcccacctttatctctcctcctatcttttgggatcagttgggttttctatttaatcatatattttccctttactgatttggaatgtgaatgttacaagtccttttgattatccttaaacatctaaaaatgctaccctctttccaaacaacacaaaggtattgaaataacattaattctaattaaattccacaagttctttattaaatctccaaattggatattattagtattttatatagtcaatgtttatttttttgatgggacatggtgggggcttaccttttttcttgtgtgtcagatgttccttctaggtagaattctttataccttctgaaattatgtccttagagctgtagatttagaactgacatctcttgagctgttctaagataatatcttttactttggagatacgcagtttttattatatgtctagctatagatttatcatggatttaggttcattatgaatctgcagatttgtgtcttccatcaaatctggattgttttcaatattaaaaaaacttctattttaaaatctgtatatagaaaggtacataaacataaatgaacatgttaatgagtaattgtaacaactatgtaactgtccaagtcaagaaataaaacatatcaagtaatcaagaagtccagagttttctttggggtttcattacgtaggcatgatttattaaaacctttactgtgtgcttgaacttaatctccagtttccctcctctgtctggacatcaggctggctcaaagtctcaacaccctaatcatggttgtttttttgaagtgagctacctccatcctaaatcatctttttagcattagctgtctagggcccactgtgggtcacatcattagcatacagtgtcagggcttaccatgaataatgaaggcacttctgttgtttaggaaattccatgggttttaggagcttggtgtccaggaaccctgaacgaagaccagaccaattatactacagaatcttttttttttttttttttttgagatggggtctcgctctgtcgcccaggttggagtgcaaaggtgtgatcttgactcactgcaacctccatctcctgggttcaagtgattctcctgcctcagcctcgagtagctgggattacaggcacctaccaccacacccagctaatttttgtatttttaatagagatggcatttcaccatgttggtcaggctgatcttgaactcctgacctcgtgatctgcccgcctcagcctcccaaagtgctgagatacaggtgtgagtcaccacccctggccctactacagaatcttttaaaataagttttgagatgtattatggccccaaagtgatctactttagtaaatataggtatgacttgactgacaatgtggttatgctcagataagcccattgtaaattgaaaatatcatgagtgaaatacatttaatacatctatgaaacatcatagcttagccaggcctacctcagacatactcagagcaactcacgttggcctacagttgggcaaagtagtgtaacacaaagcctgttgacagagcctgggccgggcgtggtggctcatgcttgtaatcctagcactttgggaggccgaggctggtggattgcctaagctcaggagttcgagaccaacctgggcaacatggtgaaaccctgtctctaccaaaatacaaaaagttgactgggcgtggtggtgcacgcctgtagtcccacctactggggaggctgagacaggagactcgcttgaacctgggaggtggaggttgcagtgaaccaagatcccaccattgcactccagcctgagtgacagagcaagactccatctcaaaacaaaacaaaaaaagcctgttttataataaaatgttgaatatctcatgtaagtatcatactgcatatcagtcaccgaatggaattaacagcagatactgctggagaaaaaattagtgcactagaagtcagagcaataaattattcagaaagaaacagagaaaaaataataaacacagcatctgtgagctatgagacaacttcaggcaggctaatacatgtcttattcaagtccccaaagaagagaagagggtgggagatgtaaaaaatatgtgaagaaacaatggagaaatttttccaaatttgaggttaactataaacccacaggtccaaagagcttggcaaatcccaggtacaataaacgtgaagaaaactataccaaggagtaacctaatcagagctcttaaaaccagtgataaacaccatcccttgaaaaagacatactattgcagaaaaacaagcaaagccaacaattttgaaaatattggaagccagaagacagtggtctgacatcctcaaataaagtaaagaagtgggggaaaagttggttaacttagatatcttaaaaaaaaaaggaaaataagaacataaggcatacatatgaaagaactcatgcccggtagacctacattacccataaaattagaggaagtccaacaggcaggaagagcacaccagatggaaatacagatctacacacagaaatgaggagcaccagaaatatgagtatatttaaaagctttttttgtttcttatttctaagtgtctttttaaaagttggctatataaaacaaaaataaaaattattaaaaatatattgtaggattacaatatatgtgggagtaaaatgtaacagtacaaaggccaggaggggaagtatataattttaagtatagaaatggtagtatattattgtaaggcccttaaactaaacatgaagtggtgggttacatcttgaagacagactgtgataagttagagatgtataatataaaccctaaaataaccactgaaatagcaaaataagttttaattaataagccagtaaagaagataagaaatagaataataaaaagccacaaaattcaatccccaaaaaaagcttaaaaggagagaaaagaggaataggacacatggggaaaatagaaaacaaatagtaggttggtacatttaagtcatatcaaaatcatgttaaatataaatgatctaaaaacctcaattaaagggcagagattatcagattgcatgaaaaagtaggacccaactgtctgctgtgtatataaaattttttaaaaaataaagacaaatatgttaaaagtaaaaattggataaaagacacgagtctaacattaatcaaaagaaagatgtaatagctttcaacaggaaaactgcttgttagagcaaaggaatttaatcagaaaatcatttcaaaatgataaacgagtcagttcatcaggagaatgcaatagtcctaaatgttaatgcatcctcaaaatacataaagcaaaagctgataaaactgcaaggggaaaaatatccacaattgtagttaagagatttgaggctgggtgtggtggctcacacctgtaatcccaacactttgggaggccagggtgggcagatcacaaggtcaggagttcgagaccagcctggccaatatactgaaaccccgtctctactaaaaataccaaaaagtagctgggcgtggtggcgggcacctgtaatcttagctactcgggaggctgacgcaggagaatcacttgaacctgggagatggaggttgcagtgagctgagattgtgccattgcactccagcccaggcaacagtgtgaaactcccatcacacacacacacacacaaagatttgaatacttttttctcaataattgctaaaatgaacatacaaaaaaaaatcagtaaggatacagaagacctgaacaattgacatttatacaaaagtccacacaacagcaaaacattttgttaaagtgcacacagaatacagatgttccctgacttacaatagttcaacttaaaaattttcaacttcataatggtgcaaaaacaatgtacattcaggagaaaccatacattggattttacattgtgatgctccttctgcttctttcaggtgctttctttctcagagttcatatgcatataataatcaatactcaactgaggacttaaggggtattttctgcagatttctgcagctatctgaattctgaactctagctgttcgtgcctccagactcccaggtccttaattcacagagactgctgggctctctctggcttctctcctccagggctgcaccctggaaacttcaggcagtaagctaaggcaattgtagggctcacctcatttgctgacttttcatttctgctattttgtttttattttacttttttaaaaagttcttccttattctctaaatgtttatttccatagcaccctgttcttgttcattttttctcagatacagtatcttctcatctctaaagatgtggtaaaacttccaaagatttccttatactgtatagtctctcttgaagttgcttttatttgtttaagaatgtgggactaaaaatatgactggaagctctgatagcttgggtaggacttgtcagctttgagttacatacaggatgatctggctaggccattgttgggggaactcctgatgtccgtatcattagatctttcctttggggctggttatgtttatcaaatatgatgattaaaatatcttacttagattatgaatgtctgtctgtctggctggctgtgttataggaacaatgtggggaaagggactagaaatctcagcattcaatatgtatactcatttaatcttcctgttcttagtatacttcctagattctcaactaaaccaaacattctctagttcagagaccatttgttttactgtcctctagaggagagtaaaaaaagagttttactcttttacaattctctagaaaaaaactccaaccttttgttggatttgaggagataatttctcaatgtttttagtctttaatttttgttggtacatagtaggtatgtatatttataggggtacatgagattctttgatacaggcatgcaatgcataataatcacatcatggtaaatggggtatccatcccctcaagcatttatcttttgtgtttacaaacaatcaacttataatcttttagtcatttaaaaatatacaattaaattattattaactataatcaccctgttgtgctatcaaatactaggtcttattcattctaattattttttgtacccattaactatccccacttctcccaacccacctccactacccttcccagcctctggtaaccatccttctactctatcttcacaagttcaattgttttaatttttagctcccacaaataagtgagaacatggaaagtttgtctttctgtgcctggctaatttcacttaacataacaacctccagttccatccatgttgttgcaaatgtttctcaattagttttcacccacttctccttaccaagtcccattagcatcacatcattgatgtggaattagccctgtgggttatcagcttgtggatgtccagtatttgtgaaagcaaaagtaatgatgtattgctatttgaattacagctgtgatatatagtcttgcatttaatggttccaatgtagacttaaaggtagaagctctcatggtaggacacctacatagtatacttggaggcatccccaagagcctagaatctgcccttcccacttttccaacaatgccctaagtacctaattagctgtaataaattcacccctttctgcctaaactacctagattgttctgcattattcctagaatgacagaatggtagaaaactcaattcttttaaaaatccgcttgcactttttcttacactgtctgtgttaaaactgtcatgttttattttaattactattttcaacaaagtcatttttattctatatgaggtaatacaaatatttgaattatttggtgggggactataattctttgtcttatttattatttctgctgactactcacatgctggcatttttcctcatgtgctctgtgattttggagtgtgtgttcatgtttgctagcctttatttgtggaactcctgcaaggtctggatgaggatgtgtcactccaggaaatatttgcacttgcttctgctggcacttggactattttgttaatttcttatcttgcaaattaaacctcaaatcttggcagactgcaggcatgcattctcagatgatacttccacctctctcccagttcatttttcttttttttttttttaattatactttaagttctagggtacatgtgcacaacatgcaggtttgttacatgtgtatacatgtgctgtgttgctttgctgcacccattaactagtcatttacattaggtatttctcctaatgctatccctcccccatccccccaccccacaatggccctggtgtgtgatgttccctgccctgtgtccaagtgttctcattgttcagttcccacctatgagtgacaacatgtggtgtttggttttctgtccttgcgacagtttgctgagaatgatggtttccagcttcatccacgtccctacaaaggacatgaactcatcctttttatggctgcatagtattccatggtatatatgtgacacattttcttaatccagtctatcattgatggacatttgggttggttccaagtttttgctatagtgagtagtgacacaataaacatacatgtgcgtgtgtctttatagtagcatgatgtataatcctttggatatatacccagtaatgggattgctgggtcaaatggtatttctagttctagatccttgaggaatcaccacactgtcatccacaatggttgaactaatttacactcccaccaacagtgtaaaagcgttcctatttctccacatcctctccagcatctgttgtttcctgactttttaatgatcgccattctaactggcgtgagatggtatctcattgtggttttgatttgcatttctctgatgaccagtgatgatgagcattttttcatatgtctgttgactgcataaatgtcttcttttgaaaagtgtctgttcatatcctttgcccactttttgatggggttgtttgcttttttcttgtaaatttgtttaacttctttgtagattctggatattagccctttgacagatgggtagattgcaaaaattttctcccattctgtaggttgcctgttcactctgctgatagtttcttttgctgtgcagaagctctttagtttaattagatcccatttgtcaattttggcttttgttgccattgcttttggtgttttagacatgaagtccttgcccatgcctatgtcctgaatgatattgcctaggttttcttctagggtttttacggttttaggtctaacatttaagtctttaatccatcttgaattaatttttgtataaggtgtaaggaagggatccagtttcagctttctacatatggctagccagttttctcagcaccattcattaaatagggaatcctttccccatttcttgtttttgtcagatttgtcaaagatcagatggttgtagatgtgtggtgttatttctgaggcctctgttctgttccattgttctgtatctctgtttttctgccagtaccatgctgttttggttactgtagccttgtagtgtagtttgaagtcaggtagcatgatgcctccagctttgttctttttgcttaggattgtcttggctgtgtgggctcttttttggttccatatgaactttaaagtgtttttttccaattctgtgaagaaagtcattggtagcttgatggggatggcattgaatctataaattacctttggcagtatggccattttcacgatattgattcttcctatccatgagcatggaatgttcttccatttgtttgtgtcctgttttatttcattgagcagtggtttgtagttcttgaagaggtccttcacatcccttgtaagttggattcctaggtattttattctctttgtagcaattgtgaatgggagttcactcatgatttgactctctgtttgtctgttattggtgtatatgaatgcttgtgatttttgcacattgattttgtgtcctgagactttgctgaagttgcttatcagcttaaggaggttttgggctgagacgatggggttttctaaatatacaatcatgtcatctgcaaacagggacaatttgacttcctcttttcctaattgaataccctgtatttctttttttttttaatttcttttttgaaacagagtctcgctctgtcacccaggctggagtgcagtggtgctatctctgctcactgcaaactctgcctcctgggttcacgccattctcctgcctcagcctcctgagtagctgggactacaggtgcctgccactacgcctggctaattttttgtatttttagtagatacggggtttcactgtgttactcaggatggtttcgatctcctgacctcatgatccgcccgcctcagcctcccaaagtgctgggattacaggcgtgagccaccgcacccagccccctttatttctttctcttgcctgattgccctggccagaacttccaacactatgttgaataggagtggtgagagagggcatccctgtcttgtgccagttttcaaagggaatgcttccagtttttgcccattcagtatgatattggctgtgggtctgtgctaaatagctcttattattttgagatacgtgccatcaatatctagtttattgagagttttttgcataaagggctgttgaattttgtcgaaggccttttctgcatctattgagataatcatgtggtttttgtcattggttctgtttatgtgatggattatgtttattgatttacgtatgttgagccagccttgtatcccagggatgaagcccacttgatcgtggtggataagtttttgatgtgctgctggattcggtttgccagtattttattgaggatttttgcatcaatgttcatcagggatattggtctaaaattctcttttttgtgtgtgtctctgctagcctttggtatcaggatgatgctggccccctaaaatgagttagggaggattctctctttttctgttatttggaatagtttctgaaggaatggtaccagctcctctttgtacctctggtagaattcggctgtgaattcatctgttcctggactttttttggttggtaggctattaattgttgcctcaatttcagagcctgttattggtctattcagcaattcaacttcttcctgatttagtcttgggaggatgtatgtgtccaggaatttatccatttcttctagattttctagtttatttgtgtagaggtgtttatagtattctctgatggtagtttgtatttctatgggatcggtagtgatatcccctttatcattttttattgcatctatttgattcttctctcttttcatctttattagtcttgctagcagtctagctagcaagaaaagatcaacaaaattgatcttctcaaaaaaccagctcctggattcattgattttttgaagggttttttgtgtctctatctccttcagttctgctctcatcttagttatttcttgccttctgctagcttttgaatttgtttgctcttgcttctctagttcttttaattgtgatgttagggtgtcaattttagatctttcctgctttctcttgtgggcatttagtgatataaatttccctctatagacacactgctttaaatatgtcccagagattctggtacattgtgtctttgtttcaaagaacatctttatttctgacttcatttcgctatgtacctagtagtcattcaggagcaggttgttcagtttcctggtagttgtgcggttttgagtgagtttcttaatcctgagttctaatttgattgcactgtggtctgagagacagtttgttgtgacttctgttcttttacgtttgctgaggagtgctttacctccaactatgtggtcagttttggaataagtgcgatgtggtgctgagaagaatgtatattctgttgatttggggtggagagttctgtagatgtttattaggtctgcttggtgcagagttgagttcaagtcctggatatccttgttaaccttctgtctcgttgatctgtctaatattgacagtggggtgttaaagtctcccattattattgtgtgggagtctaagtctctttgtagatcactaaggacttgctttatgaatctgggtgctcctgtattgggtgcatatatatttaggatagttagctcttcttgttgaattgatccctttaccattatataatggccttgtctcttttgatttttgttggtttaaagtctgttttatcagagactaggatttcaacccctgtttttttttttgcttaccatttacttggtagattttcctccatccctttattttgagcttatgtgtgtctctgcacgtgagatgggtctcctcaatacagcacaccaatgggtcttgactctttatccaatttgccagtctatgtcttttaattggggcatttagccatttccatttaaggttaatattgttatgtgtgaatttgatcctgttattatgatgttagctggttattttgcccgttagttgatgcagtttcttcctagcctcgatggtctttacaatttggcatgtttttgcagtggctggtaccggttgttcctttccatgtttagtgcttccttcaggagctcttgtaaggcaggcctggtggtgacaacatctctcagcatttgcttgtctgtaaaggattttatttctccttcacttatgaagcttactttgactggatatgaaattgtgggttggaaattcttttctttaagaatgttgaatattggctcccactctcttctggcttgtacaatttctgccgagcgatccgctgttagtctgatgggcttccctttgtgggtaacccgagctttctctctggctgcccttaacattttttccttcatttaaactttggtgaatctgacaattatgtgtcttggggttgctcttctcgaggagtatctttgtgggttctctgtatttcctgaatttgaatgttggtctgccttgctaggttgtagaagttctcctggataatatcctgaagagtgttttccagctgggtttcattctcctcgtcactttcaagtacaccaatcaaatgtagatttggtcttttcacatagtcccatatttcttgagggctttgtttattgcttttaactcttttttctctatacttttcttttcacttcatttctttcatttgatcttcaatcactgataccctttcttccagttgatcgaatcggctactgaagcttgtgcatgcatcacgtagttcttgtgccatggttttcagctccttcaggtaatttaaggtcttctctacactgtttattctagttagccattcgtctaatcttttttcaaggtttttagcttccttgcaatgggtttgaacatcctcctttagctcctagaaatttgttattaccaactttctgaagcctacttctgtcaactcgtcaaagtcattctccctccagctttgttccattgctggcaaggagctgtgatactttggaggagaaagggtgctctggattttaaaattttcagcttttctgctctggtttctccccatctttgtggtttaatctacctttggtctttgataatcgtgacctacagatggggttttggtgtggatgtctttcttgttgatgttggtgctattcctttctgtttgttagttttccttctaacagtcagatccctcagctgcacgtctgttggagtttgctgggggtccactccagaccctgttttcctgggtatcaccagcggaggctgcagaaaagcaaatattgctgcctgatccttcctctggaagctttgtctcagaggggcacccggctgtatgaggtgtcagttggcccctactgggaggtgtctccaagttaggctacgtgggtgtcagggaagaggcagtcagtccactctcagagctcaaacaccgtgctgggagatgtcccatgtcttcagagctgtcagacagggatgtttaagtctgcagaagtttctgctgcctttagttcagctatgccctgccctcagagatggagtctacagaggcaggcaggcctcattgagctgcggtgggctccacccagtttgagcttccaggttactttgtttacgcagtcaagcctcagcaatggtggatgcccctcccccagcgaggcatgccaagccacctcgcagttccatctcggactgctgcactagcagtgagcaaggctccatgggcatgggacctgctgagccttgcctgggatataatctcctggtgcgccgtttgctaagaccattggaaaactgcaatatttgagtgggagtgtcccgtttttccagatacagtctgtcagggcttcccttggctaggaaagggaaattccccggccccttgtgcttcccaggtgaggtgatgccccaccctgtttcggcttggcatccgtgggctgcacccactgtccaaccagtcccagtgagatgaaccaggtacctcagttggaaatgcggaaatcacccgtcttctgcatcagtcacactaggaactgcaaaccagagctgttcctattcagccatcttgtagcggacccctgttttcttttatttttatggttggattatttttttctagttcgctgttttactgagaagatagtccttcaaggttcctgagctgtcacattctagttactcaccttctgtgggtccaaagtcttatctcctatcttcaaacttagatttaatcattttttgttttcttatttgcagactaccaccacttgtaaataagttataaggatagtgtggaattctctcttatcctgttacctcacagtattacctactattttttttttttctgggagaaaggtatgctctgcatttcagccttgttttataaaattgattcatgttaacaattttagttcacaaagagtgttacacttttgatacatagtggtcaggttctcacaatttggtgatatttgggtgtccgccctttcttttctaagttgtatttattatatattagatatactaaagtcctcaaatattgaaaaaatcttttaaaaatatgttaaaagcttttgagaaaactataagctttttttcaaatgtattagtcaggaaaatggaactggtgtacatattttaagtaagaaggaatttagtgtagtgaattaaatgcttacaaaataattgagaagctgaaggagtgagttctaggtttggccgccagaaatgaatctgagaactatacagaatcaaccaccagataagctctttttattaaaaaaaagtagagatgggatctcgttatgttgcccaggctggtctcgaatgcctggcctcaagtgatcctcctgcctttgcttcctgaagtgctaggaaggattacaggcatgagccactgtgcccagtctagctatttcttttggatctgttgtagaactatgaattgaagaaagtgaaatcagtatgctgccaccctgccacttcttcttgaaatctggaaagctggagaagttactgacaattgtaacccagtgataaggaaccaggaattgagaagctgctgttgcctctgttgttgatgcatctacctcttggcacacaagagtctggtagttggacactggaacacagaaaagaagactcacatatccttgtttttgctagccatcagaaatggcaataaaataataataataatgaagaaacatggcttctgcttcactaagaaagtactattgaattactattgaaattactattgaattttaaaaagtggtcagtatagtatatttgtgtcatagtggtcattcctttttgtttcaaattaccaacttgtattctaataaagtttagccaatagttgatttatctaaaccaaacctatgtagatacatgtatactgagacagaacaatttgtgatgttgacagaagaatatttcatctatttaggcttagccagactatagtgttctacttcaattgtcatcaacttttttgatataacaccctagcagtgaaaaaaacttgggaggtacacactcacagaatctgtatatttactaaagatgcaccaaagtttaggtttagccttagtatgcacttccttggtgtttgggtggccgaataatcaaataactacatcagcatcaatttgtggcatcccatgaaattgtgcacaaaattatcatgttcctcacatagtttacatcatatctaatcaggattaatgattctagccataaaaatagggcatcacatttagatttattattaacatctgaatattcactttctttttttaacttttattttagaattgagggatacgtgtgcaggtttgttacagagatatattgcatgatgctgatatttggagtacaaatgaatccatcacccagatagtgagcatagtatccaatagatagtttttcaacccttgatcccctctctccttctcccttatattcccccccagcgtctgttgtttccatctttacatccatgcatacccaatgtttagctcccacttataagtgagaaaacgcagtatttgattttctgtttctgtgttttttgcttaggataatggtttccagtggcatccatgttgctgcaaaggacatgactttgttcttttttatggctgtgtagtattccatggtgtatatatgccatattatctttatcgagtatatcattgatgggcacctgggttgattcctaggtgttcatatgtctttgctcttgtgaatagcgctgcagtgaacatatgggtgcatgtgtctttttgctggaatcatttattttcctttgggtatatacccaggagtgggattcctgggttgaatgattgttcagttctttgaggaatctccaaactgctttccacagtggctgaactaatttacattctcaccaacagtgtgtaagtattcccttttctctgtagcctcaccagcacctgttatttttgactttttaacaaaagccattctgactggtgtgagttggtatttcattgtgattttggattgcatttctctgataattagtgataagcatttttttcatatgtttattagctgcttgtatgtcttcttttgagaagtgtctgtttatgtcctttgcccactttttaatggggttatttgttgtttgcttgttgatttaaattccttatagatcctggatattaggcctttgttggatgcatagtttggagatattttctcccattctgtagcttgtctgtttacacctttgatagtttctcttgctgtgcagaaactctttagtttaattaggtcccacttgtcaatttttgttttcattgtaattgcttttgaggacttagccataaactctttgccaatgccaatatcgagatgggtgtttcctagattttcttctaagaattttgtagtttgatggcttacatttaagtctaatccatcttgagttaattttgtgtatggtgataggtgggggtccagttgcattcttctgcatatggatagccagttatcccagcaccatgtattgaataggcagttctttctctattgcttacatttatcaactttgacaaagatcagatggttgtaggtatgtggctttatttctgagttcttttactctgctccattggtgtatatgtctgttttttaaccagtaactttctattttcgtttctgtaaccttataatacattatacttcgaagtcaagtaatatgatgtccccagctttgttctttttgcttaggattgctttggctatttgggcttttttttggttttgtatgaattttagaatagtttttctaattttgtgaaaaatgacattggtagtttgataggaatatcattgaatctgtaaattactctgggcactattaccattttaatgatattcattcatccaatcaatgagcatggaatgtgtttccatttatttgtgtcatctctgatttctttgaacagtgttttgtaattctcattgtagagatttttcacctccctgcttatgtgtattcctaggcatttagttctttttgtagctattgtgaatgggattgtgttcttgatttggctgtcagttttgatgttgttggtatgtaggaatactactgatttttgtacactgattttgtatcctgaaactttgctgaagttatcagatataggaactttttggcagagattatgggggtttctagatatataatcatattgtctgcaaacggggatagtttgacttcctctctggctgtttggataccctttattcctttctcttccttgattgctgtggccaggatttccagtactgttgattaggagtggtgagagagggcatccttgccttgttctgattttcaaagggaatgcgtccagcttttgcccattcagtataatgttggctgtgtatttgtcatagatggtttttattattttgacatatgttcctttgatgcctagtttgttgagggcttttatcatgaggggatgttgaattttgtcaaaagcctcttctggatccattgagatgatcatgtggcttttgtttttaattcttcctgggatgcaaagttggttcaacataataatttattcacatttattgatttgtatatgttgaaccaaccttgcatcccaggaagaaagcctatttgattgtggttaattaactttttgatgttctgctggattcagattgttagtattttgtttatggtttttgcatcaatgttcatcagcaatattggcctgaagttttctttttttgttgtgtctttgccagtttttggtatcaggacgatgtttgtttcataaaatgagttagtggggagtccctcctcctcagttttctttggaatagtttcagtaggattggtgccagctcttctttatatgtcttatagaattcagctgtgaatccatgtggtccagggcttttttaaaaaattattactgactcaattttggactcattagtggtcagttcagggtttcagtttcttcctggttcaatcttgagatgttgcatgcttccaggaatttattcatttcctctagattttctagtttgtgtgcatagaggtgttcgtaatggtcactgggtatcttctgtatttctgtgggatcagttgtaatgtcatctttgtttatttctgattgtgtttatttggatcttctttttttctttgttaatctgattagtggtctatcaatcttgtttattctttcaaagaaccaacttttgatttcattgatctttttgtatggatttttgggtctcagtgttattctgttatgctctgattttggttatttatttttttatgctagctttgcagtcagtttgctcttgtttttctagttcctcttcatgtaatgttagattattaatttgagatctttctaacattgatgtaggcatctagtgctataaactttactcttatgacattgcttcagctgcgtccaaatattttggtatgctatgtctctattttattaatttcaaagatttttggatatctgccttactttcattgtttacctgaaagccattcaggagcaagttgtttaatttccatgtaattatatggttttgagagattttttggtattaatttctatttttattgcactgtggtctgagagtgtgcttggtgatttcaattttttttcaatttcttgagacttgctttatgtatggccaagtatgtggttgatcttagagtatgttttgtgtgtggatgagaagaatgtatattctgtggttgctgggtggaatattctatagatgtctattaggtccaattggtcaagtgtttgctttaagtccagaatttctttgttaatttctaccttaatgtactgtctaacactgtcagtggggtggtgaagtctctattactatgtggctaagtctttttgtaggtctagaagtagttgttttatgaatcggtgctccaatgttgggcgcatatatatttaggattgttaagtcttcttgttgaattgaaccctttgtcattatataatgcccttctttgttctttttgactgtttttgatttaaagtctgttttatctgatacaaaaataatgacccctattcttttttgttttccatttgcatgatggatctttctccacctctttactttgagcctctgtgtgtcattaatgtgagatgggtttcttgaagacagcagacagttgggtcttgattttttatccaacttgacattttatgcattttttttttttgagacagggtcttcctttgttgcctagactggaatgcagtgctgtgcttatagctcactgcaggcttgaactcctaggctcatgcaatcttcctgcctcagcctcctgagtagctgggactacaggcatgtaccaccatgcctggctaatttgctattttttgtagagacaggattgcactgtgttgcccagactggtttcaaagtcctgggctcaagtgatcttcctgccttggcttcccagaaagttgggattataggtgtgagccactgcaccagacatctatgccttttaagttggacatttagactgttgacattcaaagttaatattggtatgggacattttgatcctgtcatcatgaatatgtactttcaactatgggtaaacattctagatgttacctaataaaatctcataagcttttcttgtgatttcatcagagtctaaatttgtgattattattgcaaagaaaaatgttgatataattgaagattgtgaagcttattttatgtacaaaacaattattaacagcttacaaattattgagagagtggattagcttggtcattttatgatgtaacatattctttttgagtccacagaataaaatgtgtggttatttgttttgtggtgttatttcagtaatagataatagctataaaagttggtacataaaagtggagggctatacaacaaaaccccaaatatgtggtatttaggcttttgggcagtagagggctcagaaaactgttagcagaggctggagtaacaatgaggaaactgctttaagaagttcttatgaaatatttggtaaaaggaaaaaaaagctgcttatagtacattggaaaacaaaatattgtaccttatgaacttttggcttagaatgtcttcaggcaaaatgtagaaagcaccaccttgtgcacttaactgcattagattaaagtactgtaaggaagttgattgagggttgctatttgcaagcggaagttaaaggtaatatataggagtctggaattactaaattggagagtagaactgtttcatctccagcttttggttatactatctgagatgtcctcctttttccatcattatcttttcaaaattctttctaagaaatgatcatttttggaaacttattgattatgagtttagacatgtgattttgctaatggaatgttggactttagaaagtgcttacaatatttccacttcctcccttgctcccttgccttcttatgagaacatacaaaggctaggctgctagtggatgaaattcatgaggcagagctaagtcgccccagttacgtcagcccacctcatcctttctcagataacccacagccaattgccaggcatgtgagtgagctcagacttaagagataaagttagatttgtatgtcactgagattttgtgattgtctgttacacataattgtggcagttgatattcatacaagtgtgtacagtaatatgcacaataaagcaacttcattattagaaaaaaatgaagtatattaagaaagtgttagcaaaaaagtgttagtgaaaaacaaactaattttgttctgacgaattgagtcccaaaataatctttaagtggtggataaattttaaagcagaacgtattaaaattatttattgggctggatgcagtagcttatgtttgtaatcccagtgctttgggaggctgaagcaggagaattgcttgaggctaggagttgggagaccagcctaggcaatacagcaagaccctgtctttacaaaaattaaaaaaaattaacccagtgtggtggcatatgcctgtagtcccagctacttgggagggtgaggcaagaggatcccttaagcccaggaggtcaaagctgcagtgagctatgatcataccactgcactcaagcctgggcgacaggctttaataaacaaaaaggatttattataaattgctgtctttggtagttgaagattaagaattttttagattcgccaaagctattaatcctaaatcaaagttgattctgaaaatcatataacttaaaacctattctaagatttaatgtccaaaaaaattagtaatataattatgcataccacttgaacctgggtgttttataatattgaattcgtgcaatatagtatatgccttgaagctagctcacagttctgagaggttttttttgtactctaatgacaaattttaaaatgttgactatttttaaaaacaaagttgtaataaatatttttggataaaatttcagatttatctttatatcgtagtttattctaagatagtagtaataataggagctgggtttagtttgaccaaatactgatttaaatactcagctctttgtccaaagtgtgcttttaattcaatgtacatctatttttacttattttaaaagtgtaaacatgaaccactgtcattggataacatctcaatatatgaaagatatttctggtgaagttcgttttcattgacattagatataatttcatatttcaaatagtcttgataatttctattttttgctagcttatgagatctaaactatattgtcgtttacttttaatattgcaaagatctcatattagtaaaatttcagctgcgttcatgtttgtattattagtattttcaatccttaatttctttgtagaaatcttttaaaccaattcacaattttctgatgatttttttcattaaaagtatatctgcttaactgtacccctataaaacataatttgtcaaaatatactgaaagccaacaaccaatttcaaaccttccacactgtggaactcatccttatttctcagaatatcttttatgctcatgaatggctaggtgaggcaccagagtcaagctgcatattctgtattagtaaagcttaattttctaaaaaaataaatataaatataagttgtgctattttatttctgcactctggtggagcttctttgcttttttactatagatactggaatacctttccagatgcctttgcagccaggtgtgaacagtgttccatttctggctaatgagatgtaagcatctttcttggggttcccaagaaagctatgaaatagggctaaactcagctaaaatatcttttgcctttcactctttttcttcctgcttagaacattgggacaatgccaccagaaagacaaatgctataagctaagtatggcagagctgagtgctgtaaagagccttggtccctaatgacattattaggccatcatatcagatctctactgcagactcccagacttcttgtgtgagatcaataaacctctcaacatttatgtcctctataaatcatatttttgttgtttgcagccaacgttttcttaactgatataataatgttgcactcccctctatggaaaccacagttctgattcattagtattatgtgtccaaaaccatggtagagaagggacattgaaaagggacatggggcatggggcataaatagtcttgataatttctcgataagactatgactatttatatttagttaaatataaacatttttgttttggtaagtccagtaatgtctgaatatctgaaagtattagaggagttatatggtaagaaagataagatttatagaaaaatctaagttcagaattgttaaattatttttatttgtcatattgtttggataccagtattacttacctttaaacctttccgttttgtgggattgttattattatatatggtaccttctgcaatacctagctatttagaagtaatcgaagtgacaaaataccataatatatggagatgatgacagggcaaggagaaggaatcaaacatgcagtacctggtattatttccttttaatttgtttgctattattatttacattttaccttaaataggagacaagttaattaaatatccaattttcctatttgtaagacaaagaaaaaacttatgtttggctttctgatttcaagatttttatctttcttgggatatgtattttattaaaatgtgtaatttggtgatttgtatgtttatgaagtttaggggtggctgaaagtctcacattcttctaagagtaaagtctaaattggaaaatagtaaaaattgcatactcacaaaattaggcatattctaaatcatagtataactacatctttaattatgtctcccgaacattcagtagaaaagggaaaataacactcagaatcccagtagatttaggaagagagttaggaacagaagacagtctccctttagttttgctcctcttttaaatagtagtggttttttatgtgccttccagcttctcccccactgtgcccttcttcttcccacaggtctccagtccccagatttctgtgcatcctctctcatgcaaagaaggctggaagacaaacttgtgaagctagagggtgtttttactaaacactaaaggagttttactaaaggagtttcaagtgagtgccatgaaaagacctaattattcttaaggagaatggtatttctgtatgttcctacacttgaattttgacaatatttttctatgaagcatcagagctgttcaagccacaattccaaaagggtgtgtgcttttttagatttgatacataatatttttgaataaaagtaggctttttgctggggctaaatattaatattctttaacaatcattccaatccatagagtgagattacaaaatctttactaaggaaattgcttgtaaagtgtaatgtcaaacaaatattaataacgtaaacacattaactatatattggtaaataatgagtgatatggtagataaatgaaaaacaaatgctatcgattatgatatagtttttaatgacattcttttttggcttggataggcttttctatttttttttttaaacttattttgagataattgtagatttgcatgcagttttgaaaaataataatacataataataataccatattccctttatccagtttctccccatggtaatatcttgcatacctacagtactgtatcacaactaggaaaatgacattgatactacccgctgccattatttagatactaccagttttacatgcactcatttatgcatgtgtgttaattctatgcagttttattgtgtgtatagattcatgtgaccacgccacagtcaacacacagaacaggtttatcacaaggatccctcctgccaccctttcaaagcgaaagccactttctttctgctcctcccccacctccctaaccccagaaaccactaattctgttcatctttatcattttgtcatttcaaaaatgttaaataaatggaagaatccactatttaacctta

SEQ ID NO: 147 - DNA, 114587 bp, Homo Sapiens
ttgatataaagtttctcataaattcattttatttcaacagcaaaaagattagctccatccctctgattgggatcacaaagtacaatcttttcagcatgggttttctcaccatgccacaaacagaaagaggcactaagggactgataagggggtattttctgtctctggcagtattatattgacctgcaataaaaacatctgatcttacagaacaggatacctcttgaagaggtatagtttattttataatatgtaagtattccaaatacattcattgtatgaattagggaaggaaaagcaataagaaacatttcatgaatattcattcctacactccaaccataccaagtcttactactttatagaattcataatttattagccaatactattttaaaatactatttccgtactgtaaaattgatattagaggaaaaaaagtcacacacgatgcctaccaccaccagggtgaaaccaaatctttatctgcctatggctgctgtctgggtcgattgaggcagcagcttcattttcttcatggtttacccagacagatgtggaaccaaagtgctaagtgcatatttcaagcatctgttctgaatatgtttaaagccacagtaagttacaaaaggcaaattcatagatgctctttgaaagtgaatgtaactattatacttggtattctacttcccccacgcccccagaagtttttgatgctatagacactgatatatagtttgaaactctcactataaaattactaggctaagtctatcaagacttgaaagtttgttttgctgaggtaggtgaaagggtaatctctgttctttccaggtgactgcatctgcacaggcttccctgggaggacttcatcaacagcacagttacacatcaaagtcctttagctctccccagctggcgcctattttcactttcactttcaatttcacagacagttttacagcactttccatttcattcttgacaatctgagctacctaaggaaaaaaaaaatgtagttaacaaactgcccagtcaaagaatgtttcccaaaccatcccctgagaaagttataaaccagactggagctcttcacccaatggtgcttaaaatgctaaatcagaaaaaataaaaaataaaataaataaatgaataaataaaaagacatctcatactcttcttcactgatgagcaggaatttctgaaagtttttgctagaatgcttggagcttagaaaccctaagggaaagactccaaatttttgtttaattcctccaagacaaaaacatcttgcattggcaattcttcacttattaagaactagtacaaaacggaacactcttagctccttttctacctgtaaggactcaatatttatacagccatcccagggctagggtagagttccaaaatcctcatgcacaggaaacaaagctgtcggcctgacaatacagtgtcttgtcttcctatggaatggacacaagcattgcaaaaatacctgaacaacatcttcttctgccacttcatataggagttcatcatggagttgaaggatgaagaagcctcctctgattgggcagaacatcccttgcagttttctctttcgtgacaatcctacttcatgaaaaaggagcaaaactgatcagcatgtcgctaagtcataggagaatgtttttagagattctgagtaactctgaggaattttaatgagaagattaaaacacacaagaataagaactatcaggaaaataactacttgctggtcgctacctaccctaagtatccggtataaactcacaaacttcctcctagaaagaaggagtctcccaaagaagtcagtaaatggggtgtgaggaactctgctccaagctctagtccaacttatttctcatgaataactaacattttctctatccatggagtcccccaaccaccatctgagtaatagcaccagggaggtatggggcctgattcctgccccaggaaagcaaactaatattgttaggcactgtttcttaagggggacactccctcatgtctttttatggccagaagtgtcatcgtgatagaactggtgcttccccaattgaaccgtacacactccaaacaagtaattgtaaaacctaggctcccaaagtggacttcagagagtacataaaccccttgcagttatatgtaagagtctatgtctgtacgtttttctgtggagataatccataccttccagtagccataactccaaaatatatactagacttagttactatttcctcattagctggatctagtggtacagattatgcccttctgaccaaaaagataaagctcaacatgaacacctttactggaactgcctttacttgtttgcttaaacctcacagtagtcatcttcctttctgttgtccaaattccctacttatctttcaggtccagcatgagtaacatctccctcagtatctggtgcttccctcagggagagagttcttcaactgtcactatctgcagtgccagtttgctcagaggtggctctcacacagtaagcaaacaaaatcacctgaggctgcagcaagctgcttccacactaggactgcaaaggctgtacctctgttcacctgttcagctgaaatcggatctgccccatgaagccacacttggctcacaccattgactgtctggatgctctagcttttctgctttctgatgaccatgcctttgccctcttgatttcccttggctacctggcttctgacctagaatgccatgatgctcttgttccccatatggtctgcttcctcatgctcaccttcctttcatcctactgacctagtgctactttaagctggcatgacatcatgaagccatcctcagcgacagagccatatcgccttccactgactcttaaagtcattactgtctgtatcctcattttgacatttatcactctgctgtgtggaattaatacaaatacttcagtcaggtatcatatcttcctctcctttcttaaatagaacttaaatttaaagatagattgataacttttacttctaaatccccaaagcacacagcacagtattactccccaaatgagtttaattatatattctctctcaattaaatataaatgtgtatgtgtgtgtatatacacacatagtcccacactgaaaatgaatgaggggcctcaggtatttcaagggggactgatgacaatattaataatcctcacttaatgagaaaataaacttttgttatctacgtatttttgtacgtaagtgaacacgttataactggctgtattattctctataacctgtatgtatgtctcttctagaaatagcaaatctcatcctcaataactaatcatgacctttctgccccatctctagcagctttttcttcctctgtatgcaccaaaccttaatttcttcccaggaaaatttaaaacatgcctcctggctgggtgtgatggctcacgctggtaatcccaacactttgggaagccaagcttggcagacagatcacttgaggtcaggagttccagaagagcctggacaacatggtgaaaccccctctctactaaaaaaaaaatttttttaaattagccaggcatggtggcacactcctgtaatcccagctactcaggaagctgaggcaggaaaatcccttgaacccaggaggcagaggttgcagtgagctgagatcgtgccactgcactccagcctgggtgacagagtgaaactctgtctcaaaaacaaaaaaagtctgctgtcatggtttgacaatctcagtgacagtgaaatggtatttaaagcagaaatatggaatgtgacagaagaaaaaaagaaaatttcactgtacttgttagtacaagaaataatttatccaagcaataaagggaaaactcagggaaaatattctgaaagtaagaacaagaaaacaatatcagcaaaggaacatatgtgataaagagatcaagagtatattctaagatcagagaacactgaaggtcataaataggaatatcaacatatccttaaagtatggtctgaagaccacagaggatcccaaaatctgcagtcaaaattactttcataataacactatgaggctatttgcctttttcagttttattttcttgtaagagtgcagcaaagtggccaactgtcctggtatagaagtgaaattccacatcctgggaaactcatccgtctcccacaaattgagacatgcatcatcccagactgtacagagtttcccaaagagggttacaggacatgtgatattacaacagattgaatacagaagcagatacaaacagccagctgtgttctcttaagccaaacattaaagagatttacacatatgtaaaataaagccacctatcaagaattttctttagttcttaagagatgtagttattttcataaaaatatgtgacatgtcaaaatatggtgagtttgtaattactttaaatgttaatgttttaaaattccctgttttaatttataatatggtaaatatatagacataacccacaaaaacaagagctctttgaaatccttaataatttctaatagtataaagacatcatgagaccaaaacatttgagaactgttgagaaataaaataaaaaatacttcccatttacatttctgatacaattattctcatcatgttacagcacaggcctcatctatgaacaaacctgtttggtcactttggagcataccctctcgatgaccatgggatttgaaggttgagtggaaggtctctaattgcttctgaatgttaactgtggctattttgacaatatcagctgctgatccttggactattgtgttgatagcttgacgctcagcctagaaaaaacaatcaacaggtgctccaccagatatgccaacatggtttcatactttcctttagtgtccacagttcagtgctcacatttgcagccagactggaaagctggactgagatgcaacccagaacaccaactattaggctgcatcctaagaataacacctatcatgatccagggctctagattctggggtttccacattagggcagacaaaaataaggtcagattgcttcagcttagatatcttgactactcagttagcatccaaaaactactttgcacttagatgtatttagctcatcagtgttatagctgttctagacatcattctaagagatctgctcctcaaaataatcttaatcctaaataagtagaatatcattctttgggaggggggttggaatgtcctaagcacaccctctataccaatggcctcttggtctttaatatagagtgtgagccctgcaggtatggagccctctgatgtgaatcagagcttttcatgggctgctgaggcaaatccttagccgctagtgaaaacgcacatcctagatccctgggtattcagttacaacttccttgaaatgactgctgccaagtgcttcttggcagggaaccatgcctactaaaattaatcatcttggaagagtagagaagggagtctgggttaatatccaggtgtaatctatatatgaatatcattcccggtgccccaaaatatctaagaaaatgaaaaaggtctactccagggaagggggtcaatgtaacatgagaggtattctctagtcctctgtcatctgagctatacccaacttctagtatattaaatgcctgtaatctcagctactcaggaggctaaggcaagatgatcagttaagaccaggagtttgaaaccagcctgggcaacatagtgagaccctgtctttaagaaaaacaaaataaaacaaaaacctctctccacacctaaaattactaatgagtgggagaaaaggccagacacaatgtaggagagaatattttctacacatgtaaccagtaacaggttcctacaaattgataagaaaaaatgcagaaaactcaacagaaaaattaaaaagaaaaccagaataggtatttacccatgaaaaaataactaaatggctaatacacatttgtaaggttgctcatttgtaagattacctcactagtagccaaggaaacacaaattaaaattacaggatactactttatacccaccagaatagctaaaattatattagcttaatagcaagtgtcgacaagaatgcagagcagtgaggactcacatactcttctgaagggaggacaaactgctataatctccacagaaaacaatttggctttatctactgaagttgaaaatatgcagcaatcccaccactgtgtctttaccaaacataaatgcatgtaaatgtgcaccaagaaccttgtacaagcatgttcaaaaacataatagcttagcttcaaactgaaaacccaagttctcatcaagagaaaaatagataaattatggtatatttatataagagtatacagctattcctacaagaaacaagaatgacttacccatgtaattttgatagaagctagatacaaaatatacatatatgatgtatatggagctcaaaaaaatgcaaaacaaaactatagtgttagaagttataacagtggctatttctgggaaggcgatgggtggtgattaggaggatgcatgaggggcgcttctggggcactgacagtattctatttcttgccctgagtggtagttacacaggtgtagctctgtgataatttagtgaaatctacattctttatgtgtgagaatgtatttttcagtacaacaaaagtttgaacaaaagcaaaaaccaaaacaaaaaccaaaaaacaacctggctgtgtttactctattcctaattcagagggctggaatatttttcctcagcagcaacataatgaatcagaactttaacactgaagtatttggcatgaaaaagtcttattactctcttgcatcttcaggtacaataatattaattttcacaaacttatatgattcatttatattaataactacatattccattttttatcatgtaaattccagaaaacataatcaattcgtattattagatcgagtccaagtttctcagcctgccactaaaagccttctgtcatttagaagaagccttttagtctcctaggttctagctggctccatctatccaggagaaaattatatacccctatgtgacaactcaaactctccattcctaccagtttggcttctagccagtcctcactcagttatccttttgtgattgtctttttctcattcccaacagcctaaactttagccttcaagaatctgtttaagtctttccttctccctgaaacctaaataattaagtatatcaatgatgttttcatatatatttttttgtttgcattatttcttccaagacttaaaacttaagtttcctagtccatcaactaaagttactagttcacttagagatatggtaaaagcctgataaatatctgatatttgcatgtggatatatgggaggctagagagtaaagcagtaacaaaaagccaactattcttccacagtccctaaaagcattaatgctctgaaggctttgagctccagacagaagtttagcggggtattttcattatatacaatgtctaatgagcactaaaacacaaagttatgggtgaagggcaaaaaacatctagttaaaataggaagatatgaactatactagaagtttaaatacttaggtacacagaatactttcatgaatcccaatgaattcagaaagacacttaaacataatttgagcaaatatcaataaatcttttaagtgccgttaaaaatagccttattcactatttgggatatcttaataatctctgatgagatagtgcctttttttttttttttaattaaacatagggtctcattctgccacctaggctggaatacagtggttcaatcatggctcactgcagcctccaattcctgggctcaagcagtcctcccacctcagcctcccaagtagctaagactacaggcattgcactacctcactcagctaatttatttatttttatagatataggtgatctcactatgttgcccaagctggtctcaaactcctgggcgcaagcaatcctcctgcctcagccttccaaagtgctgggactacaggcatgagccactgtgcctggccagatagtgcttttaaaataagcaaacaagtagaatgaaccaaaaattaatcaaaatttagtgactggctaatctctgaggaatgttagcaatttggtatgatatgataaattagtatatggtataggaaacaaagaataattagcaaatgtaaaaattaagtttatttacaacttagtacctaagctaataaataattggtttactgcaacagaacatgtttaaagtattattaagtaaacacatgtttacattaatcccccagactctgttcagcaaatactggcatgtgccatcacttcagaagtccttaatgaaaccaatggttgacgttgtctatacagaaaatccaattaatatgccagtaatccctaaaacggatatttgtagtatttactctgctgaaaaagtacatgtcattgaaatgttaagttaaaattcctaaaaaatttcaacatacgtgagctttacgataagggttgttgtctttgattcctggcaaatatctacgccttcccaaaatggtctgaacaaatccgtctcttttacaattcttcactgtctctgtcatgaattgattaatccctacaaagaaaatacagaaataattaattagaaccaaagtctatccttcacttcattcactggcttaaatatggcaaaatacaccaaaaccccacgatgattcttaacattaatatcatatcgtcaaatcaggcatgcgaactttcattcactttttctagactcaaaaagttagaaataaaagagactttagaaatgaaatactctaactctttgggtttttttgtttttgagacaggatctcgctcactctgtcacccaggtgggagtgcagtggtgctatcatggttcactgcagcctggatctccccaggctcaggagatcctcccacctcagcctcctgcctaggtgggactacaggcaccgcgtcacgatgccaggataatttttatattttttgtagagatgaggtttcgtaatgtggcccaggctggtctcaaacatctgagctcaagcgatctgcccacctccgcctcccaaagtgctaggattacaggtgtgagctactacatggcctttgttttttgagtaacaacaacaaaaacaaaacgtaaaactaaaaattccagaacggggcagatatctaggtgtctttattccaggatcttaagactattccacatcacttttcacaagtgtctgttgattgtgtgaatccccttttactctttcatcttatcattcctaggtttaaaacatttcaatagctccttgttaccatctacactatgatccaaagtaggaccttgctgaaattaatgcatgagttacgataaatatttcactaggaataaacatgacccacttcttaaaataaaaaaaaaactatgtgtagtgtagtattccaacatatttgtatttcctagaccaacattcatcctttgcaatctgggtcagtcattatgtcttaagcatctccaggatgaatcctttgctgttggtgatatgtaatcaatagcatgggaatttccaaaagccactggactctcatctttttctgtttaagaattactgtgatatttttgggtaaagaggaaagaaaagggtgagatttaagaggctgtacttctacaaaatctcttaccaaactcctataggagacctccaaatactcaaattgaaagagctactttaaaaaaaaaatcagtgctgaggtataatttacatgcaacaaaatacactcgctttaaacagcttgaggcattttaacaaatatacacacccctgcagctactactacaagatacaaaacatgttcatctccctttacagtcaggccccatgatcaccctcagacactcactcatctgctttatgatactcttaagtttttcatgttcatgaatatcatacaaattgaatgacactgtatatgctcatttgtgtctgccttcttttgctaaggaaaacatttttaagaatcatcaatattgtactgaatatcaatatttaattactattccttgatctatactactctgttgtggaggtataacaaaatttgtttatacattttcctgttgatagacatgtggcctgttctcagaatctggctgttgtgaataaagctgctataatattcacatacgagccttcctttggacatgctttcatttttcttgcacaaatacgatagtagaattgcacggttatatagttaaatggatgtttaactttacacaaaaaagccatactgttctccaaagtagttttaccattttacaaataaatgaacaacgtaaaagactgtgtttttaatattggccattctagtgtttttgtaatggcatctctttgtttttggcatctcagtttgcttttgcttgatgacaaataatgacaatgtttaatatggtcattcatatctttggtaaagtgtctcttcaaattttctgacttttaatttatcggatcgtctagcttctgagcattgaatggtaaaagttcttcatatattctggatatacatcctttgttcgatggaactactgcaaatatttcttcccagtttgtaccttgcttttacatttttcataaatttttaatttttgtgggtatatagtaggtgtacatatttatggggtacatgagatattatgatacaggcatgcaatgcataataatcacatgagggaaaatggggtacccatcacctcaagcatttatcatttgtgttgcaaacattccaattatactcttttagtcatctttaaatgtacaattaattattattaactatagtcaccctgttgtgctagcaaatactagttcttagtcattctaactatttctttgtacctattaacaataccccctacccccaatacccttcccagcttctggtaaccattactctactctctatctccacgagttcaattgctttaatttttagctgagtgacaaataactgagaacatgtgaagtttgtctttctgtgcctggcttatttcacttaacataatgacctccagttccatccctgttgttgcaaatgacaagatctcattcttttctatggctggatagtactccattgtgtacctgtacattttctttatccattcatctgctgatggacactgaggatgcttccaaatcctggctattgtgaatagtgctgcaataaacatgggagtgcatgcagatatcttttcagtacacagatttcctttcttttgggtatgtacctagcagtgtgattgctggatcatatgatagctctatttttagttttttgttttgttttgttttgtttttgagatggagtctcactctgttgcccaggctggagtgcagtggcgtgacctcagctcattgcaacctctgcctcccggttcaagcaattctcctgccttagcctcccaagtggttgggatacaggtgcccactaccatgcccggctaatttttgtatatttagtagagatggggtttcaccatattggccaggctggtctcaaactcctgaccttgtgatccacccgcctcagcctcccagagtgttgggattacaggcgtgagccaccatgcccagcctatttttagtttgagaaacctccaaactgttctccacagtagttgtactaatttacattcccaccaaaggtgaatgatggttcctttttctctacatcttcgcctgcatttgttatcacctgtcttttggataaaagccattttaactggtgtgagatgatatcacattctagttctaatttgtatttctctgatgatcaatgatgttgagcaccttttcataaacctctttgccatttgtatgtctttatttgagaaatgtctgttcagagcttttgtccattttaaaatcagattttttttctgcagagttatttgagctcctcatatattctgcttattaatctcttgtcaaatgggtatctgcaaatattttctcccattctgtgggctgtctcttcactttgttggttgtttcctttgctgtgcagttttttttaaacctgatgtgatctcatttgtctatttttgctgtggttgcctgcgcttgtgagtattgcttaagaaatctttgcccagactgatatactggagagtttcccccatgttttcttgtagcagttgcacaatttgaggtcttaaagtttttaatccattttgattttattttgtatatatagagagataggggtccagtttcattcttctgcatattcagttgtcccaacaccatttattgaagagactgtcttttccccagtgcatgttcttggtacctttattgaaaatgagttcactgtagatgtgtgggtttctttctgggttctctattctgttctactgatctttgtgcctgttttataccagtactatgtcattttggttactatatgtctgtagcataattcgaagtcaggtaatgtgatttctccagttttgttctttttgcacaggatagctttggctattctaggtctcttgtggttccatgtaaattgtagtactttttttttttctatttctgtgaagagtaaagaatgtcattggtattttgatagggaatgcattaaatctgttgattgacttggggagtatgaacattttaacaatgttgattcttccaatctatgaacatggaatattttttcatatttttgtgtcctcttcaatttctagtatcagtgttttataagttttccttatatagatctttcacttctttggctaattcctaagtgtttaattttatttgtggctattataaatgagattactttccggatttctttttcagattgtttgctcctggcatatagaaatgctactgatgtttgtatgttgatcttgtatcctgcaactatactaaggaatttgtttatcagttctaatagttttttgatggagtcattaggtttttccatatataagatcatatcttctacaaacaaggagaatttgacctcttcctttccagtgtggatgtcctttatttctttctcttatctgattgcttgagctaggacttccagtactatgttgaataacagtgatgaaagcaaaagtgggcatccttgtcgtgttccaggtattagagaaaaaggctttcactttttccccattcagtgtgacactagctgtgggtctatcatacccacagcttttattatgtagaggtatgtttcttgtaaacccagttttttgagggttttcatgatggaatgttgaattttatcaaatgccttttcagcatcaattgaaatgatattgtttttatccttcattctgttgatatgatgtatcacattgatagatttgcatatgttgaaccatccttgcatcccagggacaaatcccacttggtcatgatgaatgatctttctaatatattgttgaattccatttgttactattttgttgaggatgtttgcatcaattttcatcagaaatattggccggtaggtaggttttgtttgtttgtttcgatatgtctttgtctggttttggtattagggtaatactggcctcacagaatgagtctggaagtgttctctcctcttctattttccagaacagtttcagtaggattggtattagttatttaaatttttggtagaattcagcagggaagccattgagtcccaggcttttctttgtggaagactttttattatggcttcgatctcattatttgttcttagactgttcaggtttttttgttcttagactgttcaggttttagatttcttcatggttcaatcttggcaggttgtatgtgtctagaaatttacccatttcttctagattttccaaattactggcatatagctgctcatagtagccactaatgatcctttgaatttctggagtattcattgtgctgtctcctttttcatttctgattttatttatttggatcttctccttttttcttagtctggctaaaggtatgtcaattttatcttttcaaaaaaccaacttattttcaggccaggtgcagtggctcaagcctgtaatcccagcactttgggaggccaagatgggcagatcacttgaggccaggagttcatgaccaacctggccaacatggcaaaactctgtctctactaaaaatacaaaaactagccaggcacggtggcacatacctgtaatcccagctacttgggaggctgagacaggaaaattgcttgaacccaggaggcagatgttgcagtgagccaagatcacgccactgcccaccagcctgggtgacagagcaacactccatctcaaaaaaaaaaaaacaaccaataaccaactttttgttttgttgttcttttgtatactttgtttcaatttcattctttatttctgctctgatctgtattatttcttttcctctactaattttggatttgccttgctcttacttttctagttttttaagatggattgcaggttatttgaagtttttcttcttctttttttttaatgtaggcacttatagctataaacttccttcttagcactgcttttgctgtatcccataggtgttggtgtgttgtatttccattgtcatttgtttcaagaaattttaaattttctttcttaattttttaattgactcactggtcactcaagagcatattgtttaatttccatgtttgtatactttccaaaattccttgttagtgatttctagttttattccattatggtcacagtagatacttgatattaactttctgaatattttaaaacttgttttgttatctaacatatagtctatcctagagaataatccatgtgctgaggagaagaatgtgtattgtgtggccattaaatgaaatgttctgtaaatatctattaggtccatttggtctacagtgcagatttagcataatttctttgttgattttctgtctggaatatctgtctgctgctcaaagaggggtgttgaaatctccagttattattattgggatctctctctctctctctttagctctaatgatatttgctttatatgtccaggtgctccaatactgggtgcatattacaattcttatattctcttgcttaattgactcaaaaggagtattatataatgtaaaagacattatataatgaccttctgtctcttttcatagtttttgtcttggaatctattttgtctgataaatagtatagctactcttgatcttttttggtttccattggcatggaatctcttttccatccctttattttcagtctatatctttagaggtgaaatgtgtttcctgtagggaacagatcattgggtcttgtttttctttttttaaaaaatctatccagccactctatgtctttttattggaaagtttagtccatttacatgcaatgttattattgacagttaaggacaacatcattttgttgtttactggttgttccatggttttttttctctttctttccttcattcctgtcttccttttaataaaggtgattttttctggtggtatgatttaatttcttgctttttagtttttgtgtatctgttgtatatttttttatttgaggttaccatgagacttgcaaataatgtcttataaccctttttttttttttttttgagaaagagtctcgccctgtctcccaggctggagtgcaatggcacagtcttggctcactgcaacctccgcctcctgggttcaagcgattctttcacctcagcctcccaagtagctaggattacagtcacctatcatcatgcccggctaatttttgtatttttttgtagagatggagtttcaccatgttggtcttgaactcctgacctcaggtgatctgcctgtctctgcctcccaaattgctgggattacaggtgtgacccaccgcgcctggcccactttttaacttttttgttgtttatatttatatcgtattgtactgccagtgtcttgaaaggctgttacagttatttttgattaatatttttgtctttctatttaagataatagtttatatatcacaattgcaatgttataatagtctgtgtctctctgcgtacttaatattaccagtgagttctgtacctttaggttatttgttattgctcattaacatccttttctttctaattgtagaactctttttggcatttcttgtaggacaactctggtgttgatgaaatccctcagctttcatttgtctgagaaagtctttatttctccttcatgtttgaaggatattagtatttttgccagatatattattccagggtaaaagctgtttttcctttgacacttcatgccactaaaaagtctgctgccagacatattgaagctccattgtatattatttgattattttatcttgctgtttttaggatcctttctttatccttgacctttgggagtttgattgttacatgtcttaaggcagtcttctttgggttaaatctgttctataactttcttttacttgaatattgatatctttccctaggtttggaaagttctttattatccctttgaatacactgtctactcctatctccttctctactcctctttaaggccaataactcttagaagatttgcccttttgaagctattttctgatgttgcaggtgtgcttcatcctttttaatacttttttatctcctctgtgaatttccaaatagcctgtcttcaaactcagtaattcttctgcttgaataattctgctatattaagagactctgatactcttcagtatatcaattgcattttcctacttcagaatttctgcttgattcttttcattttttattttattttattttttgggatggagtttcattcttgacccccaggctggagtgcaatggcgtgatctcggctcactgcacctccgcctcccaggttcaagtgattctcctgcctcagcctccgagtagctgggacttgcaggtgcatgccaccacgcccaggtaatttttgtatttttagtagagatggggtttcaccatgttggccaggatggtctcgatctcttgacctcgtgatctgtccacctcagcctcccaaagtgctgggattacagacgtgagccaccatgcctagtattgtattgcttgcttcagtaccaatacaagggggataagggataagggacagggttgatttaaaaagagcataaaagaactttttgggatgatagagtaatggttctatatcttggttgtggtgtaaattttatgaccatatgcatttgtcaaaattcacagaactatatacctttttcagggtgaatctaattattatacgtaaattataccacaacaaacaggcaaaaaagatcatttaagacaatactcaaactgctctataacagcaattgttctcagaattcctcgtatatttaattagcaattatcagagttcctagtatatatactcaatagtttactgtttcaaactacagctatctaaaccaaagcacaagtcaactcctgattttatgggttgttcacagtgacacagtagattcacatcaactacattttactattctgttccaactttaatgaaaaatatgaaataagattattacatcttagtaagtgattataaggttaatcttatttacccttaacaatgcctgatgaaaacttctgactaattgatatttcaaaagaaaattccattacacaaatttttaaaaatataatatggtaagatggttgaaaagaatactatctagaagataaattacctgtgtatctggatttgaaggagtcaatatagcatgcagcatcattttctttaatgcccatctgctctcccaaagatttagctcccattccataaatgatcccatagcaaatctgaaagggagtcatccaacaaataaaggttataagtacataaaatgcaaataaaagggttcattaggatgcgaatttcggcaaactttttatttcacagtgagtgaaacaatgattagattgcttttggtgggttacatccacagagactgatatccagcaaacatcttttctgcctttcagcattactttttgagagagagacagaagggcaggagggagtatgaatgaataggtatgtgtgatctaaggaaaaatttatttttgactatttgtcctttatccagcagtctttatagcaactttttactcctcacagaacttcattaacttccacttcaagtgcctaggagtcagggaagagaagcattaccaacatccctcttcttgtccttgaaaaagacttgaagtgtagaaagagtaggctttgtgactttatgacgaagacttaactggaaaaaaaaatcctcctcacctcatagccacctaaatgtccacaactgcagaatttaattcacttaaatacaaacaaaaactcctaagaaaatttcgggagtagtgaagggaaatgatctaaataggcaattaaagaaagtctggtttaatcacaaggacggccggggttcaaagcctagatctatcattcacaaaatgtatcatcttgcacaagtcacttaaccaatttgtatcttaatttcttcatctacaaaatgaagacagtaatatctgcatcatgggattgttaggtttaaatgagttattacttataactgtttaggaaactgacataaagcaagctctgtataaatatcattaaataaaatctaaaaagataacttgcatgattatcagaattccaaaaaaactttcaacatgataagctaactaaagtctacccccacccccaagttttctattttattttttcgcttttttattatttatttattttttttattatactttaagttctagggtatatgtgcacaatgtgcaggtttgttacatatgtatacatgtgccatgttggtgtgctgcactcattaactcgtcatttatattaggtgtatctcctaatgctatccctcccccctcccccaaccccacaacgggccccagtgtgtgatgttccctgtcctgtgtccaagtgttctcattattcttttctttaatagtgctgaatattggccccaacttttttctggcttgtaggctttctgcagagagaactggtgttagtctgatgggcttccctttgtgggtaacccgacctttctctctggctgcccttaacattttttccttcatttcaactttggtgaatctgacaattatgtgtcttggagttgctcttctcgaggagtatctttgtggtgttctctggatttcctgaatttgaatgttgggctgccttgctagattggggaagttctcctggataatatcctgcagagtgttttccaacttggttccattctcccggtcactttcaggtacaccaatcaggtgtagatttggtcttttcacatagtcccctatttcttggaggctttgttcgtttctttttattctttttctctaaacttctcttcttgcttcatttcatttatttgatcatcaatcactgataccctttcttccagttgatcgaattggctactgaagcttgtgcatttgtcacgtagttcttttgccacggttttcagctccatcaggtcatttaaggacttctctacactggttattctagttagccattcgtctaatcttttttcaaggtttttagcttctttgcaatgggtccaaacttcctcctttagctcggagaagtttgattgtctgaggccgccttctctcaacttgtcaaagttattctccgtccagctttgttccattgctggcgaggagctgagttcctttggagtgggagaggcactctgatttttagatttttcagcttttctgctctgttttttccccatcttagtggttttatctacctttggtctttgatgatggtgacgtacagatggggttttggtgtggatgtcctttctgtttgttagttttccttctaacagtcaggaccctcaggtgcaggtctgttggagtttgctggaggtccgctccagactctgtttgcctcggtatgagcagcggaggctgcagaacagtgaatattgctgaccagcaaatgttgctgcctgatcgctcctctggaagctttgtctcagaggggtaactggccgtgtgaggtgtcagcctgctcctactggggggtgcctcctagttaggctacttgggggtcagggacccacttgagggggcaatctgtccgttctcagatctcaaactccgtgcggggagaaccactactctcttcaaagctgtccgatgggacatttaagtctgcagaggtttctgctgccttttgtttggctatgccctgcccccagaggtggagtctacagaggcaggcaggcgtccttgagctgtggtgggctccacccagttcgagcttcctggcctctttgtttacctactcaagcctcagcactggcgggcgcccctcccccagccttgctgctgccttgcagttcgatctcagactgctgtgctagcaatgagcgaggctccatggacatggtagcctccgagtcatgcacaggatataatctgttgatgtgccctttgctaagacccttggaaaagcgcagtattagggtgggagtgacccgattttccaggtgccatctgtcacagcttcccttggctaggaaagggaattccctgaccccttgtgcttcccaggtgaggtgatgcctcgccctgcttcggctcacgctcggtgggctgcacccactgtccaacaagccccagtgagatgaacctggtacctcagttggaaatgcagaaatcacctgtcttctgcatagcttacgctgggagctgtagactggagctgttccaattcggccatcttggaactgccccccaccgccacgttttttaatgcctttttcctttcctttttttctttttcaccttttttttgttgttactcctgttttttttttttttaactcatgttgcttagtgctgtctgagatctcagcaaggctcagggattaggtggttcagtgcatggtgacacaaacaaaaactggtatagcataaacactattaaatcatgcaggagtctattaaatagaagcagttgtctccggcggataagtgtgttggataggaagtcgggtgcccaatgcccgccattgcccaggcttgcttaggtaaacaaagcagccaggaagctcaaactgagtggagcccaccacagctcaaggaggcctgcctgtctctgtaggctccacctctgggggcagggcacagaaaaacaaaaagacagcagtaacctctgcagacttaaatgtccctgtctgacagctttgaagagagcagtggttctcctagcacgcagctggagatctgagaacaggcagactgcctcctcaagtgggtccctgacccttgacccccgagcagcctaactgggaggcaccccccagtaggggcagactgacacctcacacggctgggtactcctctgagacaaaacttccagaggaacgatcagacagcagcattcgcagtttacgaaaatccgctgttctgcagtcaccgctgttgatatccaggcaaccaaggtctggagtggacatctagcaaactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagagcgcctctcctcctccaaaggaacgcagttcctcaccagcaacggaacaaagctggatggagaatgactttgacgagttgagagaagaaggcttcagacgatcaaactactccgagctacaggaggaaattcaagcaaaaggcaaacaagttaaaaacttagaataaaatttagacaaatgtataactagaataaccaatacagagaagagcttaaaggagctgatggagctgaaagccaaggcttgagaactacgtgaagaatgcagaagcctcaggagccgatgcgatcaactggaagaaagggtatcagtgatggaagatgaaatgaagcgagaagggaagtttagagaaaaaagagtaaaaagaaacgaccaaagcctccaagaaatatgagattatgtgaaaagaccaaatctatgtctcactggtgtatctgaaagtgacagggagaatggaaccaagttggaaaacactctgcaggatataatccaggagaacttccccaatctagcaaggcaggccaacattcacattcaggaaatccagagaacgccacaaagatactcctcgagaagagcaactccaagacacataattgtcagattcaccaaagttgaaatgaaggaaaaaatgttaacggcagccagagacaaaggtcgggttacccacaaagggaagcccatcagactaacagcggatctctcggcagaaactctacaagccagaagagagtgggggccaatattcaacattcttaaagaaatgaattttcaacccagaatttcatatccagccaaactaagcttcattaagtgaaggagaaatacaatccttaacagacaagcaaatgctgagagattttgtcaccacctggccagccctaaaagagctcctgaaggaagcactaaacatggaaaggaacaaccggtatcagccactgcaaaatcatgccaaattgtaaagaccattgaggctaggaagaaactacatcaactaatgagcaaaataaccagttaacatcataatgacaggatcaaattcacacataacaatattaactttaaatgtaaatggactaaatgctccaattaaaagacacagactggcaaattggataaagagtcaagatccatcagtgtgctgtattcaggagacccatctcacgtgcagagacacacataggctcaaaataaaaggatggaggaagatctaccaagcaaatggaaaacaaaaaaaagcaggggttgcaatcctagtctctgataaaacagactttaaaccaacaaagatcaaaagagacaaagaaggccattacataatggtaaagggatcaattcaacaagaagagctaactatcctaaacatatatgtacccaatacaggagcacccagattcataaagcaagtcctgagtgaccttcaagagacttagactcccacacaataataatgggagactttaacaccccactatcaacattagacagatcaacgagacagaaagttaacaaggatacccaggaattgaactcagctctgcaccaagcagatctaatagacatctacagaactctccaccccaaatcaatagaatatacatttttttcagcagcacaccacacctattccaaaattgaccacatagttggaagtatagcactcctcagcaaatgtaaaagaacagaaattataataaactgtctctcagaccacagtgcaatcaaactagaactcaggattaagaaactcactcaaaaccactcaactacatggaaactgaacaacctgctcctgaatgactactgggtacataacaaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagactgctagcaagactaataaagaagaaaagagagaagaatcaaatagacacaaaaaaaaaaggataaaggggatatcaccaccgatcccacagaaatacaaactaccatcagagaatactacaaacacctctacgcaaataaactagaaaatctagaaaaaatggataaattccacgacacacacacgctcccaagactaaaccaggaagaagttgaatctctgaatagaccaataacaggctctgaaattgtggcaataatcaatagcttaccaaccaaaaagagtccaggaccagatggattcacagccaaattctaccagagttacaaggaggaactggtaccattccttctgaagctattccaatcaatagaaaaagaggaaatcctccctaactcattttatgaggccagcatcatcctgataccaaagcctggcagagacaaccaaaaaagagaattttagtccaaagtccttgatgaacattgatgcaaaaatcctcaataaaatactggcaaaccaaatccagcagcacatcaaaaagcttatccaccatgatcaagtgggcttcatccctgggatgcaaggctggttcaatatacacaaatcaataaatgtaatccagcatataaacagaaacagagaaaaaaaacacatgattatctcaatagatgcagtaaaggcctttggcaaaattcaacaacgcttcatgctaaaaactctcaataaatcaggtactgatgggacatatctcaaaataataagagctatctatgacaaacccacagccaatatcacactgaacgggcaaaaactggaagcattccctgtgaaaactggcacaagacagggatgccctctctcaccactcctattcaacatagtgttggaagatctggccagggcaatcaggcaggagaaggaaataaagggtattcaattaggaaaagaggaagtcaaattgtccctgtttgcagatgacatgactgtatatccagaaaaccccattgtctcagcccaaaatctccttaagctcatgagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaagaaatggaagaacattccatgctcataggtaggaagaatcaatatcgtgaaaatggccatactgcccaaggtaatttgtagattcaatgccatccccatcaaactaccaatgactttcttcacagaattggaaaaatctactttaaagttcatatggaaccaaaaaagagcctgcatcgccaagtcaatcctaagcaaaaagaacaaagctggaggcatcaagctacctgacttcaaactatactacaaggctacagtaaccaaaacagcatggtactggtaccaaaacagaaatgtagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaacctgaaactggatcccttccttacaccttatacaaaaattaattcaagatggattaaagacttacttgttaaacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaacgagcttctgcacagcaaaagaagctaccatcagagtgaacaggcaacctacagaatgggagaaaattttcgcaacctactcatctgacaaagggctaatatccagaatctacaatgaactcaaacaaacttacaagaaaaaaacaaacaaccccatcaaaaagttggcgaaggacataaacagacacttctcaaaagaagacatttatgtagccaaaagacacatgaaaaaatgctcatcatcactggccatcagagaaatgcaaatcaaaaccacaatgagataccatctcataccagttagaatggcaatcattaaaacgtcaggaaacaacaggtgctggagaggatgtggagaaataggaacacttttacactgttggtgggactgtaaactagttcaaccattgtggaagtcagtgtggcgattcctcagggatctagtactagaaataccatttgacccagccatcccattactgggtatatacccaaaggactataaatcatgctgctataaagatacatgcacacgtatgtttattgcggcactattcacaagagcaaagacttggaaccaacccaaatgtccaacaatgatagactagattaagaaaatgtggcacatatacaccatggaatactacgcagccataaaaaatgatgagttcatgtcctttgtagggacatggatgaaattggaaatcatcattctcagtaaactatcgcaagaacaaaaaaccaaacaccgcatgttctcactcataggtgggaattgaacaatgagaacacatggacacaggaaggggaacatcacactctggggactgttgtgtggtgggggaatgggggagggatagcattaggagatatacctaatgctaaatgacgagttaatgggtgcagcacaccagcatggcacatgtatacatatgtaactaacctgcacattgtgcacatgtaccctaaaacttaaagtataataataataaaataaaaataaataaataaataaataaaaggaagtcgggtgcccaagttctggcattctgaatttattcttggtctaccacttatagctgcatgaccttaagcaaattactttctgtgcttcagtttcctcctctataaaatggtgatagtaataataatagctatctcatgggttatgagaattaaatatgggaatattatctattttacctagggtttgattcttgctaaatgcagaacctctccagggattaaacagacagagaggacagagctggctttttaaatagtggaagaaacaagtgttggtgctaaacaggtggttagagaaagtgttccatgcttgatgagccagtcaagaagtacagctgtgaggctgggtgcagtggctcatgcctacgatcccagcacttcgggaggccaagttggaagtatcacttgacgccaggagttgaagaccaccctgggcgacaaattgagacctcacctctccacacacacacacaaaaactacaactgtgaggaactagaaatgtaaatgcgaaacaaaaacagcaggatctcagagtacggtggtgtgcatttacctcagctagcaatcctactgtcttgcaaatggcatcagatttcccacgggtcatgtggtaagaaagtatcagtgttaacccaggccaaggaatggtataaatgtggcctctgacttactctttgcctaatagttatccagagtagaaactaacatggatccatttcaaagttacaaaggcagcatgaagtttcataggtagattactaaccaataacttcaacggctaaaaagctatcaggtactaactataatctacaggtcagcaatattttttcaacaaacatttagagaccaccttctgtacaaagcactatggcttgatgctataaaagatataaaaatgaaaatatggaactttacctcagaacacttacagactagaaagatttttttttttttttttttttttgtttttcgagatggagtcttgctctttcacccaggctggagtgcagtggcgctatctcggctcactgcaagctccgcctcctgggttcacgccattctcctgcctcagcctcccaagtagctgggactacaggcacccaccaccacggccagctaagtttttgtatttttagtagagacggggtttcactgtgttagccaggatagtcttgatctcctgacctcatgatccgcccgcctcagcctcccaaagtgctgggattacaggcgtgagccaccgcgcccggcctggaaagatgttttttaagtatacatatgtgcacacatgcgggtgtgtacgaacacacgcactctgaccaccactaccaccatgacatctagtgagtaccaggcactgtgactagccatataatggctttaaatgcatatggttttcctgacacgaagtagcctcagatctcagtctttttggttcttcctactgcctccacaaaagaaaatataatgaataccatgagataagctcagatgaactgtgctttgaaagatccaaagttggagaaactgtttctcagctgcaaataattgagaccatttttaattttttttgagtcactaaattcttctcctttatattaaccatgttcactaaaatcacctgttttgcctgctgcctcagatcatccccaacagactctggctcaatcatcttccactctgctgcaatgctcctgaaaacatcagctccagtgtttaacacttgaatgagacgacgatcatgggataaatgagccaagatcctcagttcaagctgagagtagtcagcagccagtattgaaccacctgaagtagaagtgatttcagaaaagctagtacaaagtttctatatcacacaatccaagttctatatcatataattgagcaggatgacaaaaattttgttctaacttagaactttgaaatcacatgtcaaaagttaaaaccttcctcttaatatgatggaattcagctctgtatcttaggtcatttttttccatgtagctttcaagtatatataatatgggtaaagccaccctgacatctgcccaccgtggagtgtgttcctcagtgttcctacagcacctggcacataatccaaaatggtgctttcatgcctctcttattttgctctgagtacttaagaataggaagcttaattttccttttcattctacagaaaagcttgcacagttgctgatagataataggcccttaacaaatgcttgttgaatgaattaattaatgaaaaaactggtgtccaatgtgtgcaaatgttaagtgggctggagagaaatgtgtgccctgatttgacaataacaaagtcattcagtgaaaaaaatcaagtggtcaacaggtgagcaagttattaaaacgattaaaataatttacctatagattagaaatgggtggattagatatgcatgacaaaacaaaaacaaagttaaaaaaataaaagcagggtcaaagaaaaattagaaaaatatttgcaactgatctcacaaaagactcattgccctttcataagaagagttgttacttgtggaggaaaagacaaactataaataagaagttcagacataataaaaacaaaagaaccttaaacatattaaagaatgctcagcttcataagagaaataaaaaatctatggcaagaaacaatttttcttcacctgtattgcaaaaattacaaaagttggacaacactctgtgacaaggctgaggagaaaaacactcgtacattgttactgagaagtaaaatggaatctcctccccattcgctggcaatttaacagtgtctatcgaaattaaacaggtttttactctatgactcagcaaacaagcccacagactgctgcacagactacctgaacatagtttaaactggtttttgtttaaatgtccttattgataagcacaaatctctagtatagaaacattacagccaggcacagtgtctcatgcctgtaatcctagcactttgggaggccaaggcaggcagatgacgaggtcaggagatcgagaccatcctggccaacatggtgaaactctgtctctactaaaaatacaaaaattagctgggagtggtggagcatgcctgtaatcccagctagtcgggaggctgacgctggagaattgcttgaaccagggagttggaggttgcagtgagctgagatcccaccgctgtactccagcctggtgacagagtgagactccgtctcaaaaaaaaaaaaaaagaaagaaaaagaaacattacatgaaaaaagcaaggtacacaataatgtatacagaatgctaattttgtgtaaaaataggaaaagattatatacccatatttgcttatatctgcataaagaaatactgtcaaaatacataaaaggcctcatacatgtagtaatctataagaattgggaaggatagtgtagatgacagggaaggaagcaaagcttcccaatacacatcttttatatcatgttgatttctgaactatgttaatgaataacctattcaaaaacagagataaatactaatttaaaatacaggttgagcatccctaatccaaaattccaaaatccaatatgctccaaaatccaaaacttttgagcaccaacgagatgctcaaacgtcacgctcactggggcatttcagataatggatttttggattagaaatgttcaattggtaaatattctaaatagtgtaaatattctaaaatcaaaatctaaaacacttctagtcccaagcatttcacacaagggatactcaaactgtaaatggccacaactttggtggacttcctaccacagacaaccacaaaattggacaaattatatgggaaaaaaaaaatggttctcagatgttagacaacaagccatgcagaactataatcactgagaatggaagaaaatgaggtgagccacacaaaggtctcagggatctgaatggaggcattttccagaatctgtagcagggaaagggagctgaagcacagcgctgtatctgtctctgaactaaggaaacacagtctagagtttggggctttgaggcagctggaatttggagagaaaagagttgtgcataaaaggagcaccagaaatacacacaggaattcccttggatttttgaccaaatattaagttgtgcagggggaaagtgcagggcgccaaagaacagacactgaagaaataaatattactaaaggaagaacaaatactgcatagctttcagctgaacaactacttcaacaacatattcttgaatgctgagaaatgatcaagctgtaacaaacaagactgagaagagatcttgttaaacaactttagcaccaagtagactccagaaaggccacaccttatgaacaggaataacctagccctagagtgcaggctactctaaacatttgttagcaaagctttaaaagcctcaaaatgaccaagctgatgtgaaagtaaattgtctgacaaaagaaaaccttatattctattagtgaagactacaaaatccaaagattcaacaaggtggcaaccataacgtccgcatactagcagcaatgcttcaatatttgtttaatttagtgttcattgtggctttgtagaatgcaactaccatgaataacaagaatcaatcacattttacaaaaagcaaaagatcttcaaataacacacctgataaggtttggctatgtctccatccaaacctcaccttgaattgtaacaaaactcacatgtcaagaggtcaggtgaagataaatgaatcatgggggtggtttcccccatactgttctcatggtagtgagtccgtctcacgagatctgatggttttataaatgggagttcccctgcataagctcttgccagccaccatataagatgtcaagatgtccctttgcttctccttcatcttccaccatgattgtgaggcctccccagcaatgtggaactgtgagtccatcaaacctccttcctttataaatcacccagtctcaggtaggtctttattagcagcatgacaacggactaatacaccaccaaacaattacctatagattctataggtaacctaacagtatgatagatcaatcaaattgcaagtgtttcttttttggctttggataaattgtcccataacagagaaactgcttaattaatattctgaataggctttgtctcagtggacttccaaatttataaagaaaacaccattcttagcttacaaaatcaaaccagtggcatagatattttggaatcttttacatttgtcaaagaagaattttaagtagatatgaaaaaattagttttcatcatatagacaatgctctagctttgtcattaaaaacttcttttttttagatttttaaacaggagaatgatgtttccctatttcttcattccactatatatataaaaaagatttatgtttagttttctaaatcagaccatcaaaagtgttacaatacagttaaaattattttatgtatgtgtacaaatgctgagtcatcaccaacttaagaactgttgaaaatttccaacaatgaatttaacaatcttgtatactctgtcaaagctccttgtttgattcatgagagtcctacaaagattaactgtactccagttcaatattttcttgaaacaaaagaacatttgccaagtattcagtaatcaaagacaaaaagaacaatgtggtttatgttttttgactgatatcacacagcatatatttgaggctccaagaaagcgaaaaatgtacttctgacctagctagacaggtaagagaatgtatttggaaatgaaaacttttcataaaacaaattaataatgggctgggtgcagtggctcacacctgtaatcccaataatttgggaagccaaggctggaggatcactcctggaggagcccaggagttccagaccagcctgggtaacatagtgggacccccatctctaccaaaaacaacaacaacaacaacaataataataataattttatgcatttttaaagcataaatcaatatgcagtatagtttaattacaatcaacatgttatataaactgaaaatattaaaaatttttaaaaatgctctgatgttgatgaatttagagtcgcttttttatttaagtaatactcctttgaatttgacatactgtaggtacagcatccctaatctgaaaattcaaaatccaaactgttctaaaatctaaaactttctgagcactgacataatgccacaagtggaaagttccacaaccgacctcttgtaacaggtcaaagttataactttgtttcatgaacaaaatttaaaatattgtataaattacctttaggctatgtctataagatgtatatgaaacataaatttcacattatgacttggatcccatccccaagacatcacattatgtatacacaaatattccaaaatctgaaatacttttggtcccaaggatttgagataaaggatacttaacttgtaataatgagtaacataagaattagtaaatttacttaacttgtatagacattgttttgtaatggatgtttctgcttcaaagtcaaattaatacttctaaaaaaagatgaaccagctttgtcaatcagatgcaattttttaaaaaatgagtttctggtactcaattcagttactggaaatgttttttttcttttttcttttttttttttttgacatagggtcttgctttttcgcctaggctggagtgcagtggcatgatcatggctcactgcagccccaacctccagggctcaagtgacatgatattcccaccacagcgtcctgagtagctgggactacaggtgcgcaccaccatgcctagctaattttttgactttctgtaaagatggggtctccctttgttgcccaggctggtcatgaagtcctggactcaagcgatcttcctgcttcagcctcccaaagtgctgggattacaggtgtgagccaccatgccttgtgagaaatacttttgagtatgtttgaaacaacttgggcgtgtgatctactttttcaaaacataagttttataaaatcaagcataccttgctttattggacttgactttattatgcctcacagatattgcaggtttttttcttaaagaaattaaaggtttttggcaactctgagtggagcaagtgtttcagcaccatttttccaacagcatgtgctcactctggcacattttattaatagtgatgctcacattatttcaaaccctctcattattatctgttatggtgatctttgatattactattattacaatccatgaaccacactcatgtaagagtgaacttcattgatcaattttgtgtgtgttctaactactccactgactggctgttcccccacctttctcccatctctctcagaactccctattccctgagatacaatattaaaattaggccaattaatcaccctacaatggcaatggcctctaagtgttcaagtgaaagggaaagtcgcatctctctcacgttaaaccaaaaagctagaaacgattaagcttatgaggaaggcatgtcaaaagctgagataggttgaaagctaggcctcttgtgccatacagttagccaagttgtgaatgcaaaggaaaagttcttgaaggaaattaaaagtgttactacgctgaacacacaaatgataagaaggcaaaacaggcttattgctaatatggagaaaatttaagtggtctggataaaaaaaatgaaaccagccacaacattctcttaagccaaagtctaatccagagcaaggagactctgatgtactattcagtatgtcaattgcattttcctactccagaatttctatgaaggctgagaggggtgaggaagctgcaaggaaaaaaaaaaaaaaactgattcatgagttttaagaaaactctgttgcacttcagcctgggcgagagtgagactccgtctcaaaaaaaaaaaaaaaaaaagaaagaaagaaattaccatacaccttagccaggcgcagtggctcacgcctgtaatcccagcactttgggaagccgaggcaggcggatcacctgaagttgggagttcgagaccagcctgaccaacgtggagaaaccctgtctctactaaaaatacaaaattagccaggcatggtggcccatgcttgtaatcccagctactcgggaagctgaggcaggagaatcacttgaacctgggaggcagaggttgcgctgagccgagatcacgccattgcactccagcctgggcaacaagagggaaactccatctcgaaaaaaaaaaaaaaaattaccatacaccacatagactttctggggactcccttggataactttgatagaattgtgtatgctgatagtttagacataagtaaaactaaaaattgccaagcaggacatgtcatcataggtctgaattcaccattggcatataagtttctgatggaatttaaataaattcagatggttaattgtactcactaggacttgctagctggtgaaagattaaagaacaaatatgtatactaacagttggaatgatctgcaagttacatcataacttccaaatgtcttgacaacaaaaggtttatgactagagtattgaggaggggtcaggcagaatgagaatagccttaggggccaccccatgcaataggaagcagcagtgcagaaaaagagagaaaaaacataaaagcaaacaagttagaaggagagaaaaactgcccttagaggtcaagggagaagagaaattgaagaaggagttgattaacagtgacaaatgctgtaaacaagttaaagaggatgaagactgacaaaaccaactggactttgcaaagaggtttacaatgacgttagaaaacatggtttcagcagactgctgctgctgagcacacaccataaaagtttcccacagagcagatcatggagatgatgactgctataaacctggcatgacaaaggagaaaggcaggctccaccgtagacagaaagatggagggaccaatgcatgctctaagtctcactcatatttcaggctttatccatgctttgaaaaacattctcacagcaatgagaagcttcaaagctatcagccaccttacctgggaaaggcacaaaggcatgtcgcatgctaattgaaaatggcattcctctgtctgcagctctctcctccatctgtgcctggcatctaggattcacgctgaaacccttcttatattttcctctgtggtgcaaacaacatcatcagttagacatgaagcagtctcaaatatatgaaaaaggtctgattttcagtaacatcagtatttccgtctaagaaacttaataaaaaccttactgagggctgggtgtggtagctcacacctgtaataccagcactttgggaagccgaggcgagtagattgcttgagcccaggagttcgggtctagttagggcaacaaagtgagacccttgtctctacaaaaactagctaggcatggtggcacacgcctgtggtcccagctactcaggaggctgaggtgggaggattgctcgagcccaggaggtggaggttgcagtaagctgagatcgcaccactgcactccagcctgggcaagagagcaagactccgtctcaaaaaaacaaacaaacaaagaaaaccaaatctttatctgagactcactttaaagcttaacaaagatactagaactttttttagcaaacattgaattaaacatgaattagcttctttatagatgggactcaggattcaaaacggtctaggacagaaatgggtatgtctgaaacataaaattaaattaatttcatttatttgtctaataagctattttgagccattcatacttacaaaagtttattaatacagatacagagaaacagcacctacctgcccatgggaagtaggcctttgcctacagcttgagaaggtgggctttctcctactagtgttggcattttgatttcaaaatctcttggcacattctgaatatttggttctgtaaaggttattcgtcctaaaatcaagcagaataaagacataaaatcaggaaaaaaaatctagtatttgtcttaacagtattcacatttctggattatcttaaaaatgcagactatcaatgctgaactgaaatacatttatatttaaatatttttcatcatgttcatgtgtctaacaatgataaaataagtacaagaccatcccaaataaatgaatgtatgaattggctacactactatgttttacacagaaaaccatcgcacaatgagaagtaatttgataaactgaactagtcttatgctaaaatgagtatcagatttcagcactataacatgttagcggtcatattaatgagtaaaggctaatcaaatggatcttaggagaaacaaccactgacgcttctaaaaacaacactttcagacatcatctggctgtttttcttcatcattgtcattcatcaagagaatctacaacagtacttactagaagtactgaatcaggtgagacttgaatcaggtggttaatagtaaattttccagtgaacagaaagctgttttttaaaaaaatgcttataagcctggccaacatagtgaaaccccgtctccactaaaaacacaaaaaattagctgggcatgatggcgggtgcctgcaatcctcagctacttaggaggctgtggcaggagaattgcttgaacctgggaggcggaggttgcactgagccgagatcatgccactgtactccagcctgggcaacagagtgagactgtctcaaaaaaaaaaaaaaaaaaatgcttataaagcctttatttccaaatatattttacatcttttgtttacttattggttgaatttctctaaaacatgaaaacatgttaagtatcactccaaaaaagtttgagaaattttgttactgtgattttttataacactatcagcaacactaaaactctattttatgacacactcttcattgtaacaggctgtctactagctatgtataactccattatcttctgataaatcagaccttttaagtgacttggacgttgtttttttgaatgatcccctaatattatgtctttgtcatttagcttttagcacaaaataagtgctcagttaatgataacctttaacataattgttgacattaaatggcctgttcagtgttacaaagctaacaaacagcagaggaaggcatccaaggctctttttacatcaacacattgtcttcttttctataacacttaatattcagcacactactctggtctattagttgaattaatgaagcaacactggcagaccaaaaaaaatggtaaaaataaattacaaagaatgaatatatagcttaatggatatgaagtatattcatgaaatggctttgctatgcttaagtttgtatttctaaatattataagcattataaaatattattaaaatacatttctaaaatcactaataagtaaaatcagtaataaaatcaaaagaaatgttgcacatttatttgttctttacgaacaaataacaaagcagaaggcttattactgattttatcttctgttttgtaaagaacaaataaatgtgcaacaccattgaaaattctaggttgctgggcgtggtggctaatgcctgtaatcccagcactttgggaggctgaggtgggtggatcacgaggtcaagagattgagaccatcctggccaatatagtgaaacactgtctctactaaaaatacaaaaattagctgaggcaggagaatcacttgaacctaggaggcggaggttgcagtgagccgagatcacgccactgcactccagtctggcgacagagcgagactctgtctcaaaaataaataaataaataaataaaagaaaattctaggttgatgttgtcttttcatcacggaggattttattttacgtaagtttatatcattagcatatgtttcaaagtgaaatttaaataccaacaggacaagatatcactaggatgggacaagtttagaatgtttagaacaagggataaagcaagcagagaaaagcagcacctcatggagcctccgtgctgggtaacagcagcaactgatagtgagcactttctaggagccatgcactattctaaataccctacatctatgaacctatttaatcctcagaattaccaggtggggtgagactgttattaccttattcgtttattggtttatttattgactgagacagggtctcactctgttgcccaggctgaagtgcagtggctcaatcacagctcactgtagccttgatctccgaggctcaagcaatccttctacctcagccttccaagtggctgggactacaggcacaagataccacacatggctaattttttgactttctatagagacatggttttgactttctatagagacatggtttcactatcttgcccaggctagtctcaaactcctgggctcaagtgaccctcccatcttggcctcccaaagtgctgggattacaggcggcagccactgtgcccagcctattaccttgttttatacatgaaaaaaaatgtaggcattgagaggttaagtatcttgtctaaagattcacagaaccaggattcaaaccctgatttctgatgtcaaagcccacattctataccaccaatctaaactgcctgcctcctctatgaatgagttaaagctaccttttcttccactacacatcacatttagcaaatatttagagttttgtactgcctagagaaagaatacatttttcttcataagattacactcttacttatctcaggaggaccatgagataaccaaaggactctacagctttcttttctgcttgggtaaaataagacacttacttatacggatgccccagaggcctactcagattcaacttggagaaatcttaagaggctcaaaaaagggctgggactgaaattagataagaccactgactcaaatatttaattcctgtgtatactcacattgaaagtactgtctcagacatcccagttactctatacaagttcttaaaagcaggaaccaggctgggcgcagtggctcacgcctgtaatcccagcactttgggaggccgaggcaggtggatcacctgaggtcaggagttcgagaccagcctgatcaatgtgacgaaaccccatctctactaaaaatacaaaaattagccagatgtggtggtatgcgcctgtaatcccagctactcgggaggttgaggcaggagaatcacttgaacctgggaggcagaggttgcagggaggtggaggttgcagggagctgagatcgtgccaccgcactccagcctggccaacaagagtgaaactctgtctcaaaataaataaataaataaataaataaaaataaaagcaggaaccaatactcatctctgtacccaggtagtatctatctatgctttggataaagcatgtattttatagttgtaaaacttcaccgaaccccttgatcaacacttgaattcttggccatcataaaaaatattacatatgaaaatgcttttccttcaaaattggatattgtttatacttaagatttctcatcacctgtagcagtgtgcgactgtgatacaggatagattctttccattccaagaaaaggattaagacacttttcccgctgaaggggaaagaccactttggtaatagcattagtgattcttctccattctaatatcaagcctggtaaaggatgtaatgcctttaatttatttaaaacgtcctgccaaaaaaatataaggtaagattgaattcttgtccaaattccacagcaagctagaatctcttttctgtaaataatacagtctcaaaattaaatttgagagtaatatcgacaactcaaaactattacttggagttttttaaaccaccgtattgataaaactataactacagtttacaaaatggaaatgtggtaatactgagcagtatcaatttaaaactacctttttcaaaaaaataaatgaattgtcagtttaacaaagtaactgcctccccacacccgaccaaaagtttattttacaccatctgttttctttatgcattttcctccttcgctcctcacatgactggaagtatcccagttgtttttgtgcttgcccggatacttatacggtttccatatcaaggtaatcaggagacatttatttttaaaactttgaatttttcatactatagactttcagtgaactattaaggaacagaaacttgtgagtaaaagggccagtgagattaaattaaaaattgtgctatagcctggagctaaggaaacttcctaggagcagacaaatcatagataacggtataaggaccacaattctacacaagggcaacttggacagctctgtggctatattttctaccctatttttcccctgaaacatctgtaaaaatgtaaaattaagccccttctctcttccctcccactaatgtgtacagtttccatggattatgattaacaattgtactttgaaattagcagattaaattcttaaatcagggcctggtgcagtggctcatgcctgtaatcccagcacgttgggaggctgaggcgggaggatcccttgaggtcaggagttcaagaccagcctggccaacatggtgaaaccccatctccactaaaaatacaaaaattagccaggcatggtggtacacctttataaacctttacaccattttaatgataggaaggaaggacacaactgctaacttatgattcggattttccatgctggaatatctccacagaatttgtgggctaccaaaccacaaaccaatgtgttaatttatatctgggtaaattcaaatggtaggctaagatgttgatttcatcagcattctttctagacaccaaaatgttaaaagtagtttaggttctgccctgctctgtgactgccccaaagagcaccttactagtgctgaactgtcttcccagccttagcttgcgtccattgtcaatccctcttctggtagaacccagagttttcttgctgccttggtttttcatctctctatttgggggcaacttcaattccaaaaataaaacctgcaagaaattaatgtctctttagtcaagaatgaaacttgcaaggattatcattcagaaaatattttaagttatttcagaaaacaatctctacagttcaacatggattgaaataatgtttctgtggataatttggaattaccatatttaataaatgatggcaatcaaaatttatatgtcaggtagtctatccatactctaattagacactatcagattaattaatactaacacaaggcctttttttttttttttttttgagacaggatctcactgtcacccaggccagagtgtagtggtgtgatcacagctcactctagccttgacttcctgggctcaagtgatcctcccacctcagcctcccgagtagctagggccacaggcatgcaccaccatgcccacctaatttttgtatctttggtagagacaggatttcgccatgttggccagggtggtctcaaactcctaagctcaagcaacccacctgcttcagcctcccaaagtggtgggattatcggcatgagccaccacacacagccagcttttaagcagtcaggaacacaggcacgtatatacactgtgctgagcaactggcaaacaagttattgacattgagacttattgctctaagaattgtgagctctcctaaatgaggctgctcaatcagttaagccccatagatcaacatggaagcttacatggctattgtctcattacaaaaatcagaaaacactaaagtaggaaggggtttgaaaagtcatctagtcccaccaccacaatgctgggccctgatagtccctaggcacaaaaagttaggagaaggtggccaatacaatgtggcaataatgaatgctagagagggccggtagcacccactgaagacaccagaactgtgctgtgtgggaggtggaagaccccatgtaacactcacaagctcagatgagaggggatgaaactagggcaattcagaacattatctactatacctaatcattcacttatatactttgagtgggttttaatgaaccttggattattttcccagtaataattctaaaaattgaaactatttgtgtaagtacaagaatttttcccacaagttgagccaggggtggaagggaagataatccctgtacttctctagaatggtaatgatgacagaaacaatgatctggttccagtttgaactggggttttaggaatgaaaggtactgaggcttactacagatgtcagtaactatttagcccaagaactatgttacacagatatgaacatatgcatgtatagggattagggttgccacatataccaaataaaattacaaaatgcccagttaaatttgagttgcatggggcatacttatactaaattgttatccattgtttacctgattttattgacaaattatagttgtatacattcatggggtacaagatgatgttttgatgtaagtatacaatgtggtgtgattaaattaagctgattaacatattgatcaccacacttagacttatcattttttatggtaagacatttgaaatttactcttagttactttgaaatatataatacgttactattgactgtagtcacccttgtgtacaataaatattagaatcgattcctcctgtttatctgaaactttgtaccctttgataaacaactccccattcccctatctaaaactttataccctttgactagcaactccccatttccccgctccctactcccccagcctctggtaacagctgttccactttccacttcgaggagttcaacttcattggattccacatatagtgagatcatctgaaacatatggtacttatctttctgtaactggcttatttcacttagcataacgtctttcaggttcctccatgttttcaaaaatgacaggatgaaatacaaatttcaaactggatgtgccatattttatcaggcaaccctaatataggtatcaaagggtacatgaatggcagtataggagaaaaaaaaccaagcaactggataggaaaaataaaacactattaaagtaataataaagcagcaaacccaggaagagagacccattatgattaaagacaacacaaatatctcaagttatatatttagaagttctttagcttaagcatttttttgggggggtgaagctttcagaattaactgtgaaacttcacatacaaactaccttccaggtaactgccattttgacatgcaggacgaagaagccaatactatcaaaggccctttactcttagtccaggatttgctcaaggcctgtagcttacatgctttcaggcccatctgaatcacaagggcagcaattcttgcctttgccccaaacctacttgtgctgaaacagagattctatattttctataagttccctatgtaattttatgtgcagtcagctaggtattggcttggggatttgaaaagcagataccaaaaagaaaaaaaaaaggcaccactgaattcaacacatgaataagagaaaccaagttcctcattttcttttaaatatgttaacgaaggaacagaaaatcaaatactgcatgttctcatttataagtggaagctaaatgatgagaattcatgagcaaaaaatccctttttcatttaattcagaaaaatatccagtttcctattctatagaaagatgttagggcaagcaaggaaggggtaagggctcatgaaatgaccaacttcctggaaaaatagctatgctgtcatgcaaccaccagtaccaatcatttcttcaacaaatacttagtgagtccctcctccgttccaggcaaatctccttctcaaggagcttacattctagaagtcctctttattaccttcctttatttgtaaattaaatacagatataatttacaaattagatgctagaatattcccaaagcaatctggttaactggctgtttcattttactgacctttggtgttcaggtaaatacacacacacacacacacacacacacacacaatcattttaactctaaaaattatgtatctatatccctagccccatgatacaacctcagcgatgtcatctgaactggtgaaagaaaaactgtggccagctagttgataggcctgggtctcaattgcatccagcttggcttgcattatatgtttctgactttcacattctgcagtactaaagccaattccatttagttctagcaaggccaagcagtactgagagggcatttccaccttacggaaaacatctggaagaaaaaagaaaattaaaacgttaattcattggctaagtggctagatcagcagccttacctaaactatacagaattcatctaggaaaatccagaaatgctaccaaggtatccttcaggagccagtctcccgagcagcatcctcaagccaacaatgaaaggtggaaaagtacaggctagtttagcactggacaactatccttgtctctgcagagagtagaagagtcggcaatcttgtgactagtctggattacaagagactgtatttctcctaagatgtttctgcttctactcttagcagcagcataacaatcaaccttattttgaaatccaaaatgctccaaaatctgaaactttctgagcactgacatgacaccacaattaggacactccatacctgactttacgtgacagggcacagtcaaaacacaggtgtacaacacaaagtttattcagcgtctctaaaggaaaaaagcccctccttgccccattcagcttcaatatatcttttccgccagacaaccacagactgcctacatgagtgactgagacagtgatacctttgctttctgatggttcagtgtacacaaattttattttgtgcacaaaagtattaaataattgtataaaattatctttaggctatgtctataggtatatatgaattctacatttagacttgggtctcatccccaagatatctcattatatatatgcaaatattccaaaatccaaaaaaatctgaaacgtaaaacacttctggtcccacattttggataaggcagacttaacttatatattaaaggccctgagaggacctgaagcaaagacaactatttaattttattttaagtgaaagtcccaaacttatttgaccattaaacccttttttcatataatacttattaacatcttgaaaagtaagcatccatggaatgtactataggaaatgctgtcctaaatcattaagaaagaatccctaagacttcagcttccagtattgagtcactaggaatctaagcaaccctggcccaccttccccagctccacacaaacattatttgaggcactgctggtctcaatcagcatgagaaatctccagggacacccgtaaccaccacgaaaagcaaagaaacaaatgagagttactggcctctaactacatgcagaaggtacgagaccgtcagagcctggctttagaagcctggaactagtggagaaattcacgttacttgagactagagaaataatgaacttgggtcagaacaggaacaatcagagaagcacaaagtaagagtggcaggaagctagcctgcatccatagccattaggaaggagcaaggtcgttatgggaatggagtcccatagcaaaaaaagttaaggggatatagatccttgaaacaacaacaggatgaggagcagagtctcagactcctgttctgaaacaaaactctcaaaggctactgcggtcctttgatgcagagtagtgtggtacccagcagaggcaggagcaaaacctttctaagggaagatttcccccacgtaagtcctgcagggatccttgatcataataaatcctgtatgaactcacaaaaaatatgaaaaatacaagacagcaaagaaatgtgaataggactcagaagaaacaaccaagaagaaatttagatccccaaaactgcagataaggactagttagaatattgcacaactgtgaatgaactacttacaaaacaaaaagtgactagaaacaaagtaaaatagtaggaaaatagagaacaagtgtatcaataatcaaataagcagaaatacatcaagaatcacaataaattggcaaatttgtaaaaaaaaaaaaaaaaaaaaaaaagttaagcctgaaaagtaaatgagctatactttgtttataagacatgtctgaagatagggacctagaaaggttaaaagggatagaaaaaagctatatgaactaatattaagagaaagctgatgttgccatattcatataagaaaacagactaagaataaaaatcattatttgtaatacagatggtcataatacaataatagaaggtttaattcaccaggaagacaaatcatttttaaacacatacacacctaataaagtggcctcaaaacaaagttaaaattgattgaattacagggaaaattagacatagaatattttaaaaacaactttgacttaacagacatataaaattgtgcatccagaattagagtacacattcttttgtgtgcacatagagcatttacacaacagctcaggttttagataatgaatcgttggctaaaaatttcaagaattagtattatacaaccatgtactcgaactacaacacaattaagtttaaatataataaaaatacaaaataaaagtttctaaatatttgggaattaaaaaccattcttctaaataatttgtgagtgaaaaaatataccagaaatctaaaaatatctagcatgataagaatattatcaggccaggaatagtggctcacacctgtaatcccagcactttgggaggcaaaggcaggaggactgcttgagggcaagagtttgagaccagcctgggcaacatagcaagaccctcatctctacaaaaaaaaaaaaatgtgtgtgtgtgtgtgtgtgtgtgtatacacatcaaaactgtagaatacaataaaagtagtgctttgaggaaaatttatagctatatatatatattttgtttgtttgtttgtttttgtgatacagatcctcactctattgcccagactggagtgcagtggcagaatctctgctcactgcaacctccgcctccggtattctcgtgcctcagcctcctgagtagctgggattacaggtgcatgcaaccacacccagctaatttttgatttttagtagagacagggtttcaccatgttggccaggctggtctcaaactcctggcctcaagtgatccacccacctcagcctcccagagtgctaggattacaggcatgagccactgcacccggctgccttatattcttaagttagaaaagaaaaaaaataatttgagaagtaatggttttaaggtcaaagttatgaatattgaaaaatgactacaaaataaagtcaggggaactagaagaaaacagataatatagatgtggacagaaatcaaggaaatacaaaacaaaagtaataggaagaatcaaaggcaaaggttggttctttgaaaagactagaaaattgggaaaacttcaagtgacattaaataataatattatgaaagaaaaagagaatataacaaataaaccagagacgtaaaaaagagagacttagcaatagctgtatatcaataaatttgaaaatttagatgaaacataaattccttaaaaatatataggttgggaatgtcacagtggagtaataaaaagaaaaaaaagatttggaaaaaaaatatatatatatagcttaccaaatatattcaaaaagaaataactgaataatcttacagttattaaagaaatcaaagttgcagttaaaatatctttctatgtcagatgagaatacctcctggctaacagaaaaattttaaaaataaaacatatctatatctctttctacaaagaaataattatattcaaactaaatctgatagctgtctacattctctccaaaaacttcccttatctcagtgcacttcaattcttgaattctatgaataagaaagcattaacactgtaaaaaatgcatttaatacctcctaaccacccttttttttttgagatggggtctcactatgtggtccaggctggtctcaaacttctgggctccagtgatcctcccaccttagactcctgagtagctgagactacaggcaggaaccactgagccagcctagccacacatttttgaaagtgcagaaaaaaaaaggagctttcaaaagcacattgaaattgtgaaagttaaaaattataataatcaactaacataataagcacctgctctgtgacaaacactgcccatattcactatcttatttaatccttagaacaactttataagaaccagacttacagtttcagtagtttgcccaaagtccctcagctcataagtggataacccagatccaaaccctagtctgtatgaattcatccatctattttctagtacctattgattagtcaataaattcggtcactcctcacaatgaagccaaatttgttctacttcacatctctaccataagcatccgttaagctctctgtagtcagggtgcttgatctgggccagcagataacaatgacaataaattcatgttatttgtcatgagggaaaaaagagactctcatgattatcccttgctgtgaaaaaacatctgtttgttaatagttccaaaaagaaaagagttaactttttgaaatccattaaggatgtcttctaagggtgaataaaaatcctttgataaagttcaaatacaaaattaccaacaactgcataaatgcgattttgtaattctcttcttcacacaagggccagaagtcagcaaattatggccaaactaacattagatgcatgtttttgtaaagtgttattggaagacagccatttgttttggtcttgtctacagctgctcttttgctacaatggcagagttgagtatttgtgatagagattgtttagtttacaaagccaaaaatatttactctctggccttttacagaaaaaaagcactagacaatccaaaggtaggatttgcataaatgtgtaatttacccatttttgataaagagtggctaaatctctatctctaatctataacataaaaatgccagaaacttggtttttaccttgaaggttttccttctgcaacaaagagttgagctgattcatagagttgaagatgagaatggactccacagatgctctgtatcgcccagaatgctcactgccagcatttagccccaggctttgaatcccttggctggtctccatcccttctaggagtggaagctcatgaggaagaaaactggtaactatgctatgaagagtcggctcctgagaatctggatctagtaaccagcatgccacctgaatgggatagcaatgagaatattttcctgatttttttcaaagacacttatgtacctctaaatgaaaagggaaaaaaacaaagctcatttctaacctcactcattttcatttaatatttattcagtggtcttcccaggaaagaaggaaagaataattgtaacaggactcatttttggtagcaacaacagcagtagctttcaaagaaaggaaagttgtaactattccattcctacaatgctcaggccgatccagtttagcagtaggcttgaaaaacaagtgtgtctcagcaaactcaaaccatgtgtctgaaaatgaagatggactcctccactaaggctaatttgggctaagctactgtaataaagatgggcctgtgaggttttaggtatatttagttctttcatcatcaaaagaagtgaggcgccgggcgcagtggctgacacctgtaatcccagcactttgggagactgaggcgggttgatcacctgaggtcagaagttcaagactagcctggtcaacatggtgaaaccctgtctctactaaatatacaaaaaattagctgggcatggtggtgggcacctgtaatcccagctactcaggaggctgaggcaaaagaatcgcttgaacctgggaggcggaggttgcagtgagccgagattgcaccactgcactccagcctgggcaacaagagcaaaacttcgtctcaaaaaaaaaaaaaagtgacgcataaatgttttaccattaaaagtttatatccagagtttcagaaagcctctacactttcccctcagaatggggggggtctgtcaccagaatcatccaattattcatttgattgctatttccaacttcctcataagactaggagtcctgtagtttctaatactagatcaggcagatcattaactggattagaataagggaatctaagccctgttcataattctgacaattactttactatatgactcaattctttcttttgtaggttaagaataaagttttataggggaatattgagtgaaatagtctgatgtaaaagttaacatgtttcttaactgagtcatcattacgaagagtgcatcatactttgctattataaaggaaagttctcaggagccagtaaggggatttgcctctatgctaaatggccactaactacaatcctttttgtcatcttattcacactcttttccaattttctgcctccaccctcatgaatatttaagacctcctgctatcatacacctaaatctgttctcatttcacttccaatttactatcagacagaaaacttaggacttatgacccaaattaaaattttttaaaaatctctgaggaaagacataaactttagggctccaaatttgtgacatctctgtttttatctacacagagatatttggtgcatgatattctattctgggtagatgagattattgaataaagaagtgactactctaaaatacttttaagctgcattattgatgctaagtaaataccaagtcatttaagaattaacactaaaaatgttgttttaagtatataaaaattaaattagacatagaaccttaggatcttcataactttgctccaaggagatgccacaagaaagaagaagaattttatagctctggatgaagtcatagatgacaacagaacattctttatcagattcctttcgcaagcaagattgaaggtaccacatcctgtctttcaaagtcaggcttggatctaaagaaggtggaaccaaactggcactaatttctttaaaaaaaaaaaaaaaaaggaaaaaacatttttaaggcaaaaattacatgcattcatttgaagcagcaatctttagtagaaagactgaaaaagactcagaaggctaagggtctggttccatgtgacgagtaattcagcatcttatccaggtcatatcagctatgtagatgaagtgcatcatatatctaaaaattatgacttgggctagaagatttttaatgctctacttaattaggtgggagaaaatattaaatattaatacttgtaaaaacaaaattacatttcccaaaatgaggagttaaagacaggaaaagtatttggaaatgaattttaaagagagatttagtatgaacacatactattctatccaaaataaaaaaaaagcttaagtaactactcaccccaacatattttcctgcaaaacaactgaaaatatttcatgcttactaaggaacagacactatacagcatcctttaaaatgtttccttattaattttgctcctaaaaaaagcttaagtaactactcaccccaacatattttcctgcaaaacaactgaaaatatttcatgcttactaaggaacagacactatacagcatcctttaaaatgtttccttattaattttgctcctgtccaaaaccaacctatcagctggggtatccaacatccacattcagatcacagggtatttccagattacatcctttccactctaaagacttctccaaagtttatataattcgactactatagatctctagctcaacattccctctagatgagtttcagacccattcaatggtaggacagaagactgaaaataaactgccatcgtttagtcttcaaaagcaaaccctaaaggtggcaagagagtccctgagtcttcactgccccctcagaggaaaaacccatagcatgaatagcctcgtgtgacaggcagggagaagtaaggaagtgcttcttaaaacattaattctagttaatatatgcaataatgtacatgccagctgctctccaaaaaattacaatttttgccaggcacagtggctcacacctgtaatcccaacactttgggaggccaaggcgggtggatcacctgaggtaaggagttcaagaccagcctgaccaacatggtaaaaccctgtctctactaaaaaaatacaaaattagccggcgcagtggcacatgcttgtaatagcagctacttgggaggctgaggcaggagaatcgcttgaacccaggaggtgaaggttgtagtgagccaagatcatgccactgtactccagcctgggcaaaagagtgacattctgtctcaaaaaacaaacaaaaaaaaatttaactctaaaaataaatcctaggtaaatatcaggaaattattctcaaaatataagatcactaccctaatggatgttacagtaattacatagtgacttagccaaatactcattacttaccagaatgcttttgttccttctgcagtgaaaaataataggcatcccttccaccccagcatactgccagtccaaccaccaaggtgtcatcacaacctttaatgggaaatccatcatctctaataggaatttcctgaggtgagctagctaagtaaaacaaaagtgaaacagttaaaaatctctaaaaataaagacattacataaattgttaaaacaattataataaaaaacctatctttgataggcaaaatttccagatcttaaaatatgcatttggacagtcattttaagtataagtaagatctttccaggcttcccatcaattaagataactgtcactatgaaaaagctatcaaggatttgttaaaataaatctataatgattaacgtcaagaaagggaggctgcatttcaaattttataactcaaacaaaaatacagatcatttgcatactacaaatattttgcagcaaattcagcaattcttagctaagaaactccagaaaaataaagactattactccttagtgaagaagcataattttgtatctagagtcaatgttttattcctaaaataatgtatctccaattttataaaggtcaagaatcaatccgtcttattgataattatatccctagtagcaggaaaataactggcacataggaacttagtacatatttattaaatttaggtgaacttttttatccctctagcctctattatatagcctgatacagaaaatgtgctcaattttgtttgttacatcaaaaatggaaagtgctattcaacactaaaagtacataaaagttgtggttaacacatctgcttcatgaattgaaaatcagacaaatactcaaacctttatgaacaaattaattcataaaatagcaaggtttaataaatctaatcaaacacctgatttccacagctgactacaactggtccccacaatccagaaggcagagctcacgcaataagacaggaatatacatagccttatttgaccaaaaggttcaactctctcaaaacctggaagagctctgcaaggttttggaagcaacatttcagtatacaattcatgactatcatggaggtctaagttctactcaagataaatcttggaaaatgtagctaatgtacactgtgaagaacaaagttcctattagcaatgtaattttgtaattacataagcaaacaaggatattacaatttaatagaaaataatttatgaggccgggcatggtggctcacgcctgtaatcccagcactttgggaggccgaggtgggtggatcacgaggtcaggggattgagaccatcctggctaacacagtgaaaccccatctgtactaaaatacaaaataaaaaattagccaggcatgatggcatgcacctgtagtcccagctactcaggaggctgaggcaggagaattgcttgaacccgagaggcagaggttgcagtgagccgacatcatgccactgtactccagcctggccaatagcgagattctgtctaaaaaataataataataataataattcatggggctgggcgcagtggctcatgccggtaatcccagcactttgaaaggccaacacaggtggatcacttgaggtccggagtttgagaccaccctggacaacatggtgaaaccctatctctactaaaaatacaaaaattagctgggcatggtgcacatgcctgtacttctagctacttgggaggctgaggcaggagaattgcttgaactcagaaggtggaggttgcagtgagcgaagatcaagatcacaccactgcactccagcctgggcaactgaacaagacaaagaaagaggaaagaaagaaagaaagagagacagagagagagagagagagagagagagagaaagaaaagaaaagaaaggagaaaaagaaaaaagaaaagaattcatgagcactggtgattaataaaaaccattatgttacaacattaatataccataaaagaaatgtcacgttcatattcaaaatatgtattatctttatttttataaacttttattctaatatatattacatgcacctcttatactggagggcaactatcattaattaatttaggtatgctgaataaataaggctgttctacacataaatccacagaggagatacatactacaacttgaatagattatatttaatatctaacattgagaaatctaactcttatctcagtctactaagtagtttataaatatgaaaaaataaaattaaaaaaattcttaccttgcttaaacctactgccaatagtagcagttttagaagatgtcaaacttctaatcttttcacaagccagtgagatggaaaatcgctttttgcaccgccactccttaatgaatgtttggaaaagattttggtcacttgctacatcaattatggacaaactttctgaactgcttgaggctggagttaactgtaatccatcctgtgataactgaagtgaaaagcttgtgtcactaatagggctgttgtctttgaacccatttctactccctggacttaaatcgtggtttttaatatctgaaggtgagccaaataaataactttcaccaggttgtaaaacattattagttttccaagggtttacaggtgtttcaagaatccctggaaatgtcagcttagaagcagatgttggaatgggtgtaggaggaatgagaccattatcatcaactatattactttctttacgaggtaagagggatgaggtttcatcatgattggcattgttttctagcatctcaatcttgctttttacttcattattagaagaaaatgaaattccctgcacttgttttgtctccaagtttgaaataacttcttgttcttcatttaactctgtattttttctattcaaactggaaaagtttatagtcattgattttagcttttcattttctagaggactggatactttatctaaaatcctttgcagtcctggacttagatcaaatgatgcccctgaccatatgaatgaatgattttgcctggtcccagttaattttgatttttcagccctttcatcttgatctcctccatcttgatcaccttggtggtgctcatcaagtactggatcacttagttctaatgctctaggagatactacagtatgattcttctcttggacaggaaatatatccacattgtccaaagcttcaaccatctgaacagaatccatttctgaaaatataatagattcatcattggaacaagtcaactgctggtgggtatcttgattctcatttacatttgattttttaattaggtcttcttgtagacacagagaatcactaaaatggtttgatgttacttctgaaggaaggggttctttcatttgcatatcaggtaattgttcttttactagatagtcatcactgaagctatcaaatagtaaactatcactcatattcaaacttgtttcaggaactggaagacattctccttctacaccagtgggagttctcttttgaggaatcagaagtataactggtttcacagtttcttgtgtttgataaccttgaagaaaactatttaattgtgaatcagtaacagaaacttcattcttttttaaaaaaagaccattttcctccaatagtattggagaatggaaaatcgggctttctggagtcaggatatcaaccccatgtgaatcactgctttgtttcatagtacctacagtcttaaggtccaaatgatctatcttagtcgctcctagagggtgctgttcagcaggaaaaggaatgtgacactccttctgaaaagagttcattgagttctgttggactaagctcttctgcattatccctgctgccaggttggtgtcctttgctcctagtttggcattttcagttgccatctgttgtattattttctctgactgagtatccagatagaaactatcttcaaaatcacagaggactaaacctaagtcagaaacatgattatttttagttttgtttgttgtataagtacctgttttttcttgtagtctagaaatatttagaaaattctcatgctggccttctgatttgctaaatgctccagctgatggaagtacttcactgggtatcacagttctgcttatatcatctcctaatgcctgaaaatgacttggtttattttcctctgtattaagctttatcctttcacaattgatagtaacatttgagtctctatttatgtaactactgactgcttcacagggcatttgtctctctattatatttttctgtttggtaatagtgcttgtctgttcatgagattgctttcgcaggtactggttaattggatggatgtcatggtgtttcatataaacattctggttttttgaaccattttgtatcagcacttcatttattttttctgcctcaacagctactcctctgcccttttcactaaccacactagtggcctgacaagtcacatttttactctgagatcctgtgacaatatgctccacaaaattatcattagttagtgttatgttccatgaacaattttgctttatttgtaatgggaatgatgttttattatctttttccttaccactcaaagatacatttttagcaaatggccctgaatttctaaattccgttttcttctcatctaaggtaaacgggtcttcacaaagactaggattagacagagtctgtccttgtaaatggattctacacgctccagagtctttcagggggctgctgtccctagatcgctttagatgctttctacgtttccaagatcgaaaacttctgctcatcttttctgaattgaaattcaaaggtgccttttttgttttctgtgaaaaagtctgaacaactttcttatcacttgttttcccctcattctgagaggctcctggcttctctttatttatatctaaagaggcccgttttcttgctctgaaaatggaacatgtctgatgttcttgattcccattctggaaattacaattaaaggaacttgtatgctctctacttttatttaagtcttgcactatatttggtgaatgcttaatataagaatcactaaatattgtgttacttttgttctttgatgttaattttttataagaactcttagtttgggatataaatgtgtgttcctttacttcggactcactatgagtcaatgagcatgtactagaatgtaacagggcacatggattccattgcactcccatttcaactaagtcctgctgcagaatcattctggcttcttccactataagggctgctgcttccctttcagttaaaccttttctgccagtcacccagatagttcgcatattgcgacgttcttcaactgcttcctcttcctcatccactgccttccgggcactacacaaggagatgggaaaagacagaaatgaattcattcattcgtaaggcaagtatttattaaacatgcaatctgagctgttaccaggaactgaaaaaataacaatgaagaagagagagaaatgtatctgctctcatggcacattctagctggggaattcagaaaataaacaaaaagtttaaaatgcattctatattacctggtgataagagttgtatacaaaaataaggcaccagaaaggggtggtgggtggttctgtagtttttaaatggcataataaaggaaggcttcactaagacagattctttaagtagaagcctttaaaaaagtgaaagccataaaactttcattgaaaaacatccggccgggcgcggtagctcacacttgtaaacccagcactttgggagaccaaggaaggcgaatcacttgaggcaacgagttcgagaccagcctggccaacatggtgaaacactgtctctactaaaaatacaaaaaatcagccaggcatggtagcgggtacctgtaattacagctgcttgggaggctgaggcatgagaatcactcgaacccaggaggcgttacagtgagacaagatcacaccactgcactccagccagggtgacagaacaggaccctgtctcattaaaaaaattttttaaaaggctgtgcgcagtggctcatgcctgtaatcccagcactttgggaggccaaggtgggtagatcacctgaggtcaggagttcaagaccagcctgaccaatatggtaaaactctttctctactaaaaatacaaaaattggccgggtgtggtgacatgtgcctgtagtcccagctacttgggaggctaagacagaagaattgcttgaacccaggacgcagaggttgcagtgagccgagattacgccattgcactccagggcgacagagcgagactgtcacaaaaaaaaaaaaaaaaaaaaaaaaagacaagacaagaaagaaaacgaatgcttctgtacaatacacaatataaactctgggcaaaatatatgaagggactagaaaatgaacaaaagaaagcagaaattggagtggggttgagacttggaagaaagaaaatggcagtgggttaattttcactttttacctgaaggcagggcccagtcagcaccctgtaggttggctaaaaacttagataacaacctggagttcactgattgacagaagtcagaagagagttaagagtaactacattagttggaaatttaaggcagtctagaacagataactagagaggaacaactcgtaattcttcatataaactctgcccaaatctctcactgacctctaaaccgtgcaagtgtggacagattccaagtggccagttaaaagtctaaaccaggggtcctcaacccccgagatgcagaccagtaccagtccatggcctgttaggaactgggccgcacagcaggaggtgagctacaggcaagggagcattgctgcctgagctccgcctcctgtcagatcagctgcaggaaaccctactgtgaattgtacatgcaaggaatctaggttgcgtgctccttatgagaatctaattgttttgtttcatcctaaaaccaaaccatctccaccacccccctacccccacctccacccccggtctgtggaaaaattgtcttccatgggcaagagatatgcaagagcaaagaggatagtaaaatactataccccatcccttcccacacaggttaaggtctcagagctgggagtcaggtttaaagtgagtgggagggaagaaacactaattggaaatgagattgatgcttccatctaaaacaaattgtttaatacctgaaaataaaactggttgttagtacctgaaagtaactaaatacctatagaatctgcctgagatttcatataagactgagttcaaaaaacagtggtagaaaaaataattaagctattccttgatttatatactgagtctagcccattcaataaattggttattcagacatacacacaaaaaaataatcaaggaatcttctcacaaattgttttgagggacactagcattccaaagaacatttcagaggaatgtattttaaaatgctcttgcctaaagtgtaagatgagcctgagatatataatgaaatcacatcaaaattatcaaaatccatcaaagcagatcaaaatcaaaatttagcaaagcagaaagcattgataccaaacttttgctcagtacttttttttttttttttgagacacgatcttactctgtcacccaggctggagttcagtggcactatcagggctcactgcagcctcgacctcccgggctcaaccaactctccagcctcacatccccaagtagctgggactataggcacatgccaccatgcccagctatttttttttttttttttttcagttttagtagcgatgagatcttgctatgttgctcaggctagtcttgaactcctaagctcaaacaatcagcctcagcctcccaaagtactgggattacaggagtgagtcactgtgcccagccccactcagacgttctagcaggaatgtttttaagtcatgtattattttttaaatatacaaaataaaaagtaatctgcagccgggcactttggctcacgcctataatcccagcactttgggaggctgaggcagggggattggctgaggtcaggagttcaagaccagcctggccaacatggtgaaaccctgtctctactaaaaatacaaaaattagctgggcctggtggtgggtgcctataatcccagctactcaggaggctgaggcaggagaatcgcttgaacccaggaggtggaggtcgcagtgagccgagatcgcaccattgcactccagcctgggtaacaagagtgagacttcatctcaaaaaaaaaaaagtaatctgcaatggggaaaaagtagccatattttcttccacttacaccaagtatataataagattatttaagagaaaaataactttaatacattatctattattttaaaattgacattttttttttatttcataagcccatgtaggtaaaggtattttcttaccttttgaaaggcacagcatttttcagaatcacctccacctccacaatatttgctctagcaaggtctgccacagtatgaaagccagaagcatagagaaccctggctctctgagcatttagtaaggatacccgaaccaggtcacacagctccctctggatgccaaacgtaagacgcttctgaaattgggaaagtagtagttccatgttgtgccagcccagacggttggaaaatactgtaatcatccctagaacattcatagaatatttgttgaattcaattttttttacagacgaattctccatttctttagatgtatttatattttcttttgttttttccctgcaaaattgtaagatttaacaaggcccaaggtgtaagttaacaagggagcagatatatattaagagccttaactaattggacaataaatgtgctaagttttatgagatgacattaaatgtcatcttatttattcttaatcctcaagttaatacatgaaaactgaggcagagcacataaacacaaaacaaacaagaagccctcaccctaattcattcctctctctctctctttcttaagcaaaagagaactcttaaaaacatgtaaaggtctctctcttcccgccacccaagatgccgaaaggaaagaaggccaagggaacgaaggtggctccggcccctgctgtcgtgaagaagcaggaggctaagaaagtggtgaatcccgtttgtgaaaaggcctaagaattttggcactggacaggacatccagcccaaaagagacctcacccgctttgtgaaacggccccgctatatcaggttgcagcggcagagagccatcctctataagcggctgaaagtgcctcctgcgattaaccagttcacccaggccctggaccgccaaacagctactcagctgcttaagctggcccacaagtacagaccagagtcaaggcaagagaagaagcagaggctgttggcctgggccaagaagaaagctgctggcagaggggacgtccccaccaagagaccacctgtccttcgaacaggagttaacaccgtcaccaccttggtggagaacaagaaagctcagctggtggtgattgcacacaacgcggatcccatcaagctggctgtcttcttgcctgccctgtgtcgtaaaatgggggtcccttactgcattaccaaggggaaggcaagactgggacgtctagtccacaggaagacctgcaccactgtcgccttcacacaggtgaactcggaagacaaaggcactttggctaagctggtggaagttatcaggaccaattacaacgacagataggatgagacccaccgtcactggggcggcaacgtcctgggtcctaagtctgtggctcgtatcaccaagctcgaaaaggcaaaggctaaagaacttgccactaaactgggttaaatgtacactgttgagttttctgtatataaaaataattaaaataatacaaattttcaaaaaaaaaaaaaaagcatgtaaagatgctgggcgcagtggctcacgcctgtaatcccagcactttggaaggccaagtcgagcagatcatctgaggtcaggactttgagaccagcctgaccaacatggagaaaccccatctctactaaaaatacaaaattagccaggcatggcggtgcatgcctgtaatcccagttcctcgggaggctgaggcaggagaaccacttgaacttgggaggcgggggttgtggtgagccgagatcgtgccattgcactccagcctgggcaacaagagagaaactccatctcaaaaaaaaaaaagtaagggactctttccacctagaggaaaacaagagttggtttaaatattcaagtgctgagagaactagaaagagtgaagttcccacctgcattttcttcaaagaaaggttgctgagctcaatagctgcactgtcttggaataaagaaaccaaaacaagtgccatgtcataaagacatttgttgaattaaaattttgttacacttccctacaagaacataaacccctagaggcagtctttcatctttgataccagtgagtctaagagtgagtccctcccggccgggcgcgggtggcttatacctgtaatcccagtactttaggaggccgaggcgggtggtccacgaggtcaggagatcgagaccatcctggctaacacagtggaaccccatctccactaaaaatacaaaaaaaaaaattagccgggcgtggtgccgggcacctgtagtcccagctactcgggaggctgaggcagcagaatggcattaacctgggaggcagagctttcagtgagccgagatggcgccactgcactccagcctgggagacagagcaagactctgtctcaaaaaaaaaaaaaaaaaaaaaaaagagtgagtgcctcccttcctaccactatctcttctcatcttccccgcagtactccctcataagcacatatcttcacgatgaaacctattatacatataacacaccctcttgtagcccatagtttccttcttaagggcttgtaaggattccttagtaaaatcagacccagaatttctcgtttgcttagggtttaatacattaaggcagaccagtggttccttagatcatttttataacagtcagacaggagttcagaaatccctctccatcttccgtccttctcctcaacaatatggattaatcagtacctttttttttttttgagacagagtctcgctctgtcacccaggctagagtgcagtggtgcgatctcagctcactgcaacctctgcctcccgggttcaagcaattctctgcctcagcctccccagtagctgggattataagcgcccaccgccacacctggctaattttttgtattttcagtagagatggggtttcaccatcttggccaggctggtcttgaactcctgacctcgtgatccacccgactcggcctcccaaagtgctgggattacaggcatgagccaccgcgcccggcaatcagtaccttaatgagaaaggggagaccacagagaactttgtttctgtttcttcttgcaacaggaaaaagaaaaggaaaacagaaaggaggatagtcagcaggttgctaaggaatagaggccaagacattcagctagttaccaatcctctgtaacatggtactgagccctgaggagccatagttttgaattttctgatgatgacaagaactgtacaaagttttagcacttttaaagaagcctacaataaaatggaatttgaaaaaaaaagtaatcttaactcgacctcaaatcacagtattaaataaatgtgaaaccctttgtttaactgacctgcataaacagcagctgactgttgcaaagattgaatctgcccacgattgcatccatatttctgatttatttcccttaagggaacttcactgattaaatctaatagcacaagactggtgaaaaacctgggaataaatcatcaaaagcgtggtaagagatccttcacgtctactaggcgatacagtgtgttgaaaaatgactaagaactggaaaggcaacagagggcttatataatacattgtggtgagattcttaatagaaaataggattactggacaaaggctgagatcaatgcttgcaaagcaagttttgacatgcattagtactatagtaaagaactaatgtctgtataacaaaaacctgcccatattcaaaactgctgctaacaagaaatgagacttggttcaagaaatgtgatgacacaaaaattaaaaagataacttgatatacagctacatgtatatcattactccaataaaatgacaatataaatatagcatccaattttgatttgaaaggcaacggtagcaaaagtaatccaagtatataaatccaagtatataaaatttatacttaaccatattataaataatatattagagactgttttttaagaaaaatcatttcattattatttctttttttttgagacggagtctcactgtgttgcccaggctggagtgcagtggcgcaatcttggctcactgcaacctccatctcctgggttcaagcaattcccccacctcagcctcccaagtagctgggattacaggtgcacaccaccacaaacggctaatttttgtatttttactagagacagggttttaccacattggccaggctggtctcaaactcctgacctcaagtgatccgcccactttggcctcccaaagtgctgggattacaggcatgagccactgcacccagccaatttcattatatttcaaagaagctaacagcctgtaccaatttttccacctgaatcttttaattagctcttctcctctattggtaatgaatcacttttaagtatgatataaagcataaccccaggtgaagtcacagtaagttggtggttcttctgatcaacaccttctttacaaaagagaggtaattaaatattctaccttaaaagataaggtctttatatataatggctgctaaactgtgagctgcagaaagaaactaaaataccaataaatttagtaaatacagaaaacttgttgggtgtggtggctcacgcctgtaatcccagcactttgggaggcggaggcgggtggatcacctgaggtcaggagtttaagaccagcctgaccaacatggagaaaccccatctctattaaaaatataaaatgagccaggcatggtggcacatgcctgtaatcccagctactcaggaggctgaggcagcagaatcgcttgaacctgggaggcggaggttgcggtgagctgagatcgcgctattgcactccagcctgggcaacaagaacaaaactccatttcaaaattaaaaaaaaaaagaaaatgaaaaaaaagaaaactgaaaaatcttatactctgccaaaattttgattttattgacaatgaaagtgactacaataaactgggcgtctactacatgcaagacactgtgttaaataccggagagcccagagaccttgacgtttaccttttatggatggccatttgtcgatgctgtctctcagttctggctactacttttcctttcacacaacgggccaagaacccctcttcaactcccactagctctgccacccttttcattgaagttggcaacttctcccataaacagaaaaatcgataccaatcaatagtagtccaatcctcaaacataggtgtaacctaaaaggaagaagtattattcattaactaaaactattatattacaaaaaaccattatatacaaccttcatattaaagacaaaagccaggcatgatggtatgtgcctgtagtcctagctactcagaaggctgagatggaaagattgcttgaacccaaaagtttgaggccacagtgagctatgactgtgccactgcactctagctcaactgaccaggtgagactctgtctctaaaaaaatgaaataaaataaaataaataaaatggctgactgtggtggttcatgcctgtaatcccaatgctgtaggaggccaaggcaggaggatcgcttgagcccaggagtttgaggctgcagtaagctatgactgtgccacatcactccagcctgggcaacagagcaagactccatctcaaaaaaaattacaataaaataaaattacttaaaataaaaagacaaaggcctcaggatttacaaaaatgtctaactgtgataatacctcattcatatggaaacatcatttattcacaaacaatgcactgccaggacaaatggaaagagatcactaagcatacaaactggattttatagaacccaagtctttttttttttttttttgagacaaggtcttgttctatcatccaggctgggatctagttcactgaagcttcaacctcctgtgctcaagcaatcctcccaagtcagcctcccaagtagctggggctacaaggtgagtgccaccacgtctgcctaatttttaaatttttttggtgaaactgggttttattctgttgcccaggttggtctcagactcctggcctcaagcaattctcctgcctcagactctcaaaatgctgggattacaggcatcagccactgcgcccggccagaacctaagtttttaattatagacacttctaatatcaatattctaactgtaggtacaatcttaagtattctgagtaattttcaagaaagaatcaataacatagaggagataagggaagaatcaatattcagagttgatatattacccaaaatgtcaagattcaacaaaaattatgaaacatataagaaataggaaagtatgtctcaaacacagggggaaaagcaggcaaaagaaataaaaagaaatacctttgagagggtccagctattgaaataagtaaagacttcaaagcaaatattataaatatggtaaaaacaaaaacaaaaaccatgcttgaagtaaaaggcatgatgccaatgtctcattaagtagagaatacaataaagacaaaattatttttaaaagaaccaaatgaaaattctggagttaaaagtacaataactggccaggcacagtggctcatgcctataaagccagcactttgggaggctgagaggggaggaccacttgagctcaggagtttgagatcagcatgggcaacatggtgaaacactgtctctacaaaaaaatacaaaaattagccagggatgatggcacatgcctgtggtcccagctacttgggaggctgaagtgggaagactgcttgagcccaggtcaaggctgcagtgagccgtaattgtgccactgtactcttgtttgggcaacagagcaagaatatgtctcaaaaaaaaaaaaaaaaaaaaagtgcagtaactaaaatggggtttattatgttgcccaggttggtcttgaattcttgaactcaaataacactcctgccttggccttggccttccaaagtgctaggattaaaggcgtgagccaccaaacctggacctaaaatggataatttactagagagatcaacagtatatccaagctggcataagaaagaatcagcaaacatgaatagattaataaagactatgcaatctgaaagagggagaggagaaagcagaaaaaatgaacagagtcttaaaggaatatgggaaacattaagtgtaccaacatatgcataatgagtaccaggagaagatagaaaggaaaaggaaaatcatctgaagaaattatggctaaaagtattccaaatttgatggacaacattaacctacatatccaagaaactcagtgaactccaagcaggatacatacaaaggcatccatacaaagacgcatcacagtcaaaacattaaaactgaagaaaaaaaatcttgaaaacagcaagaaaaagtcatcctatgtaagagaaacctgataaggttaagagctaacttctcaccagcaacaagaaggccagtgagatgacatattctaaatgcagtgagatgacatattcaaactgctcaaagaaaaaaaaatctgtcaactaaacattgttttttcttttgaaacagggtctggctctgtcaccctggctggagtgcagtggcacgatctcagctcactgcaacctccacctcctgggcggaagccatcctcccacctcagcctcccaggtagctgggactacagatgcataccaccacacctggctaatttttgtatttttctggtaaagacagagtttcaccatgttgctggtctcaaacttctaggctcaagccatctacctgcctcagcctcccaaagtgctgggattacaggcatgagctaccacgcccagcctcaactaagaatattatataaaggagagttatttttcaaaaataaaaataacaaacatttccagataaacaaaacccgagaaaattttgctagcaaatccattttataagaaatgctaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagctgggcgtagtggcgggcgcctgtagtcccagctacttgggaggctgaggcaggaggagaatggcgtgaacccgggaggcggagcttgcagtgagccgagatcccgccactgcactccagcctgggcgacagagcgagactccgtctcaaaaaaaaaaaaaaaaaaaaaaaaaaaagaaatgctagccaggcgcagcggctcatgcctgtaatcccagaactttgggaggctgggtgggcggggtttggatcacttgaggtcaggagttcaagactagcctggtcaacatggcgaaaccctgtctctactaaaaatacaaaaaaaaattacccaggagtggtggcgcatgcctgtaatcccagggactcgggaggctgaggcatgagaattgcttgaacctgggaggcggaggttgcagtgagcagagactgcaccaccgcactccagcctgggcaacagaatgagactctgtctccaaaaaaaaaaaaaaaagcaaagaaatactaaagaaagctcttcaggttgaaagaaactcaccaaaaccatatttcaattccaaaccaaaaaaagaaagtcaacaaaggaaattatgtgggtacatataaaaacagtatcattacatatttctcttttcttctcctgactgatttaaaaggcaacttataaaacaatatgcatatttttgtactgtattgggtttgtttgttagtttgtttgagacagggtctcactcagttgcccaggctggacacaatctcagctcactgcaacctctacctcccaggttcaagtgattcttgtgcttcagcctcctgagtagctagaattacaggtatgcaccaccacacccagctcatttttgtatttttagtaaagatggggcctcaccatgatgaccaggctggtcttgaactcctgacctcaagtggtccacccgcctcagcctaccgaagtgctgagattacaggcatgagccactacaacctgccaatatgcatataattgaattgttgggtccataacatataaaattcacaatatatttgacagtatcagcccacaggaggcaggtggaagcaaagctgtactggactaaggaaatgacaagagatggtgtcccaaatccatagaaataaatgaagaaaaaaaacacaatcataaataagaatgttaatgaagcaaactctgtaaatgtatatttgctctcctttcttctctcagcttctctaaaaacattaaattacataaaatactaagtataacaacgtactgttaggtttgcaacacataatgatgtaataagtataacaatggcacaaaaaaaggaatcaaaatagagttatttaagaatacttctttatttcactgcaattaagttagtataaattttaagctgtacctgataaacccttgagtaaacactaaaaaaaaaaatggcaaaaaatatagagaaaaatgtacaaaattaaaatgttatagtgttttgtgctgcataatgacatttttggtcaatgacaaactgcatatatgacagcagtcccataagattataatggagctgaaaaattaatattgcctagtgacatcatagtcatcaaatatctagcatgttgcattaccttttctatgtttagaaatgtctagatacacaaatacttaccattgtattacaactgcctacagtactcagtagagtaacatgccaaacaagtttgtagcctagaagcagtaaggttataccatatatcctaggtgtgtagcaggctataccatctacatttgtgtaagcacactctgtaatattcacacaacaatgaaattagctaaagatgcaattctcagaatgtatcactgtccttaagcaataatgactatactagaatatattcccttcattcaaaaaagagcagtaaaagaggtacaggggaacaaattccctgagaataccgactgtagttgaaaacttcaatacccgactttcaacaatgaatagaactactaagaaaatcaaaaggaaatagaagactaaaataacattctaagtcaattagacctaagagacatctatagaactccaccaaaccatagcaaaatgtatagctgtctcttgttatctgtgggggactggttccaggacctcctgcagataacaaaatccatggatgctcaagtctctgatataaaatgatagtgtctgtatataacctatgcacatcctgccatatacagagtaatcatctagcgtaattataatacctaataccacataaatactacgtaaatagctgatatactgtattgtttagggaataatgacaaaataaactgtatgttcagtacagaaaaaaatttttttgagatggagtctcactctgtcacccaggctggagtgcagtggcataatctcggctcactgcaacctctgcctcccaggttcaggtgattcttctgcctcagcctcctgagtagctgggattacaggcgagtgccaccatgcccagctaatttttgtattttgtaattttgtatttttagtacagacagggtttcaccatgttggccaggctggtctcgaacacctgacctcagatgatccgctgaaagaatgaaaagaaaacaaaattgaaaaatatttagctggactgatcaagaaatgatgcaggaagattcaaattactaaaatcaggaatgaaagaggaaccaaccccaccatcctcacataaataaaaaggattataagggaatactatgaacaagtaaatgccaacaaattagataatctacgtggactattttctggaaatacacaaactaccaaaaccgattgaagaaaaaatcgaaactctgaatagttataaaaagtaaaaagattaaattcatcatcaaaacatttactccaaagtaaagcccaggcccaagtggcttgactggtgaaatctactaaacatttaaataacaattaatagcaatctttaacaaattcttcaaaagaaacagaagaggaagaaatatatcctaaatcatactgtgcagttagtattactccaaaaccacacaaagacatcacgagaaaacagaactacaggtcaatatatcttatgacaaaaatactagcaaaccaaataaaatactagcaataaaataccagcaaaccaaatccagcaacataaaaaggattatacaacctaaccaagtcagatactcccttttggaatggaagtatttatccaatgcctgtaaccccattgcatcttgggagtaactaacttagtttttttatttcacaggctcatcagtggaaagcactagccttctctcagatgagactttggacttctgagttaatgatgcaatgagttaagactccgggggactgttgggaagggatgattgtattttggaatgtgagaaggtcatgagatttaggggcccaagtgtagatttatatagtatagatatgtgtccccaccgaatttcatgttgaaatataatctccaatgctggagatagtgcctggtggcaggtgactggatcatgaagaccgtttcttatggtttaacaccaccccacttggtgctgtcgttgcaatggagagttctcgtgagatctggttgtttaaaagtaagtggcacttcccgcctctctctcactctcttcctcttgctctggccatataagatgtgcctgcttccccttcactttctgccatgattggaagctttctgaggcctccccagaagcagaagccactgtgcttcctgtacagcctgcagaatcatgagccaattaaacctcttttctttataaatatcccagtctccataatttctttatagcagtgtgagaatggactaatacagtaagccaaaaagaatagctatgaacactgaaaagcagagcaatgaagggaaacttgccctaccagaaagtttttaattaaaacagaggcactggcacaaaaatcagtcaaactggtcttttgtcagactaacaagtgaaacaggaatatacacaatgacaaatggaattagaaatgtacccaaatacaaatggaaatacagaagataaaagttgccatcttgagtcattgtataaatgaattttttaataaatgatgctgagattacagatagccattatgaaaaaaacatgaaactgaagaaccatgtactagaatacactccaaatgaagcagagctcaaaataggggcaggccaggcacagtggctcatgcctgtaatcccagcactttgggaggccaaggcaggtggatcacctgaggttagaagttcaagaccagcctgaccaatatggagaaaccccatctctactaaaaaaaaaaaaaaaaaaatacaaaattagccaggtgtgatggcgcatgtctgtaatcccagctactcaggaggctgaggcaggagaatcgcttgaacccaggaggcggaggttgcagtgagccgagattgcaccattgcactccagcctgggtgacaagagcgaaactccatctcaaaaaaaaaaaaaaaaaaaatagggggatcacaactatacaattacttgaagaaaatgtgggtgaattccttaataatttcagagcaaaaaaaatttctcactaattcaaaagtccatatattcaactactagacaaaacatacaataagcaaagtcaaaagacaagtgaaaaatcaagaggaaaatcattctacttataccacaaagcaccaatctccctaatatataaaaaaacctttaaaactaaaaacaaaacaaaacaaaaacaaaaacaaaaaaacacacacacaacagaacaatgagcaaaagacatggacaattcactggggagggaggtggggagccctgtacccattagcaatcactctccattttcatccaacctcctcacattcccccagccctgggtaactactaatgcactaaaggtactttttgtttctatagactgccattctggacattttatataaatggggaaaatgttcaaatttactcataatgtaaaaaaatgtaaactaaaactacactcaaaaatacaaaagtttgaccatatactctctacttgtgaagctgtgaaaaaacaactactctaatatatctctggtaaaacaggaaagtgatacaaactctacagaggtcaactttgcaaaaccaaaatcacttatggttttacatttcactctttggttttacattttaccaaaatcacttatggttttacatttcagtctttcctaaagatacacctccataaaaactaaacactgtgtgtaccatgttacttactgaagcataatttgccacaagaaaatattgaaaatgatccaaatgtccatcaatagggaactgatagaataaacaacggtacatccacctacacgacagaattataggttataaaaaagaataaaaaatgaattgatatgaagtgatttccaagatacactgttaagaaaaaaaaaggtataatgtatacagcatgctaccctctgtataaaaaaggtgaaggatatgtatgtctgataatttctgtaaaattaaaaaagagaagagatacattaaaaaatgaatgaaaacagtcatctatgaaaggtaggtggaaaaggcatggaagggatggatataggagtcagacttctctgactattcctgtttatatagttctgacttttgaatcacagaaatgttttatatattcaaaatataaaatagtacatgcaaacactaaatgttttgtctaacttaaaacataaatgtattttaattgccaatgctttgagctaggggtcaaggccttttgagcatgagtctgttgattagaatttaccatggctttcttaaaccataaccacaatatattgtctaagaaatccagtttctgttttgtaatgtgaagttagatattaaagataatcattggctgggtgcaatggctcacacctgtaatcccagcactttgggaggccgaggagggtggatcacttgaggtcaggacttcaagaccagcctggccaacatggtaaaactctgtctctactaaaaatacaaaaattagccaggtgtggtggcatgcacctgtagtcccagctactcaggaggctaaggcagaagaatcgcttgaacctgggaggcagaggttgcaatgagccaagactgtgccactgcactccagcctgggcaacagagtgagactctactcaaaaaataaataaataaataaaaattaaagataactgcaaaataaactttgagcagtgtccttttagtttcctccctgtctaaattcctataactttttctcagagctttcagttatctcacttatatttttttgcttgtttttaagacacgaggtctcttgctgtcaccaaggctggagcatggtggcacgatcatagctcactataacctagaactcctgggctcaagtgattcttctgtctcagccttccaagtagctgggattaccggcatgcaccaccatacacaatttttttttttttttttttgtttggtagcgacagattcttgctctgtttcccatgctggtctcaaattcctggactcaggtgatccttctgcctcagcctaattttctcagaagcaaactgacatgaacaagtttgggaacacaactaactcttgaagggcatacaactcgaatggtgagagaagtatacaagaccactaaccacaagcattcagcatactaacactgccaacagtcttcacgttttagagagggaacaggagtaggagtagttaggtaatttggcaaatgacttacataatgtttatgggagaatttactagaaataatagatgttattaaacatttattcagataccaaacattcatcaaagactatcagccctgaggtgggtattattatctccattttacaaatgaggaaatggaatcgtaagagaggttaaatacttacccaaggttatatgattactaagtgatgaggccaaaagttgaactaaggcagtctgatcctagagcccacaatctcagccactgtataataaatgacttatttttaaggccatgatagatgaccggtgaaacctgctttgagattcctcccagccacattcttgggcacagacctttgagcctattatcacccatgtattatgcgagtttgtaataaaagaaaattggtactgtctagacatttcccctctgctcactacatagcgatttttattgaaacacatttcctgataagcccccttcattctaatgagaatttcaattttactcacctccccttatcacttgcttatcaaaatgcatgcatctgctcttaactgacaaaattaattatttctgatcaggttcttgccagagaacatgaccttaaacactatccaattcttattaatatctttgttatacaaaataatattcacagagcattgtctaatataaacaaacttaaaattccttattgcatttattatagagatttttatcaaacaatgttaagttccaaagtatccttttaggactaaatttctcttaggcagggaaatgcaatgtttttcctaaacttgttttgttttttatcttatgaatattaacactaatcaagctttcctctttcttttagttgctagaaaacccagaatcaaagttgacaacagcattggacatgacttaatggcacgcatgtttgtgtactgacctttgcttgagttttacatcatgatccgatctttaattttctgatatcccatttttctttgctgttcttttatacgttgtaaaaatatatattttttataaaacaactcaaatcttttttgaaaggaggttggagaaaataaatttaaaggtaactagaacatttagattattactttaaaacaattatcttcttacctcttctctattcccaccagtactaacctaggcatggaaaacagacgagatgttctgttagggtatctttgatgttcaggattatatatctatttttttctccctattttcacaaacataattgttaaaacagaacttaccagatagagaatatgaagatcattctctaaaacaaagcccttcattgctctttgcaggtcagcaaaaatatctaaagtatcagctggagaaagtgaagaagaaagagtggccgaaccaagatgtgttggatgatacacctttcctggtttagggttagggtgaggaaacagaggaacaaacattcaaaataaaataaaacaaaatactatctttctgttttccatgctaaccctcccggctgataaattttacaaatagtaccttatccagagcatgaaaatgtatgagcaggctctatcataatggtctgaagttgctaaatacaatactgatttactaaaaatgagttgatacactgctcaaaaaatcaaattccttttatactacatgaaaagacaatttccattcactgagcagtcatacaacctcactaaagaagaaaaagtgagtaaattgcaactgagaagtcacacttaccttctgttccatcactggcttctgtactctggatgaattcattttctagtagccacatcacacaggcctcaatcgctccaagctgaacagactcttgatttctctgaattccttgcttcccttctttcatacttgcagccaaaaatgtgcaggcagcataagtatgcatatcttgtgatgtacttgccactccaccaactattatctgaaagaagatatttggaaatttctgtagctttttaagaaaacatgcaagccaccgggcgcggtggctcatgcctgtaatcccagcactttgggagtccgaggcgggcggatcacgaggtctggagatggagaccatcctggttaacacggtgaaaccccgtctctactaaaaatacaaaaaaattagccaggctggtggcaggcgcctgtagtcccagctacttgggaggctgaggcaggagaatggcatgaacccaagaggcgaagcttgcggtgagccaagatcacgccactgcactccagcctgggcgacagagcgagactccatctcaaaaaaacaattaaaaaaaaaaataaataaaacatgcaagccctctgaatataaaataaagcaagctatttcattctcatttttttaaatgttcttagaatcttaatgtagagattctttatttactttcccatcaccactcactgtaactgttggtaacacctaatgacaacagaaaagttctccttaaagtagataaaatattttcttaaaaagaaaaataagtgggccaggcacggtggctcacgcctgtaatcccagcactttgggatgccaaggcgggcagatcacgaggtcaggagatcaagaccatcctggccaacacagtgaaactccgtctctactgaaaatacaaaaattaactgggtgagccaggcgcagtagctcacgcccgtaatcccagcactctgggaggccgaggcaggcggatcacgaggtcaggagatcgaaaccttcctggctaacacggtgaaaccccatctctactgaaaatacaaaaataagccaggcgtggtggcgggcgcctgtagtcccaactactcgggaggctgaggcaggagaatggtgtgaaatcaggaggcggagtttgcagtgagccgagattgcaccactgcactccagcctgggtgacagagcgagactccgtctccaaaaaaaaaaaaaaaaaaaaaattaactgggtgtggtggcaggcacctgtagtcccagctactcaggaggctgaggcacgagaattccttgaacccaggagccagaggttgcagtgagctgagattgcaccactgcactccagcctggcaacagagcgagacttcatctcaaaaacaaagaaagaaaaagaaatgaatcattaaattcatctgaaattttggataacacagcgagactccatctcaaaaacaaaacaaaaaaaacataaagcaccgggcacagtggctaacacctgtaatcccagcactttgggaggccaaggcaggcagatcacctgaaggctggttcaagaccagcctggccaaaatggtgaaatcccatctctattaaaagtacaaaaattagccagggatgatggtgtgtgcctgtaatcccagctactcgggaggctggggcaggagaattgcttgaacccgggaggcggaggttgcagtgagctgagatcatgccattgtactccggcctgggtaacagagtgagactctgtctcaaaaataaattaaaaaaaataaataaataaagctaagattttcatatactaacattttactaatttaggcataaaagagcaaatggtaatttagtaaattctctcttacctccagaatagctcgtatcatgctgccagttacttcttctccttctcgtctttgcagacagctgcgaacaggctttagagaaccctgaaggagagctatgccttttgatttctcagagttcttacaaattaagatactctcgcctataaccaaaagatacacatttgcaaaatcccaatatagttccataagatatctgctaaagagattttaagttgccttactttgcttaaaagcagacaagagatgatagtggttgttatggtaataaaattatggctattttttgaactttggacagaaggggatcagaatatgccactccaaaatatgccacttcagcataaggattattttgagctgaaggccattgggaagcagcaaacacagaaagaactctttgtcctctccctatctgcctaaaagcaagaataaatttttccctttgtgatgatgttttccattccctctcccacacaggacaacaacccttatcactggagacaggtcagcactgagatgggtctgcacaaacaaactctacctactaaaataacttctatcttccattagtttgccccatatatttaccttctcacaatttgttgcccctagaagcccagataccttttcctttttcttgttgcttctccacaatttactgcccattgttaaaatgttatataagaccccaggttaaacagtttctcaggtcttcaatccttttctataaaggcttccatgtacataaaaattaaaatattagcatcaaataaagtttatatgccttttctcctgttaatctgtcaatttaattagcaggtcccaactgcagaacctaagaaagtagaggaaaagtctttttcttcccctacaggattaaccattattattgaataatgaagtaattaatagaggtactttcaaacctataaagtaaaatgcaaatgtaaattgttaccagttatatgataaaataaattcaaaaatacttgtagatacccaaaatttatattacaacatttactaatctaaatgctttattgtgagaaccaaatgaacaaaaatacatgaaagcacttatatgttaaagccatatacaactatacaatttgaacaaatacaaactattattgcaacaattatgactagagagaatcataatttttcttcaaaaatgaatccaatactgtgggaaagaaagcaggtaagaggttcaaaaagacaaatgaagaatacttttttttttaaataaaactggcacagtgctggaatatccttaccacccgaggcaaagagaaggtacagattatccttcccaattgccaaactgagaatcaagataggataaagtgaagggattataaacttgattatcaatggctgtttatcccagaaatgattataaagataggcaccattaaaaaagcaaaacagccaggcgcggtggctcacacctttaatcccagcactttgggaggccgaggagggcagatcacgaggtcaagagatggagaccagcctggccaacatggtgaaaccccgcctctactaaaaatacaaaaattagctgggcatggtggcacgcacctgtagtcccagctactcaggaggctgaggcacgagaatcacttgaacccaggaggcagaggttgcagtgagctgagatcacgccactgcactccagcctggcaacagagagagactctatctcaaaaaaaaaaaaaaaaaaaaaaaaaaaggaaaacaagatgtcagcaagatggtggtttaggaggctttactacccccctccccagaagcttcaactagcttctatctgcagacaagaacacctttgtgaaaaccccaaaactgccaggcccagtggcttatgcctgtaatcccagcattttgggaggccaaggagtgtggctcacttaggtcaggagttcgagaccagcctaaccaacatggtgaaaccccgtctctactagaaatacaaaattagccaggcatgatggcacattcctgtaatctcagctacttgggaggctgaggcaggagaatcgcttgagccctggaggtggaggttgcagtgagccgagattgtgccactgcactccagcctgggcaacaagagtgaaactccatctcaaaaaaaaaaaaaaaaaaaaaagaggccaggcatggtggctcatgcctgtaattccagcactgtgggaggccaaggtggacggatcacctgaggtcaggagttcaagactagcctaaccaacatggtgaaaccccatctctactaaaaatacaaaattagccaggcatgatggcacattcctataattccagctacttgggaggctgaggcaagagaatcgcttgagcccaggaggtggaggttgcagtgaaccaagattgcgccatcgcactacagcctgggcaacaagagtaaaattccgtgtattaaaaaaaaaaacaacaacaacaacaataaccaaaaaaaaaaaaaaaaaacccaaaacttgggaataagtctgaaacttatgcatagaccacaaaactacataaaaattgcaagatatagtaagataaactatctcactttgacctcatcaccccttccactcccctaagtcagcacagtatcacacagaaaggaatccccagggctcatggcttctacagtgggaaaagaaaaccagagaacacagagcttccctagcattccaagaggcttcccaagaagccaactccagtctcgcctcacagagaacatgctgggtaacagcatggctagatcacctggggtcaggcagaaacaaagcaaggaggtagagctcacggcaaccagcatgcagatcttggtggtagctctgtgtacctgccagtggtggtgcccaatcagaggtaccagctaacagctaaacagtgtagcccaggacaaagccaaactgatcacttctagaagtggtaggaaattctacctggcttgaatctttagatggccagcctccaggcccagcgtcaaagctcatgaggaccctgcccaggaaaggagatgaccatcacagtgcattctggaaagaagcaggggctagttctgccaaacctgggattttaaacagtgctcaagctcagcctcaaggacctgccccaggtggaagatgcctatcatactgtatttttgcaaagtgcagggactagttctgccaagggtggaagtttaaacagccctcagttcagtctcaaagcccactccaagtccccacctaggcagggaggcaaacctcagatgtgcattttttttattttatttttagaggtgggatctctgtcactcacataggagtgcagtggcatgatcataactcactgaagcctgaaactcctgggctcaagcgatccttccatctcagcctcccaagtcactgggattacagtcatgagccaccatgctcaatcatgcatttccactgagcatagcagctggcccactggtccagaatagcaactccacctaacctcgaggcccagcctgcaacactgtccaagtacagatctcaaataggggtaccatctggccaaggaatacactctggggcccagccaagaggcgattgcagtttcaaaccagcaactctgcctgactgcagagctcagcttgtgggttcacctgatagcagagcccagccagcagtcccacccaaactcagagcaaaggcagcagcccaactatctacagaatccaaagcaagctttgcctgctcagggctgctgccagttggcctattcagaatcaaaggctagacaagtgaagttctatccctgccaaagaacacctataaaagccaaagaggtagctgtctcctcaaatgtgcagataccaacacaagaacacagattacaaagaaccaggaagccaagataccttcaaaagaaactaacaaagctccaacaatgaaccctaaagaaatgaagatctgtgaaatgagaaagaatccagaataattatcctaaaaaagtccaatgaactacaaggatatatggataaaaaattaaataaaatttggaaaacaatatacaaacaaaacaagaagtttgacaaagaaatagaaacaataaaaaagaaagagaaatcttagagatgaagagtacaatgagtgaactgaaaaatgcaatcaaagctttagcagcaggctcaatcaagcagaagagagagagattagggagttggagggatgagaagatggtcaaagagtacaatgtttcagttagacaggaagaataaatgataagtatttgggggtgatatgttaactggcttaattccatcattttgcattgtatacagatagcatcactctgtgcctcaaaaatatatacaattataatttgtcaatatccaatttttaaaaatcacatgaatataacacctgactcttgcaatggctacaaaacagcccagcttaagaaagaaaacacacacatataaattacctagaaaatgaatcaactagcattagcagcaagataaacaagccactttgggctgtttaaaggtctttcggggctttgattcttcaacaaaatgaactgcccttttcctgaatgggcaaggtttataaaatgtccaaatgaacatcagtatatatgtacaggttcctgcaaccacctgtctagggaggactcatccacatcacaagagggaagttgaaattatttagaatcaaataatttattactgactgctgaacttacaaatcgctattttggcaccaagcaccatcatcctatactagaagcttctaagtagtctatggaaagactgaagtgtcatctaaataaaacaccatgtgctgtccaggaatataaaatgcacagaatttccaatgatgctacacgatacaaaaagcatgaccaagtatttaagtctccatagtgaatataaaccactatattcctacattcttcattagcttgaagttatgagcaagtcatatgacatcctgaaatacaatgatatgcaagatcaaaagcttggaagtctttaagacctcagaaatgaacttattacagtatattttagttctgtttgagagttgtctgatttaaggcttgataattagcccagggcactaaccttccaattgttctttcccataataaatataagctaagaacataacaaggcaaataagatctcagcttatttcttgtcttatttctccttatcttctacattaactaaaagaccctctgtcccgagagacaattatctatgtaaaatggacttatactccattccccagaggtgtgagtccactgaaaattggggatggacagaggtaggcaaataggaatgggaaggaagaatctcactctcttccctcaactctttttaagcatatacatgcaatctgcatattctgtaggtaaagtaagagagaaacaggataaacgtctctgatgtcagctgtaggaaaaatccaacaaattggaagttttgttttttttttttaaatcatcaaaattttcagggcttaaaagaaaggctgaccaatgcccttcagggattgtaaatgggtcatttattactggtgctgagactgaaagctgttccaatagccatgcacatcttcttaagtattagtggagcacgtggccacccaagctaaagattatatttcccagcctctcttatagttggggaatgtaatcatgtgaaagttctggcccattgtatgtgaagagaaatactatgtgcaacttctgagcagcggccttaaagggcagggcatgctctttgcttcctcatcttcccttcctgatggctgaaatgcagatgtgatgacagagactggactggccatcatataccgaggatagaaactacattgctgaaaatgttaaaacaaaatagaagactaggtccccgacacactacagccatcatataaggcctaaattacaattacatcatataaggcctagaatagaattttactgttatatgagaaagaaattaacatctatcttgttaaacacttattgtattggtttttgttacagcagtgaatttatattctaactaatccagataccaataaattacggtcaatttttggtatttgtggtagtcatgttctataaagctgccacgaacacagaatactgaacccttgctgccaaggaaaacagatgattaggttcctgcaagcctctagtaaaaacattttcatcacttcatcaatacaaaaccttgttttatgcatgtttctgtttaaagacatcttatttaatgtatatagttgtttacattgagctccagccaacagcattataattcatgcctaaagaaaacttatcacatattttctccataaggcacatcacagccttaaggcactagggaacattagatagcatttcagtactttgcttgggggtcatgttaaacagcaaaatcaccaactaaaagcacaaaaatgtgaaaaatatggcactaactagcccattaaaaagaagcttgttcacagtataagagctgaaacaagaacgcagagctttggcttgttcaaccacagcagggaaagtgtgcttggaaagattcaaatttttcgcagatctgcatatgtccacaaaagccccagaggtattatttcgggattctgaataaattctgttaaggtggaaaattcaaatatggaatccatgaataatgagaactgacatatttggggacttcatgtgacaagtcagtttattctaaaagttacttcctcagtgtactacccagcttcctctgcccagaatatccatttcccatccactttccttattctcctggatttcctaatttctcttcagtagccacagaactgtttgcctgttttgtttttttttgacatatctaataaaatactggagtcaattatgtcctacagtagaaagatgacaattatgtcctagagtagaaagtggcagggaatgttcctcccaaggttcttcaatgttagatggctgataatgatttagttacatataatgatacagcacgttagaaataaaatttgctgccgttttgacatttaattcaaacaaacctcttccttactgcttaagacaaaacttttgtttggattgctggtaaaaacaatcataacttgctgatacaaggtaaaaaaaaatgaaaaggtgttttttcagagccagcaccaatttcgagaaaaaagatgggatgtcaagttcctattcccaaagtgtgagggtgcatcccagcatccttgtctgatttctgagaccagtcacctaagttgaattaacatctgtgaaaattaattagtgctaaagagtagactacacctagaaattaaaaatcatcttccagctaagtaataagaagtcatcttgatttacataatactaaatcattttattgtatacaatacgaaagaaaaacttaattcaacatttgtagaaaatcaacagttgatgatatatatatatatatatatatatatgaaaattatgccaggcgcggtggctcaagcctgtaatcccagcactttgggaggccgaggcaggcggatcacgaggccaggagatcgagaccatcctggctaacatggtgagaccccgtctctactaaaaatacaaaaaaattagccgggcatggtggcaggcgcctgtagtcccagctacttgggaggctgaggcaggagaatggcatgaacccggaaggcagagcttgcagtgggccaagatcgcgccactgcactgcagcctgggcgacagagcgagactccgtctcaaaaaaaaaaaaaaaaaaagaaaattataactcatactcactataaatattaagtgaatccaaaatgatgacactagtgcattggataataaagaaatacagcatgatgagaaacaggttgccagacactagtcaaatttcaagtagacactgtccttcagcaatgctgctacaattaaattcaaactcacttacctactgtgtccactcctttcctgccagcacggccaaccatctgcttataagtaagaatatctagaggtcgaccaccaaaaataggggttcgaataatcacacgacgtgcaggtaaattcaccccagaagaaagagtagaagttgccgccaagacccgaatgagaccttgacgaaaggctccttcaatgatatccctctcctcaaaagtaagacctaaaaaaaggaggtttttatatatttattgatatataacgaaaatattatacgtgttcacttacaaatggatttgagagtctgcttcaagcctctgaagatttttgaaactattgttatgactgttgacaaaggagtcatcacagtctatctctttaacagcataatctggccgggcgcggtggctcatgtctgtaatcccagcagtgtgggaggctgaggcaggtggatcgcttgaggtcaggagttcgagaccagcctggccaacatggtgaaaccctgcctctactaaaaatataaaaattagctgtgcatggtggtgggtgcctgtaatcccagctaatcaggaggctgaggcaggagaatcacttgaacctgggaggcagagtttgcagtgagctgagatcacatcactgcactccagcctgggcaacagagcgagaaaacaacaacaacaataacaaaaaaagagtagaatctgctgcctctagtatacctctaccttattttctagaccaggggtccacaaacttttcctgttcctgtggaaaacagcaggtctccgctgcaactatcccaccctgccactgtgacatgaaagcagcaacagaacaaatgggcatgactgtgttccaataaaactttatttacaaaaacagatggtaggctagacttgaccagcagactgtaacttgctaaccactgttctaaacaatgaactccttgtgggtagtgatatgccttattcatcaagatatcttcagggcctatgcatcacattggtcagatatacctctgacataaatacgtgatgaacaaaaacatgagtaaatgaaaaacagtgtatagaatatatacttagctggctcattttcaattttatttaaaaatttaaagggctggggttctagttttaaaattaagtgatgggtacacaggtgttcacttttttagtatgcatcataaattacatacaatgtaaattctgtgtgtgtgtatatagtagttttcccccatctgtggttttgctttctatagttttagttacccaaagtcaaaaatataaagaggaaaattccagaaataagcaactcataagttttaaattgcatgtcctaccacccaggacatgaattatccctttattcagtgtatccatgctgtatacactaccggcactatataatgtgactatataggaaagaacatagtatatagagggtttggtactatctgtggtttcaggcatccactgaggatcttggaacatattcctcacaaaggactactatataccatatatataccccctcacacacacacatttctaatgcatttaaaagttttaacatgctatgaaaaaacatcatatatgtggggctggtactatctatggtttcagatatccactgggggtcttggaacatagcttcagtgaacaaggggagactactatatagaaataagtaaactgaaacaggttcgttttactcttctttaatctatcacacaatttcgctctgtcacccaggttggagtacagtggcacgatctcggctcactgtaacctccgcctcctgggttcaagcaattctccctgcctcagcctcctgagaagctggaattacaggtgcgtgccacaacgcccagctgatttttgtatttttagtagagatggggtttcaccatgttggccaggctggtcttaaactcctgatctcaggtgatccacttgcttcggcctcccaaagtgctgggattacaggagtgagccaccacgcccagcccacacaatttcttaaaaagaaatctaaggacattaagtgtgtttaacaagaaataaatgtacacaaatataaaagttaagacagtatgaggaattttggaggtttcttaataacattataaatatgaaatacctgcatgatgaaatgctactccccatggtacagttttctgtaatacagagtccagtcctgaaggcaaacgtcttaactgatccatcacttccaggagttctttttgttccagaattactggtgggcattcagagggtttcaccaatcctgtcacaaaaaaattatcaacaccatttgcttctaactcagcttctttaagtgtatctgtctaaatcataatagagctaaatagcaggggaatggttctgaaactgctgcatactatataatcccctggagatcttttttttttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcctgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggctggagatcttttaagaatactgatgcctggttcttaatcctggacattgttatataattggtgtgggatgtgacctggacatgaagaatttttaaatctccccaggcaattccaatgtgcgccaaagtttaggaaactgtgtaagggtaagacgaagcccacaggaggggatcaaaggaacctgctgaggaagcagagtattacggatactgattaccactcaaagccccaaaatcaaaacccttgctcaaggtgtgtaccaccaaccagcagtagcagtatcagagggtttcaccaatcccgtcacgaaaaagcctactcctctgtgaaattattcttgcctctttggcattaatctggtagctaattaaatagtaccctctgttttttgtcttctcccccagtaagagcttaacgtttttttgagacagggtctcactctgtcacccaggctggagtacagtggcacaatccctgctcatggcagccttgacctcctgggctcaagcaatcctcctacctcagtctcctggttagttaggaccagacacacgagccactatgcccagctagcatttttttttttcacttgtagagatagggtctccctaggttgcccaggctggtttcaaattcctgggcttaagcaatcctcccaccttggcctcccaaagtgctgagattacaggcatgagccaccacccagccttaactttcttatatgcagtaaaagctttacatacttatatgttgtctttaaaaattttccagacttttggatttttgaacttgtaaaacttttcataaacagtaaatatatggctgggcacggtggctgacacccgtaatcccagaactttgggaggccaaagtgggcagatcagttgaatccaggagtttgagaccagcctgggaaatgtggcaaaatcccatctctaaaaaaaaatacaaaaaaattagccaggcatggtggcatgcacctatagacccagctactcgggaggctgaagtgggaggatcacttgagcccatgaggtagagattacagtgagctgagatcatgccactgcattccatcctggacaacagagcaagaccctgtctcaaaacaaaaataaaaacaaaaaaacaaaaaggaaaataaataaatgtatgttctagaattattatatgtcagttgaaaataaaaatatgtatatttaaatatgtaccttatatttcatacatttttaaatttttaggtaaactttttaaaaaattttaaggaatcacagagagttgccaatgttttattttgctgagggcaattaattttttaaaaccttacctatcaatatttttacttcaaaaaaagacatttaagattaaaaaatgagtaggaataatttcagaatgtaaactgcagctttataaataatgtgctgccttgtctttacttttctgataaaaatctcatcatagaccaggctccagtccaagcaggagcatttgggaaccactgctacaaaccaagataacaaaatctcaagaaaagaaaatgatgatgattctggttattaaggattataaatggccatggtaaaatgtaaggaaataagctaacccggtgtagaaggtaccagttaaggggaaactggaagagatgatacactgttagacaacagcctagccaatataaacttcaggcaaagtttacttgttagagctaggcttgagatttccatcacttatcctcatgatgtgactggtataattaattaataaaatatcctaatattctgtgactagaactggtccctgtcttccttgtatttatcttgagcaccacagactagtaaaaatagtgaggcaacagtgttcactctagaatcagtaaaaatatatactatgattatagccattagtatatactagatcaccatctggcaacaaaaaaggaacaaactgataaattaacaacctgggtgaacatcaatcacaccaggctgagtgaaagcaagctagatacaaaagacacatacatactgtatgactttatttacgtggaatttttagaaaagcacaagtaatctaaagtgacagcaagcagagatcaacagttgcctaagtctggaatagagggaagagacagcaaaagaaaagagaatattttagggtaatgaaaatgttctaggtgttgattatattatggttaaacagatgtatgcatctgttaaaatttatcatatacatacaaaatgggtacattttcttataaataatacctcagagcttattttaaaatacatttgtatatacatgcatgtgcgtgtatatttgtgtataaatacacacacacacacacacacacacacacacacagagttgactgtcaaacaacacaggagttagaaacacagaaacccccagtcaaaaatccgcacacaacttgacttccccaaaagttaactactaataggtggtgtctcacaactgtaatcccagcactttgggagtccaaggcgagtggatcacgaggttaggagatcgagaccatcctggctaacacggtgaaaccccgtctctactaaaaatacaaaaaattagctgggcgtggtggtgggcacctgtagtcccagctactcgggaggctgaggcaggagaatggcgtgaacctgggaggcggagcttgcagtgggccaagatagcgccactacactccagcctgggcaaaagacggagactccgtctcaaaaaaaaaaaaagaaaacaaaaaagagaaaatacatttactattcattaactggaagtagatcatcataaaagtctccatcttcatcatctttaccttgagtaggctgatgaaggagaaacagaaggggttcatcttgctgtctcaggggtggcagaggcagaagtggtggcagtagaggcaggcacgcttggtgtaactttacgcaaatacattataatttctgcctgtttttgctttttcattctctaaaaatgtttatatacggtaccaatcctttcgccatttgctgtcgtttcagtgccgatatcatagaagggtccgtgccataaaaaaagtcagaagcagtcttgaataattagaatcctgccaaattgtctaatgtcaacttgttttatggtactgcttcttctgtgtcttcttactcatcatctggcacttgtttggaagcactcatttccttcaagtcatcttctgttaattcctctggtgtggtgtctactagctcttgaatttctccaagattcatatcttgaaaccctttacctccaccttttttttgccattttcacaatctttttcatgatttcgttcatacctccacctttttttgccattttcacaatctttttcatgattttcgttcaagactttcacaaggttctatcggggttctcttccataatgttgacagtcctttccatagagtacagtgcgtaatgagctttaaacatcctcatgaccccttgatctacagaccaaattagagatgctgtgtttgggggtaagtagatcactttgatgccttaagtgttgaactcaaggggttctggatggcccaaggcattgttcagtatcaaaagaaagttaaaaggcagtcccttactggcaatgtatttcctgacttcagaaacaaagcatcgatgaaacgaatccagagaaggggttctcactctccagtccttcttgtacaaccaaaagactggcaaccagtgtttatctattccctctaaggcttgagtattagctgttttatagacatgagtagtcctgatcataaacccaactgcatttgcacaaaacaagagttagcctatcccttcctgccttaaatcctggtgctttcttctctttcttactaataaatgggttctttgtggcaatttttttttctcagaatagggcactttcatctgcattaaaaatctgttcaggcagatatcctttctcctcaataattttcttaatggtatcttggaactcatctgcagcctcttggtcttgcatctcctgttatcttgacattttttcaaattcatacaaatcaccaaaaaattttccaatatattatgtattgaaaaaaatccacatataaacctctttctaaaattatccaaccatcttttgctggcattaaattctccagctttagatccttttgctttaagttgccatatggacttcattttttctcaaatcgtagtagagtctataggtatgtatttcttctgtgtgtgtgcgtgtgtgtctctgtatgtgtgtgtgtgtgtgcgcgcgcgcacgcacgtgcatctgtggcgacaggatctcactctgccacccagactgagctgagcacagtggcacgatcatggctgactgcaccctttacctcccaggctcaaacgatcctcccacctcagcctcccaagtagctggaactataggcacacatcaccacacctggatatttttttttgagatggagtctcgctccatcgcccagggtggagtgcggtggcacgatctcggctcactgcaacctctgcctcccaggttcaagcaattctcctgcctcagcctcccaagtggctgggactacaggtatgccccaccacgcctggctaatttttatattttttagtagagacagggtttcaccatgttgtccaggctggtctcaaactcctgacctcaggtgatccgcccacctcatcctcccaaagtgctgggattacaggtgtgaaccaccatgcccggcctaattttttaacttttgtagagataaggtctcactatgttgcctatgctggtctcgaactcctggacacaagtgatcctcctgccttggccttccaaagtgctggaattattgacataagccacctcacccagcaggtatgcctttcatatagtgatcctgcagccacataaaactgcattttcaaaatcagatgaagaagtatttcataaaatgtgcaaagctgcagcaatagcttcacaaatttccttctttttttacagtagtacttaagctcgatgcatttatcttaaaatagtaaatgcagctgcagacctcaacttatggtacatagcaagcaattcaattttttcttagaatgccactacttttctctgcttcttcggaacacttccagcatcactagtggcacctcaaattggtcccatggtattattcaaggtttacagtactgcactaaatatgatgaaaagtacataagaaacatgataaattactttttactgcaatatgaaatttatgagacacaaactgctcatatgaaggtgataagcgtcatattttaagtgcatacttacaacacgtgagcttactgcaacagcagcaggaggtggctataaaattattacagtagtagtacagtatataccagttaattttatgcagttatgatttaacactgcctctttacatttgtttacatttttcttctgtgaatggggctatgtatggtctgtgtctgtgtgcctaagttttgataaatatttatttatttattcgagagagggtctcactctgtcacctaggttagagtaaagtggcgtgatctcggctcactgcagcctccacctcccaggttcaagtgattctcctgccttatcctcccatgtaggtaggattacaggtacccgacatcacatccagctaatttttgtatttaggagagatggggtttcactatgttggctgggctggaaattttaattttttttttttttttgagatggagtttcgctcttgttgcccaagctggagtgcaatggcatgatctcagctcactgcaacctctgcctcccgggttcaagtgattctcccacctcagcctcccgagtagctgggattacaggcgtgcaccaccacacccagctaattttttgtatttagtacaaacggggtttcactatgttagccaggctggtctcgaactcctgacctcaggtgatccaccctcctcagcctcccaaagtgctgggattacaggcatgagccaccacgcctggcagaaattttaattcttaataaaagatttgggccgggcacagtggctcatgcctgtaatcccagcattttgggaggccaaggcaggcggatcacttcagatcaggagttcaagaccatcttggctaacatggtgaaacctcatctctacacaaatacaaaaattagccgggcatgatggcgggtgcttgtaatcccagctactggggaggctaagatggaagaatcacttgaacccaggaggcagaggttgcagtgagccgagatcatgccattgtattccagcctaagcgaccgtgcgagactctgtctcaaaaaataataataaataaataatagatttgtgtatattttaaggtagtatgtgataaaatagactagtatctacatatgttttaggctacatgacatacctttttctttttgttttttaatgttttcatgtttctaggctacatagcttgtcagttttttcaaattaacacaaatcaccaaaacattttctaatatattatgtattgaaaaaaaatccacatataaatgaacgcacgcaattcaaacccatgtcattcaagggtcaacttatacatatgtatgtatgtgtgtatgattcttttcagagttacacattcctttggaaatataaagaaagatatggttactttccccaaagaaatgtctacatgtgaagttttgcatccaatttaggggctccaaagatcaaactcttaaagcccatggatccctgataaagaactatagtatatacccagtattctaaaaatctaaagctgattagtctaagcatgtgtgtgtatacatagtctatactagggacggaatattattagaatcgcaaaagcacagtttggtaaaaaggataccacctagtgggcaggcagtgacaatgatgaacaaaagccatgtttttgctaatataatcactaccattactttcaagcaaatgtactaagcatgaaggctttcctttccatccataactcaccctcagcttgatgatgtagattataaaactctcgagcaatgatatctgccagcttctcacaccatttctttgatggacaaaaaagtaatactgaatggttatcacaaatcgtctcataacataaactaacaacatggtcctcatctccctaaaacagaaagataaataaccactttagtggtcctttcaaaagattctcacatcagtttaaaagcactcattttcctttctggggaagctttttcttctttaaggcataatgaaaatcagttacaaagtcaataacaaaagaaaggaaaaaaagaagaaaaaataaactcctaatgatgaaaggtgaaagaaatacttactattcattcaactaatatttactgagctccaaccctcaggcaatgggaatacaatattgagtaaaaagaaagtcaagatcctaatagtcaaggggtttatagtctcaccaagagacacattaaaatacagatatcctcaacttaaaatgattggactttatgatttttttttattttacagtggtgcaaaagcagtatgcactcaatagaaaccatactttgggtgcccatacaactcttctatttttcactctcagcacagtattcgttaaattataagatattaaacactttattataaaacaggctttgtgctaaatgattttgcccaactataggctgatgtaaatgttctgagaacatttaaggtaggctaggctaagctatgatattcagtaggttaaatgtattaaaggcattttcaacttacaatgagtttatcaggatataaccctatcataagtcgaagagcatgtgtactaaataaataaatataaaatacaacaataatatataccattaaaagagagttttacggtgttttgaggcctcatatttgacagaaagatctgaaagaaaaattgtcctgagaaaacaatttagctgagatgtgaaggtggggaaacattatctcaaagaaaggcaacacatttcaaatgaacaaaagggcacatgtgaatccactgtggtggccctgcaagttctccatactggaagtatgtcaatgtatgtattaaaaactggattaatgcatccatctattcactcattaaacaaatatttactatttgtcaaatattgttctaggtactggggatggagctgcgaacaaagcagaaaaaaagctctaccctcataatgtttctactccagtaggaagagatagataattacaaatatgaggtaagtaaaatacataagggacagggcgcagtggctcactcctgtaatcccagcactttgggaggccgaggcctgaggtcaggagctcgagaccagcctgaccaacatggagaagctccgcctctagtaaaaatacaaaattagttgggcatggtggcgcatgtctgtaatcccagctactcgggaggctgaggcaaaagaatcacttgaacccgggaggcggaggttgcggtgagctgagatcgcgccattgcactccagcctgggcaacaagagcaaaactccatctcaaaaataataataataataatatgtttggttttgaaaagtgctaagggaaaagaaatagagaccatgtaagggagaacactataatttagacaagttggccagggaaggtctaagatggtgacatttgagtaaaaaagtccaaaggtgaaagagtaaaccacactgatggccctaaggggaaagtattctagaaaaagagaacctgaggccagaaactcttgttgtattaaaaaacagcagaggccagtgtgaaggaagtgagagggaacatagtagatagagtcagagcactaagaggggtgggggatgtagatcatgtaggaccttatagactactaagaagacactggcttttattctaaatgaaacagaaagccactgcaagtttctgagaagaagggtaacatgatctgatgttcattttaaatagatcactagctcctgtaagcacagactgaaagggacaaggtcagaagcagagagaacaattaggaaatatttcaataatccaggtaagaaatataagtggttcaaaagggtggaggcacagacatggtaaaagaagaaaaaaattaacaggagagcaaatgaatgtgttcacacataaatgtattgaagtaaccaaggcatagccaggcgaaatatggggcacagagcaaagcaagcaagattccataccaagtatgcagaaactacaaatgcatacctaggtagttagtgaaacacatgaatttccaattctatttccaattctaaaatgacccttagctgttttagtactcagaggcacaactctgcacaaaaacagcagatgcctcactccaccaatgtacatgagtcagttctttaacctcaggattaaagtgtatttgggagtatgggagggtacttatttatcaagtaactttctagatgccagataatttttaaaaatcatatttaattcttacaatattcaagatagggattataatatcctatttaacaggtgaagatatgaggttcagataggttttgtgattcaactactatctcagccatatcaagtatctctattaagtatcagaggtagatctatcagactacaaaaataatattttcactctactatatattatacctaccatttaacaaaaaagttaatcttgcacactagcagttagtgtaaactaaaccataagaaaatcttttcccagtaaaaagaaaacgctacaagatcagttattttttttaaatgtttatattatatatcaggaaacaactatttatttaaattaaaggtacaactacatttcctctctcaccatcaccgctaatattttttttggtgggggatggagtcttactctgttgcccaggctggagtgcagtggcatgatctcggctcactgcagcctctgcctcccatgttcaagcaattctcctgcctcagcctcccatgttcaagcaattctcctgcctcagcctcccgagtagctgggattacaggcgcccaccaccacacccagctaatttttgtatttttagtagcgacagggtttcacatgttggccatgatggtctctaactcttgacctcaagtgatccacccgccttggcctcccaacatgttgggattacagacgtcagccaccacacccagctcaccaccaattctttaagaggaaaccagttagcttaatattaatcctaatgtatatgtaactcccaattacatcattcagaatttgttagcaatttgctagaaaatgaaatcaaacacacagataaaaatagtagtgatgtacatatattgatttaccttcacttgtagcatgggctcaaattccctcacaagtttcattgaagagtcatatatggaatttccaacttttactgactccaaaagcggtacagggcgaaagtcggtatggtagagttcagcattcaaccaggaagccacaagctccaaattaggaagggtagcactcatgccaacgatttgcacagcattagacagagaactggctagatctgcctgactgtaaaaaaacaaatgaaaagaacattaaaagatatataatacattaataattagtgttgctaacaatattcttggttatgccctttggtacacacatgcatacatttctttaggatatatacctaagaataaaattactgagccacagattactgagtcacagaagatcttcaattttagtagataatcccacattgttttccaaagtaacacctccacaatctgtgttttctattgttccataatcttgtcaccacttggtattgtcaatctttttaatgttggcagttatagacagtacgtggtagtatttctttttttttagacagggtcttgctctgtcacccaggctggagtgcaatggacctgtctcggctcactgcaacctccgcctcccaggttcaagtgattctcctgccttagcctcccaagtagctgggactataggtgtgtaccaccacacctggctaatttttgtatgtttagcagagacagggtttcactgtgttggccaggctggtctcgaactcccgaccttgtgatttacccacctcggcctcccgaagtgctgggattacaggtgtgagccactgtgcccagccagtatttctttgaagaagtaatttacagttccctgataaccaatgagactactgagcatcacttcatgtgtatgaaccatgtggatacccttttttttttttttttttgagacggagtcttgctctgttgcccactcactgcaagctccgtctcctgggttcctgccattctcctgcctcagcctcccgagtagctgggactacaggcgcccaccaccacgcctggctaattttttgtatttttagtagagacgggttttcaccatgttagccaggatggtctcgatctcctgacctcgtgatccacccacctcagcctcccaaagtgttggaattacaggcgtgagccaccacgcccagccgatactgtttcaaaagcctgtttttttgtccattgatatagtgggttgtgtttttcttattcatttgtagaatttttaaatgtctggatagtgaatttcctctttcattttttgctctgtttttattagtttatcaagctttctgttgcattattttactttttttttttttgagacagggtctagctctgtcacccaggctggagtgcaaaggcacgatcttggctcatggcaacctctacctccagggttcaagtgattcttatgccacctgagtagctgggattgcaggtatgcatcaccacgcccagccaaattttgtatttttagtagagacagggttttgccatgttgggcaggctcatctagaactggcctcaagtgatctgcctgccttggcctcccaaagtgctgggattacaggcatgagccaccatgcttggccttttttctaagttattgggatggataattaaataattgattctcagtctctcttccttaataatatatacactttatgctatcaatttccttttaaaaacaacttttgctgcccttcacaagttttgttaagagatatttttattatactttcagttcaaactattttctaacttctgttgtgattacttttttgatctaaaagtgtgtcaaaaatgtgtttatttctagtcatgtagacatgtcctagttatgcttttcttatagctaaattcactattgttagaaaataaatgatatgaatccattaaaatatgttaagacttgctttatggtccagtatatggaaaactttttgataaatgttccatgtgtaactcaaatgcacaggtactctgctgttttgaggtaattgttcaatatatatccattaggtcaaatttgctgattatattaatcagattttctatatccctagtgatttgggatatagatggttatctgcttgttctatcacaagagagatgtgttcaattctcccttaactgaaaagaatctattgagtacccagcacaatgattaaaaatagaccaacaccaacacacatcagtatgaaatttcacagcactgtggaaaaagaggagtgcctaaaaattcccagacagaatttaaaaaattgtttacaaaggatgaaaaaccagcatagcactgaatttctcaatagcaatgagaaaatgaagtaatgccttgacaactctgaaggaaaagtatttctaatcttgacttttatacctggacagtccataattatggaggccgggcacagtggctcatgcctataaacctagcactttgggaggccgaggtgggtagatcacctgaggtcaggcattcgagaccagcctggccaacatggtgaaaccctgtctctactaaaaatacacaaattagctgggtgtggtggcaggcgcctataatcccagctactcaggaggctcaggcaggagaatcgcttgaacctgggagatggaggttgcagtgagccgagatcacgccacttcactccagcctgggcaaaagagcggaactccatctcaaaaaaaaaaaaaaaaaagaaagaattatgaggcattttcagacatgcaagttctcaaaaagtttatacctatgtgtgttcactgaaataaagtagaagttcctggaagatattcccaccaaaatgagatggtaaatcaagacagacatatggtcaaaaaattggtagggggaagggaatcccaagatgattgctatatagcacatatatagattaaccacctatctagattggaacaacttgaagggcttcaggaaaatcttcaagaagatgactggcagaatagcaaatgtggtagaatacacaactggggaggaggctagggataaattagcagtaagtatctggaaaaccaagccatcaaacaaaaaagacagttattaatttcagagaaaacaaaaagttgtttagaaaagcagaagtaatcatattacactatagcccagttaccaatgtcatttatatagtcataatagtgtaacactgaataatgatctaagcaaaatcataacataactatatttgaagaataggaagataatgagaggataaggagagactgcagagaagggagaagattgggtagtggttagtaaaaaatttaaaagaaagctagatcttcatctttcatagtaaaagtcaagatataaggtctgaaatttaaaaaattaagtagccacaattagagatgctgctgtaaatatttttaaaaagctagaagagttgaaaggtagttgcctctgagaagtgagggctaaaaaaataatatttttttcaaaattagcctgactacttatatatatatagatgacaaatacagaaactagatttttaaaaatctataataaaaatgtatacattgaaaggtgagcagtcagaaaattaagaatgtttacacagtaatctaaaatcagttgcaacctgaaatactttttctgttgttgttagagacatggtcttgctctgttgcccaggctagagtaaagtggcacaatcatacctcattgcagcctggaactcttgggcttaagtaatcctcctgcctcagcctactgagaagctgggactacaggtgtgtgccaccatgcccagctaattttttttattatttatagaaatggggtctcactgtgttgcccaggctggtctggaactcaggctcaagtgatcctcccacatcagccttccaaagtgctgggattacaggtgtcagccaccatgcctggactgacttctggaacaaaaacaaactactatacataagttttctcaataagaaaaatattacactcccttaatttatttaactcatacttatgcatttttcagacacttcctcaacattgtttgaaatctcaggaactcagttatttcacgtacttaccaagatgctgatttccgagtaatatagcaaatcttggtcagcaaaagttccagcagataccctcggtgagagtctcccagcatatgtaattcatccacaaccaccattcctaaaaagattttccagatactaggtttttacagaatgtcacatccatgaagaatttttttccaacctttatttcactctatttaatttcctttatatcaacttttattttagatttgggggtacatgtgaaggtctgttacctgggtatattgtgtaatgctgaggtttggatacaaatgatcccatcacccaggtacttagcaatagtaccctattattaaatagttagtttttcaacccttgttcccttctagtagtccccagtttctgttgtcgctatctttatgtccatgagtactcaaaggttaattcccacttacgagtgagaacatgtggtacttggttttctgttcctgcattaattggcttaggataatggctccagctgcatccatgtggctttgctacaaaggacatgatttcattctttttatgactgcgccaagaagacatttaaaagactcaatatctttgaaataagatattgagatgccaattcttgcctccagaagtagataatagacaagagaaaaacaaatgggacctagagaaatcacaacggctccacttcattccatcaaaaatagcaatagaaagtatttacttattttctaactttcccacacagtgatataagatataatacactatataatacattgcaagtgatgcaaacttcaaaccataaatcaaaaatcatattccttataatgggcaattcttttccaagatgtttcaggtattacaggcagtcgtactacaaggtatactgatctaaaaatcaattattagcttactcagggctaaacaaacccagggaaaactgcctctcattactcttctaaattggcaacttcaccgaaataaacatacaatgaaatatcaaagacatctatgtcagttttcaatgtattgacttttcagtgggaaaacatacatactcatgttagaaagtagcttagaaaaaacataagagggtccagaagaaaaagacaattttaagagtttttttttaatatggtaagctagtgagtcatcatactgcaaaacataaatatgatcacaatgtccttcactacttggagaatttaaccaatgtatatacttggaataattcttaagaattactgaaaattcagtatcaactaatactttctttagttaaacattttcataacaacatagtttccacatgtactggtattctccccaccccaaattctccccaccaaaagacaactttctggtgaaaaggaatttaaggagacaataggaaacttcctaatgacacatgatgttctttttcctatcaataagctgtctccaaaattgtactgtctgatgagttattttagcacttactcattcattcaccaaaaaaaaaaaaaaaaaagtattctgcctgccgtgtgccaagcactgtgctaggtacattggaaatagcacttactacgagtctattgcaactctcaaatatttaaagtccaatggggtcacaagtaataagacaattctgatacaaatcaattgcaatttctctctccaagctttatggagcatagcctatgtctgattcccaccctccacccctaccctaccataactttaccatggtatttttaagttcaccagcttctcaataattagctgatattcttgctacttctgctgctgcaatccttctattcctgttgctacctctacataatggcctttccataatggcaaaaaaatgcattaagatagaaaatcttcccacaatcccaagctcaaatagagtgtcagtttctttagcttcctaccatttccatgctaaatgacagactctgggtccaagcccaaaatagacatcatagcagcagaatataataacaaaaacccatatacactaaccacaaaatggcagatctggcccagcaggcctccttctattcctggtagagtttagataggaaagaagcaaggagaaattattgagggctcaaggatataatctacgttttgtaaagtacaaaaatgcaacgtaacggagtcaataacagcagcaggacacaaaacttataaacacagcgttcctaacattacagatgccaatccttgcctccagaagtagataatagacaataggaaaacaaatgggacctagagaaatcacaacagctccacttcattccatcaaaaatagcaatagaaagtatttacttattttctaactttcttacctaacagatccatcttattttcctctatgaggcgattgatcagaccattggctctctcaattgtgcagactgcaatatccaatgaagagaaatgccttgatggagaggtgctgcccatataaccgtctacttttattcctacttcctgaaacagactctgaattgagtaaaaaggaacaatacaggtgaaaaaacttgaaattcaagagttataaactggttctatcccagaacatagacataagtatctaaagacatctaccagattactgtcatcagttgtttctggccaggacacactggttctttttagatcatatactaaaaatataaagtttagaactgacaaaactgttaagagtcaaataaaattatgccattttaatgacagcataataatctaaaaacttctaagagctatttagaggaattaaaattggagaaaaactaccttaagcactaacatttttaatctaataaatagcaagaaactagctataacacttaaagaaacaaatttatacttcatgaggaaaatagtctcattatcctactaatgaccaattttttaatgtaattggaagaaaagtttttaaaagtcaaattcagtgggactttaataataatttttttttttttagtttaacttttaactaacatacctttcaataaaaaggatcctttcatcatttcgttactttgggtctaagttgagtgatgttaccatgtatgaccagctttgttggctactgtgcctctgaaataactattaaaaagatttatagaaccatagaaatttagagctattcattcaataaaattttcctgagtgtttactaagttaacccacagggctaagggttaacatcctaattttacaaataaaaaaactgaggcccagccagttatatgcccggcctaaagacatagttagtggcaaaactgggactagaacccacatttctttaacaatcagtataacaatctttccatttcaaaagcacatatttttcactgcagaaatcacaacagtaaatttattccatttaataaaatattgtatttgtgaaaatgccctaaaaactgtgagcatcatattgatgtaaactactattagtcatttttgcagaacagaggaacagatcacatacctggagctttacctaagcaccaatggatcttgaccttcatcccctaaatattcctaaatagtcctcaattagggcaggatacacttccttaaacactctttcctttctatgcttcagtctagtcctactgttcagttaaatgctgattcttaatgtgcgtgtttatatgctagtttaaatattctgtttatttcctaagaaaaggtttacaaatttttacacaattttcaccaattattcttttgatttgatggccccttctccttaatgcaataataattttcttttaatttccttctgtaaatttttttaatttttttttttttgagacagagtcttactctgttgcccaggctggagtgcaatagcgtgatctcggctcactgcaacctccacctcccaggttcaagcctcagtctcccgagtagctggaattacaggtgtgcgccacaacacccagctaatttttgtatttttagtagagatggggtttccccatgttggccaggctggtctcgatctcctgacctcagatgatccgcccaccttggcctcccaaagtgctgggattacaggcgtgagctaccacacccagccccttgctgtaaatttttaatgcttttggcagtagcctcttaaagctacatagggcacaatgaagaaactttgttttccacttgcttttataattctatttcaaatgaatgaaaccaagactgccaataatgagcctttcactatttcaaacttagtaaaaaacattacctggaggtagtatttcttctctttagccacagaaacaaagggaagaataaacaaagctttcttccgcatttccaaaacccgcttcaaaataagtaattctgccacaagagtcttcccagcacttgtaggagctaaaacatgattattccacaagattataagaaaaaagtaatattcggtacaattcattaataaatgttttaagccatgtgtagtactacagagcctaaggctaaccaatcactaagggcccaatagcacttaaaatctttataccctgaaatgccctttactttaaaccacctgtcttaatagtctcaactaaaaacagagtaaataaatctttatatcagcaatatgatgaatactactgagtacctagtttatacctaaagatcctttcctttaagtaccaaatgggtaaaaggcctgctttgaggaagtagatgaacaattttattatgataggagctatgatcgaagttgaagaaaagggctgggcatggtggctcatgcctgtaatcccagcattttaggaggccaaggccgggggatcacttgaggtcaggagtttgaaaccatcctggacaacatggtaaaaccccatctctattactataaaaataacaaaaaaaaaaatagctgggcgtggtggcgggcacctgtaatcccagttactcaggaggctgaggcacaagaattgcttgatcctgggaggcagaggttgcagtgagccgagatcaccccactgcactccagcctgggcgacagtgagagactccgtctcaaaaaggaaaaaaaaaaaaaagaagtggaaggaaaaaagttgcaaggaatcttatggaaatgaaacagaatttatgagaaggtaaggaagaaagcaagaggaggccacgatgggcaaggtgttgtatgtctgtaatcccagcatcttgggaggctgaggcctgagaatcacatgaacccaggaagaggaggctgcagtgagttgcagtcacgccattgcactctagcatgggtgatacagtgagactctgttccaaaaaaagaaaaaagaaaggaagaggaaaggaatgccatgcctaagaaacagcatatggtacaaaggcctagaagaaagcctggcatgttcagatgacacagaaggtaatttagtaagcatggagtataaagtaccccaggggtataaaagaagagatatgaaagtgccacaagaaaggtttataatcccaccatttaaggagtttaaaccttgtcctgaaagcaatgcagtgtgactgatgagttttatgaaaaggagtgacaagatcatatttgtactttataaagatcactttggactgggcacagtgaatcatgcctgtaatctcaaaactttgggagaatcacttgagcccaggagttcaagaccagcctggacaacacagtgccacccccatctctacaaaaaatttaaacaaaaattttttttaaaaagaccactttggggccgggcgtggtggcgggcgcctgtatgtaattccagctactccggaggctgaggcaggagaatcacttgaacccgggaggcagaggttgcagtgagctgagattgtgccattgtactccagcctgggcaacaagagcaaaactccatcaaaaaaaaaagaccactttggctgcaggagcagggcaagatcagaggaaaagaatgaactagtttcaaagctattgcataatctagaagaaagatgataatgagctgtaccaggtaatggacctaaaaacagaaaggagtcagaagcaagagatatatgaggtaacagacaccaggacttggtgattaattgtataagctggtgaccagagttctgaatgatacccaagtttcagtttcaagcaattgaaatggtcaagcaattatgccactgccactaactatgacttcttagcatttacaagtattttattttttgtaatgccttttcacaatacaagtactttctatgtgccaaaaactgttctgagcttttatatatgaaataatttaatcaactctaagtactaccgaggcacacatactcacaaacacatatacactctctcactcttcctaagtaatctgtgaggctgcatagccagtaagtgatagttttcaaatccaaccagtctaattccactgcctgaacttatatctgctgataattatttaattcgtccttacagccataatgaaaaatctgtgtgactcataatttcggagaaaactgacacaaaggaattgcatcttaccaaatgattagatttaaagtcagtgtagtaagcatgcgttaaaaattgtgtatgccatagttgcccatgaaaacccatatagggccgggcatggtggctcatgcctgtaatcccaggactttgggaggctgaggtgcgtggatcacctgaggtcaggagttcgagaccagcctgaccaagatgtgaaaccccgtctctactaaaaatacaaaaattagctaggcatggcagcgggcatctgtaatcctaggtactcaggaggctgaggcaggtgaatcacttgaacccgggaggcagagggtgccgtgagccgagacaactccattgcactccagtctgggcgacagagcaagactccatctcaaaaaaaaaaaagaaaacccataaaaattttatataaagtatattacttgttgtttgtatatacaaccctgtacaaacaggtcaatctatagctgggcacggtgactcacacctataatcccagcactttgggaggctaaggtaggcagatcacttgtcagaagctcaagaccagtctggccaacacagtgaaatcccatctctactaaaaatacaaaaaagtagctgggcctggtggcgcacacctgtaattccagctacttgggaggctgaggcaggagaatcacttgaacctgggaggtggaagttgcagtaagcccacatagcgccactgcactccagcctggagacaaactctatctcaagaaaaaaaaaaggtaaattaacaaacatgtaatgataatgctcataccctgaaaagcaaccaggatcaaacaggggaagggcagatttacatctcccattgcacactcactgggatatatgtttgttgagaataatggcaggcagaattgcccactctttaaattgtcatttttcttgcttccctccaccccagtcaaacaataaaacttttgtaatttaaatataaataaaactccacttttcacacatattgtacgattttctctagttataaagcactgcctcattcaccttttaaacgaaccacaactacctcaatagagtattctttacattcatatcttaaaaatagtaattagtttacataaatttggatacctgaataaactaaattctttccttccaggacttgtccaagcaaaaggcactctgcctgccattcaaacatcttttttacaccaaaactgtggtatttttccagaactgctttaggaagtccccagtttgccaatagtagcttgtctctttcgtagtcaggaactgtaggcttgcattctccttttaggaaaaagaaaaaattaaaatttaatttacttctaatatatgagttttacagttagcccttcaccgtgtgttggaattcctatgtgttgaaatgaagctctttaaagcacatcctgacttcaagaatcttatgagaaattgaccatgtatagaaaagtaataaattgttatttactgcatataataaaaattccttaaaagcctcaaacgaacaaaaaagcgtgcaatacacagtagataaagagtgttggaattacgggtgtagttgggggaggagggcaatatgcaagcattacaaagctaagttaggtgagtttctatttatagtaagttttagttccatgacgactgcacaactaacgattttaaaaaactgggtcgacatccacgggacacccaaccaatctcattacgaatcccttccagccttcccctggacgccgaacagcctgtgccgtactccaggcccaacaatcctgtcttaagggtctgtaaggagtactgggtactaccaggaacgagccgcccaacagatgatgggatgaagctaactaggaagttgtttctctaaaggtcgaaagatccagaagccacgtgaacattaataccaggcgatcactgaaaacacgcgtatgtctgaacagaaagtgacctgccacaccaggccccagtcacagagaaggggagtagaagcccaatggggtatgcaacgaagcaagtcccgtggggtgaggacacctcccgacccatggcccggcggagctgcccccgttgcccgcggcctcccgggttcctggagcacctgcagctgcggccttcaggcagcgaccaaggccgggcggcgggctcagcacggacccggagaggaactgggggctggcactgctgtcaccgccgcttcccgagaacgaatctgagcctgattctgaacgccgccgtttcccactccgacgcagaagattcatggcaaactcttctcggccgatcagggcaagccacagtcccagcgtcctccctctcgggagaaccctggcctggcaacagctgcggacatcttcccgccagtcttcaaactcaaacctcccggcccgccc

SEQ ID NO: 148 - DNA, 90745 bp, Homo Sapiens
agctgtgctgcattctgggaagggcgttggtccgtcgctcgcgcagcctcctgggagttgtagtcgcgatcctgaggtaacgggtgagtatcccgcgcggggatcgcttgtccccttggggccttgtcagtcggtgggtgggcttcgtttgacagttgcgtgaccagcccctcggcctcgcttctatccttgccttgtgtgtttatgacgaaccctccgggcttgcgggcccagacgtgagagagctttccgctgaagatgacgggcctgctttccagggcggcttgtcgaaagcccgggagcatctggccgcttccgcctcaaccatgggctggggttttgtgagctactagtgccaagggttttctttccaccagaccaccgctgtaaatctcgagggtcttactcattagaagttagaattcacatttgacgtttaaaggaagaatttccttagtaccttctcacaagcacgcacttcgcatttttagatttctagagtttgctttgtagaaagtaattttgaggttgtcagagaataaatgacgttagaaaggtttttaaagtaaaacaagaatgtgagatgatagcctgggattttctcttggttgtaaatgaatatcttactgagaaccacgttaaccatgcctgcccctcaaagataggaaaggttggatatatagaaactttctcgtattagaaataccgaagtgcagtggttttgtgtgtacaagggattaggcaataggaggctatttttgttttaagactagggttgaattagcagaaagaccaatagaagatctaacaactcttgtcagttgtcaaggataactttgattatgagactttgactttgtagcttcagtaatttcctctcgttagctattttaatatagtcgatttccttgtaattgccaagagtaaaatttgttattaaaccttagaaagagtactttcttactacaaggatgggacgataggagcgaaatttcgagtctaagggaaaacgctggccgagtgtggtggctcacgcctgtaatcccagcacttcgggaggccgaggtgggtggatcacctgaggccgggagtttgagaccagcctgggcaacaaggtaaaaccccgtctctactaaaaatacaaagattagccgagcatggtggtaggtgcctgtaactccagctctttatatcctggtttcaaatctaggcttgatgaccttctcccatatcccagtatcatatttttttcttcctgcatgggggattaattacgattctgaatggttggtagcatgaagctaggttatccctatcgtggcaatggatatttaagtaggcattgccaatatttatcttgctttcttttactttcttctttttctgaccatccacactccatttatattgatgagttcttttactaatatcaattattattatattatgctcatactgccatgtcttattctgcagctttgatccttaaggtgactttgcatatctgtctaggactcctttatctgttgatttttaccatttaagtctccaaagacagctgtatttttggaaaagtgggagggaagaggtagatggggatactcattgataccttaatgcacttcacagctgcttgagaatatgtcagatctcataaaaagttctaacattcgagaataagacagtgatttcagaaatggaatttcaaagggtgtgtaggccaccctttttatcctgtttcctattgtagaaatgagagccaggctaggaatgtttcaagcagaaatattcttactattcaatgaaattgaaaatgtattcccatatcttttactcctatctgtttggtttatgggataaaaacttgttagagtagttggtatttcataggcttcactataacattggaaaatcttttagtctaaaaagcacacagtacggtacaccaatgaacagtattagtgcccactcttggcatgtacacatgttctttctgtcgtttttattttgcttagcttttgagtctcttcctgttactgtgagaaattcttttattaatattttaaaggcatactatataaagcagtgtggtggtatattaggtatcagtagaatcctcttgatagttatttagtaaacgtgttttgcttcctgtttttttctaacctttttattgtttcacttctactataatttcacatccttttcttcttagtcaaataagttgaaaaaatatatttttatagaacatgttgctatggtgatagtttatgaaaatatactttatccctgtttaagatctttattaagatcttgctatatgataatctgactggggtgctataaaagtaagatataaaccacttcttctgtagattcattgttttctagcatttttctgtctaggtattctgacaataattatgtgtagagagtgaataaatatttaaaattgtgtgtgacataggaggttttcagtaaataataactgatgaatgaaataagtttaacttggttgatgattgaagagaagttgtgggaactgcaattaacaaggcccaagaaaaaaatcactaacatgattaaaattggtcagacaccaaagaaccaaataacatcatagccttttgtaagtagcaattatcatttgccaaaggcctacaaaatgtcaaacattgttttaggttcatttgatttattcgctcttcacaaaaatcctgcaaggtagacattattcttactttacatatgaggaaattaacattcaaagaagttaattgcccagatcatcgctagtgaatagtctagtccagactttggaccttaggcgcttgcaatacataacttttaatacatatagaattgattttagattttagaaaagtcactcaggcataatggcacatatctgtagtcctagctgctcagggtgctgaggtggcaggctagcttgaccccagaggtttgaggctgtagtgagctgtgatcatgccagtgcactccagtgtaggtgacaaagtgagaccctgtctcaaaaaaaaaaaaattccaaaaaactattatcccaaattttttaaatgattaaacatttgagaatctgtcagagccagatagattacattctaggtgtgttacatagtttttctttagtttaacagttttcttaaaagaaaattcatccacatgcatttttaaggtgcagtaacatatagccagtttacagctcttttcttgctagtgtacactagcaaatatatgttccaattacgcataaataatttaaatgatctctggagcctcttgcaactatccccttgtcttgtgttgctactaaaaggaaaaacgtattgatttaacctttggtattatcaggaaaaatagtcattgtcatttactatcattttattttttgtatttttggtcattttatgaatagtcctgagaagcagcaataaagggatagtggaaaaacaactttattagaaattataataaaaataaaaacatagcaaacccaaatttttattccatatattcttgaaatagggaggcctcaagcaatcctcctgccttggcctcccaaagtgttgagatttgatgtgagccaacatgccaggcccaatattctttttttatggctaaattccattgtgtatatagaccacatcttctttatccattcatccattgatggttgattccatattttagctattgtgaatagtgctgtaataaacgtgtgagtgcagatatctcttcaatgtattgatttcccttttggatatatacgtagtagtagaattgctagatcatacagtagttgtattttaagttttctgaggaacctccatactgtattccatagtgactgtactaatttacattcccaccaacagtgtagcagggttcccctttctccacatccttgccaccatccattattctctatctttttaataaaagccattttaggccgcccatggtgactgaggtgagaggatcacttgagctgctcaggagtttaaaactagcgtgggcaacgtagtgagacctcgtctctagtataataaaaaaaattttttttaagccattttgactggggtaagatgatagctcattgtggttttgatttgcatttctatgatgattagtgatgttgaacatttttttaatttacctgttggccattagtatgccttattttgagaaatgtctattcttttgcccatttttaaataagattatttttcttttattgagttgtttgagctccttatatattctggttactaatcccttgtcagatggatagtttgcagacattttctcctgttctgtgggttgtcccttcactttgttgattgttcactcagctgtgaagaagctttttagcttgatataatctaatttgtctacgtttgctttggttgtcagtgcttttgtggtcttacacagaaaagtttttggccaggccaagagttgtgcctcatgcctataatcccagcactttgggaggctgaggcagaggattgcttgaccccaggagtttcagaccagtctgggcaacatagggagaccctacttttgcaaaaagaattttaaaagtttaaaaattaaaataaaattaaagaaaaaagtttaaaacattaaaagtttaaaaataaagttaaatgaataaataaaattagctggatgtggtagcacacacctgtgatcccagctactcaggagcctgaggtgggaggattgcttgagctcaggaggtcaagggtatagaaagctgtgattacaccactgcattcaaagccaggtaacagagtgagaccctgtctccaaaaacaaaaaaacaaaataaaacaacttttggccaggccaatgtcctggagtatttcccaaatacatttttctagtagtttcataatttcagatcttacatttaagtttctaatccattttgatttgatttttgtatcaaaaatcaaagagataaggaagaaatatctgagagatagtcttattcttctgcatgtggttatccagttttcccagcaccatttattgaagagactatccttttaccatgatgtgttcttgattgctttgtcaaaaattacttggttgtaaatgtgtggatttatatctgggttctctattctgttccatttgtccatgtgtctattttcttgccagtattatggtcatttggttactatagctttgtagtatattttgaagtcagatagtgtgatgccccaagctttgttcttttcccctaggactgctttggctattcagagtctttttgtggttctatatacgttttaggattctttttctatttctgtgaagaatgtcactggtattttgatagagattgcattgaatctgaaaattgttttgggtagtattgtcgttttaacaatattcttctaattccacaagcttagaatatctttccttttatttgtgtcttcaattttcttcatcagtgttttatagttttcttttacagatctttcacttaagataattgcttcgtattttatattatttgtaactattgtaaatgttatgctctaacagcaaacaacatgaaaaataaatcaagaaagcaatctaaataaaaaaaagtctgtactgacttttgtatgttaattttgtatcctgacactttactgaatttgtttatcagttcttaacagcttttggtggagtctttaggggttttgtaaatataagattatgttgcctacaaagataacttgactccttcctttgcaatttagatgccctttatttctttctcttgtctgattgctgtgaccagggctttcagtattatattagataacagtggtgaaggtgggcatccttgtcttgttccagatcttagaggaaaggctttcaatatttcaccattcagtgtgatgttagctgtggttttatcacatgtggcctttattatttgggaacatgttcctgctgtatccagtttgctgagggtttttatcataaagagatgttgaatttgtcaaatactttttcagcatctattgaaatggtcatatgtttttggttcttgattctgttaatgtgatgtatcatgtttattgatttgaatatgttgaactatccttgcgtcccttggatgaatcccacttgatcatgatgaaggatcttattaatgtgatttgctagtattttgttgagaatttttgcatctgtattcatcagtaatattggcctgtagttttcttttttgttgtgtccttatttggttttgatatcaaggtaatgctggccttgtagaatgagtttggaagtattccctctttaattttttgttttgttttgttttggaagagtttgagtagaagtgagaattagttattcttgaaatgttgggtagaattcagcagtgaagccatcaggttccaggcttttctttgatgaaagactttttattgcagcttccatcttattacttactggtctgttcaggttttcagtttattcatgtttcaatcttggtaggttgtaagtgtccaggaatttattaatttcttctagctattccaatttgttggcgtatagttgctcataatagtatataatgattctttgtatttctgtggtctcagttggtatgtctactttttcatttctgtttttatttatttgaattttctttcttttatttgtctaaagttttgtcaatttcatctatctttttgaaaaaacaacttttgttgacctgtatttttttagtctcaattttatttactgctgttcttatcttcattatttattttcttctactaatgttgggtttggattgttcctgcttttctagtttttgagatgcattgttaggttatttatttgaaatctttctccttttttgatgtagacaattattattgtaaacttctctcttggtactgctacttttgctttatcccatagattttggtattttgtgtttccattgtcatttgattcagaatatttttaaattcccttcttaaatagagacagcgtctcactttgtcacctaggttggagtgcagtggtgtgatcatgacccactgcatcctcaatctccttggttcaggtgatgctcctgcctcagcctcctgagtagctaggacaataggcataacaccaccaagcccagccagcccaggtattgttgtgctgcccaggctggcctcaaactcttggcttcaaacagtccttccaccttgacctctcaaagtgctgggatgataggcatgagccaccatgccctgccaggaacaagtcatttgatttgaacttactccaaattaaatcaaacaattaattaattttttgtattgtttcccaggttcctcttgttaatgatttcaagttttattccattgtggttacaaaagatatgtgatatgatttctacttaattgactttttgagacttgttttgtggcctaagatgtggtctgttctggagaatgtttcatatgctgatgaaaagattgtctgttctgcagcagttgggtgaaatattctataatgtcaattaggcctatttggtctagtttaactcccctgtttctttgttgattttctgtctgtatgatttgtcctttcctgagagtagggtgttgaagtctcctactattattatattgcactctatctctccctttatgtctatcaatatttgctttatagacttgggtattctggtattggatgcttagatattaattgttatatccttttgctgaattgacctgtttatcataatatagtgaccttcttgctcactttttggagtctttgacttatagtcgtattttatctgatatgttagctactcctgctcttttctggtttccccttgcatggaatacctttttccagcccttcacttagagtgttatgtgtgtctgtgtaggtgaagtggatttcttgtgggaattgtatggtttggtcttgtttctttatccagtcatctactctgtgtcttctaattggagacttgagttcatttacattcagtgttattattggtaagtaagaacttattattgccattttattgcatgttttgtggttgttttgtactcctctcttttcctttctgtgttcttttgtggttaagtgattttctctgatagtatgttttaattaattgctgtttatttttagtgtatctattataggtttttgcactgtggttaccgtgaggtttattaaaaagttttagagctatgacaagttattttaaaacaatgacaacttatcttagatagcaaagaaaaaaatagaaactaacaaagaaatttaaaaacttctacactttaactctatcacccctaaaattttgactttttattgtctcaacttacatatttttatattgcctgtctcttaacaggttgctgtagctacgattgtttttaacaagtttgtcttttagacttcatactagaattatgggaggaccaaaaacaattatagtattagagcatcctgggtttatctatgtacttacctttaccagaggattttatttattttatttttgttttcagagacagggtcttgccttgtcaccgaggttggagtgcagtggcataatcatagctcactgtagtctcgaactcctgggctcaaatgattctcccaccttagcctcccaagtatctgggactacaggcatttgccaccatgctcaggtaattagaaaaaaaattttttttagagataaggtcttatgatgttgcccaggatagtcttaaactcctggcctcaggcagtcctcctgacttagctttccaagtagctagtattacaggcatgaaccacagtgcctgtaatagactagcaatgagttttatacctttaaatgttttctttttgcacattttttttctctgagattgaagaactccctttagtgtttcttgtaaaatgagtctggtgatggtgaattttctcagtgcttgtttgtctgggaaagactttatctttccttttttgtagttgaaggatgggtttgctgaatataatattcttcaatggcagttgtttctttcagcactttgaaaatgtcatcccactctctcctggcttatttggttcccattgtggagtctgttgccaaacaaattgaagctcctttatatgttatttgcttttttttaacttgctactgttaagagcctctctttgtccttgacatttgagagtttgattattatatgccttggggtagttttatttaggtcaaatctgttcgtgttctctggcctgaatattgatatttttcttagattttgggaagctttatttttttgaataaactttctactcctgctcttgctcagctccttgaataccagtaattcttagatttagtcttttgaggtgattttctatatcttctaggcaatcttcattcctttttattattttttttcctcatctatgtgttttaaaatagcctgccttctagcttactgattgtttttttctgcttgatccactatgttgttgagagcctctaatgaattttttagttcagcaaacgtatttctcagttccaccaagatttgtttgattttttattgtttcaaactctgttaattttctctgatacatttctagattgattttttgtgttatttgggatgtcactgagtttccataaaatcactattttgtattcatggtccaagagctcacatatcactctctcgttagggttagtcactggttccttgctttgtccatttgaggagataatggtttgctgttgtttcttttggatgtacatctatgtctttgcattgaaacattatttatttattttagtcttctctgactagtttggtttttattggacatgtttgcttagagattctttgtaacttacctgttgaatttctttttttttttctgctaggtcactctgcctcttttttggcactagatggaggcttaattccagctttgcctctgccctagtaaaggatcagagtgttgcctgttaggaattggggaggtcccaaaggtgatatctcagcagtgtagaaaggctggctaggggtttgtgcccaggggacctgtggaacgtacctcctacctagtggtcctgccgaacaagtactctgatttggtgtctcctttgactaagttaaagagcagagtttccaagactgggaatggtagtcctgccttccccatctgtctctgagtgtcctcagggctgtttctccctttgtgtactcatgatgcttcccatggattgggtcagggacaggtcttctgtcaggaccccaagatggtgggggaaactggttgtctacttcagtctcactttttccagtttagacactgtgagtcagggaaattttccacatacttggtgtcaggcaggttgtggggaggggtgtcatagatattgaattctgattctttttctgtctgcttggagtctttttcacttttttgtgtcccttggaaccatttgatctacatatttgagttctgggctattactagcaataatctcagcaccatatatttgtttttggttttctctagtgagggaatgaagccagcttacttctacttactattttggaacccaaaaccggtttcagaactcttaatggtgttaataaaagccactaaaaagaagactgcaaaaatgaggtttctatgcttttctgctttcaaagatgttatactgcggaaaacattttgaaagctgaagtatgatataaaaatgatttcttttcctactggatcatctttttaggtgattccattttatttttaaattattttatttttagcatatctcctaagaaataattcatgagtaatgattaaataaaccctaggatgatgcaatactaaaatacagagcataggaaaaacaggatccctaagattctattatgcatcttaaatttataaagaggatgaatacattcatatagtaattgtaggatagaatcagttttattctgttaaaaaaaaagaatccttttttctttggaagacttctaagaaaataagatataaaatattaatgtttacaaataaatttgctcaaagaagaaactcaaagataaaagacactggtggtatataatgactaatgtaactacgttcttcaattttattttacaaccaaagctgagctgatttatatttccttcccctgtctcagggttagctgttgtaattcattacaaaataagaataatttgcctaaataagatactctttatcttaaaggtcaaagcacatcataatatactgctagttgatttatctttgtccaatctagtaaaattttttgcatttaaaaatagaaaatattatatatgatgtatttagtaaacacctatccattgggatatctgaatgtcattttagttagaaatacctaaagtattaaaatcatttttcaggtttccacataagaaaggtatgtctgtcatgtagatcgcactgtagaaatcagttcatagtagaaccatactgtgtaaattgcaatctaagagaattatcaaggaccaaagtaaagtcaaggggatcaatgactaatatgcagtaatatttaccttagccctcaggcagatatgtgaaaagatgtgtaaagttaagaaatacctgtaaactccagatacaaaggctttctgcaaacaaagacctttgcttctttctaggaatttttgctggttttactgtggaatgagaacccaaactgttttgtgattaagttaaacaggtacatgattcaagcagtaggttttgtaggttatattcttgaaagaaggcctgggaatttttgaagccttggaaagccttgggtttttttgttggtttgtttttcacttgagagtgtttttaaactagaaaacaatttaaatatatgcgtgatgaggattctggggaggtgaggaaggcatctttgttgcatgtcagagacagataaaactttcacattgtaggctgggcaccatggcttacacctgtaatcccagcactttgcggggccgaggcaggcagatcacctgaggtcaggagttcaagaccagcctggccaacatggtgaaacctcgtctctactaaaaatgcaaaaattagccagatgtgctggcgggcacctgtaatcccagctactcaggaggctgaggcaggagaatcacttgaaaccgggaggcagaggttgcagtgagctgagattgcgccactgcactccagcctgggtgacgagtgagactccgtctcaaaaaaaaaaaacaacaaaaaaaaactttcagattgtaaaaagggcagataagaggaagcaggagtaggaggatgtgctcatagagaatatgagaacctgtttcatctctgtactttgaaggtaggggtggacagttcacagaataggtttaaatctaggaactgagtcagtcccaggtgccttccttaaatacttgtgggttgaatgactgtcttaacccatctgaaaccaatctaggattaaaattttagaagacagtggagtttaattggctgctctcctctcttaggctcttggagaagtcagtgctgtcagcaaacatctgtttaaacatgtggaatagctgtactttggagagcaaaagttattttagtactttaggaatatgaagtaaattacgtataagtttatttgcttttaaatttttgagaaacttctacttccagtatggagaagtaagctcttgcacatgactgaaaacctagaaaaaaaaaacaaaaaaatcaattacttgtggggtctggaacaaaaaacagatagattttggagggtatcaaactttgacaaagcaacccttacagagtgagattctcattctttgcagctttgccttgagggcaggcacagtaaggcataactaatgttccagtacaaaaccccccattattctgtccaaaagaaccaggggaagggggccagtgctaccaaagagtagggaaggcacccaagaaaagagagagccagataatggaaattctaaatgctgtataatagcttcacctgactctctgacttgcatagtctacatgcatgcccacggcaaattgagagcaatctgaactgagatctgagtctctctccttaccagacatagagagttttcagttagaatttatttgcctgctaaaacaaaaatattaacactcttcagaaagataaaacagaatctagagttcttacaacatagcatttacagtatcgaggatataatctaaaattacttgatatatgagccagggaaatgtgaactattttcaaagaaaagacaagtcaacagatggtaaccccaagatgatccagatgttgaactatctgacaaagactttaacacaactattaaaactgtgcttaacgaagtaaagaaatatgtttgtatcattataaagaaaggaaatctcagcaaaaaaggaaaatataaaaaatcaaatggaaactgtagaactaagaaatacaatatctgaaatcaaaatgatgttactagatggacttaatagcaaaatggaaatgacagaggaattggtctgtcagttcgaagatagagcaatacaaaataaccaatatgaagaagagtaagggaaaaaattaaaaacaacaacaacaacagaaaaggaaagtcaggtacctgtggaacaacagcaaaggagtaataacaggagtaacaggtaattgaacctccaaagggagatgagagagattataggaagaggaagaaacaatagtaatagccacaactttctcaaaataggaaaacatacatagaggaacaacaatttgagtgatcatggccttagcagaaataatggagtctagaaaacaatggagcaacatctttaaagtactgaaagaaaaaagctgtcaattcaattctatatctgatgaagatatcttttgagaatgaagataaaataaaactggcatcttaggtgtagttgtgtatttggcatactgattaagaatgcgggctccggagacagaatctagatttgagtttcagcctgagtacctcttgtgatcatgggtgaattatataaattctctaacctcaatttccttatgtgttaaagacacttaaatgaaatatctaaactaatgagtagcaatgagaggatgcttcttaagcacttagtatctgcttggcatatggtaaattgttggaaaacattagttaccatttatatatgcatgtttttagctttcatagtaaatataaccaacctttatagaatttcgtattttatatttttatctgtttcatttttgttcaactgtagagaggttggctgtatcttgaaaagggaagagtgagactccgtctcttaaaaaaaagaaaaaagaaaagggaagaaaccactgacagtattgtaaaagagaaatcacttttactactgctttgacttcagcaaaaacaagatttaggaagctcttattttcagaaaaggaaatgagaggggaaatttttctctcttagaaaataaaaaacctcagcacctaattaataagatttttactatgtaaattaaactttatccaatcattctttgtcccatttggtacccttttgtttgttttgtttgtctccttatttctttttcaatatttttcatggtattttaagaggatgatttaaacagagataaacttctgatttaatgggttttttttttgtttttttttttttcttttttttttggagacagagtctcgctccgtcgcccaggctggagtgcagtggctcaatcttggctcactgcaacctccacctaccaggttcaattgattctcgtgccttagcctcctgagtagctgggattacagacgtgcaccaccacaaccggctaatttttgtatttttagtagagacgtattttgccatgttggccaggctggtctcgaactcctggcctcaagtaatccacctgcctcagcctaccaaagtgttggggatatgggcatgagccactgcacctggcctaatgtgaatattttaaaacctaaaaccatttattttcttttgaagtaaaaggtagaggtatctaaagtagataaagagagtcagctaggtatgtggagtttatctctcagtctgatttgagttttaatgttcataagcataaaccataagataccccttttgactttgtttctgcatttgatatgaatggtagtgaaagatattgtgtattaaatttggctttttatatataagtcattacataaaaaagtctccaaggagaatatgctttgttctattctcctctaaaaagaattatataatcaaactttttttttattctagttgttggaaatcttaagatgtagttttggcaaggtgcagtggttcacacccctaatctcagcactgtgggaggccaaggcaggaggattgcttcagcccaggagttctagagcagcctgggcaacatagaccctgtctctgcaaaaataaataaataaaacaaaattagctggttttggtggtgcacgcctgtggtcccagctacttgagaggctgcagtggaaggattgaatgactgtactccagcctgggtgacagagtgagaccctgtctcaaaaaaaaaaaaaatttatatatacacacacacacacacacacacacacacacacacacacaagtacgtgtgtgtatatatgtatatatacatgtgtatgtgtgtgtgtatatatatagttttattcttagatcaactgtttggactttactgttgacatacctgcttttcttctccgaacctggtagttttgctttcacttaaatttttaattctttttataaggtatctcaaaatctttttggaaagaaatagataaccaggcaggctgataggtaagaaggtaagaagaccacttgttaaagaattccatgtgttgcttttaaaatgtctgtcttattaagaccagtgcctaaaaatttataggcatagatattcatcacagcattttttataatagagaaaatttagaaacaacctaactgctgtcactagggagctgttatatgaaatatcgttcaaccatacagtgtaacactgcacagccattaaaaatgatattagaatattggtactctcagacaaagattttgaagcaagaagttaaaagttcagccatccccaagtggccgaactaaattcagatgcccagacacatcatgatggcatggaaaatttcccttcatacagttttaaataaagaaaacagactagaaaacaatatgtaggatgaaatctactatgtctaaaatatatagatgatacatttatactccatgtaagtaaaaaaatacggaagaaaaaatgattatatagttccataattatttaaataaaaataattccatgattaagaggggaagaaaaggttacaaagcagtatgaatagtgtgatgtcatttttgtataaaatatatgaagaaatagacatagaagaaagtaatgaagtatcccaaaatattatattaatgatcattctctctggatttgttgcatgatatatttattatctttgtttcccttttatgcattctgatataaaattttttgtagcaagcatgaacttttatcattggaataaacattgatgctatattaaaattagagtgtggtggagcatggtggctcatgtctataattccagcgctttgaaaggcctaggcaggaggaccacatgaggccaggagtttgagaccagtttgggcaacatagcaagaactccactctaccaaaaaaaaaaaaaaatttgggcaaggtggcacatacgtgtagtcctacctgctctggaggctgagtcagaaggatcacttaagcctagaagttcgaggttacagtgagctatgattgtgctgccgcactccaacctgggtgacaaagcaagatcctgtctcttaaacaaaaatagagagaatttaatgaaatagatgttataaaatgtaaagttttgtattttcatgacattaagtgaatacaattatcccttggtatccatgggggattggctcccagacctcccacagacaccaaaatccacgattgctcaagtccctgatataaaatggcatagcatttacatataacctttatatagtattccatagactttaaatcatctgtagattccttagaatacctaattgtgttagtccatttgcattgctttaaaggaatatctgagactgggtaatttataaagaaaagagatttattttgactcatggttctgcaggctatataggaagcatggtgccagcatctgctcctggtgagggcctcaggaagcttccaatcatggtagaaggcaaaggggaggcaagcacattacatggagagagcaggagcaaaagagagaggggggaggtgccacactctttttaacaaccagatctcttgtgaactcagagcaagaactcacatattaccacaaggagggcactaagccattcatgagggtcataggtcatgacctacccccatgacccaaacacctcccactaggccccactccaacattggggatcacatttcaacatgagatttggagaggaacacacacataaaaaccatggatgcatggtttggatgctgtataagtaattgttatactgttacatagtatatgctatacaaatagttgtaaatgctgtataaatagttgttatactattgtttagagaataatgagaaggaaaattgtctgtacatgttcagtacagattttttaaaaaaattttttatatagagtgtgttgaatacacagatgtggaacccatggatatgaaaggccaagtacacagattataatcttgtaatatatatataaacatatcaaaatgtatactggagtatatagagatcttttagattgaaatagtataaaaaatacttaatacatttcacttgtataagtacatacatataattgaatataaacatgtacatatagatgaaattgtacccttcatatccagtcttacattccaggagatacaatagaactatcagcacaaattttgcagtaaatcttagttgactcaaattcacatgaaatggctaacaacaacaaaaactttccttttttgaataatgctttccctttactttcccttttcctttaagtagaaatatagggccctttttacttgatagttgatttttcagtttttaggttaggtaatgtctggtgaaaagctgttttagatgctatgattattgaaggaattaccctttggattactgggaagatctccagttgatccaaaatgtatttttctttatgtttctcacatttcagggtattcaaaaagctgaatctatttgtatttcttttttttttttttttttttttgagatggaatcttgctttgtcacccaggctggagtgcattggcacgatctaggctcactgcaacctccacctcccaggttcaagcaattctcctgcctcagcctctttgtatttttttttccctttttcttttttttttttttttttttttttttgagttggaatctcactttgtcatccaggctggagtgcattggcatgatctaggctcactgtaacctccacctcccaggttcaagcgactctgtcagcctcagccttggataattgtattaccttatccaaggtacctactaaatacatacctcagtttcctcatctctgatgaatattatatcatgcatgtaaaatactataagagccaaatgttaacttttacaattattgtgtttgtaaaaacttaactgatatattgttattaattttatttttatctgtatattagtctgttcattcattaaacacacatttaataattaacaggtctaatggcctagcactgtagcagtttttgccctcttgaaatttttttcttttcttttctttttttttttttttgagttggagtctcgctctgttgcccatgctggagtgccgtggcgcgatgtccgcttgctgcaagctgcctcccaggttcatgccgttctcctgccttagccttgcgagtagctgggactacaggtgcctgccaccatgcccggctaattttttgtatttttttagtagagacggagtttcaccgtgttagccaggatggtctcgatctcctgacctcgtgatcctcctgcctcggcctcccaaagtgctgggattacaggcgtgagccactgcacccaaacccctcttgaaatttatattttagttgaaatataactaaaatgaaaatgttttttttcctcgaacaggttctacgggaaaaagttttttggcatcaattattctgttgatcagttcattactgtgctttaaattcttaccatcattcaaatgaaaacaatatatatagtatattgtttatatactatgtataaacaatatactatatatatttagtatatagtatatagctatttacaccagtatatagtatatagctatatagtatatagctaccagtatatagctatttacaccagtatataatatatagctatttacaccagtatatagctatttacaccagtgctacccaaaatgtgggctgtggaccagtgcttatccatatgagataattataaaacttgaggctgggtgtggtggctcacgcctgtaatcccagaagtttgggagtccaaggcaggtggatcacgaggtcaggagttcaagaccagcctggccaagatggtgaaaccccgtctctactaaaaatacaaaaattagccaggcgtggtggtgggcacctgtaatcccagctacttgggaggccgaggcaaagaatagcttgaacctgggaggtggaggttgtagtgagctgagactgtgtcactacactccagcctgggtgacagagcaagactctgtctcaaaaaaaaaaataagaaagtaagctgtaaacttatctcatactttctgagggtcaaggatatgagcacagcgtagttaaatgtctctggctcatgaaggtccagtcaagttattatctagggcagtattcttatttgaagatttgactagaggaggatccacttctatggtcactcacatgacctcctcacagggctgtctcacatggcacctggcttccccagagttagtaatccaagagagaataagaacatctaagatggaagtcccattccattataaaccatttttgattttttgttttttaacttttattttaggttcaggggtacatgtacacatttattatataggtaaattgcatgccatggggtatggtgtacagattgtcacccaggtaataagcatagtacctgatatgtagtttttcaatcctctccctcctcccaccctccaccctcaagtaggctccagtgtctgttgttcccttctttgtgtactcaaagtttaactgccacttataaatgagaacatgcagtgtttggttttctgtttctatgttagtttgcttagtatgatgacctccagctccatccattttgcctcaaaggagatgatctcatcctttattatggctatatagtattcctttgtgtatatgtaccacttttttttttttaaatccagtctaccattaatggacatttaggttgattccatgcctttgctattgtgaatagcgctgcaatgaacaagcacatgcatgtgtcttttatggtagaacgatgtatattcctttggatatatacctagtaatggcattgccaggttgaatggtaattctgttttaagttctttgagaaattgccaaactgctttccacaatgcctgaactaatttacattcccaccagtagtgtatgagtgtttccttttcactacaactttgccagcatctgttattttttgattttttaaaaatcacaattctgactggtgggaggtgatatcattgtgattttgatttgcagttctctaatgataagtaatgttgagcattttttcatatgtttgttagccacgtgtatgtcttcttttgaaaagtatttgttcatgtttttgcccactttataatggggttattctttttttgctttaaaattttgtttcagttccttacagatgctggatattagacctttcttggatccgtagtttgcagaaattttctcccgttctgtaggttctttttattctgttgacagtttcttttgctgtgcagaacctctttagtttaattaggtcccacttgtcagtttttgtttttgttgtaattgcttttggcatattcatcatgaaatcttagccaaagcctatgtccagaatgttatttcctaggttatcttccagggtttttatggttttaggttttacatttaagtcttgaatccatcttgagttgatttttgtgtataatgtaataaaaggatctagtttcagtcttatggatgtggctaaccagttatctcagcaccatttattgaatagggagttctttctccattgcgtgtttttgttgattttgtcaaatatcaaatgattgtaggcatgtggttgtacttctcagttctctattctgttccatttgtctgtgtgtctgttttgtactgctaccgtgctgttttggttaccatatccttgtaatatagtttgaagtctggtaatgtgatgcctccagctttgttctttttgcttagggttaccttggctattcgagctcttttttggtttcataggaaatttaaaatagttttttctagttctaggtttgtgaagagtgtcctttgtagtttgatggaaatagcgctgaatctgtaatttgctttgggagcatgactattttaacaatgttgattcattctatccatgagcatggaatatttttccatttgtttgtgttatctctgatttctttgagcagtgttttttaattctcattgtagagctatttcacctccctttcaatacctagttagatattttattctttttgtggctattgggaatgggattgcattcctgatttggctgtcagcttggaggttgctggtgtacaggaatgctacagatttttgtacaatgattttgtatcctgaagctttgctgaggtttatcacatcaaggagcttttggagctgggcgtggtggctcatgcctataatcccagcactttgggaggccaaggcagatggatcacttgaggtcaggaattcaagaccagccttgccaacatgatgaaaccccatctctactaaaaatacaaaaattagctgggcatggtggtgcatgcctgtagtcccagctactcaggaggctgaggcaggagaatcacttgaacctagaaggcagaggttgcagtgagctgagattgtgtcactgcattgcagcttggatgacagagcgagaccctgtcttaaaaaaaaaaaaaaaaagcttttgggctgagaccatgaggttttctaggtacagaattatattgtctgcaaacagggatagactgacttggattgggtttcgactgtctcctgtatgtcgatgatctttgttcctatccatattcagggatgatgagtttggttctttcatataatggcatttggtctattacctcctgtactgttttattgtaatccttagatttcttggattgggttctgtccaaatatgtttgttagtttgttgcctcaatgatatgtctaatattatcagtggggtgttacaatctcccaccattattgtgtggttatctaagtttcttcataggtctctaagaacttgatttatgaatcttgatttatgcactcctatgttgagtgcatatatatttagaaaagttaggtccttttgttgaattgagcccttaaccattatgtaatgtccctctttgtcttttttgatctttgtttatttaaagtctgttttgtctgaaattacaatagcaatccatgcttttttctgtattctgtttgctttgtagatttttcttcatccctttactttgagtctgtggatgtcattgcatgtgatatgggtctcctgaagacagcataccattggattttgcttctttatccaagttatcattctgtcttttaattggggtgtgcattcaaggttagtattgatgtgtgcggatttgatgctgtcatgttgttagtcggttattatgaagacttgtttgtgttgctgttttgtagtgtcactggtctgtgtagttaaatgtgcttttgtagtggccagtaacagtctttcctttccatagctagcacttccttcaggacctcagtaaggcaggtatagtggtaactaattcaattaccacttacttgtctgaaaaggatcttatttctccttcatttgtgaagcttggtttggctggatatggaattcttggttgaaaatttttttttaaagaatgctgaatataggtccccaatctcttctggctaataaggtttctgctgacaagtctgcttgttagcctaatggggctccctttgtaggtgccctccctcttctttctagctgcctttacattttttctttcagaccgtggagactctgatgactatgtgcctttgggatgatcttgtgcagtatttcacaggggttctctgcatttcctgaatttgaatgttggcctctctagcaaagttcatgacaatttcatggacaatatcctgaaatatgttttccaagttgcttactttctctctctctcttttagggatgcaaatgagtcatagatttggtctctttacataatcacattatttcttggaggttttgttcagtcttctttattgttttttctttatttttgtgtgactgggttatttcagagagctactcttcaagctctgagattctttccttaccttggtggattctgctgttaatacttgggattgcattttgaaactcttctgatgtgtttttcatctctatcagatgagtttggttctttcatataatggccatttggtctattacctcctgtactgttttattgtaatccttagatttcttgaattgggttttgactgtctcctatatgtcagtgatctttgttcctatccatattctggattctgtctctgacatttcagcctagttaagaaccattgcctgggaactagtgtggtcgtttggaggtaagaggacactctggctttttgagttgctagagttcttgtgctggttctttctcatttgtgtgggctcatattccttcagtttttgatgttgctgtcctttggatggatttttttgcttttctcttctttgatgcccttggggatttgattatggtataaggtggattcagttgatgaactttgattctagtctgttcctgggtcttggaggagcgctctctgattactttctctgtgcctacattttttggggggtgttctggtccacagggcttcctcagtcaggttcctcagttggcagagaggctgcattcttgcaacatcagccctaatctgctatctgtgtgcttcctggggaaacatgaggttgtgcctgcctgcagagttcaggtggaagtgggaaccctggattggaagttctcgtagatgtggcccatctggctacaagaggcagggtgggttgaattgcctgctctgccatctgggtgtttccatggcaacaggaggctgtacccccggcaaattcaggcagaagcaggaccactgggccagaagctctagcaggcatggctcacctggctaccagtggtgggggtgggtggaggcacccaccctgccccctgggtgtttgctgggacaatagtaggctgtgcctaccagctgagttgccatagaagcaggacccctgggccggaagctctagcatgtgttgccccccagctaccagaggcagggatgggcagggtgacatgctgtcttgtctgggtgtttactgggacaacaggaagctgagccctcctgctgagttcacacagatgtggagctgctgggctggaagctctcacaagcattgcttgcctggctaccagtgacgggggcgggtagggtcatgtagtttgctgtcccagcatttcttgggatgacagaaagctgcatccttcagctgagttcacacagaagcaggactgctgggctagaagctctagcaagcattgtctgcctggctacctgtggcaagggtagatggagtggccagccaaattctggctgaagcaggaccactgggctggaggctgttgctgagccccatccagcaaggagtagtggagaaatcttactgctttcaggcactgcagtggcggcctctattgaggctataacactggtgctgatctgctccggggcgcaaagcttgtagaggtgcccttgggcttcagaattgcctccaccaaacatctcagtggctctgcctcagtctagaagcatgggggtggggggcacagggtggtcagggggaatctcccattcccagtcttgcacaggtttctgtggaaagtgtgaatccccctgggggctctcactcaccgtttgcggtgttggttaggttctcctggctctgtgctcagcccagacaagctggtgcccaccttcattcctccgtgctctctgtgtttccctgctgccttgatagatctcaacgttgtttctcagatgatcagcttgcagggtcagtgttcagtagcccttttgcttattctctgtgagagcaatgcgcatgagctgcttctagtctgccatcttggcccccctaacctaacccatttttagatgttacattccatcacttctacttctgctataatctatttgttagaagcaggtcacttaattacacattatggcattagtttgttgtgccttttgtgcttttcctagcatctgtgaagtattattgaaagtattttagtagtgttaggaaatgtgtattttataataattattttagtagtgttagaaaatgtatattttatttgcagttcaaattttgttttttttatttttttatttttatttatttattttttttgagacggagtcttgctctgtcgcccaggttggagtgcactggcgcaatctcggctcactgcaagctctgcctcccgggttcatgccattctcctgcctcagccgcccgagtagctgggactacaggcacctgccaccacacctggctaattttttgtagttttagtagagacggggtttcaccatgttagccaggatggtctcgatctcctgaccttgtgatccacccgcctcggcctcccaaagtgctgagattacaggcttgagccaccaggcccagcctcaaattttattttttagtgtactttgtagtatagaaataagtacttcatatgctggaggtagctgttaacattttatgaattttcataatgctataccatgtgcacattttttaaagtcttcttaaaataaacagcatatttggatctcattaatttaaaaaagttaccagtaagtctggactgctttttcttttatgaaaaaaattaagctaacttaaaccacatattaagctaacataaaccacatattgtgatagtttgatgaactaatctagctcggtgttttgcaatgttttttaactcatgctttctttcataaaccttccattagtgttttttgaaacttcaaaaaaaataaatgttactaaatacaaaccaagttatagtatctcagaggagagagagatatcatctcatcaattttttttggcaggggtggtgggagctttctggtgaagaccggaaaacctgttagacaaattctgaaaaactgtaacattcatctcatcaattgagaataattatttttactaatttagtgtaaatcctagatgccgttgtttattatcagatgctttttatataatatgtgtttaagtggttttattttttttttatttatttatttttgagatggagttttgctcttgttgcctaggctggaatgtagcggcgcgacatcagctcactgcaacctccactttccaagttcaagcaattctcctgcctcagcctcctgagtagctgggattacaggcatgtgccaccatgcccagccaattttttgtatttttagtagagatgagatttcatcatgttggccaggctggtctcaaacttctgacctcaggtgatccacccgcctcagcttcccaaagtgcagggattacaggcatgagccaccgtgcccggccgtttaagtgtatttttatagcacagggttaataatagtttccaaatggactgtcagtattttaaaagtaaggctctttttaacattgtgctcttaaaagaataaaagattattaaggaaggtatgtgattatgtttctaaatcattttggcttaatcactccaagaccacaacttcttgctgcttttttttttttatcatgttttggcaagtcccgaagcagtatttttgggatgtttaatttttttgtttctggtatttaggcatgtatgatatgactaggaagaaaatagaataatgattttcagagctgatttgctatggaaaccatcttttaaaattcatcaatattaaacaactgttattgcggtctttgagttggtaacaatcgcaatgtatgttagtgttcacacaaatatttctttttctttcttttcttttttttgaaacagggtgtctctgtcacccagactggaatgcagtggcactatcatggtttactgcagcctagacctactaggcttcagagatactcccacttcagcctcccacgtttaattttttttttatagagacaggcgtcttactctcttgcccaggctggtctcaaacccctgggctcaagcaatcctcctgccttggctccccaaagggctgggattataggcataagccaccacaccctacttgcataaatatttctaaggaatttggagagtcaaataaatgaagtttactatgagctttcccctttttgtaggttacccatttattcttttaaattagtgatagaatacatatgaagaaattatagaagagctgtaaagtagcatcagtagaacagagatctaaggaaatatttgagatttttatctaaaatttcatttgaacagggttatgttgctaaggagttttaaacccctgccatacactattagagctgtaagaaaactaaaaagtcaggagcagtggatcaagaaacaatatcaaggttagaactcagaagaaacttaggagcagtttggcaaaggggacaattgaaaggatcatttttccaggacaggaaaataataatagcttatacaactctttttgattttattagatattttgcttccaatagtgtggagcgtagtgtgaagataaatagcacagtatctcaatttcttatttgtagtgtagccctatcctattatcctggcttctgttgtaatttttttttttttttaaagacacaggcttcatcaccctgtctcttaaaaactcttctctgttgtccaggctggagtgcagtggcataaccgtggctgactgcggcttcgaactcctgggcttaagcaatcctcctgcctcagcctcccgagtagctgggactacaggcacatgtcaacacacctggctatttttttgtgtagacagggtctcactatgttgcccaggctggtcttgagttcctaacctgaaatgatccttccatcttggcctcccaaagtgctgtaatcacaaccctgagccactgcccctggcctaattttatattaaaattgtaatattctagattgtagagcttaaaaaatacagtaccaaaaaaggtactacaggagaaatgttttctcgttttctaaggacattagtatgaactgtcccttaagacctgtgcattttactgaaacaaaattagtctgtttagcatcacttttatatagataggtatttttgccgacatctagtgcccaaagaaactcccagcctatctccttcatgttgattcagcattccaagaaacaatcaactcctataagataaaaacttagattttcacacttttgagtatgtttatttctgagttaaagttttcattgttaaagaacctggaaggctttttataaaatatgcaactcatcatccaaatagaaacttaaaaacttggaggctcggcgcagtggctcatgcctataatcccagcactttaggagacagaggcgggcagattacctgaggtcaggagtttgagatcagcctgaacaacatggagaaaccccgtctctacaaaaaatacaaaattagccaggcgtggtggtgcatgcctgtaatcccagctgcccagctactcgggaggctgaggcaggagaatcgcttgaacctgggaggcggaggttgccgtgagccgatatcgcaccattgcactccagcctgggcaacaagactgaaactctgtcttctgtctcaaaaaaaaaccaaaaaacaaaaacaaaaacttggggcttggggaattgacctttgaattgacactgtaggtaatatgtttatatcagaatattattcatcctgtcgaaagaagataatttccacttattgttctataagaatgaatttaatgtctttaggatgaagtagagtatagatttttaaatttccctctgtcccattcttcttcactagaaccaattaaatgaataaaaaaaggagaaaggcagtagaagagaatacatgcatggttctcacaaggcaggccttctgtctctggtaaaaaacttgagttttagtgtatatactcttggtttaggatctgtggaatttcattatttctgttctttctctcagtgacacatgtaaatgagaaaatcattcaaatccagtctaaaataatttttaaagttttttcctcttgttttgcaaaaatattaaaagctaaagctaaaaattcaaagttgcacctatactttcatttttgtcatacaaaaattgtggccatatggtttcagtgtatgttttcatgtatctgtatgtaaaataattgaagaacatggaaaaataatctgttaaagtcttgaattgtgattttttattttcttgaaatttcaaaaagtatttttgcaataaatgaaaatgaaaaaggaaattttaaagtagatcatataagatgtattggtttgaaaattactactttaaatgtagagtaatatccctaattcaattcattgtatttaaatttatagagaataacgagcatttaatcacattctgaaattttgtgctgggtgctaaatctgttcaaagtattaaatatttgaatatttgggagattcaaaatagtatttgtccttaaagtatataaaggttttctgaggaaattattgcatttggttatttatagtatattagaaataggaaacaagctccacctaggaacttactgtagtttagcctttcgtattcatacttctctctctcttcccgccacctctctctccctcactctccctttcccccatcccctgtctcctccccttctctcttattacttttggtatattttgcatattttctggtagattaattccaggtgactttgatcacagtgtggttttttatatagctttgtttacctcttataggtgggaggaggcctaccacactaaaactttttccttagaattctttcttaaaaattctaagtttccatctttattaccaccaaaaacaaaagtttgccttatatgtgtgggtatatatatgtgtgtgtgtgtatatacacatatacacatatatatacacatatatacacatatacatatatacacatatatatatacacatatatacatatatatacatatatgtatatatatgtattttttttttgaggcggagtcttactctgtcgcccaggctgcagtgcagtggcgtgatctcggctcactgcaacctggctcactgcaaccgccacctcccagtttcaagcaattctcctgcctcagcctcctgagtagctgggattacaggcatctgccaccgcgcccagctaatttttatatttttagtagagatggggtttcaccatattggccaggctggtctcgaacccctgacctcgtgatccacccacctcggcctcccaaagtgctgggattacaggtgtgagccaccgcgcccagccttatttatttatttatttatttatttatttatttatttatttatttttgagacggagtcccattctgtctggcccaggctggagtgcagtggtgtagtcttggcccactgaagcctctgcctcccaggttcaagcgtttctcctgtctcagcctcctgagtagctgggactataggcatgtgccaccacacccagctaattttgtattttaagtagagagggtttcaccattttggccaggttggtctcaaactcctgatttcaggtgatccacccacctcggcctcccaaagtgctgggattgtaggcatgagtcactgctcccagctgtgccttatatttttaactagtaacctgaataaattcggggtgattttgaaagcagagctcacaggatttcctgatagtttggatgtgggtgtatgagaaagagaggggtcaacgatgactcctgggttatttgcatgagcaactggaatagattagagttgccctcaatggataccaggaaggccgtaaatggagctggttggaggggatggaggcagatgaaaagattacttttggacatgttaaacttgaaatggcaaacaggtattttgactggtgctataaacctgtaagtcattggcatgtagatgatagtcaacatatgcctatgaaactggacaaaagtttcatggtaattaggtatcaataagcaggaaggtagcaaaaaactaactttacctatctcacaattttgccttgtcccaggattgcccatagcccaattcttttgattcaagcaccaaaaccaactcttagagttttttgtttgtttgtttggtttggtttttttgagacaggttcttgctctcttgcccaggctggagtgcagtggcatgaccatggcctactgtagccttgacctcccaggctcaagtgaaactcccaactcagacttccaagtagcttggactacaggtgcgcatcactacacctggctaattttttacttttatttttgtagacatgagtctcactgtgttaccagggctggtgttgaactcctgggcttaaccaatcctcctgccttggcctcacaaagtgctaagattacagccatgagatgctgcacccggcctcttctcaagagttttttggctaagcaattaatatatgtgaagagtaggcattcaataatatgtcttttccttttatacatttcatcttttaaagggcaaggcagccaggagttgtggcatgtgccttcagtctcagctatttcggaggctgaggtgggaggatcactcgagcccaggaattcaagtccagcctgggcaacccacccctgtctctaaaaaacaacaagagccaggtgtggtggctcaggcctgtaatctcagctctttgggaggctgggacagatggatcacttgagtagtttgagaccagcctggctaacatgacgaaaccccatctttactaaaaatacaaaaattaaccaggcatggtggtgtgcacctgtagttcaagctacttgggaggctgaggcaggagaatcgcttgaacccaggaggcggaggtagcagtaagccgagatcacaccactgcactccagcctgggtgacagagtgagactttgtctctgaatgaatgaatgaatgaatgaatgaatatgaataacaacaatgacaaacccagaaatatatgggcaagacagcttaaatgtaggatgtttgcatttagccacttcactctttagtagtgaaggtatggtgaaattatgactgaattacattcacctgctttactagacaatgacaggtaattggattaatgaagcgtaaggcaaaatatagagtaattttagctcagtgtgatagtcgaagggaaaaaaattcaaatgataacaaaaaaccaacctatattcccctgggcactacgaaataacatctataccagtggttcttgtactttgggacacattggaattacctgggcatctctttaaaatactcctatctggcttctactcccagaccttctgatttatttggtatgggaggagctttggcgtcacagctctccaggtgggcctaatgtgcagcaaagtttgagaactaccatgatgtatactttttttcctagtgaaactaccactaatagtcacagtattcagagtcccttccaaaattctttttattctttgctggtgccaaaaacagaagcaacattgttaagggaagatcctcaaggcagagtggagtaaatgagtgccctctctaaatcatacaaataagtcacaatcgtaatttattttagattcatgacagctgttcatctggccacttatttatagcatacatgatccccaaattggaggcaaccgtaatgtcatggagtgcatcagagttgaagtaaaaaggcttgcattcaaatcccaattcttccacttactaacagttatgatgggcaattcattcaatcttgctgaagttctcatttttttctccctaatatgaaaataaccagatctgttttgcatggttgtaaatatctttaaaagctaatgtatgtgaagataaactataaagtatataaagatattaaataattattatctgaaaggatttttcttaaccttagagatgacgtaactttctaggtttttttttctgtattttttcattgccttaagaaggagatctgcatacagtagataataaatgcatttgaacttaacgtgtatagtagaggaagtattattttgtatttctataccatgttttaatctgggtagaaacgtaagttttctactcatgcctgggttccaacacatgtgttgccacttgttagcaaatttgtgtcagtagacatgttctaagagtcaggtttgttatctttttgtatggcgaataatatctatctttcagggctgttatggccctcacatgtagtgccgtaagcatagtagctagaatggagcatgcagaaaatgctaattcctttcttctctccaagaatatcataatcttgtgatagtacagatgacctttgaacaccacaggggctagggaccctgcccacacacaatcaaaaattcacatataatttttgactcctgaagaacgtaactactaatagcctattgtaaactggaagccttactaataaggtatacagttgattaatatgtattttgtatgttatatttgttctgtactgtatttttacaataaagaaagccagagaaaggaaaatgttattaagaaaatcataaaggagacaaaatatatttattattcattaagtggaagtagatcataaagatcttcatcttgtcttcatgttgaataaactaaggaggagaaagcagtggggttggtctttctgtcttgagggtggcagaaacggaagaaattcaaatataagtggatcctctcagttcaaacccgtgttgtctaagagtcacctgtaatttttaaaatctgagtaataatttttagtagctaaaaattcttaactgtcatttaaaaattttgttttgctgatttctatatcatttaacgttttaaaacttttttattgatgcataacggatgtacatggtcctcctgccccaccccaccccccacccccacaacatgttttttggagttttttctggtttttgtttgtttgtgttttggagacaaagtctcgctctgtcccccaggctggagtgcggtagcgcaatctcggctcactgcaacctctgcctcccgggttcaagcaattctcctgcctcagcctccctagtagctgggactacaggcgcatgccgtcatgcctggctaatttttttgtattttagtagagacagggtttcaccatgttgcccaggctggtgtcgaacccctgagctcagtcaatctgcccgcctcggcctcccaaagtgctaggattacgggcatgagccaccacgcctggccacagatggttttaaaagcagtgtttatctttatgctttttcagataagtttataccatggatagcacaaaggagaagtgtgacagttacaaagatgatcttctgcttaggatgggacttaatgataataaagcaggaatggaaggattagataaagagaaaattaacaaaattataatggaagccacgaaggtatgtttcttgtttcttttgatgtgtgtaatttaatgaccttttaactttctgtttcaaagaaaatcatttgaatatcatttgtatttaatatttcaatattttaatatatattatttttaaactacaaaagggtatggaataatctcccttctattctgttgctcctaccatccaggtttctatttcacatgcatataataggcatttaaaaccaaaataatgtatatgttcctgttcacctttttttttaaccccagtgggagaaattgtttaggtatttggatttttttttttcagttaatataacttggagctctttctgtataggtaaataaagatcttcattctttgtatgcctgtgtgtgtggatataatgtaatttattgaaccatccaaaaagtttatggataaatatatgtcatttgtagtcttttatttttacaaacattactagtgaagtagggaataacgtattttataactttctatatgtgcaagtataactgtggaagagattcctacaatggaattgtttcaccaactacacatagcacaaaagaatatatgcatgtgtgatttttatgaattgccaaattaccctccatggtgtttctatcaattcacacttccactacaaatatctgagagtatgtattaccatactgaaactgtgccaacacagtgtattactaaacttttgtatttggcaatctgaggtaatatagtatagcattaatttgtattccacttatgaaaaattagtttcatatcttttcttttttttgagacaaggtctcactctgtcacccaggccggagtccagtagcacaataatagctcgttacagcctcaccctggtctcaagtgttcctcccacctcagactttgaagagctaggacaataggcacatgccaccaagcctggctaactttttattttttgtagagaggcggtctcactgtgttgcccaggctagtcttgatctgctggcctcaagcaatccctctaccttagcctcccaaagtgctgggattataggcatgagctactgtgcctggagctcttttgatattttaaaaattatttgtatttcattttttatgaactttgattatatattctgtatacatatgcacattcaataattagttatcttttgactttgcttatggtagtttctcctgttcagaaattttttgtttgctccattttatgtagttgaatgtcaactacatatggctttcttcaaggttataaaagaattctttaatttttttaccacttttttgtttcatttatatattatagaatatatatgtattaatgtgttatgtgtattaatgtatatcaatattaatatacattatatatacatgatatataatgtatattagtatgttgtattatatgttatgtatattaataaacacaatacatgtattaatatacatgtagaaagatgtaaactttaagagaatatccttgttcttaggaaatgcgtggtgatgtccacagcaacttactttaaaatggtttagccaaaaggaggggaaagtgtgtgtgtgtgtatgtatgtgtgtgtgtatacactcatacttccccaacatatatacatagaagttggggaagaaatcaaatgtagcaggatattaattgatgaatctaggtaagggtatataggtgttcgttgtactattttttcagcttttgcagatttgaaaattccacgataaaaagttaaggaattattgttaatttcattagctatgaaaatgttactgtgatgaagtgggaaaatggccttatttttaaatgcataccgaaatcttctgtggaatggctaaatatcttgatatttataatttaaaatgtttcacttgtaatgaagcatatacagtaaaatgttaacagctgttaaatctgagtgatagttttatatgtgtttattgtattcatgtttttcctgcgttttcctgagacttttttgatattttcatcataaaaatgttcaaaaagaataaaacaaataaaacctatgaatctagttcttaggttaagaaatagaatatgtaggttaccctagatgtccctatctatctgatcctccctctctattctctgtgacccagtacaatttattaaatagtccattcttttcctactgatctggtgtgctttctcttctgttccactggatcatttgcctgtttgtatgtaaacaacatgtttttttattatcatactttataataagccttgatatctgctagcacaatttctttttttttacactttgttctttttcaagaatatcttgagtattcttgaagctttgctttcatataaattttatgtgatatatatcaaaaatatataggtgcatatataattggcacatatcacatgattggtatataaaaatacatagaataatatatattcctctagtgcatgaggtgagtttatcataaatggtaccttgtttaaattggaattttctaattgttactattccatagcaatacaatttactttttacttttttaaaactcttatcagaaaatttaaaatatatagaaaattacagagaatagtaaagtaaatccccatataatcatcacccagcatcaacaattaccaacatttttgcaaatatagttatctatcttacccttcccctactgatttttggagggaggagtattttaaaacaaattccaataaattggacacatttctagaagtttacaatttttcaaaatggactcaagaagatacagagaatctaaatagacctatataataaggaaataaattagtaattaaaaatctccccatcaaagaaaaaagaccaggccatttggcttctctggtgagttttatcaaatatttaaagaagaaatgataccaatattccacaagctcttctagaaaatagagaaggatggaacacttcccaactcctatgaggccagtatcaccctgataccaaagccaaacacaaggttatacatcattatgaatgcaaaagtcctcaacaaaatattagaggactgatttaaacaatatagcaaagagattatgcaccataaccaaatgggatttatcttaggaaagcaaggttggtttaagatctaaaaatcggccaagctcatgcctatgaccccagcactttgggaggctgaggtgggtggatcaccggaggtcaggagttcaagaccagcctgaccaatatggtgaaaccccgtctctactaaaaatacaaaaataagccaggcgtggtggcatatgcctgtagtcccagctactcaggaggctgagacaggagaattgcttgaatcctggaggtggaggttgcagtgagccaagattgcaccactgcactccagtctgggcaacagagcaagactccttctcagaaaaagataaaaaaaagagagagatctgaaaatcaattaatgtaatacatcatattaaaataaagggcaaaaaaaccacacgatcatcttagtagactcagaaaaagcatatttgataaaatcccaccactattcatgctaaaagctcttaacagacttgaaatagaagggtacttcctcaatctagtaaagggcatctataaaaaagcctacagtgtacatcatactttatggtggaaggctgaacactttctacctaaaatgaggaacaaggcaagaatgtccactctcaccttttctactcaacatagtcctaacagttctaaccagtgcagtcaggcaataaaaataaataaaagggccaggtacagtggctcacacctgtaatcccagcactttggtaggctgagataggaggatcacttgagcccaggagtttgagaccagcctgggcaacatagtgagaccctgtctcttaaaaacaaaacaaaacccttacgccgtacacaaaattaactcaaaatagacttaaagagccaaaacaatacaacttttagaagaaaatttgagaaagcctctgagaccttctgttaggcagaaatttcttagatgtgatactagaagaacaatcaataaaagaaagttgattaattggtcctcatcaaaatttaaaatgtttacacttcagaagacagcaataaaaataaaaagataggtcaggtgagctggctcacacctgtgatcctaacactttggaaggctgaggtaggaggatcaggagtttgagaccagcctgggcaacataatgagaccccaccccccaacctcttaaaaaaaaaagaaaaagatagcaatgtgccttgggtaaaatatttgtaaaacacatatgtgataaaagacttatatccagaatatacagaaaatgtctacaactcaataagacaagcaaccgaatcaaaaaatggtcaaaagatgtgaatagacatttcagtaaagaagatatacaaatgactctaggcacatgaaaagatgctcaatattattagtcatcagggaaataaaaatttaaaaaccacaaagagatgccattcatgctactattgcttagaatagctataataaataagacacagtaacaaatgttggcaagaacgtggagaaattggaaccctcctacgttgctgatgggatttaaaatggttcaaccactttggaaaacagactggcatttcctcaaaaggttgagtatagaggtaccatatgtcaaagaaaccctactcctagttacctacctgagagaaatgacaacatatgtccacatgaaaacttgtccacaaatgtttatgatagcattcttcactgtagccaaaaagtgaaaataagctaaatgtctatcaaccagataaatggatagacactatgttcagtgatgaaatgatgggcagttttttgaattattttctacattttctttaatgacttaacattaaatatttgaaaataccttgtaaggagtatttttttaatgcaatagataactgatgatccaacccactaaggcctttgatacccactgtggatcctacctaggacatactgttcttttctgaatgcaaacctgtattcatctcagagagcttgtgctgtgctaagtactgctcacaacaatcctgtgatttagttaactactaataaattcatcttacaaataaagaaactgagatgtagaaagattaaataattttagggtcacctagctagtaagtagtagagctaagttttaaatttaatcttctgtttcctgagtatgtgctcttagccaccaggttatactacagtgatgctttccttcagacatttttcttatgctttgttttgttttcctccataggggtccagattttatggaaatgagctcaagaaagaaaagcaagtcaaccaacgaattgaaaatatgatgcaacaaaaagctcaaatcaccagccaacagctaagaaaagcacaattacaggtattaattaaattgttaaataaagtggaagctggtagaatagtaattgacagttaaaatgtattgtcaagtcataactgaaaacaagatgaaatgtaaatgttcattatattgtaaagcatacatattcagcaaatgaacatactttactttgctaagtgttgctctgctcatttacataaagactccacacatagacattgtcacctctattatacagaagagtaaatgaagtcttaattaagttgagtaacttgcccagcttgataggacaggtagttagcagaactaggatttaatccaaagcctatgttctttttattgtatacatcgcagctagaaaaggccacgggataaatgtggaatgttttctgcaatgctgattttgcaaaaaaaatttgaggaatatgttaactaattaaattggagagtaacttaaaacataatcatgttatagtaaaataaaaagtcacactatagattagaatgccaaatgtacatgaacttttaagacaaaacacaagacttctaaaaccttggaaggtttttgccttctccaggatctttgggaagtaaatactccaagtttcctcttctattaaaagttatttcaggagaaaagtttggaaatatccaagttgcagggcactgtgtggtagactgacaactcaaagcagtcaaatttctgatagtaaaacaagtcatggcaagaggaatttgctctttatcaaaatctgatccaatgttaacagagctctatagtctataaggtaacaataaaattagattaatctaatatgctacaaaatccttctcttgtgacagagttcaaagatcataaattttatgttttctttatcaaactatacaatgtgtgattttttgatacatatgccttctcagagcacaagataatttttaagtggtcttctattatgatgaaagatgatttatttgtcatatcatcatttttaatgcttcacagcattccactgtgtggaggtaccataatttatttaccatatcccaccttggtttcagttttttatttcatacgcaaccctgtgattatcattcttatctttgtactctagtgctgttattttgaccaaagatggtatcattttacattttcaacatgaaagtattgattttctcacatagttgtaaaccattaatatttccttattatgagaatttcctcttttattctgtttgcgagtatatacactaagttgctagcacaagagaccaaaaatgtaatattttaaataagagctgctttctttctcacataataagtgagtagttctagctggtgagtggctgattatcatttagagacccaggttctttaaatcatattgttccatcatcccctggtgttatccttacctgaattaacaaaagtgaattattttccatccatattccatctcctggttaaggaagaaagggaaaatattgaaggcaagtacagtaatttgctattaaacaagtgaaaaagaagttgcacacattacttcagctgacattctttggcaagaatttaagttacatggccacacctaactgcaggagaagctataactttagctgggtgccatgtgcccagctgaaaatccattaccatggaaggaaggaagaatagattttggggttcaagcagcagcctaaagcaatgttttttgcccacatgtctgggggagtttatatctatttatcttgatttataaggtcttaatatattagagattttttcttgccatttgttatgaatacttttccaatatattgtcttttaattttgtagtttttcccatataatttttaatgtttatgtaatcaaatccagtgacttttttaaaaaaagattatatatatatatatcttcctttcccttcaaaatttattttttttaacttttaagttcaggggtacatgtgtaggtttgttatataaataaactggtgtcgtgggggtttgttgtacagattattttgtcacccaggcattaagcgtagtaccactcattagttattcttcctgatcctctccctcctcccatcctccaccctccagtaggccccagtgtatgttgttcccttgtatgtgtccatgtggtttcatgatttagctcccacttataagtgagaacatgcggtatgtggtttctgttcctttgttagttactagggataatggcctccatctccatccatgtccctgcaaaagacatgatctcattcttttttattgccacacagtattccatggtgtatatgtacacaattttctttatccagtctatcattggtgagcatatagattgattccatgtctttgctgttgtgaatagtgctgcagtgaacaaacacaagcctgtataaaaagaccttatttttcaaagcagttttaggttcacagcaaaattgaataaaaggtacaaagattttccatatactcctgtctccccacaggcatagcctcccctgctatcacatcccccaccagaggggtacatttgttacagtttatgaatctacgttgacacaacattatcatccaaagttgatagtttatattagggttcaatattggtggtgtacattctgtgggtttagacaaatgtacagtgaggtgcatccaccattatagtatcagacagagtagtttccctgccctaaaaaaatactctgtgctccatctattcatccctccctcccccactaacccctggcaatcactgacctttttactatctccatagttttcccttttccagaatgtcatatattagaatcatacaggatgtagccttttcagactgattgtttttacttatgcagtgtaatgtaaatgtatgcatttacatttccttcatgtcttttcatggcttaatagttcatttattttatgtactgaatattattcaattgtctgggtgtaccacagacaattttttttttttttgagatggagtctctctcacttcgttgcccaggctggagtgcagtggtgcaattttggctcactgcaacctccacctcccgggttcaagctattctccctcggcctcccgagtagctgggataaccagtgcccaccaccatgcccagctaatttttgcattttttagtagagacggggtttcaccatgttggccaatctggtctgaaactcctggcctcatgtcatccgcctgcctcagccttccaaagttctgggattacaggcgtgagccataccacagacaattgaataatattcagcacataaaataattgagctatcaagctatttgtccatttacctactaaagtttactttggttgcttctaagttttgggaattatgaataaagctgctgtaaatatccatggccaggcttatgtgtagacataagttttcaactcctttaggtaaatactaaggagcgcaattgctggataatatggtaaaataaaaatatgtttagctttataagaaactgccaaactgtcttccaaagcgaccataccattttgtcttcccaccaacaatgaatgaggattcctgttgctaaatatcattgccctcatttggtgttgtcagtattgtgaattttggctattctaatatgtgtatagtggtatctcattgttgttttaatttgcatttccctgatgacatatgatgtggagcatcttttcatgtgcttatttgccatctgtatatgttctttgttgaggtgtctgttaaggtccttgaccatttataatcaagctgtttgctttcttatttttggtttttaagagttcttcgtgtattttgggcaacagacctgtatcagatatgtcttttgcaaatattgtttcccaacctgtggcttttctttttattctattgacagtatctttcacagagcagaaatttttaattttaatgaagtctagtttatcaattctttctttcatggattgtgcctttggtattgtatctaaatagtcatcatcaaatccaagtccatctagattttctcttatgttatcttctaggaattttatagttttgcattttacagttaggtctgtgattcatttgagttcatttttgtggaggaaataacttcatctttttttcttttttttttttttaacatgaggatatccaattgttccagcacaatttgttaaaaaactcttttcttgctaggtgtggcggctcacgcctgtaatcccagcactttgggagaccaaggtgggaagatcgcttgagcccaggggttcaggaccagcctaggcaacatagcgagaccctgcttctacaaaaaatagaaaaaattaactcggggtggtggcacaggcccatggtcctagctatttgggaggctgaggtgggaagattgtttgggcctgggaggtggaggtggcagtgagctgtgattgcaccactgcactccagcctgggcaacagaatgagactctgtctcaagaaaagaaaaaaaagaaagaaactcttctccattttattgagtcattgctcctttgtcaaagaccaattgtctgtatttatgtgagtctatttctgggctctgtattctgtttcattgatctatttgtctattcttttgccaataccacactctcttaattactgtaactttatagtaagtcttgaagtcaagtagtttcagtccttcagttttgttcttcttctacaatattttgttggctaattggatcttttgcctctccatataaattttagactcagtttgttgacatccacaaaatagcttgctgggattttgactaggattgcattgagtgtatagatgaagttgggaagaactggcatttgataatagagtcttcctgttcatgaacatggaatatctctccatttaaagatgctccttggtttacaatggagttacatttggataaacccattatacagttgaaaaattgtaagtcaaaccatcataagtccagatattccctgacttaatggtgggattatgtccagataaacccctcataaagttgaaaaatcttaagttgaaccatcataggccagagaccgtatttagttcttctttgctttctttcttcagactttgtagttttcctcatgttgatcttgtacatattttgttacacttgttcctaagtatttcatttttggaggttttaatataaattgtaatgtgttttatgttttgttttgtttttgagacagagtctccctctgtcacccaggctgctgcgtagtgggatgacctcagctcactgcatcttcctcttcctgggttcaagcaattctcctgcctccacttcctggtagctgggattagagatgctcactgccatgcctggctagtttttgtatttttagttgagacagggtttcaccatgttggccaggctggtcttgaactcctgagctcaagtgatccacctgcctcggcctccaaaagtgctgggattacagatgtgagccaacatgttgggcctgtaatgtgttttaaattttaaattttacttgttcattgatggcatacaggaaagtgattgacttttgtatattaaccttatatcttgtaactgattattatcacttactagttccaggaacaatattcttataatttttgttgttgttttttttttttggtctgggtattgtacttggaaaattattcctcataaccatgcctatgtcttcttttagtatttttatagctcttggcatactcatatctttagtcaatttggaatttgttttgatgtaaagtgtgaagtatgtttttcttaaatggtgttatgttttccctgcatagtattattttccctaagtggtgattcacttgtcccaactccatttattgaatcatgaatcctttcttcactgagttgaaatgaagtacttccaaattaaaaaattctcaattgttctttgatttatttctggactctctcttctaatcaattcagtcttttcctgtatcagtaccatacagttttagttattgaacggtaggaatatagtttaatattctcgcttgtaactcttctttaaaattttttttgtatttctcatgcatgtttctttcaaataaacttaggcatcattttatcaaggttttaaaaaaatcagttctatccacagtaatattattttaaaattgatattaatccttaagcaacgtactttctggacattttcattttattgatctataatctacaaatatatttaacagttttaatgatacagtatataagtgatgctaacaactgttagctattcatactatttttaaagctcatatccttaaatatactaataatctgaaggaatagaaagtatctttcattgtatagcagaatttaagattttgttccagttttggttgactatttcatcagaggctctctggcatcttttgcaacaggaatggcaggaaacgtgttttatgttgattgttcaattgtttcatttgttgagcttcctccaaaagaatttgtataaatgggaggagattgaggaagtttaaggagtcaagaaggcctgagagaacagagttgttttcgtaggaaatgtgtttctattttagagtcttaaaatttccaagtactcgattttattatgtgtgatatgatagtatgaactattgctagtcgagctgaggtaagcaacttttacaggcatgaacctctagggtgttcagaacctctctaagtatactccaccctttcccaatctcagtggacttcttaaagcacagtcatttttgtaactgacaaattgttgtataagaacatgggttcataaatcaagtagacagatgtttatgttacattgcatgacagctatacagcaaatcagtgcattttgaccattttggcaatttattgatttggggtttgtttttttgttttgttttgtttttttttttttttttttttttttttagagacagggtctctctctgtcacccaggctggagtgcagtggtggtaccatcatggctcactacaacctccaactactgggctcaaacagtcctcccgcctcagcctcccaagtagtggggggactataggtgtacactttcacactcagttaatttttaaaatttttcgtagagacaggatctcactatattgcccaggccagtctcaaactcctggcctcaagctacccttccacttaagcctcccaaaggggttaaaggcatgagccactagggctggccaacaattgattttattaactcaaatttattcaacagtcttggggaaatactaatttaagaaaacaaaaccaaaaaaacacattatttctgaaatagtctcctcaatgtaatagaaatgggatatttataaagaaaataagacataatatggatggaaaatataccattacagtttgatttgagtgtatttcaacattacagactttaaaaaatctattatagggaagcatcataacataatcaaaaacagacttcagagtaacctggtttcagtgtttagtgctaacatttactagctctatgacttagggcaaattacttactcttactgagctttagtttcatctataaaatgggaacaataattatgatctcagaattatgaccagtaaatgagttaacataggaagcacttagcatattatatgacacatatacccaataaatgtaacttctactttataattatagataattaagcccttattgtatccctagataggtgcattacatgggtgtctcttttaattctttcaataacctattgaggttggtttagtaccactttacaaataaggaaagtaagcatgaaaggggttaaattgctccctgtcctgtaactaatgagttgcagtgctaggacccgaaccaaagccgttattctattttttgtttctttaaaaaaatttgtttttttattatactttaagttctgggatacatgtgcagaatgtgcaggtttgttacataggtatacatgtgccacggtggtctgctgcacctatcaacccatcatctacattaggtatttctactaatgctatcccttcccttgcccaccacccctcaacaggccccagtgtgtgatattcccctccctgtgcccatatggtctcattgttcaactcccatttatgagtgagaacatgcagtgtttggttttctgtttctgtgttagtttgctgagaatgatggtttccagcttcatccatgtccctgcaaaggacatgaattcattttttatggctgcgtagtattccatgatgtatatgtgccacattttctttatccagtctatcattgatgggcatttgggttggttccaagtctgatattgtgaatagtgctgcagtaaacatacatgtacatgtgtctttatagtagaatgatttataatcttttgggtatataactggtaatgggattgctgggtcaaatggtatttctggttctagatccttgaggaatcgccacactgtcttccacaatggttgaactaatttacactcccaccaacagtgtaaaagcattcctatttctccacatcctctccagcatctgttgtttcctgactttttaatgattgccattctaactggtgtgagatggtatctcattgtggttttgatttgcgtttctctaatgaccattgatgatgtgcttttttgtttgttggctgcataaaggtcttcttttgaagtgtctcttcatatcctttgcctgctttttgatggggttgtttggttttttcttgtagatttgtgtaagttccttgtagattctggatattagctgtttgtcagatggatagatagcaaaaattctctcccattcagtaggttgcctgttcactctgctgatagtttattctgctgtgcagaagctctttagtttaattagatcccatttgtcaattttggcttttgttgcaattgctttcagtgttttagtcatgaagtctttgcccatgcctgtgtcctgaatggtattgcctaggttttcctctagggtttttatggttttaggtcttatatttaagtctttaatccatcttgagttaattgttgtataaggtgtaaggaaggggtccagtttcagttttctgaatatggctagcaagttttcccaacaccatttattaaatagggaatcctttccccattgcttgtttttgtcaggtttgtcaaagatcagatggttgtagatatgtggtgttatttctgaggcctctgttctattctattggtctatatatctgctttgttaccagtaccatgctgttttggctactatagccttgtggtatagtttgaagccaggtagcatgatgcctccagctttgttctttttgcttaggattgtcttggctatacaagctctttttttggttctatatgaaatttaaagtagttttttctaattctgtaaagaaagtcagtggtaccttgatgggaatagcattgaatctataaattactttgggcagtatggccatttttaccatattgattcttcccatccatgagtatggaatgtttttccatttgtttgtgtcctcctttatttgcatgagcagtggtttgtagctctccttgaagaggtccttcacatcccttgtaatttgtattcctaggtattttatttattctctttgtagcaattgtgagtgagagttcactcatgatttggctctctgtttgtctattggtgtataggaaagtttgtgatttttgcatattgatttggtatcctgagacattgctgaagttgcttatcagcttaaggagtttttgggctgagacaatggggttttctaaatatacaatcatgtcacctgcaaacagaggtaatttgactccctctcttcctaattgaataccctttatttctttctcttgcctgattgccctgaccagaacttccaatactatgttgaataggagtggtgagagaggacatccttgtctagtgctggttttcaaagggaatgcttccagcttttgtccattcagtatgatattggctgtgggtttgtaataaatagctcttattattttgagatacgttccatcaatacctagtttattgagagtttttagcatgaaggggtgttgaattttatccaaggtcttttctgcatccattgagataatcatgtagtttttgtcattggttctgtttatgtgatggattacgtttattgaattgcatatgttgaaccagccttacatcccagggatgaagctgacttgattgcgttggataagctttttaatgtactgctggatttggtttgccagtattttattgaggattttcgcattgatgttcatcagggatattggcctgaaatttttttgttgttgttgtgtctctctcaggttttggtatcaggatgatgctggcctcataaaatgagttagcggggagtccctctttttctgttgtttggaatagttttagaaggaatggtaccagctcctctttgtacctctggtagaattcagctgtgaattgttgtgtttttagtagaggtggggtttctccatgttggtcaggctggtcttgaactcccaaccgcaggtgatctgcccgcttcagcctcccaaagtgctgggattacagacgtgagccactgtatctggctgtgaatctgtctggtcctggacttttttttggttggtagtctggctagcagtctgcttattttgttaatcttttcaaaaaaaccagctcctgaactcattgatttttttaagggattttcgtgtctctatctccttcagttttgctctgatctcagttatttcttgtcttctgctagctgttgaatttgtttgctcttgcttttctaattattttaattgtgatgttagggtgttgattttagatcgttcctgctttctcctatgggcatttagtgctataaatttacctctaaacactgctttagctgtgtcccagagattctggtacattgtgtctttgttctcttattgatttcaaagaacttacttatttctgccttaatttcatatttatccaggagtcattcatgagcaggttgttcagtttccacgtagttgtgcaattttgagtgagtttcttaatcctgagttctaatttgattgcgctgtggtctgagagactgttatgatttctgttcttttgcatttgctgaggagtgttttacttccaattatgtggtcaattttagaataattgcgatgtgttgctgagaagaatgtatatcctgttgatttggggtggaaagttctgtagatgtctattaggtctgcttggtccagagctgagttcaagtcctgaatatccatgttaattttctgtctcgttgatctgtctaatgttgacagtggggtgttaaagtctcccactgttattgtgtgggagtctaagtctctttgtaggtctctaagaacttgctttatgaatctgggtgctactgcattgggtgcatatatgtttaggatagttagctcttcttgttacattgatccctttaccattatgtaatgcccttctttgtctcttttcatctttgttggtttaaaatctgttttatcggagactgggattgcaacccctgcttttttttcttctttctttctttctttcttttctttctttcctttcttttttgtttggtaaatcttcctccatgtctttattttgagccgttgtgtgtctttgcacatgggatgggtctcctgaatagagcacactgatgggtcttgactctttatccaatttgccagtctgtgtcttttaattggggcatttattttgatcctgtcataatgatgctagctggttattttgcccattagttgatacaggttcttcaagtgtcagtggtctttacattttggtatgcttttgcagtgcctggtaccggtttttcctttccatattcagtgcttccttcaggagctcttgtaaggcaggcctggtggtgacagaattcctcagcatttgcttgtctgtaaaggattttatttctccttcacttatgaagcttaatttagctggatatgaaattctgggttgaaaattctttaagaatgttgaatgttggcccccactctgttctggcttgtagggtttctgcagagagatctgccgttattctgatggacttccctttgtaacctgacctttctctctggctgcccttaacattttttccttcatttcaaccttggtgaatctgatgattatgtgtcttggggttgctcttctcgaggagtatcttgtgtttttctttgtatttcctgaatttgagtgttggcgtttcttgctaggttggggaagttctcctggataatatcctgaagagtgttttccaacttggttccattcttcttgtcagttttagtttcaccaatcaaatgtaggtttggtcttttcacatagtcccatatttctaagaggctttgtttgttccttttattcttttttctctaaccttgtcttcatgttttatttcattaagttgatcttcagtctctgatatcctttcttccgcttgatcaattcagctattgatacttgtgtatgcttcccgaagttcttgtgctgtgtttttcagctccatcaggtcatttatgttcttctctaaactggttattctagttagcagttcctgtaaccttttatcaaggttcttagcttccttgtgttgggttagaatatgctcctttagctcggaggactttgttattacccaccttctgaagcctacttctgtcaatttgtcaaactcattctccatccagttttgttcccttgctggcatgaagttgggattctttggaggaacagaggtgttctgttatttggaattttcagcctttttgcactgttttttcctcatctttgtggatttatctacctttagtgtttgattttggtaacctttgaatggcgtttttgcgtggttatcctctttgttgatgttgatgctgttgctttctgtttgttatttttccttctagcaggaccctcttctgaagttctgctggagtttgctggaggtctactccagaccctgtttgcctgggtatcaccagtggaggctgcagaacagcaaagattgctgcctgttccttcctctggaagcttcatcccagaggggcaccatcagatgccagctggagctctcctgtatgaggtgtctgtcaacccctgccatcaggaggcattggggtcaggcacccacttgaggaggcagtctgttccttagcagagcttgagcgctgtgctgggcgatccgctgctctcttcagagccagcaggcaggaatgtttaagtctgctgaagctgtgcccacaactgcccctttcccctggtgctctgtcctagggagatgggagttttatcaataagcccctgactggggttgtggcctttctttcagagatgccctgcccagagaggaggaatctaggaaggcagtctggctacagtggccttgccaagctgtggtgggttccacccagttcgaacttcccactgggtttgtttacactgtgaggggaaaaccacctactcaggcctcagtaatggatgacgcacctcccttcaccaagctggagtgtcccaggtcaacttcagactgctctgccagcagcgagaatttcaagccagtggatcttagcttgctgggctccgtgggcgtgggatccgctgagccagaccactcagctccctggcttcagccccgtttcccagggaatgaacggttctgtctctctggcgttcaggcaccactggggtatgaaaaaaaactcctgcagctagctcagtgtctgcccaaatggccgcccagttttgtgcttgaaacccagggccctggttgtgtaggcaccccgtgaaatctcctggtctccaggttgtgaagacagtgggaaaagcgtaatatctaggctggatagcaccatccctcaccaacggcacagtccctcacggcttcccttggctaggggagggagttcccagaccccttgtgcttcccaggtgaggtgacaccccaccctgcttctcctagcctttcgtggcctgcacccactttctaatcagtcccagtgaggtgagccgggtacctcagttggaaatgcagaaatcacctgccttctgccttggtctcactgggagctgcagccatcttacccgggaatccccgaagccgttattcttaacgagtgtgacacacaccagttttgagcagtagcaaaaggaacaacgtgcatgttggagactcagatcagaacttgaaagtcattggaaaatggaagaaaggacaatatgaatggggatttcagttgaagaaacttttaaaagcagtagtggcatgcatctggttgatgtagaaagaaaagagttcagacaagggtgactaatgagagatagtaaaggaaagtggaatgtatgagtcatgcagtggagaggtttccttttggcaactacacttgctttaagcacaaaaaaagagaatagcttgctgaagacattattatagcattaatatatgagtctgaggagaattttttcccatttgacttgctttctatttattatctttttcttttctagatgattccatgtccaagtatttcagatgccactttcttattctcatttgactgttatttcttaggtatattttctggattaaaatagagtagtttttagtttacatttgtttttgttaatctccataatttgtttatatgtggtcatggtgctattctctggttcagaattgaggtactaaaagaagtaggttttaattagcatgttaaattttggtaatattgaaaggttccatttattaggtatgggattttactgtaagaagttagccttcttcaagatttttctactagtactcctttcactttttaaaccaactttaatatactgctataaattcattatttttctccttctagtctcccctccccgtctctcttgtgagaaaataatttgaaatcagataaggtctttctcctgaaggaactgacaatttagtatctaatacagtaagtgccatgcaagagcaggaaagcaaggaacattaaattctgtggcacagaggacagacattccattaagatacgaagagatatttcagctgatccttgaaggcttgtgacagagcttggaaaggcactctagacagaggaacagcctgaggaaggcatagagcaacccaggtcattcagtgagctgtagcctaaacaaggggaagcctcctacagatttcactgtacctcctgtagacaaacatgagtcagggtgattgcttctaaaagaggagttatagttttaacctgcgactagtgggcagctagtgtcacagtaagactaagaaggaaggacataaaaaaaattctgcagagtggaggcaaagctggagtacaacatgagggaaaaagccacatatacacctatagctctccacctttgagaaaacttgctagagggaactccacgttccatagatgaccccacttgctcattgctggctgtttttctctcagtttttaatgttttattatgcagctatccattgatccttttagtaatagatgtatttattgaacttgtgccatgtaccaggtactgttctatgttctgtatattttccagcttatttaatagctttcttatgatttttactttaatggtcttggtaacttccctatgttgcatagatcacaactattacacagccacctccagctgcagggtaagctgggaaagtgagtatttagcctttcttgccttgatagtggaggccggccacaaaaatggaagttagaaatgagtatgtctgctgcaaaatcacttttcttacttgcttcctttgtttatttctaccccctttcatttctttctcgttgtaaaactaagttgttagttttctctgaagaaactaaaattctttaaagattaagaatcttcactattgtatttgacatatatattaaagttcatgaagaataaattacagcttgggttttaaattttacttgtatagattaacatcaaattttaacattataaaagcaattctacagaggaacatttacattatgctacagtatcttcagttgtaccttcctgttcagcataaacatcatatgccaaagaggtactatattttgttgtatatttcctttgttgcttttttaagacattattattatgaatcaaatgtcagttgtttattttacttacattgaagcttttagttatagtgagttggactccaaatttataaagcagtagaatcatttgataaaagcagttggattagatcattcattcattaaatattaagttcctgttatgtgcctaagggtatggagagatgaaagggttagtagggaattatatttgaggataggctgtctctatgaaaataaaagcaattaccaattttaatttaaaaaacaatacaatatacatagataaacacttataaacaataataaaatataaacccataaacacccatgaacaacaaaatacacacccataagtaagtggatgggtggatggatgaatggatggatggatggatgaatgggtgtgtggacagagactgatagacacttaataaattaagattaatgttgtggttaatggtgtttcaatattatgttgtctaaaagtatgttaacttttttaaaaaattaaggttgacagatttgcaatggaattagaacaaagccgaaatttgagcaataccatagtgcacattgacatggatgctttctatgcagctgtagaaatgagggacaatccagaattgaaggataaacccattgctgtaggatcaatgagtatgctggtaagtaaagatcaaatacaaaaaggaaattttataacgtactcaagtaagctttactgtttcatgaagggggaattctttattgaggtctaccagtttgctgagtatttttctgggtgccttatatatgactcaattactgaatcctttcaacatactttaaggcaggggaccccaacccccagttcacagattggtattggtccatggtctgttaggaactgggcctcacaacaggaggtgagcgtcaggcaagcaaacgaagcttcgtctgtatttacaaccacttcccatcacttgcagtatgcccgagctctgtcagatcagttgtggcattagattctcataggagtgcaaactctattgtgaactgcacatgtgagggatccaggttacatactcattatgagaatcaaatgcctgatgatctatcactgtctcccatcacccccagatgggattctctaattgcaggaaaacaagcttagggctcccattgattctacattatggtgagttgtgtaattatttcattatatattacaatgtaattataataggaataaagtgcacaataaatgtgacgtgcttgaatcatctcaaaactatcaccccaccagtccgtggaaaaattgtcttccacgaaaccagtctctggtgccaaaaaggttaggaactgctgctttaaggtactagtttttatttccatttggcaaaaaagaaaactcagagagatgtttaataacttgcccaaagttacaaacctaataatttccatggcaaattaaatttttccataagtaaccgttctagttaaagagagttgaagaagaaagaaaaggaaatgttattctaaagtattaatagagattttcaaactgatctgcaggccaaatccagctttttattggaacaaagtcacacccatttatttattactattgttgcactaaaagagcagagttcaataattaagtgatctgcaaagcctaaaatgattactatctggacttccacagaaaagaaaaggtttgccaaccctagttctggaataacatacttcgttaatagagtacatttagaatgcagttaaattgtttttcccatgacttagaacttttgcttttctgattactgagttgctcttcctttttaccactctaaccttagaagaaccaggatagctatgtgtggctgaaagtgtgttggaaattaaaagtagcaactaaaatagatgagataatatttaaaaagtattagaaaaacaagaagagttcttccctgttcctaactccttcccatgccttagatagctacaaaactaattcttactgagtgattattttattataaaactataatctgtttgtttttttatctctgcctctgtgagtatgcaggcagctgataagtctgattccaaaacactgttttttgaaaggaaactcccctttcctacaaatcatcaataaatatttcaaaaaatatatttaattttattaagatataacaccataaatttatgtatgtttatgtatgtgtatacatacaaacttgctgtagccatgttaaagctaaaccaactgcttttgaaatctacaaaatattttctttcctacaatttctgtcctcctaaaaatcagttattgtttctaaattcaaaattattgttatatttaaacaaagattaccccttttgtatgttgaacaaatagttttcccttctactaagcataactttttgtcctattaaacatatgaaagtatatctacaaattaatgggagtgattgtttgattattcccactgataaaattcttttttggcgaatttgatggatttttgaaatgttctaacttggcactgagagttgcaactgagatcctacagcagttacctattgctgcataacagcctcccccagtatttagtggacagccaaaatttatttgctcatgattctgtaatttgagcagagtgcgatggcgatggctcaaccttgctctacctggagttggctagggcaatttaactgaggctaaaaaatccaaggtggcttcattcataggtctggcacttcgactgaggagattggaatggattccagcttcagaactttctcctctccattgttgcttcaacatttagtaatctaccccaaaatatttacaatggttgctggattacaaaaagcaaaagcctaggtttcagaactcagtgtcacttccttcacattatttttatcaaggcaagtcacgtggcatgaggaactagaacccacttttgataagagtaacttgtaaagtattgtggctgtgatctacaatataccacaaatctaaaagttagagaaattcttatttaaaagtttgtttgtcctctgctatagatctagcttttatgtcaattatattaaacttatttactaaaccattggttttgtttctagtgctatccacattttctgttccagaacactgaccaaggattagtatagttctgagtactatcaagatgttttaagtgccatttgaaaatcattagacgaaaattcatattattctgaaataatcccttcatttgtttctgttttgcatttctttgaaatttcacttgagattctaaataaggatttaatttgtgataaaatttgttttataaatagtactgtggtctaccacgttcacatagactttcatcagatatcatcaccaacaggatttaataagcaatattctcctttttactctcatacttttgtagttccatctcctagtcaaaatgttttcagcaaaaaagataattaagccttaagaaaaaccttaatttctaaacttattttaagctttaatcacttcattttggagacttaatttggctgaccacatagaccttttatttttgttctagatgaaaagtttccaaaatcccaaatagaccaaattcgaaaagtttactattatactatactattactttatataatgtaacatctatactaattgtactatactattattttatgactattctatacaacttaccatactattactttcatgtaacataactcactatcatccaaattttgatattcattctataataagtatgccttaaaaccaatgaagtttagttggtagaaatataagaaaatctttttattagcacagtcttgcttatacctggtatcacattataaatatagggatagtaatgggagagggtcatggtatcaaaataccgtgacagaataagtcaaaacttggattaaaacagtggcctataatcagagaaatgcaaatcaaaaccacaatgagataccatctcacaccagttagaatggcgatcattaaaaagtcaggaaacaacaggtgctggagaggatgtggagaaataggaacacttttacactgttggtaggactgtaaactagttcaaccattgtggaagttagtgtggcgattcctcagggatctagaactagaaacaccatttgacccagccatcccattactgggtatatacccaaaggattataaatcatgctgctgtaaagacacatgcacacatatgtttattgcggcactattcacaatagcaaagacttggaaccaacccaaatgtccaacaatgatagactggattaagaaaatgtggcacatatacaccatggaatactatgcagccataaaaaatgatgagttcatgtcctttttagggacatggatgaagctggaaaccatcgttctcagcaaactattgcaaggacaaaaaaccaaacaccacatgttctcactcatagatgagaattgaacaacgagaacacgtggacacaggaaggggaatatcacactctggggattgttgtgtggtggggggaagggggagggatagcattaggagatatacctaatattaaatgacgagttaatgggtgcagcacaccaacatggcacatgtatacatatgtaactaacttgcacgttgtgcacatgtaccttaaaacttaaagtataattaaaaaaatatatgatagaatgatgaccttgagtcattaataaaaaacaatgcttaatacattctatttttggaaaacaacaaaaacaaaaacaaaaaactggcctataaatgaaatgtccttgaattgaaaatgcacatattaatgtgtttcttatgaatgcattgatcaatatgtccatttaggtttgtgtatttttttccatgtggtcaattttctttcagtctacttcaaattaccatgcaaggagatttggtgttcgtgcagccatgccaggatttattgctaagaggctgtgcccacaacttataatagtgccccccaactttgacaaataccgagctgtgagtaaagaggtaagttaatgtctcacccctactttaggctttcactgagttcctgtcacctacagaatctcaagtccaagtgccttagcacgtaggatttggtcttagcttatcctttcagttgagcctcctatcacttcttcagcttgtatattgaatactgagctgcatatagcatccagaatacatcattctttttcccaattctttgcctttccatgcagttttcatttgcttagaaaacttcccatttcctcaaactttgaactgccttaatgataatataaaattaaatttagctattttttcttaatgtacaatatacattttttctagaaccacattttatttataacttacagaatctactcatcattaatttcaacctattgtctgaataattacttattaatgttgttaaacagtgacaaaattcatgtattttgattagcctactttacttgccccataatcatttgctgtctaagagactgataattgaaaagggagtaatccattgcttcaaaaaggatctttgaagtagatttgattatttactaaaattgccaaactgtcatatgtgaaaaccgccattttttctattttttatgacaactggtctatcatgcagtgctggaatttaatttttgaattaaaattttagactactacatcaaatacttttagactgctatagtaaaatgtgtttaagactgctgcctgaatggaaacacttaaaaaaactgtgacctaatacttattactctttagttataccaggggtctttaaattcacccctcttatttgtattccacctcattttccctagaagtgacactattccaagtttaaacacaggtttgtttgttttttttctgtccaaggcagtctgtgacagcaagtgctttttgcatacctctgaaaaggtggtggaggagaggggagcacacttacatttggttactgcttatctctttcattgtattcctaattaaaaagagataaaatactaatcataaatatagccttttaagaagttttaaaaatcctacaaaagtttagtaagaaaaggtattttttaaagtcgtactttaactcagcaaaacttctggcagtatgccagtgaaaaccaaagtgtttttagttattttagtctggttatttatgtaagtcagagaactcttcaaatttgagccggatctagctagtttatatgcagataacaaatgagttcttctgtgtaaatgaactgtagaacaaattcatcactgcctatggatacataaatattcatgacttggttagaaaatttaagaaaaagccctcccgttttttttgacacagggtctcaccccatagcccaggctggagtgccgtgactcgatcatacctcactataaccttaaactcttgagttaagcaatcctctggcctcagcctcctgagtagctagattgacaggcatgcatcaccacacccacctaattttaaaatttttttgcagagatagggttttcctatgttgctcaggctaggcttaaactcctggcctcaaaaaattatcctgcccaggcctcccaaagtgctgggattacaggcatgagccatcatgcccagttagccatttttgttttatccaaaatattggagctttaagtgcttgatttttactggaacgtctcttttaattcttacagcaatatcctatgtaaaggaagttaataaatactcaacagtgtctctagggagtacttctcattcagaatcttagttggctgccagttacagacttcacagagtttcattttcattggaaagattctatttgagcacattataacaagaacaaagctaattaaggcactctctgagtaaaacttggccaagtttatatcaccattttctaaaattccctttgactcagctgttcataattatattaagctaaaaacctttgtttttataaaagaagaaacagttttctcatgatacagtagacagttttaaaagctaaatggaagcttaacgtaattcagcaaatatgttttctaatataaattttttttgaggcagggtctcactctgtcacccaagctggaaaatatgcatattattttgacaaccattgcctctaattatagctaatacttaagtggttagaaaaaaaagtcatagttttatgtagtaacactatgttatataaaaggcatttctgaattaaaagccactataattctaatctttatatgtatttcttttatcctaagatgttactccagacttttccccatcatttaaggtaatcatggagtacactatagattgtcatttttttccattccagatcttaataagtaataggaaatagaaaacattccttttcctgtatggattaatgcattaattaatgttaagtggacttttatgtgcatgttataattaattggaatattttctaaagcaacatagtacctttatataagattattcctttttaaaatgaaccaaaaacaataaatcacaaaaggcaggagggaatagaatcctatcattcccacttcagcttctgacgagctacctaaaaccttaaccatttttttgtatgggcctaccagataatgttttctgagatttatttgaattgcttattataactagatataggtagctaaatagagattgtatcaaatgaagctattttatggtcttctgccttcatggtctattttaatacaaaaggaaattttgaaaatattccctggtagtggattatttattccttaaatccatgaactattgactgcaggattgttactgtagttgcaaactaagaatattaacatttcttatcagctacatatgacagaagaagtttgctatcacagcaaaatttaaacttttttttgtttcctttgaaggttaaggaaatacttgctgattatgatcccaattttatggccatgagtcttgatgaagcctacttgaatataacaaagcacttagaagaaagacaaaattggcctgaggataaaagaaggtatttcatcaaaatgggaagctctgtagaaaatggtaagcaacttattaagactatcaaaccaagaagcagtgaaaaaaaaaaacccacaactctttgaattaatccaattaatttattagcctgcataggtagaagggatagatatgtacctttataaaaatgtaaaatcagaaaattttaaaaataccagtgggttttctgagttaaacatgtggaatatcacatataaacaaaatgtgattgttaaatctctgagcttaagagtctgcagagtccctgaacaaagtaattttatagcagttattttcctaaggtctaactaacaaagagtttggatggcattgaagctgaggaagttgtctgtttaaagcggccttttcttgttgttagaaaagactagcctcaaacatatcaaaacattggatgattctatttttcttcattttcctaattttctataatctaattattatagcaattatgactgtttttagctctgccaaaattaatgacttcccactcccttctttgccttagactttataatttcaagactccagggtttttttaaaaaaataatccctttatgacctatccaaaagcaatgccaagaaacatgcagatattacacatactgctttcaacattttgtcaaaggtatgattatgtctgagatgtcctggacccctgaacaaagttcacctggatgaaaaagtgacacagaagggtttgctcacaacccacaggaacatttcatgtgcaccactcattgcttcagacgggccaggcagtgctggggagacctgtttgtaactttccctgaagcaaaaatggtagatccacaatgacattaatctaactctctcacattatttgtgactcacatcatttgatgcaagtttaatatgggcatcaaatacaacttcattaccttatttaaagtgctaagggatagctctctctttttttttataggagcattaaacaataatcatcatttctcgacacaggcacagagcaaaaggttttccttatttggtgtaactttattgtttgaggatgtggaacataaagcctgatgtcactttgtataaaatcttactttattaattccttactttcacaagagaatgggggaaaatcattaaataattatgtcaaagcatcccctgagggcctcccataacaattacttgcatgatgtgttttaaaagctttacattgggattaaagtaaatgttttcattttctactaatttttttcttttttttgagatagggtctcactgtgttgcccaggctggagtgcagtggtgcagtctcagctcactgcaacctccgcctcctgggttcaagcagttctcctgccttagactcccaagtatctgggattagaggcgcgtgccaccacacccgactaattttttgtatttttagtagaggtggggtttcaccatgttggccaggctggtctcaaactcctgacctcaggtgatctgcccgcctcggccttccaaagtgctgggattacaggcatgagccaccacgcccagcctactaatgttcttttcatttattataatgtccaaactcactatgaatatgtgaatttttaatatctattgcttttaacatatttacttgtatattgccctcttcgtgtattttcatattcttaaacaattggaatagttaaacttttcttctcatgtgtaaatacctgtgggctggactttcaggcgtgtctcacctcacatcatgccatgggaaattgtcaatagtgcattggaactgtggaaggcaattgatatatcttcctctaaagtccaagacattgttttgctgtttccccattttctaaaaggtgtttgtctttggaaatatattgctaactaccatctctacatacaaataaaataataattttttaaatgtttactctcccatgtaaatctggatggtgagtgccagataatataagaaactgaaataccatacactttttagcacttgtcttccaaatgaaatgctttaatcctagtgttacattctgattaccttagttatggggattataaagatgtttctgtcacaaagcaaataagaaactacttcagctcttagttacacagccaggcctcacaaaaaagtagaaagtagttcagattgaaaaggtacctgaacattctgcagcagctctgataatgtgtgagaaggcagcattcttcacttcctgctgtatagttctgctctcacagtggctcacctgagggcagggtggtagaggcatgaggtacaaaacatggcataaaaaactctgcagaacgggtttatgaatgtggcagataacttacttggtttgcagtttttctgtagctttctttaccgtgacttctacccatccagatggggaaaagggctccaggtagataccatttcaattgtttcacagtctttattttttttttatttttttttatttttttgagatggagtctcactctgtcaccaaggctggagtacagtggcacaatctcagctcactgcaacctctgcctcctgggttgaagtaattctcctgccccagcctccggagtagctgtgcgccaccattcctggctcatttttgtatttttagtagagatggggtttcaccatgttagccaggctggtctcgaactcctgacctcaggtgatcctcccacctcagcttcccaaagtgctgggattacagacgtgagccaccttgcctggcctgtttcccctctgaattgttctacattttaaaaccagcatattaaaaaatgacaggaactgaagcacataaatatcagctaatgtaagtttgaaaataaggcttattggcgaggcaaggtggttcacatttataatcctagcactttaggaggctgaggtgggaggatcagttgaggccaggagtttgagaccaccctgggcaagattgtgaaaccctatatttaccaaaaaattataaaattagctaagcgtgatggctcgcgcctgtagtcctagctatactccagcctgggcaagagggagaccctgtcttaaaaaaaaaaaaaaaaaaagagagaaagaaaataagcttattgtgtatgtgccctgggaattcagatttggaaaacatctgactgaattaacatctatgacttacttcacactacatattttaaatttttaaattaatcagatgtctgtcatatttattttatattatctttaaaattttttcctaaacagccaaatacatttttcaagtaatatacattcgtatgcatcttaaaactagaaatttaattttttcttctgtattgaccttaatttggaaaatatttatatgtaataaaattacgagatgggatcagaaagctttgttgctaaccttggttgttataaatacatttaaattgtatttcttctacattaagccaagaaaacaggctttaatagatttgttcatggagacatttttagtatcagtatagatttaagaatattttacagtccatttatgaaaaatataaatataaagaggcaataaccagactggtatttttactttactttgtaataatagtttatagcctattaataataacgtctctttttcttaaacttggattatccaatcagaccttcagaatttgtatattcaaagaagcataactttcacaggtaatttctatttattacaaatgtgcccttagtcaaagtgatactttataaacaagcaaatcaaaattaaaatcagcatttgaaagaagaaaattcagattattttaacatctaaaaggtttcttccataaatgaagaaaagttaagtgtttttccttctaaaaacaaaacttattttcagtataattattatatattgtttattatattctaaattctaattttcgaagattctttttcttcctaaagaagaataaagaaaagatttcctttttttttttttaagaaaaaggtaatgtgaactgaaacctaattctgaatttcaattaatttaggtacgaacattagtgagttttacataagatatttccttttaatatttatactgtggaaatggataatagtctttttaagaaaaattcataatcagtgttctctttaatggttataaaacattaaatgataaatgatggcatttctgatcttggatcctagaaactaaactaaactagatttttgtttttgtcttcagaaataatgtagggaaacctaacttatgaagtatatacttcttaaaataaaggtgagttattttcctgtttatgacttagataatccaggaaaggaagttaataaactgagtgagcatgaacgatccatctctccactactttttgaagagagtccttctgatgtgcagcccccaggagatcctttccaagtgaactttgaagaacaaaacaatcctcaaatactccaaaactcagttgtttttggaacatcagcccaggaagtggtaaaggaaattcgtttcagaattgagcagaaaacaacactgacagccagtgcaggtatttaaaagagtattgatggccactgtagttataattttcagactggctaatttaagtgtaatattagtagtttctcattataaagtatatagtaacattttacttacttagtctttcattcaacttctaacaactttacctattcagaatagctgtgaacctagtaagtaaattggaattaagcagactatgagcctgaaggaaaaaaaagattatacgtttctttctttttttttttttttgagatggagtcttgctctgttgcccaggttggagtgcagtggggcgatctcattcagcttactgcaacctctgcctcctgggttcaagcgattctcctgcctcagcctcccaagtaggtgggactacaggcgcatgccaccatgcccagctaattttttgtattttcagtagtgacggtgtttcaccatgttagccaggatggtctccatatcctgacctcatgatccgcccaccttggcctcccaaagtgctgggattacaggcctgagccaccgcgcccgactcataaatttcatatagctatctttttctagcacaaaatatatttttattggttttgcatgtaataacttgagtattagtttttccttgggagacttcaatcctgtccaagattacattgcaggagagaacccagacggccacaaggtaagagacaaaagaaatactaactagcaacatagcaatccagaacaatctggtaaaaggaaaaacaaatttacatatgttgataacccatgaggccatcactgtctcttaacataataactgttattcatcatgaggaccctgaactatcttgtaaaagccatattgtgattaggtaaatcttttctttctacaccaaagcatgagaatgaataatgcattttaggaagatctatataacaattaaaatgaactgtttaatgaatatatttgaatatagctatttcaaattatcttaattaggactcctagaaattgtgaaacatctttttgaaaaatagtaatttgttttgtgaataacataaaaaggatacaccatctaattatcattattttaaatatactgtaaccagaatctttgattttttgctttatgtggataatctacgcaaaagacattttcaaagagtaaacatccaccctaaattatattctgtatcttttcttagagatagatatagaaccactataaaaacaatctgggctgggcatgatggctcacgcctgtaatcccagcactttgggaggccgaagctcgtggactacctgaggtcaggagttcgagaccagcctgaccaatatggtgaaacccccatctctactaaaaatacaaaaattagccaggcatggtgttgcgtgcctctaatcccagctactcgggaggctgagacaggagaatcgcttgaacccaggaggcggaggttgcagtgagccaagatcacgccattgcactccagcctgggcgacagagcaagactccatctgaaaaaaaaaaaaaaaaatctgtattcctactaaaggtagtaagtaagctaatagtaacacttaatattgcttagctcagaaattactcttacattttaaaatgtcatggagaattaaatatttctcatttttgctgccacaatgactgtaactagtacaatttattttcctaaaaccatagcaaaccctggggagatagatggtaatcaaatgttatttttaaagtagcattatatatcatttgagattttttgcaattaactttttttttctgttttgttattgcatatttaaaagtcatacatatcaacttctttgagtcatcagagtattcttcttttaaggcattgccccaaatacaatgttagcaaaagtatgcagtgataagaataaaccaaatggacaataccaaattcttcccaatagacaagctgtgatggacttcatcaaggatttacccattagaaaggtaagatttttacataaagtttatttatatatgtactctgaattctgaagagatactgtgtaggccaatagttaatcattctttgcttaaaagttttaaaataatagataaaagcaagaactataatggatgattgaatttggacttgaagaaacctttctatgaaaccataaaagtgagatttagcttatttgctataaacttttaagaaagtaataatcagatttttaagtgaactactgccaaggagaagggaaattaaaagaatatttctaacagtcctttcatctgtaacttagtgctatcttagttctaaagtccagattgctactagattaatgggcatgatgcttcaaagagatttagaattttaattgtttttgacagagaataaaccaaaatattttgccatttttaaaatggtaaaattatccctcaggggttccagaaagtgtatactttattattttttagagcttctagatttttctgcatatatacactattttttcagtaattgcactatgcactactgtatatgatgttctaggacttgcttttctcattcaacataatgtacatgaatgaatttaaatatttttcaatgctcagtatgtaatatgtaatgattactgactagtatatgtgaggagtagctgcaaagcagtgttttccaatatgtttttcaagtatggatagatattccctttaaaaaggttctggggtcagatacctttggaatgtaccattgatgtgtcactatgcatattaatatattaaaaattcataaatcttggaataaaaagtttcacttaaatttgtcaatcccaccattccccaagtttatatgacaacagcactccttttttaatgccttttgaaattccatgaaacgctagtttagtaaatgtggtcaaaaagtaattaaagcagttttcttgcatgacttgtgaagatagtcacattattcataccttttatcgatgataaaagatataatgagcactttgggaggccagggtgggcggatcacctaaggtcaggagttcaagaccagcctgaccaataagaagaaaccccatctctactaaaaatacaaaattagccgggtatggtggcgcatgtctgtaatcccagctgctcaggaggctaaggcaggagaatcgcttgaacaacccaggaggtggaggttgtggggagccaacttggcaccactgtactccagcttgggcaacaagagcgagactccatctcaaaaaaaaaaaaagtgtaatgaggttgtaatctcaatttttagcttcactttaaaatctattaataataaatattgattcttttctaggtttctggaataggaaaagttacagagaaaatgttaaaggcccttggaattattacatgtacagaactttaccaacagagggcattgctttctctccttttctctgaaacatcttggcattatttccttcatatctccttgggtctaggttcaacacacctgacgaggtatctatatgtattgtcattctgctttttcttcagcatttgctgcaatatcagttttaaccattgagatgaggctatatggataacatgttttaaaattctttcaggctagtttaattcaaaatataatgtttgaattagagtcaacagattggatgtaggaggaaagaaaagaagaataaagaatcactcctaggttgtggtgtcagcagttgtgtagagagacaagaggaatgatagtttcttttttatccctaccttgttctttgttcagaacctaagagaaatgccagtagtcaggttgttgtggaaagaaagatggccgtattccataattcaccctttaaggaaggagatgtaatgattcttcgaaagccttaaactacatttcttttcttttccggattcattcattcagtactgactactttactttgtgttaggcactattctaggcactgtagataacagcagcgaataggacaaattcctgccctcatggagtttacagactagtgtgagagatagaaaataaccaaataaacaaatgaagaaagtaaagcagagtgagggtatagaaaatgactggggggtaagtgtgagggttagcaaccatcatccaaaggcggagagacctgagggagccagccatgcaaaggctggaagagggaacaggtggaggaaataccctgggttttcttccctgccactctttcatctaggtcttaaaaagaggaaccctagaggtagaaggtaaattgttgtgggatagtaggtgaaaagaaggaaattttaaaagactgggaatcgtggaagtcaactctgggcactatttttacaattttgtcatcaccttgtcagcctgtcctcaaaatgactcctttatattcttgtatttaaactaaaggacaacaatagaaatcaatgaggatgcatataaaattgatggactaattaagcctactaaattttacagagattgcaaggcttgttgtgttgcttttctcatctcttcctgctcttcaatcttttgagtccacagttagctgactttgatcttcagtgggcataatgaaagatgaagatatcacagcactataaataattatatttgaagatagcaggaaataaaactttatttttaatccaaaaatttttttatttccatagtgcttgaaaacaatatagttctgatgtaacataacatatattaacttgtggtatttagagatccaggtaaggcttttacatgcaattcataggtaatttataataacaaataccaaacctgcctttccctctgtccatattctctattcccctattctgctttgctttttaatctgagtacttctcccattctaatccattccatatttactactatatttgttatctgtctttctccaatatataagttttctgagggcaagtacttggtctatttccttcattactatatcctcaagttctagaacagtgcttgaatcataataggttcactaaatatttggaaaatgagtactctacatgtcatttcaactttttggttttaactaatcctgtcagagcagctagaatacagccaaactaggtgattcagattcccaatcttcatcctatagctgtgtaccaaattctgactgaggttctattatagagtggtataaatgaataatgaataggctatgggagaaagaagttaatatactaaaccaaaaactagataactgattttaaattatttaacatttaattatattttgtaactggaagatattacgctatcacttcctatttgtttttataagttgtggtttttgatagtcaggtttttaatagaagcaatttctaatatctacctattttcaagtttgttctcttcaatagatatagacttgattcataatcatattagcatcttacctacctatgttctttggtgatttgtttttagataaaaaactgtttttcatgatgtataaattttaataaaaaatttgagagctctaaaaggtaattgataatgttaaatcctcttggttaactaaaaaaaactcagtctttgaaaaataaagacctttttttttcatttcaagggatggagagaggaaaagtatgagcgttgagaggtaatgttttattatttattgttaattgtgcataattcatgttattttaaactaatattgaattaatttttagtaaatatcactgaaataagaaatctatttgcaaattactataacagtttttagtagtttacactccctgcaataaatgccttagtataagactattattttcagttgctataatctcaaaaattaacttcagctattttttaatgttggttttaatcctacctagtgaaaaccaagcattttagaatttcatatcttaatttctagcttgtttataaggacaattgagtatttacttcggaaatttaagaagtaacaatgggaattcttcctaaaattctttcaacattggtgattaagcagaagcttaatcaaacagtaaaatattactgataaaagagagcttaaagatgatctagtttagtggtttacaatcctgtttgaaaaccaaatgaaataatgatggaaacttaccgtttggggaaataagtcattgtttgaaacatccctcaattatctcctcaaagcagcaagtttccactgagacatttaagaaacactgacctagggcccggcaaggtggctcacccctgtaatcccagcattttgggaggctgaggtgggcagatcacttgaggccaggagttcgagaccagcctggccaacatggcaaaaccctgactctactaaaaatacaaaaatcagcccggtgtggtcgcttaaactttaatcccagctacttgggtggctgaggcacaagaattgaacccaggaggtggagtttgcagtaagctgagatggcaccactcactccactccagcctaggtgacagagtgagactctgtctcaaaatcaaaacaagacaaaacaaaacactgacctagtacaagattgtgttcatatttcacatatattatttgtggtcagaaaagctgattaacttttacaatacaacataataaatggctttgataaaaattgctattttaggttttggtccatatgaaagcaatcaaagagagagagaaaaaaaaaatccaaaagcaaaatagtattgccatatttgataaatttctctgccattttctctgctattgggaaaactattttatgtacaggaatgtgttctccactttttttttctggaaactttctccccttggctttctaaaatgggcaatataacatcaaatttggtatgaagttgggggaaaggaggttgcaatttatatcacaaactaactaacttctctaatatagaaagaactcataatcaataaaaaggaacagtaagccaacagaagaaatgaacaaagttctaaataattaacagaaaaggaaatacaaatggctcttaaaacaagtgaaattactaccattttcatttataattaaagaaatacagattgaaagttctctcagatacctttctttcactagtcaggttggcaaagattctaacatactctattggcaagactgtaggagtgaaaaatgtgtaaactttagagggagtacattaggtttttttattgctattaaaacaaatttctacaaatttagtggctcaaaacaaaacaaatttattctctatcattctgaaagtcagcggttctaaagttaatgtgttggtagagttccatttcttctagaagctctgggagagagtccatttctttatgaaaagcttctagaggccacagaatctttggctcatagcctcagcaacttctttctctgactctaaccctcctgcctccttcttataaggacccttgggattacgttgggcacagctggacattccagagtaatctctgtccgtcagaatttaatcacctctgctaaatcccttttgtcatgtaagatactaggttcacagattccagggattaggatgtggacatctttagggaccattatctagcctaccacagggggtaagaaatttcataatatgtatcaaaatcacagatacacatgtactttgatgccataattcttttactaagaattaattccacagatttagtcacatgtcattttacatatatacagggttactcactgcattttttatgatagaaaaaaactgtaatatccatgaatagagaattggttaaattaccttacatcattaaattagaatattatgctgctgtataaaaatgaggaaatcatttactcatggggaactctcaccatgataaattgagaaaagcagggtactaaacaatgtatctaaaattctactgtttatataaaaaatgagaggaaaatgtcttcttgtttgcttattttatatatatacacacatacacacacacacacacacacacacacacacacacacacacacacacacacgtggaatatttcttttttttgtttgtttttgagagggagtctcgctctgtcgcccaggctggagtgcagtggtgcgatctcggttcactgcaagctccgcctcctgggttctcgccattctcctgcctcagcttcccgagtagctgggactacaggcgcccgtatacgtggaatatttctaaggaattcataagaataagaagctgacacattggttgccactagggaagagaactgagtagctgaggataaggttagaagtagaaaggggactctttactgaagagtcacttgctcagggtccatactcatcattctggtctctttgtattatcctcttttaagttaatatcacttgtcaacttctttcaacacttttttgcagatgaattcaaaatacctacatttaatcttatcagccttctattttcagctgtctattaaacaactctgcgtaggttccatgagccaaccccttaaatctacttaaagatgtttctcatccataaaatccatgtgcagtaattggaatgatgttctcatttggactttcttaagataatcttctgtaataaagtctatatatacatataccctaatctgttttaagttctggaggcattaccattatctgttggtaattttaattatcttttttgtgatataatagagcaagagcataaaattgtttctttgctaatcaagctttcctgtttaggtgggtttccattatttatatagatcttagatgtttttacttaattaaattttagttcatctgaaaactttattttgtaatacagaaaaatataacttaatgctagccatataaacatgcataccatttccaaattatcctggattatagtttactttgtgcgccaaaattattcttgtctttctaggacattcagtgagataaataaagcggaagagcaatacagcctatgtcaagaactttgcagtgagcttgctcaggatctacagaaagaaagacttaaggtgctttattttgatatggtgtccttagtttttaagttttttaatagtaaaatgctaccttaaaagctagagttagattacacatttcttaaagatgaatacaaattaataaacgtcagaatagtgtattcctatccccaacagtcagatacaaatccaattctgacccatatctggagtctgtgatgaggtgattctatgaagaagcaccttatgagaatagagtggttcagtataattcagaggactttacttctgtacctcaggagtacatttgaataagttaaaaccaaagttacactggcattagagaataaggcaaaagaaaggatttccagagaattgtattcacatattacaaatgtctttccaatcatcctttaatgtttttcttacttagacaatgaccttctaaaataggcattttgtttcaaggttgtagtccaggttgcttaacacaggacaacaaaacctataaggctttgaacttgctattttataatcttcactcacaacaatttatatttagtgtattcccaacactctcaaaccagaggtagagtcagtacaaagcgtaataaaaaggtattttaaaattgctacacaggtacaaatatctggtttgatagaagaaataagacctagtgttcaatagatcagtaaggtgactatagtgtacagtaatctgtgttacataccagaatagctagaagagaataatttgaatgtttctcgcataaagaaaatacaaatatttaaggtgatagatatccgaagtacacttatttgatctttacaaagatcaaaactatgaggtacatgtgataatttactatgttcatataatgcatcagtaaaactattatgctaatcagtaaaaaatttgttttaaaaaaattactacaaagagtggaatatctgatgagtatctttctctatcataccttgaatttaaagaattttctttttaaaaaatatttaaataaacatttaattttatgatcattttagatttccagaaaagtcacaaaaataatagaatttcagcatactcctcacctggtttcctccattattaacatattaccagagtacatttgtcaaaaataagaaactgacatttaatacattgtcaattattaaccccagactttatttggagtttacttatttttccattaatgtcgtctctgccttccagaattcagtccaggggactacattgcatttagctgtcatgtctctccagtttcctggtctgtgatagtttcttagtttttccttctttttcatgaccttgacagtgttgggtagtactatacaggtattctgcagaatgtcgcccaatttgggtttgtctgatgattttctcatgattagatcagggttatggatttttagaaagagtatcacaaagaggaagtgtccttctcataacatcctatcatggggtgtataatagccacatgatgtcatggttgatattaaccttcatcacttggttagtgtttgctaggcttctccactgtgaagttagtgtttttccctttggaagtaagtcagtaaatctaactaccctcagatgagagagagcaggaattaacttcctcctccaggggatactaaaatatacataacataaaatttacattttaaccatttttaagtgtacagttcatattgttttataaccatcaccaccacccatctctagaactgtttcattgtctccactgaaaccctgcactcataaaacactaagtgtaaagggaattcttacattaaattgtttggcatagcatctggcaatgcagaaggcacacaataagtgtgaactattcataagtcgttttcagtgagacacttttagaaagatttttttccttcctttgtaggtaattaatcaacctccaaaagagattcagtaaaaataaaagtgatcatttaacctttccctcttgtaatggtcttttataaaaattcagttggggggccaggcacggtggctcattcctgtaatcccagctctttgggaggccaaggcagggggatcacctgaggtcaggagtttgagaccagcctggccaacatggtgaaaccccatcactactaaaaatggtggcgggcacctgtaatcccagctactctggaggctgaggctggagaatcacttgaacctgggaggcagaggctgcagtgagccaagatcccgccactgcactccagcctgggcatcagagtgagactctgtctaaaacaacaaaaaaaaaaacaaacaaaaaaattcagttgggaaggggaataaaaattactggctaaaatgggattttaggtcaggcatagtggctcatgcctgtaatcccagcacattgggaagctgaggccagaggattgcttgagcccaggagttcaagaccagcctggacaacatagcaaaatcacgtctctacaaagaaaatgtaaaaattagctgggcatggtggcacgagtgtgtagtcccagctacttgggaggctgaggtaggaggatagcatgagcctgggaggtcaaagctgcagtgagccacgatcatgccactgtactccagcctgggcaatagaatgggacccccatctcaaaaacaaaataaaatgggattttagcttatgtttggaaagggaagtaaacgtttttggctaaaatggtattttaattattctttttttttctgagacagagtcttgccctgtcacacaggctggagtgcaatggtgtgatctcggctcaatgcaacctccatctcctggcttcaatctattctcctgcctcagcctccccagccgctgggattacaggtgcctgccatcacgctcagctaatttttgtatttttattagagacagggtttcaccatgttggccaggctggtcttgaactcctgacctcgtgatccgcccgcccaaaatgctgggattacaggcgtgagccactgcagccggcctcttattctttatgatatgtttatcaccatgttttataaataattggttataattccatattcttatgtccgtaaacctttctgaatttttctaacatgtaaatgacttttttctagaagttaggaagtcatacagaataatgtattctggttgggtgcagtagctcatgcctataatcccaacactttgggaggccaggatcgcttgtggccaggaatttgagactagcctgggtaacatagtgagactctgattctacaaaaaaataaaaaattagctggtgtactggcacgcacttgtaatcttagctactcaggaggctgaggcaagaggattgcttgaacccagaagttgaaggctgcagtgagctacagctgtgccagcgcactccagcatggacaacagagagagaccctgtctcataaataaataaataacatattgtatatgttatagggtagaactgttaccattaagttgaagaatgtgaattttgaagtaaaaactcgtgcatctacagtttcatctgttgtttctactgcagaagaaatatttgccattgctaaggaattgctaaaaacagaaattgatgctgattttccacatcccttgagattaaggcttatgggtatgactttttcatttttttgtttttccttaaatctgctagattttcccaaataatcaactttgggaatacagggggcccccaacttaacaatggttcaacttaatgatttttcaactttgcgacagtgggaaagctgtatgctttcagtacactcttgacttacaaggtggttacatcccgataaacccatcataaattgaaagtattgtaaattgacttattatgttttcaatttacagcgggtttatctggatacaatcctactgtaactcaatgagcacctgtattctcgccttcattttatttcttaaacctgtttacgaagttcttcctttgctgctgccatttgtcttagttattagaccctgatgtgtgaagccatgatcattagtttaattccagtaagggtcaattaaagttgttattttccttataacttaatgaaattcttgtggccaggtgtgtttcaaaattcaaaacttttcagattttagaaagcaaattcagtgcatgtagagtatattacgttgtaatacttctttgtggatctggggcaacaccccctgttcaaacacattaatatttctgtagcaaaacaaaatattcagagactgtaaagactgatgacattaatttagtcatcaggtatcacttgttgcttacaattttcagaactttttggattttggaattacagataaaggattgtgacattgtgaaatcacatctccagccactacatggtaaaaagtaacaagccatgtttccaaagtgtactggttgaaagtatatatgtggatcaccactccaaatgcacattttactagtaaggagtgggtcactagccataattttatttatgaaagatatagcacacactgaaatcaactgaataaagtgttaattgaaagagccaggctgggcgcggtggctcacgcctgtaatctcaacactttgggaggccaaggcaggtggattgcctgaggtcaggagttcaagaccagcctggccaacatagtgaaactgcatctctacaaaaactacaaaaaattagctggacatggtggcgggcacctgtaatcccagctacttgagaggctgaggcaggagaatcgcttgaacccgggaagttgcagtgagctgagatcacgctgttgcactccagcctgggcaacaagagtgaaactccacctcagaaaaaaaaaaaaaaaaaaaaaaaaagcccaagagcagatatctatagaagcttaattcataattgccaaaactttgaagcaagcacgatgtccttcggtacgtgaatggataaataaactgtggtacatacagacagtggaataatattcagcacagaaaataaatgaattatcaattcatgaaaagacacgaatgaaacttaactgcataatgttaagtaaaagaagccagtctgaaaaagctaaatactgtgtgattccaaccatatgagattctggaaaaggcaaatatgagtaccataaaaaataattgattgtcaggagttaagaggggcaggaggtataaataggcaaaacacaggaattttagggcaatgaaatgattccgtatgattctataatgacacgtcattataaatttgtccagcgcccaggatgtattccaagggtgaaccctatgtaagctatggactttgagtgacaatgttgtggcagtgtaggtttatagattgtaacaaatgtaccactctagtgccacatgttgatagttggggtggtggaggggtgtgcatgtgtagggaaaggggatctttgggaactcattgtaccttctgctcaattttgctgtgaacctaaaattcctctaaaaaataaagtctattagaaaaaaaagagctaaagagtctgtatagttgactccagttagttactggtattaatttaatggtattatgtgtcacatatgaattaaaatcctacatcattatactaactccaaatagttaatatttaatgatattcttttataaaggaaggtaaatctgtacttataataccagctttgaaatgttacttatagtttctctctagccaaccttttgtatatgtcatagcactagacaaaatgtttttatgcattgtgagtgaattggctttgttcaatttgaaattgattgtgattggtttaatttaggtgttcggatatctagttttcccaatgaagaggacaggaaacaccaacaaaggagcattattggctttttacaggctggaaaccaagccctgtcagccactgagtgtacattagagaaaactgacaaagataagtttgtaaaacctctagaaatgtctcataagaagagtttctttgataaaaaacgatcagaaaggaaatggagtcaccaagatacatttaaatgtgaagccgtgaataaacaaagtttccagacatcacaaccattccaagttttaaagaagaagatgaatgagaatttggaaatatcagagaattcagatgactgtcagatacttacctgtcctgtttgctttagggctcaagggtgcatcagtctggaagccttgaataaacatgtagatgaatgtcttgatggaccttcaatcagtgaaaactttaaaatgttctcgtgttcacatgtttctgctaccaaagttaacaagaaagaaaatgttcctgcttcttcactttgtgagaagcaagattatgaagcccatccaaaaattaaagaaatatcttcagtagattgtatagctttagtagatactatagataactcatctaaagcagaaagcatagatgctttaagtaataagcatagcaaggaagaatgttctagtctcccaagcaagtcttttaatattgaacactgtcatcagaattcttcttctactgtttcattggaaaacgaagatgttggatcatttagacaagaataccgccagccttacttatgtgaagtgaaaacaggccaagctctagtttgtcctgtttgtaacgtagaacaaaagacttcagatctaaccctgttcaatgtgcatgtggatgtttgcttaaataaaagttttatccaagaattaagaaaggataaatttaacccagttaatcaacccaaagaaagctccagaagtactggtaagtgtgtaattgttttaaactgcatgattttctaggaatatgtattattaaaattaatgagattgttgttaaatctgaaacatatactattaaatgggtagtttgtgtatgccgccatttagggaaatgttggttacattgccataggttagaattaactcaagcctgtagattgtgaatttggggaaaactttggtttgatcttgatttagcacagaatgaactcaaaggtttaaggagctgagtgatctaatcaaacaaattccttcagagaacatctgtgaaggcacagtggtaaattaactataactgcataactagaaagcctctttaacttattttttggtagtgctgactctacccaaatttcaccaataaaattaagtgtaatgctaataaaattagtaaattacaaagaaattatagtttttggtgtgtttacatatgaactatatagtactaaggaagtttaatcaataagttttaactttttaaatttgtatacaactttttaattatttcatattattcattatggaatttcttgactttctttcctctaaaggtagctcaagtggagtacagaaggctgtaacaagaacaaaaaggtatggctaatttgagctttaataaagctggctacaatatgaaaattcaattattttataaattattaagtaatcaatattaaaaatgaattattttctagaatctcttcctgcattttaattgtgtgttccttttcattctaggccaggattgatgacaaagtactcaacatcaaagaaaataaaaccaaacaatcccaaacatacccttgatatattttttaagtaaacattgaacattttatcattaatttttaattgaaactagttattttataatcaatgaatttgttctttctgattttaagtttgcagatttatttagtgaaggcaagtgcaataatccttcctcagatgatgtttgcttttctaagatacatatactgattctgtgtatcttttttataaccatgagaattttacttccattatacatcaattggaaatcaatcctgttaagagataattcttaaaagggaaattaggaatgggataagaaggtgatttttttattatttttatactgaatataaaaacatttgtaagggctctcaaagattcacacatgcctatattatcataagaatttttcagcacttaactactttgttggcattgatcctagtgtctttaaatacttcatgagcattcataattaaaatttatcttaagttctatgaagagtattaatgtaactagcataagtggttttcttcaggaaaataaatatcacagtattatctgtgttaaaatggtttttgcctaaaatataatttttaatttggcttttcttatttaaaattccattatcttatgaataagcacttgaatcagtttttaaaatatttagtctaagatgattcaaagtagttttattttaatacaggacttttaaatggcagtatttcatttcttgtcaattatgttggtactttccacaaatctataaagaaggataaattgtaccatcattttattataatcctcaagagaaaatgtgtaattcaaaagattaatgtgtattaaaacacattatgtatcttagttacatttctatcagtacttttattaatatttgtgaaagaagacagcttaatagtagttagcttaagtagtttctccaagtacttttgtgctatcaatgagttcttctcaaaaaataattagttaggccaggcacaatggctcacacctgtaatgccagccctttgggaggccgaatgggcagatcacttgaggtcaggagtttgagaccagcctcgccaacatggtgagaccctgtctctactaaaacgataaaaaaaaaaaaaaaattagccaggcttggtggcacacgcctgtaatcccagctactcagatggctgaggcaggagaactacttgaacctgggaggtcaaagctgcagtcagccaagatcttgccactgtactccagcctgaagagcgagactctgtctcaataatataataatagttattatttaattgcaacatgaagttggaagccattttctgttacttctttaaggagctaaatcttttatatttttgttttctctccccttgcgtttcatattttagcttatgatctaaatatatattttgtatattataatattttaggaatagcttaattaagaactcacagactttgacaaagtggtaactagacttttaattactagattcttcaaattaggcttaatgcctgctagcatgccaatccaatcccatgactgatgttattatacactatggcaaatacaaagttgtagtattatggttcttgatggtgtgatttacttatgtaaattatgtacaaatttaagttcaatgaaacactgatttaatgtactgaaaggtaaatagtaccatagtgaattattttctgtcttgccttaggtttatttttattatcttcaatattagaataaatgctaaattattttcatttaaggatttatgtagttgaatattatcatttagtaatatttaatcatttgaaataaaatttaaagctttaattgatctaatagagatggttttctacttttccactcttcctccctcttatgccttcacttttgttttctgtgcccagaattttcttcacattctttactacctgttttgtctattatatccaacccattttctttttattataattttgatttggggcatttgaagaaaatacagcaaaactacaagaactggtaataagcatgcataatctcacctacttagtgaacctaatataaacctaatataaagaaccaccgtatttgcaatatatataactggtgaaaaactagtgtccagaatatataaatgatccctatgaatcagtaagaaaaagacagtcaatagaaatttggacaaaagactttatatggcatttcaagtgaaaggaaatccagatgaccaagaaacatgaaaatattcccagccatattaatatttgagaagtaaaaaataaaactacaaggaggtattacatctttaccttatttgcaaaaatgaaatgatctaatgatactaagttttggtgatgatgtcagctcttacattgaaaacaatcactgtggaaaaatttgtccctcagtaaatttaaagataaacatgctcaaaacctagcaattgcactctgaagtatacatctttgcaggttatctttcattacagttatttttttccctgtcaggaccctaactaatacaatgccttgggaaaactaatgaacatgtatcctaggaagcatgtacaagaaagttcttcccagtcaggaaggtggccaagaaaaaaattttttaatgttcatagcagcactgcaatatccaaaagttagaaatgaaccaaatattcagcaatggtagaatggttaaattgtaccatggcatttatattgaaacagtagaattctacacagtggtgaaaatgaaggaaatagctaaccacaacatagatgaatatcacagacatagcatagagcaaaagaagcaaatcacagaaggatgccatcaacatgattccatttgtataaagtttaaaacagtataaactgaacaactatattgttttaagggtatatagttatatatatgagatacaactgtaaagaaaagcaagtgttttgctgtccccagaaccagaataatgatttcctctgtggagaagtacagcagtgtgattggggagtggcacctggtgcttctgggatgctggcaatgttctatttcttgtcttgggtggtgattgcatggatgttcacttttaaaatactctttatacatatatattttatatattcttgttcatatataacctttataataaagagaaaaaaatggcaaaaactgctttcgttaacaagatgatattttcctccaactctgcaggctagctaatttcaatcgagaaaaaaatacatttttttcttctagaaccttgctgaacacagcaagaaagagccatcccatgcaaaatttttagtttttctcctagcatttcccctaaggctacagcctcaatcagtatttggtcttctttccaaagacagctgttgacagttagaccaaatatttttttgccgtttgtgatggttaatattgagtgtcaacttgattggattaaatgatgcaaaatattgttcctgggtgtgtctgtgagggtattgccaaagaagattaacatttgagtcagtgggctcaagaagcagatccaccctcaatctggttgtgcaccatctaatcaactgccagcatagctaggataaaagcaggcagaggaaggtggaaggactacactggctaagtcttctggcctccgtctttctcctgtgctgcatgtcttctgcccttgaacatcagactccaagttcttcagcttttggactcttggacttccaccagtgatttgccagggactatcaggccttcagccacagactgaagggctgcaccatctgcttgtctgcttttgaggttttgggactcagactggcttcctggcttctcagcttgcagactgtgggacttcaccttgtgattgtgtgagtcaattttcctaagaaactccccttcatatatacatctattagttctgtccctctagaggaccctaatacaccaccaaacaagtcaccagttttccagtctgtggtatttgtgtccccactccctaaattcttctctccaaccctaagtcaatttgttatattaggctttgttatttgcagtaccctatttctgtatcagttcagtcacaagcttcctggtgcctcttccttgttgagtcacatggggacatgcttaattctcccagaaatgtgtgacagcatgtgcaaaatattgccaaccaaggaagctcaaccaatccttggtgtccaaggtgtttactggaagtcagtcacataggcatgcatcacccatgtgactgaccttacccgttgagtctcaagaccccaggggtgtagtgatacctcatggcccagggcttcagccattcaaaaacagacattcgccatgattcatactgttagcataaactatctcgtcaaactaacaaaatgcagcccaaggcctcaggcatactagaacactattatcaaactggaaattccacgagctcaggtcatttcccaggagctagtcaaggaagggccagtacgtgaagacacctctctttgaaaagtgcagggctggagtaacctgaggctgctaggttaaccctttactgcattaatgtcaaattattagaattgtattcaaataaaatataaaaaagaaa

SEQ ID NO: 149 - DNA, 9389 bp, Homo Sapiens
ttcaatgtcaaatgcactttactgggcccctgggcctcccaacactgtcctcaccaaggctggggcaccccattcccagcaccaccagctgcccaggaagcaggacggatagagggaacacatgtggaatggctgttctcctaccccagagggtgccggatgatgttgacagcacggctgcttccctctcccctgcagcttctgtccccacccagcagcttggcctttcccatagcagggaagggggatacctggggcttcaaaccagccacctgctcctgcttaaaatggggcaaggggccatttgcaaaattcttcgaggggcagtggtgaggtagaaggggtggcagcctgctcctgtctgggagagggctgggcagacactgggagccgggcagacactgggagccgggctggctcttgcttcaggcccagagccctgggccctgctcgctgaggaagctggtggttggagcggcgaggttcagccagctgaggctggagggagtactgggtggccaggaggggtagccagtccaactcggctctcctcagcacccccagccatgggtcaccagtcccgctcagcaggttctcggtaggggaggcctaagagcctgaagacatccttctcagtgggagtgggcagcactcggccaggccccaccttgcagccatgggtgttccggaccacagcagtgctgagggcatgttctgacagactcatgcccttggttttggccagggctcgcatggagcggttgaagtgtgcagagccggtgaagtagagcagggcacaggcaaactcgctatagggcaccacgatgatgtccaggcgccggtgccgccgccctggccctgggagccggcacacccccaagtacttctgttgctgaccattctcctcttggctcaccaagtcatctgtgaggaaccctggcccaacagaggggactgctgggagggcagggaaccaggcctgggctgtcccatcctcccaggtctctcctgatgtctaagctggggcttgcccaggtattagctgggtgacactaccctctctgggcccttctccttttctgtaaaacatggatagtaattcccatctcccccatagtgtcacagaaagatcagatgagatacttggcctgcagggttcactgagcacctccacataggtgtggcggggctgttccatctctccctggagaggattccggccccgatagagagatgggatgctggcaaagcactgttcccctgcttcctgcctcaggactggaacttctgaggttctccctctgagggggcccccagacctgtgctgccctctgtcaacctgctcacccagagatggagcttataccttcctgccgaagactgtcaaggaggcggctgaagataccccggtgggaccggccatctgggtgagtgatgagcacgtcgacatcaccacaggtcgcctttccccgtcggtatgaaccacatgccacacacagcagcccagagttaaaggcctgggctgctttctggacctgggaaagagagcggtgacaggtgaggggctgtgcgtggggagctcctctcccacagcagtacaagggccttcccagactcgggcccacaccctcagcttatgcccattccagatgcctgctgcaagcccaggggaatccaccctgaggagctgctgttctttcccttcgctaggacaggagagaagaaaaagctcactgtgcaggaggcaagcctgaggagagacgggagaaggtgccggctctgcttctgagagtgggcactgagcttgccctgtggagctctttaagagtagggagacacagactctctctgcccctgccccagcccacgtgcccaggtctgtgaaactccacttaggacaaggggccaggtgctgaaagccctcagccaggtctaggcagccccagatatctactgatttggagctaaaggtttggaatatgtgagctggggtttgaggactgagcaggtggctggcagcatgcgccaggcccaggcccaggagaaagtggagcacagaaatacagctgcacctgtgggaaaggagaggaaagaaagcaaagagggggcagttctgagccaacacccacatcctttcttggtggggagggagctgagacagcaactgccagctgaaggattgtccctctgaggaaaaataaacccattagcctccacccctgagacactgaggttctttcatatgcagatggcctcctgcctccaccccaggacactgaaaattctggggccccggacacctcaagtatcctgacaggagggctccgctaatccccttactcccttcttgagcctcccaagagaatggaaggaggaggtccacgtgagtaatcccatcaaaactcctatggctggagcccttaaatgggggcacaggaggccaggtgggaagcctcttttgttccaatgggctgggtactgactgaggcattctccatgcccggacaccatggctgagtgacggtgtcatcactagcaccaaggcctggtgatgggcagacaaagaggcctgtccatccatctcataccggcctcatagccttgtggcctggaatggagctgggggctgatttcaatcaaactaggccagtctccatgggatcccactctatcagaatccctgaccaaagtgagcaaaacttgcctattacaagcagctcctaatcctaatgcccattgaacaaatgatacatctagccctaaatgcagtccagtgtctctctaatctagcttttacatgaacctaatcgctaacccaactctaaaccaaacccaaatcttatttcttggacaactacaaatcttaacttaaaagcaaccaacattaagaaaatcctacgcctaattaaagcctaactttaactcaatctttttttttttttcagacagagtcttgctctgttgcccaggctagagtgcagtggcacaatcttggctcgctgcaacctccgcctcccaggttcaagcaaatctcccacctcagcctcccaagaaactgggattataggcatgagccacggcacccgcctaacttttttgtatttttagtagagacggggtttcgccatgtttgccaggctggaaatttttgtatgttttatagagacagggtttcaccacgttggccaggctggtctcgagctcctgagctcagatgatctgtccaccctgttctcccaatgtgctgggattaaaggcataagccactgtgcctggtcttaactccatcttgatggagctttcttccagccccaaaccaaatcctactgacactgtgcttttacaccaactctaccccaaatcctgagccagccttgcgtgggctttagaaggtccatacatctggaaaaagacataaacctttgcacatttgtgcattttggggagaaaacagtccacagttttcatcaggttctcaaagaagttggtgaaataaaaaaaaaagataaaataaaatattaaaaccctctgccctgacccaccctaacctcagtacagatataattcacctgtaatctaaccctaacattaacccaatcctaacaccaatcagtctagaattgaatccaatcctaataggcctgactactgagaaccagaatctagagggctggtgttacagctctttcctcccaaagctccccacccccacctctgggcctggagcttcagtcttaacttgctctgtgctcaacctctggtgatccacagtttcctctgcctgctgtcctccccagctgaggagttgggggttcttggctttgacccaagaccttacagcaggacctggctgtcctcactgctctgggacacctgcttactgtctgctcaatctctgtagcctcctccctgggcatacgttccaggaagtcactgtaatgcttcaggccgatggcctgctgggttgtcagggaggcctggctgcggatgtcttccagacttcggaagccctggaaaaaagcagccagatgggaagctgtaaggatccaggaccaatgaagaggcatgagtgagcacacacacaaggcttccatcgccccagactctagggaaggctagaggcaggaccaacctaggggcagttgggtctgtactcagcaggacttgggaaaggcagggagcatgggaaacatgccatcatccagccctgccactatcctaagatgctcgttcatgattccatcagtctgaggatggaccttgtcatcttcatccttaccaagctgccctggtgattgtgggcagagccaggattgggaaccactgctctagacacgcagtgtcaaggcctggcctcctcaggaaggcccttgctggtctggggagactgagaaacatacttcttgtccctgtctactccttcttaaggataccaagcaacaaggctgttctgggagctgaggggtctatatgagtcctggtccgcttgaaaaatggtctccctatactgtgggtgcattcccatcagagcacagcatagggatctggggcagagcacagcacacatctggggcaggaactctgagacacagcaaaactgaagtaggggctgagccagggtgtgacctgttggtaccacatctgggcagtcttggtcccagctccccagatgttggagaagagctccaagacaggcacgctctcactgatatggtccagcttccgcaaatgcccgctctccaggatctctatgattttctcagccatccgcttcccaatcccagggatactgcaggcctcctagaggaggaggaggcagaggcaagaaagaagagtgaggagatggaagaggtagagccagtggaaaggaagctgactcctctagcagatgctgacataaaagccagcctggctgcttggcaactgtgtggctgtgtaaagcttgggtgtagttgaagatgagaattttggatagaatgagggctgggtaatttgtcttttggttcccagaaggatggagaccagcagtaagaagtagaaaataatgatgatattagtcaccaccaccaccaccaccatcatcatcattccaacagcaagagctaacatttactgagggcttactctatgtcaggtcctgtgctacagggaccatttcatttaatagtagcccctttttactaatgagaaaactgatgctttgagagtttaagtaacttgtctggagtcacacagttagtgaatgacaggaaccagagttcaaaccctggtctgttaggcttcagagtccaaacttcttttaaacaactttttaggcgggacacaagggctcatggctgtaatcccagcactttgcagggctgagccgagggtagattgcttgagcccaggagttcaagaccagcctgggtaacacggcaaaacaccatctctgctaaataaatgaataaataaataaataaacaaaattaaaaataaaaaacttttaattatgttaaaaaattcaaaagtagagagatccatataacccccaagtatcgtacatctcccagcttcaacaactatcaagattttgccaatctgctttcatcaattttccttttttttcttttgtgcaagtcctagaccccataaaatcttcaccactgtacctgaaccccactggggttactaaccactggccagtaaagacccctcctcccactctagcccctgggtacctggtacgaggtgacaggcttatggaagctcttgagggcattgatggccttggcatagcccagggccctccacttgtctccctgaacactgtaggctttggccagaacttccagcttctctgtgatatggaggttgtgattggtcgccttctggcttgagggctgtgcacagacccacttatccaggacagcaggggctgggctaggctcacaatctccctcaagggaggtggggtagtggccactgatgagggcttccagatcagctgcactaacctgggtttcttccccatcactggcttcatcatcagagatgggcttgggatagagaagaaaagaaaacaataaattcttgttctccaagagaagggatccttaaaggtgggggtcatcttctttgtgcggggggagggtcttctagtcagacctaagaatgaggcggggccttctgcatcagacttggatctccttgggtgtgaggccacgttccctttggctccacgcagtgcctagccctaggatccccagtggtatgtgttagatatggcctagataaatgcagcagtgatgagtgttgggaagagctaaatggcttcacaatagagccctcctctctcaggggcctgggactttctgaacagccaccaggcccaccccatttctgtgatctgcttcctaggggaagggagttctgagggatgggaggctcctgacctgggcttgggtgtttggtgcctcttttgccttttggggaggagacacaggcctggtgggaggaggaggaggagaaagggctgtctgaagcagggcctcatgggtgccaggaggaatagaagcatcctgctctgccttgctgggctgtggatggtccaagtacctgtggggatggtgatgggaggttaagacaccaaaggtctcaccctgtatctgtccccagtccttctgtactctgaaatacttggtttcccagtgtgtccaattaagaaaacgagttttttgaggtttttggagtttctcttgagacagggtcttgctctgtcacccaggctggagtacagtggtacgatcaaggctcactgcagccttaacctccctggctcaatcaatcctcccacctaaacctcttatagctgggactacaggcacaccccaccatgcctggctaattttttaattaatgatagttatttttaataattcaagaaaagagctcaagatgctactagaaaacatttgaaaaaaagactgggatcagcccacctactggggatgaagatgctgaatccagctacatccaccagcctcctctcctgaaggcacaagctcagccaggctgacttcaccagctgagcacccgggggcagctggggtagtctgagaaggcggagggctcgctcatagtccatgccttcatccaccacaatgtgagtgacacctgggccctgggcagggcatagctggccgccatgctgaacaatctgcttctcaaagagttctgcccgggctcgtccaatgccagtgcgcacaacatgggcccgaagggagctcagccactctgtggaaggaacatccagatgactactgttgtaactttttaatttttatctgccaccccctggccacgacataacttctaacatgatctgaatgacgtgttcacagtcccctaccctgaaaataagcatttcccttccatccagacagctttccttctacatatagcaaattttctcacaggccagcacttgaatgtaagggacaaggattttcatacgtcctgttccttggtgcaatctagaagtgtctggcacattgtaagtaacctgtaaatatttgtttaatgaatgcctcctcccttcttactttgttttttgtttgtttgttttgttttcttttgttttgtttttgtttggagacagtctcactctgtcgcccaggctggagtacagtggcatcgtcttggctcactgcaacctccatctcccgagttcaagcgattctcatgcctcagcctcccgagtagctgggattaccggcgtgtgccaccatgcctggctaattttttgtatttttagtagagacagggtttcgccatgttgcccaagctggtctcgaactcctgagcacaggtgatctgcctgcctcggcctcccaaagtgctgagattacaggcaagagccaccgcgcccagcctctctccatactttgaatcctttatcatttattctttcaacaaagcgcgtttcttgcccttacagtctgacagacccgacaaccctgcctccaaagcctctgccatttatttgccaatttggctgcaaaacaactaacaacaagcctgggtaatggaggggggtttctgtcccagtcctcagggcaaaaattatactggtcattccctgagggcccagggagtcttttctgatggatagaggtcttcgggtagaaaagaaggtaacacagcaaatagcctgtccaagacccaggaccaagcttagcacaaggtagatacaaacagacctgcaggccctggacaggcagagtcagctccaatatctgattctggacataaacaacgtagggctgaagcacatgaaggctgtgggttcaagcacacgagggttctgagactgggtcagctcaccttctgcttcttctccctcttccctcctaggaatctttgcaagtacttttgatgatgcatcagcatgaattttctgccgcttgggaaatgccttcaagatacccctgggatccattgaagtatggctggatcccggcctattggagcgttggtcagggctgctgcacgtggaaatccagaattgaggccctccaacccctttgcctatggaggtagggtctttcctgaccaggctttgggggtagcagcccagtttggggaagcgggtcgggggagggggtctcttcaaacccggttaaacttcagtggtttagcctagcttcacactccccagcctttcgaagttggagtattacgggaaatgaggggaaggctggtgccatcgggggtacttttgaggagtaggaaacgacaccattcctcagaggggttgcgctaaagattcagcacagccctgctgcggcccacttcgaagggctttaccaaatgggatgctgggctaggaaatggagctttaggggatggagcggagcctggggaggacctgcacataaaccccacatactatttctctacctccaacacagactcgcagaggaaggaggaggactttcgggggtgagtgggaacgccctgcacctgtcctggtctcagcctctcgacatgggggtgctcagcgccgcagctgcggggagatggggcacggccgcagcaggtgtggggagccctccgggaatggaggagtctcgcagctgcgggtgaagtcccgggcaggtgcggtgtactcgccgtgtacgcagctggcgcaggccagggaatcccagctcggggctagaagaaagctggagtgcccgaccccggccccaagagtctctccaacccccagagtcggtccccgggtggggtcgactactggccaagctagtcacccgggggtgggcaggaatagaccacttaccagcagagccaatgagagcggacgaaggggggaaggagggcaaatggccagaatagcttccgagtca

SEQ ID NO: 150 - DNA, 10479 bp, Homo Sapiens
aaaggttaaatatagtttggttctatttacatgacattctagagaaagcaaaactatagggatgtagcaccgctaagtgggtgggggtggagaagcacatgaccacaataggacagcatgggaagtgttctggggatggacctggtgtgccctacgtgtgcaaaaactgcaccccaagagtcaactttactgcatgttttcaaaatattttttaatgtgatgagtggtctgggaaatcctcgcctaacaaagtggcttttgattcaaggcctgaagaaggggagggcccactccaggtagatgacatggccagggcaaaacctgaggccagagtgtgcctggggatatgagggacgtggagggcacccatgtccagcccacctcagtgcttctgcctcagtgagaaggggagggagttggccacaagggggcctgggtgcatcaaataggaagccggtgagtcaagcagctcggggccagtggggctggagagatgccagagccaggggctatgtgtggacttagggtttggaaccattaaagggctctgcgacgggagtggcaggatatgacctatttttgagacattgtgctgagaacaggccttaaaggcagaagcacagagcctggctcggggcgctgcagtactgaagccccatagttgaaaattatcttcctcccagctcctacccaggccctctccctctccagatgcctacagcacaccagacagtaggctccttgctggcacgaaccacagcctccagctcatggctctcaaatgcagtgcaggtatgcatggttctcttctgggcattctgggcagggtgccctgcaggagccacagttaactgcagtgcaactaatgagacactgcacatcagggaccacttgccattcatgactgcaggccccaccacagctccacgatgtgggccccactcacatcccatccagggcaggaacgtgagccatggggaggctaagagcagacccagggtcacacagtgatgaggctggcactgagggctcccacctcatcacaccctgcagcacaccagcaggggctcaactgatcctgcaggcacaattgacctccggaagagccaggccttggcggggaggggtgaaggtgggggtcagggggcagcatatctgcctggagacattcagtggccaggttgggggcagcccaatttcctgagtggaagtgggggacacaggcaggctcaggcgtttctctgctctggaggaaggtactcaaggcccaggtgtctgaagatgtcttcctctgaagccgcttggaaaaatgtcttctgcaacagaagcaggacttccgtgacctaggagtcttgccactgctgcttccctgcaggaagactgagggtggggaagagcccagcgccgaggtggggtgtgctcttgagggccaggaactgtgtgtggagacccagattcgggtcctatgggtttcaggctggaggggtctggggccatttcagattgtgggtcagggagcggactatgggtgctgtttgctgtccccagtccccaacaatgtacctgctccgggtcaaacagcccatggctgttcagccacaggcccttctccttccggctgaagcggcgcagctcccgctggaaaagctgtagggaagggattgtcctcagcagggctggcccagccccacccccaggcggcccagcggcacactgcctaccttggagccagtccaaccgagcagggcgaaagggaactggctgacgggtgcaactaccaagtccactctcacggccttccaggatgggcagggcctcgtggatccccccacagcagcccctggaggttgtggtaggcggaaaatgcagaaacttctctcaaaagcgtccatgtggctctgttgggccaggcgggtaggggactcacagcagctgtgctggtgctggtggtacaggatgaggccctgtggggagaggcgggcgtggctgagaccatccggtggtgtggagagagcaggaggcagtggcattggccagcggtggctcttggggagcagggaggccctcacctggtcctgcaggcggcacatcactctaggcagcagccccgcctcctgaccctccttggggtgggtgatgaggaagtccacgtcatggccctgcaacttccccctgagggcgtcagtctgactctgactcagggacacggcctgctcactccagccccaggccacatcccttccaacgagtgggcccgcttcagggtccccgactcaggtcccttcactggggaggggtctgaagccaagccagaggggcacgtcgggccttcttacctgcggaagccgccggtcagcgtgacggtggccccaggcagggcctgccccacagcttcctccaccacctgctgcagggcatctacatcggaccgcaggactggggtgctcaggtcctggtggtgctggagccctgggggcaacaccggccctcctgactcacccagcctgcccaccacaccgagcccccatccctcaccagcatgaggtgatcaacctggggccccgtcattgcaggaccaggagaggcctccgaggaaggtgaggctagggcagggagcagagtgagatcccaatctaagcctgacactatcttctctccccctttaaattttaaacttttattttgagacagttgtagattcactcgcagttaaaagaaatagcacagagggagatcccatgtgccttttacccagctcccccaaaaggttaaccccttacaaaactataattttgcaaccaaatataaggatactgatgttgatacagtcatgccacaggctatctcttttgatggctgtttttccttatgcataaagtgggaccaagaggtggtaaaaggatggaagatggctttgccatgacgaacacctcactctggcctacttctgtttcctcacctatcagcctcccacacgcagttaaggagaggtttatttatttatttgagatggagtctcgctcttgttgcccaggttggagggcagtggcgcaatctgagcttactgcaacctccacctcccaggttcaagtgattctcctgcctcagcctcccgagtagctgagattacgggtgtctgccaccacacccagctaattttttatttttagtagagacagggtttcgccacgttggccaggctggtcttgaactcctaacctcaggtgatccacccgcctcggcctctcaaagtgctgggactacataaagatgtgagtcatggcacccagctaaggagaggtttaaatgtgaggaacagcagcacctggcacagtgagctctcagtaaacgctgctaaccattcctgactactcttgccatggggagaggcgatcaagaggaaccagctctgcgggtctcacctcctgtcagctgaactgggcagtggcccgggggaagatgtgcgaagaggcagtggagctggcagtgcctgctgggctgtggggattgcttcagcagagccctcaacccaagggaggtcccagatggtgtggccagagtagccaggcaggccatgcagagagaacagagtatctgctcaacacctgccacttgccggctctcacaggggagcctacgaattcattccttcccacctttttttttttttttttttgagatagggtcttgctctgtcactcaggctggagtgcagtggctcaatctcagctcattgcaacttccaccttggcctcaaggcttgacctcccgggctcgagcgatccttgtacctcggcctcatgagtagctggtactacgggcatccaccatcacgcctggctaactcttgtatttctcgtagagacagggtttcaccctgttgcccagactggtcttgaactgctgagctcaagcgatctacccaccttgacctcccaaagtgctgggattacaggtgtgagtcaccatgcccagccttccttctccattttacagaaaatgtaacagactcagagaggttatttcttgggcaatggtcacctacctggcaaatggtagataagactcaaacccaggcctaacaaacttgaaagctgatgttctttctgctgctcagtgccacctctgcaggcctccatgtaccaagcaccacactgggcagtgtgcccaaggcccaggctgtccctggtcactggtcaaagtctaaccagtaggcagacacaagcccctggcatatcatggaagttgctgtggtcagcatcgtccactgagaaaaggctttgatagatcctgactgcactgggtggagaccccaggaagcccaccacacaaagctgccaccaaaccctctgcaccagactgctcccttccctctagggagttgatgctgagggatccagggtgcagtttagggaagcccagggcccagcctctctggagggctcacccgctttctgctgttgggttagtttctggggctgctctcggaggtcatctaaggttcgcagtccttcccggtaccaccggtcagcagtcttcacaccgaccccgaagatctgggtgaagagctgtggggaaggagcgtagcccggttgggcagagctctcatggctagactcggatgatcacccgctccgggacggtgtggcccatggagcaccatgcaccaggcaggcgccgtccccactcgcaacctgccgtagaccacagggcaaggattcaaacctggagcctgactacccagcctgccgtctctgggaacaaacccacgcacacccctctcctctcctctatgaaagggacttacacagctctagcctgtgattccaacataatcaaaacagtcaccctaacacatcagcacgaggggctcctaagtcactggaaaaaccatgcctctcccacctaacagaaggtggaacaaatttctgtggttctcctccttagccaacagcaaaaaacaatgaggagttaacaatcaaaagggtggatttaggagcagagttggcagggctggctggggtgctcacatatcttcccacagagggtgggccccagcccaagcaagtcacctgcttcaggtcagccactagagtccctccctaggaattctggatctgagactgagggcaggcccacacagtggcagaagctgtagcctgtggcagccgagcaccttttgtggccacatttccaaccgatggaagaagctggtgcgtcgcaagagagggcgaagccaccgtgcagaggggcagaggggaggaggagtggcctggtgatacccaggtcgctgagcccagttgtcctgcagaccggccacagccctccccatcctgggctctgctggccctcctttcctttattttgtgaaccaacggtgtggggtgggtcactgtcacttgcaacccaaagaatcctgactaaaaatgatgagattaacccaattatattgttaataaacttctcattactaatgtaattttctgccagcctagatgccttcagggctggggctgaggctgacagtgaaagtactcactaacctcacaccacttcaaggggatttcatcatcttcaggcccctcactcccacactcaccacggtggccccactcatctggtcccctgtccctgccagtgccccttgcccccttccctgcatatttgagcccatttgccctgcacacactgctcaagtctctcctcttcgaagccctccctgtcaatcctgacaacattctgtgtgacctcccaaggccccatccacccaggaagccacacttcactgacagttatccatgtggccaccgctgtgacacctccagccacaaagccagttggcagaagggtgtcaaagcaggcacacccgaggcatccaaaagaactcagacggcatttccctatcagaccaggagtgagcagaaacagagggaaggtggccatggaaacaggcaggctgacaacactgagaaaataacacataaggtcctgcagaaggcgggcaagggcaagcccagcatgctcagtggcagcacccaagggtacatttggttcacagtgctctgtttaagatgccacagcatgtaatctacttgagaatattccatcaaaaacagtcaaggcagagcgaagtggctcatgcctataatcccagcattttggggaccaaggcaggagaatcatttgagcataggggtttgagaccagcttaggcaacattaccaagaccccatctttacgagaaagatttaaaaattaacctggtgtggtggcacatgcctgtagtcccagctactccagagactgaggtgggaggatggtttgagcccaggaagtcaaggctgccgtgagctgtgatcgcaccactgtactccagcctgggcgacagagcgagaccctgtctcaaaaacaaaataaaacaaaaagccccaaaagccagatggtgctgagtgatctagaaaattctgtcctcaaaacaagcttcttccttgcctgtctccacttggctgccttgtgcatatcaggtatcagcttagctgccacttcctcggcaagaccttctctgacccctgggctgggtcagctgcccctgtttgcctccccgtgcatggtgtggactgtgttgtcattcccagggcaggacattcctggggtaggtccgagccctgccctgcgcaccttcatggtctggtacctctctgagcgccgaactctctccacctcctcacacactccatgctccagcagctcctgggggagggaacaaagcagaactctaagcctgagggcgtgggaagaaagagaagggcggggagttagggtcagggctgggggcccaaggactgaggcagtcccctccaacacccggcagagacaactttgtgaggtcagggtccagtaggacctggaaatggagactgtgcccagggaggtgaccaaagttgctgccacacagctgggaggtcagggctccagcctcaaagctccttcgggcctggagttacagcagctgagatgccaggtaacgtggatcatctctcagtcaaataagtcccaagatacataaacaattgcttttcagaacatgtgaactcaatactacttcatttaaaagcatcttctgtcactgtgtattcttgcaatgaaagtgcactaaaggacaactaaacacactggggcactgaaaagagatgctcacactcagggtgctctctttcattccactgtggagggcagtttgggactaatgacaatgacaacagtgtcacccctagccctgccaggcccctcacagcgccattcactgggtcctctaggccacccaggagtaaatggctagtgtgcacaggaggaatctgagcgcagagggtggcttgttgaggccttggagcagtgtcagcacccacgactgtctgtcctcacccacccccacagcaccctctgctgtctcaccaggccccaaggcctccccacccacccactcaccctgctaggatggtaagcacctacctggacaaccctagaggagtgttctccaaagtggggaagcccctgcagctggctcagggttgtgacagggctgggaagggccttgagcaccgaggctgctctgcagaaggtgaggaggcggccctcactgccttcaaagcctgctgcctcggccagtatctccagagcctcctgcagggaggggccctaggtaaggggcagggtgggcagctccaatcccccacctaccacccatctgtacccttgtccccaacccccagggctggccaaggctcatagaagcggcttacggagaggccagtgttgtggtgtgtgaggggcgtagggcgctggcaggcataggcaggcatccatgctgggctcagaggccccttccttggcccagccacctggggatgggcaataaacaggtcactgtgaggctgcagggctggcaggagagccaggccgtactcaggctttgtttctcctggggtgtccaactcgggccctctggagctcatgggacagaggtgggcaacaaaacaccagcggcatgaggctgagggaggcaccgccctgcagaacaggctgtgcatggggctcctcatgccagggtagcagcaatcacatctgccagccctgtgggcacttctcctgctgctgcacatgatgcatgtactccatcaccccaatcctcacaaccaagcgggctggggatgctgaggccttggaggctaggggcttgccccacaaccatggctcacaggctgggccaggatttgaaggcaggcaacctggccccaagcccacacctgtcagaggccgggagccttatagcatccagaggacaggctcctgctaacccatgggtcatcccgctcggagttgctgtgtcatctacttggtgaggaagaaaggcctgaagaaggtaaaaataagcagaccccagaatttgcatcagtggtgagaacagaagctgagatggcctggccccctcagccccttctgtggttcctctactggtttatagggggcccctggtgatctgggtagagtcttcactgcccacctcctctgaaggacattgaggcattgctgccatgtcacctgtcccagctgagcaatggcctacactggggctttcactgtagcccccactttagtcttccacccagctcacctccaggcggtgccggcactccacaggtacaggctgcccagctcccaggctctctgttaaccagcttatgtccagcagagctgggggggtgcaacccgggggagcagctgccatcctgcgctcctgccagctgacggcctcctctgctgaggtctcttccatcacaacatgtgtcgcttcggagctggtggagggagttgggagagaaggaggagggtgaggcccagagcccgtcctggttggctccaagccttcactcttgccgtcccttctgcatggtaagtgaccattcatcctgcaaacgtcacctcctccagaaagccttcccagcccctcctcctggtagatgaacacctccaccactcagccctcagaaccgtagttctctgccctggctatgttcacaagcacagcccagtcttgtgctctctccctccctcttcacctcaaagaaaggaattccttagggtcaggaccaggtggtcttcatctaagagcaagggtttcagcagagatggaggagcctgtttgggtctgaaccccagctctgcctgccacatacttgtttggctcttgggcaagccacgtgtctatactttgatttcctcttctgtaaagcagagataacatatccaccctgtggggttgttgtacaaagatagtgccttgtacactctaagctgctatcatcctctcctgagtgggtctggcgcactactgatccctggtaatgttaaaaaatcaaacacaactgtgggggaatactagccccaggttcgtttgctctctcaacctccaaactagggggcacccccagctcccttactctgggtgttgtctctgtagccgccattttttcttctcttggttcccttcctacaagagcttctcagtcgtgttatttactcaggcctgaggacagaggagcctgcgggctccgggcctcttgagaagtcagtctcgctcacaggtgggacatagcccaggcagaagggctgttagcaaatacgactttttttttttttttttttgagacagagtctcactctgtcgcccaggctggagtgcagtggcgcgatctcggctcactgcaagctccgcctcccaggttcatgccattctcctgcctcagcctcccgagtagctgggactacaggtgcccgccaccacctccggttaattttttgtatttttagtagagacggggtttcaccgtgttagccaggatggtctcgatctcctgacctcgtgatctgcccgcctcggcctcccaaagtgctgggattacaggcgtgagccaccgcgcccggcctactgcttattaattacccctgacctctggttttgattctcgcagtgatcctttaaaacacgcctcgccctaattaatagcaccctttacagaagaggagatggaggctcagggaaaggtcacaagaccacgaagtgccactgcaaacttagaatccaaaaccagaagtgccatggaagccctcgccgcgccgcgccgccccgcacctgcaggcgtcaaggacgcggaagcctttggagcgcgccaggcctgtgaggaaggcccggcggctgcgacccatgcgaggctcgaccaggtagatggcgactcccgggaagcgcgtcgagggcggcgtggaggaagcggcatcgccgctaggggacccgacccgcgctcgccgccgtttggggagcattgggacgacagcctccagcagcgcggagcgaacgcagagggaaactccgagcgagacggaaggaagccccagtgaggctgacggaagcgggtgggcgggcgg

SEQ ID NO: 151 - DNA, 170207 bp, Homo Sapiens
aggagggctttgcacaggcatttactccaggggatggcgggccaccccagccccaaagggttaatgcgtcctggggcgtacagagctggtgaccttggggaaggccacacaatggactgctggaaaccagttctctcctcccactgttgcctggggctacagacaaaatgaaggcgaaaaatgcaggggtgggggctgggtgctggcaggggacccaggggcagccaggctgttgctgggagactcagtgcgacatgggcctggcggagggccccaggcctcctgcagtggcaccaggtgtccccatgagcggccggcactcaggctcaccttgaggggtacctgcaggtggcagccagaggtgagccccacgcctgggccagccacccccagccacctcccagaccccaagcagggggacagggcctacagcacacaggtgcacacatccagatacatgatcagacagccacacgcacacatgtgcatacacgtgcacactcaccacactcgcccagcaacaggcttatgccacatccacctcccagtcacgacacctcgatcttggcggaggttcccccacctgccagggcctctgtgccagtgggtaggctgcggccggcagacaaggtgcccttggatgggtgggtgtgtcctggggcatcctgtgcttgcccctcagggtcctgcccccgggaggattggtggctcctagaggccaggagagccctcccgggggtccctgaccttgagtggaccaagccttcacagctcttgacagggagggaggggtccagccccggctgccgtccctgttcactgaagtgagcagagtcgggtggggcttcccgggcttcagggacggtccagcctccacggctgtgcctgctgtggagtggccatctcggggctggggctgcaccctttggcctggctcttttgccctgggggtgctggcctcccctcaccctgggctccggaagaccgggcaggcttaagtgtcccctcacctgaagctgcagctccaatgcctgcacctgttccaaggactccatggtcctcctgacgagagctagagtgcggaagagagaggaggccctgctggtctcttggccttggggcctgggagccgaagataagagaactttcaggcccgagtcctgccccggcccctgagcccccttgtttcctgtgtccactcggtcacctgaaccagctgtgggaccttaatgcccacaaggagcccctgagtgcccagcccctgaggctgagtccagctcccccggccccatccacagtccaggatgcctctcgcaggccccttggccctcgctgcagcccctcctcctggcctggcccaccacactgcactggccctcacccctacccctccggctcagctcaccccagctgggggccatggggtggggcaggcgtcatgccagctctgttccagagccactggggctgggaggatgggggaggcacagggagcccccaccagccagagccaccaggcacacaagaaccccccatccccactactgcccggtgaagtttgaggcaacagtggctttgtgccacaggcaggctgaccccgttgttggggcgtggatcaccatgcagcagtggggctcagagccctacgaaagggaaggcctgggcaggggccagaggtgggacccgcaagctcaggctttctcagggcttgctctgaaacctggagcccctggataaacattcgttcagtccttttgtgctgtgtgacactgcaatgcaaagatggcggcaggagccccaagccgtggtgggcgccacctcactttccagccctgctggccccagcagagcgagggtctccctggggacctgtccctggtgtgtcctgagcagggccagcggccacccaagctctgtggccctcaatgtcttctgtgcaggagccggtcaccgtctgcagggagctgtcggccagcaggtgggcacacggcccatgtgcatggtggggagccctgcagaaggacctgggcccccctggggaccttcttatgggggcgaggctggagagccggcccaggccaagctggaccattggctcctcatgctggctggggctaccctgagtatgcagagaactggtccctcttctgtgcctggtggggtggtgctgttgactgagcgggtgatcccaagcaactgctgctcagagaggggcagcaagcgtggggctgagctggcactcagctggagcgctccctgtggggccctcgggagggcaggcagggcagagatgctgggcgctacacaccgcctgggagatatgacctgacccccagcccttcagggatggtgcaggccccgcccgacccctggttccccaggccctgcagtccctggccccgagtgctcctgagagagcagagcacaggctgcagcctgcctcaggagctgccaggccagctggaggaagctgctcccgggaacaaggccgtttgggaacgttttctttccttttttaacctacagctgagcacacgttatacttgttaaatggtcacgtaaggtgggtgtgttttcaaatgagtggctggacatacttttcaagtggcagagccctgctttaggatggagtggtctgggtgggccccagggatgggagcctcacacccctaagggtaaggcctggagagggtggggctaggagggcatggcgaccaccactcgagagttggtgcctgaagcttccagccctgacgcccccgtgcctcttctcccaacacgtgaagctgccccggctgtttacagacctggcctggagaactgggggcacaggtccacgtgggcacctgctctcgcctctcccctgtgaggccagaatgggaccagtggctgggtgctgtggggaggccccggccctcccaagggagagagaaagaaccccttgggctgaccgctggggtgattctgcctgagctaactcatctatgggccgtgtagctcagcagagaggggtggcctgtgggacaggagggcacccaggcctgaagtctgtgctgagcctagggggcctcagtgactccaacacccccaacaagaacacctgctgccagctccgcagcccccaatcagcccaggtggccccaatgcccactccccatctttctagacccccaagacatagaggccttgggcctcagacaaagcagccttgggtgtctgcagctgctgtctgcagttccagtcagctagaatacctggcgctctctgaggggctggtggcccagggtggagcccacttgggcctttcaagggtccccaaacccaggctggcccctctgcctgccaggacccaggtgacacagcagcaatgaggtggggcaggggccataaaagggaagacagctgaggggctttcctgggctgtgcccatggggcatggagcctcctcttagctgtctgtgatgtccaagcaaccctgtgttgccccaggctacctgcacactccgggatctgcggatcttccacttcaaacagcagctcatcatggatctgggccaccagcctggcagggagggaaggagtcaccctgggaggccaggactgtggggcgtgggccaccagcctggcagggagggagggagtcaacctgggaggccaggactgtgaggcgggggctcaggggtgcatgcagaggtgggggcccatccccaaggtttctgaaaggtggttctggcactgaggcccaagaggatgtggctccgtgaggcatgggcaccactgcttgaggtcacccactgtcaccaggacagctctggggagctgggagaaggggcaatagggagacaggctggttggaagtgactggttagctgcgaggaagcaggtggcacaaccagcaggaggggctgggtgccccgtgtccgccccacccaggttggtcccgtctgaagtctgggcagggatggaaaaacagccccttgtgaactgttgtgggggccctgacatgggccgagcctcgaacaacatcatgggttcttgtgccctcagggcttctccgagacctcgctctggtgagcatccagccagccccagccaggccccagccaagccccacccttccccagcctccttcatggagcccctcaggtgcccctcccagggcgtcagcagggagagcaagtgggacccaagtggaggagattcaggggaaatgcactgccaggggcaggtccctggggtggggctcacagattcaagtgcaagcacaaggcggacgggtcatggctccgggcaatcagctcttaagggccggcgccacgctggccacacagaccgcactggggctggattccgccagggcgctgcggctccacatgctccttggaaacgggtgacacacaccttgggcagatgatgcctcaaatcttggtgatgtgagacctctgctgaggcctgctgcccccagacctactgccagcctctcctgtgaggtggacacaggcagctcgccttgtgcccccgggaggggacgtgcggcgtgggtaactcacaggatgagctgctgggaaggatggggtgtcagggggtcccacgcactctgtcctctgtgtgaccttggctctgtctcctggatcgagtcttcaggggcaggggtcacgtcctatcttcgcccctgctgcccgtccttggctggcacagatgggcacagcgggcccagggccctagggagctggtctgcatgggcgtccttgccgggcagtagtcacgggcatgtgacggagagccccagctgggataaggggcagccttcaagccccagggtacaggtgggctgtgctggcactttccacaggggatgtggactttgcaacagagatttccggtgacctgccccaatccgcccttcctctctttcttcatgttggcccctttgttgctgggtggggtggaggtggggctgtgtcctcagctacaaaggacatttcccaggctctctctcaggcagggtggcccaggactgcattcccttcaacttccaaggaggctattttttttttccttagcagggagggaggtaaggagtgggaaggaaaagagactccaggaaagtcctaaaagggaaggctctttaaacggctgactgtaaagggctgccaggggcagatgctcttctgaccactatgactttctcctttgcctgcaaggtgtgagggctggagcagccacctccatcacagcaccaggagggaatggccagggagccagagggacttcggtcctgctgctctgagcctctgaaacaaagcaaccactgttctctggacttctcgtgatgggagaaaagtctgccttctggagtctgagctgctgtagcttgggcctgtgttcctgacggccaagtgcacaccctcctgggtgtacatccacaggacactacgtgggcccagacagcggtacactggtgctcacaccctcgagcaggctgcccccagggagggggaggtgggcctgtgcttcatgtgcagcctctggccaggggccgtgggcactgcccttccagaagtcagaggggcgacagagccccaggctgtcagcaccagcaagcttgtcttcaactaacttcaaggcctcaggcagaagtctttgtctcccaagaggacttacttttcaaatgggcagaaacctcagaaaaggcacttgtaactttttccagatttagcagaagcagttttcacacttcttgaaattacattgtgaaattctgagctgctggtgtggcaggaacctaagaataggtgcagttgtcagtcactcacacatcattctcgcagccactgagacatgaccgcgcttctaactgggaaatggggcacaggtgaaagaagaaggacgtctgtcgtctccgtgtggggtggatgaatgcagggccttggatcctgttgtgttccggaagggagtggacctctggtgcaacttctcatccctgttcctgagaggggtcggccacagagctgctgtgttctgcatctggatggcctgactgagatcactgcaccagtaggagaatgttccagaagagcctcaccgtgttgcctgtctggggcctgcaggggcagctcccttgcaagggatgcccccagccctgctgaactgctctgtggactcatcctgagtgtgggcgcatggtggcctcatgcagacccgccttgagaaggcccaggggagggaccgtcacagcactgacacgttctgaaacccaggaaggccttttcataaagggcctgcaccagaagagacagacaggacagccgagccatggcacagaggcctgtgaacgctggccaccggcctcctgctctgagcccaacctctctggtctttttaggatctggaccaagaggcacaaacgaatgccatttccctgtcacagggactgtgggtggtgaatgcagactgtcctgtggccccagcccacctgggcagacccttggggtggccagatgaatcttcttcttctttttttttttttttgttagacagactctcgctctcgcccaggctggagtgaagtggtgcgatctcagctcactctaggggcaccgtgtgcctcccagtgatcgagtttcatgcctgctgcttcagcgagagatgcctggccacactgagcctgcacccgtcccttccagacgccatccacagcctttcacattactcctggaagaacaaatcacgttcacaaaacacagaccatgtgcccaatattccacacgagtctgctttgcattttgctatgagaagcatttcctcgtgacagccaatggctgatgacagaaggatgaccagcgagtaactgcgttcctgagtaaaagtgtctgtgtccagctttcagaaggactcagtcagcaacagagagagacctcagctcctcacatgccaacttcctttatcaattccacaagggctgaaagtgaaccgattttttctttttttgaggcaggttcttgccctgttgcccaggctggagtgcagtggtatgatcatggctcactgcagccttgaactcccaggctcaggtgatcctcccacttcagcctcctgagtagctgggactacaggtgtgcaccaccatggccagcttttattttgtagagacaggtttcattatgttgcccaggcaacacatatgttgttcacaaacttctgagctcaagtgatccacccgactcggcctcccaaatgctgggattacaggtgtgagccactgcgcccagccttgaatcaacttttctagacttgcagtatcttagaggcaggaccaccatttggctttcagttcctgccaagacggaaactagcacaagctgctcatatcctgggagaagctataatttacctgcagaaactgtggaagtgagcgggatgcatggatttcaggacaccatgagaacactgtggggcactagaggctgcctggcatcagtgtatatgcgtatatgtgtgtgcatgggttgtatgcatgggtgaacacgtgtatgggtgcatgtgcttgtgtgtgcgtgtgtgtgcacgtgtgtgttgggaatgaatgcagatggcagtgagatggggcaggagaggactgagagtgaatcttatttttttttctgttagacagagtcttgctctcacccaggctggagtgcagtggtgcgatcttggcacactgcaacctccacctcctgggttcaagcgatcctcctgcctcagcctcctgagtagctgggattacaggtgtgcgccaccacacctggctaatttttgtatttttagtagtgacgatgttttaccctgttggccaggttggtctcaaactcctgacctcaggtgatccacccgtctcggcctcccaaagtgctgggattacaggcgtgagccactgtgcccagccgagagtgaatcttctaatgccccactcctgccttctgaccacttcagttactgcagaaagcagcactgagagcccacagcccagtgaagctgcaagcagagtccctggggcagtgcttagacccccacgggactgtcgccaagagcttgagggctcttagggtgggggtgggaaaacgtccatggtgtgtcagagggcgaggggcccttcggggactgacactgtggggggctggggcaggttagctcccagaaggggctccgggactcctgaggggatcccgcacaaggagaacgaggagaggaggtgtctgggtcaccacttgcagcacccccaggccttggctggcaaggaggaggtggctgggcgagggctgcttgtcccctggccacccacactcttgaggaatgtgccctgggggaataactgaggcagggacagaggcctgagagagctgtggcctggggggcagccagggcggagcccccccccaccaaggcacatctgcatgttggctctgggctcgggggtgggggcagagctgggcgtggggcacactgcctggcactggtggcagcaacaggtaggggtgggggcagagctgggcgtggggcacactgcctggcactggtggcagcaacaggtaggggtgggggcagagctgggcgtggggcacactgcctggcattggtggcagcaacaggcaggggtgggggcagtttggagtccccagggtcctgctcaaggggctgaggggttcgcctgcctctggggtgggcagcctcaaggggtgcccctgtgctgtgcagacaccccgaggaggaggggtctgggggagacagcatttctgtctggagaggcctcatctgcaccccacgctggtggatggctggttgttgtctgcatgcctgctgtgagtagcccccagggccttccatgggctgagagcctcaggaggggacgggggcccgataagcagagatggtgatcatcagaatcacgagccccgagggggtcttcccacagaatactaaccctcccatccaagccctgggagaccaccacccactgacctggccgtcaaggtgtgggaagcagccactgcagtgaagacatggatcatggccagcttgcagaggtcagcagcggagcctatggggcgcgtggtactgtcttgaggtcccatggcacacggttcatggtgcactcagcattctgcaccatcgccacagctctcacggtacctccacacagaggtgctggctctgagctgtctgagtgccagggccacagatgactgcaggcagacacttcgtccttgctcctcccgccctcttgctcctgcagggcacctgggttttgggtgccttactcctggaggcctcacccctgccaggcatgcatggggaggatggaagggcctaggccaagtgccaaggaactgagctccaggtctcctaaaccatagaagcctcagtttcccaccacagagatatggggaacagtactgcctgggcccagttcttgcgggaatcatccaatcatcctagctacaaagatgaccgtgtcccctcatgcctcctgacagtaactgccaggcaggacatgggtagtgtaagctcctgcaaggaggtttgtgatgagcaggaaataccgcaacagtgatcggtgggtgccacccagccctgcggctgctaaaacccaagaagcaaatggacacagaactacaggtaagaggcttctggtaccttgcaccacgaagttcactgcctgtcgctctgcttgtgcccggagttgctggtcatgagcgtgaatccttggcaggggtctccttctgcccatgatggacaccacacagcctgagtcacacagagcaaaagtagatgagggacagaaacaggcaccacagcaggtgcagctccctcgggccaggtccagaggccacagagggacagccgcactgcagtgcagactccaagcctcccctgggcccttcgggtctatcatgggggcaagtgggccctgcagtgggaaagcgagggtctgagctgggcactctgcactttttttttttttttttttttttttgagacagagtgagactctgtcacccaggctggagtgcagtggcgagatctcagctcactgcagcctcctccttctgggtttaagcaattctcctgcctcagcctcctgagtagctgggattacaagcacctgccacgatgcccagctaattttttgtatttgtagtagagatggggttccaccaagttggccaggctggtcttgaactcctgacctcaggtgatccacccgccttggcctccaaagcgctggtattacagtggggagccactgcccctggccacactctgcactctcagctctgtactctcctgacttccagctgcacctggatctcacacaggacgagggagggcagcttttgcaaagccatgtggaggccttgggcccaggagtaactctggactgtgtgggatggaggagaaagtggtcagcccacatcctcaaggagggggatgtctcagtcaggtccagaccctggactgggcagatccaatcttgagtggcctgaagtgtatgcaatttgggggctcttttaaagaaaatgaacacaaacacactgtgttagctgactatattcctgaccagtgaggacttctgctttaactaggtgtgggtgggaaataaatcctccacttgtgactgaggatgagaagaatttcccacatctataataatcatgaaagtgacaagggatcgagtacctactacatgccaggcaatatacaagattcttaagaaggactggcagtgaggacacgagagatcttctgctctgacttggtccctttcagcttctgctgctttgtcggtctagtgacttttggccggatgctgggcactgtgaattttatgttgttgaatgctggggtgtgctgtcttccttctgagggtgttttggcaggcttaagttacttgccaatcatcttgacccttttgaggtttgcttctaagctttgttagagtggatttggaatagctgtaatctagggctagtctagacctgcctctaaagtgtgacccttctgaatgtcccaggtgtctaacaaggactctccgctctggatggtcagaactcaaacatctcctagttccatggtaactctggaatcatccggattactgctcccagcaatttttgtgcctagtcccgtagcgtttcactcaatgtatgcgtatcttagtgttcaaaaacagacacaagggggaactccttgaagatttacaaggctctctctctctagctccctcctctctgacactctggcttacaaaatccagctgcatctgcctcccaagtctggatccacgtctcctccactcatccagaccactctgcagtctgcgtggctccccctccacacgtgggctgtgcctccagacacagggcgttcttaggactcaactcatttgcctcttttctctcagaaacgagcaatacgctacccactgtctagtgttggaaacggctgctccagatattttgcccagttttctggttcttcatggtgggtgcaaactctgaagccagtgactcccttgtggcctaaggcagaagtctcctgactccatacatttcaaacctcatttctcctccacccagtgcttccagtgccagtgcctgcagctcctgttcatactcgaggtgccttccggccctggccctttgtggtgatgctcgcatggcaccaatgctcctggaagccactcctgtgccaggatggctagcagcacaccacacacagagaaagcaggggaccacaggaacaccagcaggaaaatccgcattaaatgagttgccagctcaaccggctgtggccccactgatgccacctggcatagaaaggtgtgtgatggaggaagagcggtggaggcagcagtcctagccgaattaagctgaaacactttgtttttgacatgtttacaaaatgtagaaggacgtgagcacattgcagggcctctcccaggaccttgggacggccagcgtcagagtgagtctgctccagctggggcagccaagtgccccgtggagagcactgacccctgagggctggtggccagagaggcatctgagatcccagctggctcctgagcttttgatgcttccttgacatctcttacctgccattctctctccacccctcctcagttactgtgttaatgcctgcatgcttctagactattctcaggggtggctttgactgcatctcaaatctctttcccacatcttgactggaatcattttgaaggacaaagctcagattctttctccatggagtgtcacgtatggtctgggtttacccagccctacctgttctctggcccacctgcccatgctggcactcctcctggccctgtctctgcgcaggtcgccagctccatgagatggaggctggcacagctcccttggggcctctgctgcggctctgttcttctcagacctggacgccaccttcctgtccttgtctggatgcttgtgggtttaccatgtcccccaaggactgtaagctccacgggagcaagcggcttgtgtctcaggcgctgtggaggctccccttccgggctagtgtgggctgtggcacagatgctgcccacctgcccgtctgctgtgagaccaacaaggagcctgtagcagggctgcctggagctctcggggcttgggcatgggccccagagtgaaaagtcatcaacgagtcactgggagaggctcacggagagggtccacgaggctgccacacagacactgccggcacccagaggaaacaggccgcagcatctaagatgctggtcctgctgaggccaactctccagctgatttcctcactcccagtgagtgctgagtgctgtgagtgcaattcctgtgcctgtcattcatcctcctctttgttgttgatttcattaatttctgctctcccactgatttcttccttttttccctgctgctcttttccagatttcttgtgtagaacacaactcatttatgcccacaactttctctttctttaaaaaatactcctttaaaatattcctttacttctaagtgaggcgtcagcttagccacatcccagtttctgatgagatacttttactgtaatttatttctaacattttttgtcattttcttaggatttctttttttaatcctaaattattaggagtatcatcaacttccaaataggtaggtggaaggatggctacacatactcagacatacatgtatgaaaccaccttttcattgcactgtggtcacagactatgtcctattggatattctttgaaatttgtttgggtttccttcatgacctgattgtggtgatatttgtaaatattccagtgcttttcataagaatccatgttttccctttccaggtgcaggcttgtatctgtttttacctatctgcccatccaccatctagtcactcaagtttgttcactgtgttgcttcaagccgcccagactcttgtcccttctcgtgtggaaccttcagccttatttgtccaataagagctgaggattcacccaggcccccaaaccaacctcaggacccagggcccgcctgcacaccaaccacgcagctgtccccccatcctcccacagagggttggcagggagcagggagctctggttgtggccaactcacctgtctggtgacactgggcaatagctgctcgggcgaagtccttgattttcttgtacttctgcaaaaaactctccaaaaactgggcagcttcctgaataggaactccaaggcaagcagccagccgctccttccctgtcagtcagagagacgcatgtcaaagcctcactcacaccagccgtgactgtgtgcatgggctcagtgagtcaggtccagctggcagcactggtcttttctgatgggttgggatggagttggcgttgactttacaagccaggtgctaggtgccaatcaatcgggactggggcctgtgaaacatgtatttattcagtgatactgactcagtgcctgccaggtgtttcaggtgatgtggtgatgaagtagacatggtccctcctcccagtgcggccagtgggagatccaattccagaactgcggaggttagagtggggcacagaggaaaagaggaaggggaagttccatggtcaaagtatgagaaaatggtgctcaggagttcaacattttgttctagaagatgcaggtgttcttgcgacgctgctggtagaaatgtctctggttggggccaggcatgtggtggctcatgtctataatcccagcactttaggaggctgaggcagacggatcacttgaggccaggagttcaagatcagcctgggcaacaaagtaaggcctagtttctatttattaacaagaaaagaaaaaaaggactttggctgggcagtggctgagttccgcaagcatgtgagcaggttcagtgaccacagaagcctgggtctgggccctgtcccaccaggaggttctgtgtggccctggggatgttgcctgacccacattaaagcccatttcttcactgtatattaggaacaagagcccttatcctcagctgggagccccatgagctaaggcatgggaagttctaagcagtgtgtggtttctacttggtgctcaatatacactcattccctcccattttcctccagaagagaataataatgtaaatagagaatgaggaatccatgagaacatcatcccttgctcgacagtgggatcctagggaaagccttggccctggggagtgctgtatccttggaaggaaccccagagagacaagcagcctgaggacctgccttcctgggggagcatggccgggaccagcagtggtcttggctgtcctctgtgataggtaaactctagggttgtactagagggtgctccagggacctttggacaggatggtgcagaagcatggcccagggggtgaaggtgtggggtctgtgaagaccagggaagaaccctctggaggaatgggaccgaccagtctctctgatccagccctcctttcagccaggccactcctggccctggccagctgatggtgtagcagctctggacagagagaatattcaagtcttaggagagtgaaaaggcaggtgtttgcttccattgctttgtcagcaagagtgggaaggtctagggtgccctgttctcccaaagtttatcccggcagaaagggataaagtcatagtccttctatgcccaggactgcctgatgaactggcaccatttggctggaaatgaaaaatctccaatatctctcttagggcttaagatctattattgtgatatattcacaaataagttatgtgttttgctacactttgctgaaataattcatctatgactctttctttctgtcaaattccaaccaccatcctcacctagtgcctcagctatggcactgcaatggaaaattccattggctctcagaaagaaatcagatggtggccagatacacaaggctggccagatgggactttctttgagtatcttcttagacaagtcttttctcacctccaatctgctgttaagcccatctggtgaattttttattttggatatatagttttcagttctagaaattccattttagaattttatttcttgaagttttctttttttcatttattaagagcatattttcttttacttccttgagcttagtaattaatagaaactttaaaatccttgtctgttaattccaacatctgggtcatctcaggatctgtttccatgattgccttctctcttgagtatggttaagctattctgtttcttcctgtttaggaatttggggttatatattggatatcatgcatgatatacgtagagttttagatcctattatattcttctaaggggtgctattttttttttccttttgagacagtgtcttgctgtgttacccaggctggagggcaatggtatgatcatagctcactgcagctttcaattcctgggctcaagcaatcctcctgcctcagccttctgagtagctacagatgtatgcccactgtgcctggttaaggagtactaattttttgtttacactttttatatatttattttgaagtgtttatttaggacaaatggtttttaaaaatgtataaaaataattcacatataaatccaacttctatatttacatggtcccttaaaagattttcattttattatcattaaaaatgtatttcaacaatctccacagtactctcaaaggtcaggaattttaagattttctaatagaaaaattttagtatttatctacagaaaaataatgaaactaggaattatatcgtattttaaaacataatgtctcaactatgctgtgccacataagaataatcttcacactaaactataataattccaagtgctggcattttcgtttatgaacaaagcacaaaaatatctcatagaaaaaaatatttcatcataaaaaacatagaaagttgaatgcttcaaacaaaaatatctgaggtctgatttcacaacatccagtttccatatccactttgtaaacatatactcagtataggttaccaacttaaataaagcctgttatcactgaaagaagacatagtttaaaaaaaattcagtgcaaaaatacgcattagctaatcaactgatctacaacaattttcatgaaaatcacaatttgaatcccataatataaagtgatcctctaagactttaattaaaaataaaaagctgtacaacagccatcaagttttcttttgttactattctctagtaaatgctttttttttattagcttttacaatgtcatcaggtgatgctgatttgaagtcaaatggtattatcgctacaagaggacttatttctttgtcctttacatcttgaacttgtctactataaagaaaagtcttacagaggtcaagggtgcgtcgcttgcagctttttagtgggtaacgaagacacagtgttgaggcaaaagctgaaggtctagcagcaacggccttggtccgagacagagaaaaaggtggtttcctagtcagacagcctttattgtttttctcattatccttagcaaaattggatttcttccctagctttgaacttagaactttagttcgtgatgaaggagcaatggattggtctactataggctttggaagaaaatctgggttttttttataaggaccctaagatcaatatttgaatctattccaggagacctcacttcagataaactgacctcaaaggactctttcttaatctgagagttgtatacatcaattgtttctgcaatcaattcagaaagtgacaaattctcaaggtctcttgtgggagaagctttaggaaatgccaatgacaacatagatcctgttaattctgatattcctggtgaagactgacagtgatttgctaattgtgacaggggaaaggatcccaaacttagatctgtgaaactgacagatgactggttacaaaggtcagacaaagtaaagcactggcttatattgttttctttgtgttcccgaaacagttcagttagggatggactttcacactgggaaaactgcaaattatcatttttaaaaatgtaattcttggcactttgttcaactaaagaaacacttccaacttcagtttctttactagcatttaaattatcaacagtcatattttccaacaagctagttaagcacaaaggattatctgaacttcctaaactgtcctgtactggaatgttttaaaaatcagatagtgaattactttgaatatatgaagaattattcagtgttgtgctctttatcattatggactttaaatctggtatttctttgaatgcagaatcatctttggaagcacattcagatggatgaagtctcaacaaatcagcatctaggttctttgaaagcagactttccagactgtctgtagatgacaatctgactgatggctgactttcacaggaatctcttgacatatcaggaattaagttagctagtgaaagttcttttgttaacctacatgattctggtttcttttcacttttaagtctgtcaagtttctttttcctatggagtaaacagtgacttggaactgaagaattatgagataatccatattttcctactgagctagaaaaatcaaagggtttgctactataatccaaatgatttgctaactgaggataagaactttgaacattatcagctgaaacttcagaagaagaaaataagactccttaccttttgctatctttcctgtagatactcttccctcattcttgtccttcaaattctacatgctatcttgttccagaacctctgacaaaggcttctgcacatcaaacttgttcttcagaactgattcaatcaatatttcatctggcacagcatctccaagtactttctctcatgtgatcaaggcatgaataaaaacgagcttgattaaatccactgagctgatggttcgaaacataattgaaagattctttcagatcttcatgatcgtattcttctataggctcaacggaaggtttgtcacgctgtgaataaataaactgagcagctgttgatagcaaaatacaagaatcatcctctacagactggccatggtgatcatcatcttcaagatcttcatcgcagtcacagcctcgaacattccgatgctgggccatgacggtggagagggcgtttgctacagccccttaactccttccaaaacactccgcttagatactgataaggtgccagctcaggagtactatttttaaaggggcacttagtttggctaaaatcaaactctgtctccctgtagtgggaaaacactgaaatctcaggtcagtcctttttgccttggcttctgggttgtttgaagtctgtcccattcatgcatagttaggggtcagccaaggatctgagcagagttcaaacctagaatttggcctcatttcctggctctcttctttctagaatttctcatttcactttccagatcctctggttgtccagaactctgtcctccagttcttcaagctagtaggattgtatgttctagcagagtttctgtccccacagcatcaactgaggtttgccttcaggtgagggtctatagaatgagaaattcaccagtgccattcctttcttccaggtgtcagctgacctccaatttctgttgctctggtcacttcccagtgcctctgggtagttgtctttttatacattttccacagtttatagttgatccctgtgtgagggctgctccaatgggagcgacttggccataaccagaagtcatgccttgctttctaaatacttatggccaagggagaatccctttcctttcttctatggagctgtcgggatctctgaagggcagcaggtggccccggtccccaggcataaagaaagcccatccacaagagagcggacggtgtggtggctccacaagcagcagggacgagagactgagatggagcctgagggtctgggaggccttccaggccctggatctttgctcctcactccttggacacccttagcagtgggactgtcacactcaaaggccactgtcccttccccaagcaggatggcttttggctctgtggggacttctctgtcccatgcttccgctggactgctccttcttttcatagaacttgtccccacactgtgattccgttgatcctgtttcacacacaggccctgagagatctgcatgctggggacactaagtactccatacctctgaaatcctacacgaacacacaatttgactcttcccacagacggctaaccctatccggtgggtacacgtgaatctgtgtgtgtgtgtgtgtgtgtgtgtgtgtgtgtgtgtgtgcgcgcgctacaatttgacgtttagcagggacagtcttcactcccttcactcccttttctccgagtgctcttctgccccacacatattgctaacaggctttcactcctgtttatgtctctagggctgagcaagtgcctgcacatagtgggcctgtgggaacatgggctggtctagctggaacagacctgacattgaatcctacgctgctttcaaaactcagctcgggtgttgctgctctgggccagctcctggactctcccaactctccctgggctgggtccctcccctggctcccttggcaccagggactcctgcagatgcactgatggcacagtgctgtgcgcccaggcctcctcccgtgtctcctctgacaggtgcgagcccctcgggaacaggcactgagccaggcggtgtgccctcagcacaggcctgtgggtcacgtgatgactggatgtggaggcaagcttcagagtcagggaatcatctgagaagacccaaggatttgactctaggagccataaacactcagatcaagacccgaggagtcaagagctgcttccaggagaaggcaggttcctgctgggctcagcagcagctgtgcgcagggccgtcaggctggggacggacatttgaattcagttgactgatggaggagcagtgagcctgtgagccagcctctggggtcaaggctcccagacagtggctgctctgttactccatgtgttccctaccagctcccccacggtggctgcggggactgagcacacagaccctgcaccttctggggcatctcccctgcctctcacaaagtcctgctgcttcctctgctgtattcatcacagtcttcacaatagtcatgtcaccgatttctcaagaatgtgtaggaatcatgccttgccccatgccctcagcatttgtgggccgttcagaggtatgttatgtgaaaacacgtcactacaatccgctgaaagctggtaggtgcaaagctcctctatggagtttccaaagcgccccagcagcctgggaggcctggcaagttgactggcttcctcagtcccagctcatgtgacaaagtttcaaacacaaggagaacagagaccagcctaagcccacagcagtggatacacagtaattccagctgtcaagccagaccggaacaatgggaacagcagagccggaggctcagggtgggaacccttgtcactgtcacagctaaaagcagccaaattacccttttcaacattatggctaatgactcagtgcttatttacaaaatgtagctcttttcctctccagaaaaaaaaaaaaagtgaatactccagaaggagccaaacgggtggcagagaagaccacctttttctgggtaggtgggggcatccatcctgctggaggacagctgccccacggcaggtgctcggcactctcattctccatccctccctcctagctggatttggggtggctgcccccactggggacaaggccggggctgccacaggagacctacagaagctgctcagtcacttggaggcatttactgacatggcacagaagtgaagtaggactcagacgtaacggcagatgacagagatgagagctgactgtgtgccaggtatggccccatgcaccctatgagagcattttcccaggaggagatggcacagggaggcggagggccttgcacaaggccacacagtcaggagctgatagggttggggatcaagcccaggctgccgggcccaggactggggaggtgatgtcctgccggcagagcagaagcaaatgttatgtttgcaacacaagatgcagcaggatgcaaggcaacaaactctcatataatttggcagagtgatgccttcccccaagacagaggccccagggaggttcaggggtgcagcacagaagaggctgagaggaggcagtggaccaagcaactctgaggagaatcaatccaatgtcacactactgtcactcacagaacctagttctttaaaacaaagtttcttagtctattttccaaaaaccatgtatacaatcaaaatgttttcaaaagtggagctgagaccaccaagtccactaatttgttcctgtgtcttctctgtgccaggcagtgagctaacgtgatgagctcctatctttgaggtactcatgtttgagctggggcatgagaccatgaacaggcgagtgggtgcccaaggtgtgaggcccatgtggcaaggagctgagaccacctccggctgacagccagcaagaaacagaagccagccaggtgcggtggctcatgcctgtaatcccagcactttgggaggccaagatgggcagatcacttgaggtcaggagttcaagaccagcctggccaacatggtgaaaccccatctctactaaaaatacaaaaattagccgaatgtggtggcaggtgcctgtcaccccagctactcaggaggctgaggcaggaggcttgagcccaggagttggaggttgagccaattttgtgctcaatgcagtgagccgagattgtgccactgcattccagcctgggggatagagcaaggttctgtctccaaaaaaaaaaaagaaagaaagaaacagaagccaacaaagtggatccttccccagtcaagccacagatgtgatcacagccccagccaacaccctgactgcagcccctgcaggggacccagctatggcatgcccacacccagagaaactgtgagatagtgtgtattattttaagttactacatttgtggcaatttgttacctaagaaatgggtaacaaatactgtggttgaggaaggttgcacaggggagagttgagcacaggtctgcagaagtgagggatgggttctggtggtacaggggcaggtgttcccatagagggaagagtagtgcaaagctctgaggttggagctggcctggctgattggctgtggttctagacaagctatccatccacagttttggggcggggcactctggacgcttgttcaacggcaccacattctcaatggagactgtagggcagctcttagggacaatctactatgtgcttgccccgttattcttccactgaagcttgtttggttttgctgcctttctgtgaataaacaaagggtttccatggcaggatggtgaatcttcttttcagggtctttgcacaagccctgctacccaaagaagaactgatcacagggaaaaggaggtctgaacaggcttaagaaggagctggctggctggggaaactaggccatgctgattcagcatgacccagggccagaaaagaattaaaaaatcccagacagcccatgtcagggagtccaagggagagtagaagaagggtgagtggaagagagtagaaggcctgctctgacatgggtattggggctagggggtagggggaaggagggagaggagcagaaacaggaagggaagcaaaaaggggaggggagggagaggcttgcagaagaggccccaggcagcccaaacctctggccttcagtccttcctggcctagccccgctttctcctatctgctacccctgagattggacccctactgctctgctcccagcccaaggcctggctctgccctctctggggtgctttggctgcatggcccagctgggtgagctctgccctagggagatggggtgcatgttgagatgtggcaatgagtccaagcgctgcacaccttgaggctatctaactttataatgccttggcatgtgtgtggacgagggtctcctcgaaggtctccaagcacagcagtggtgcctagcacagtggtatggtgtaggggtggagccaacggcttggtcacacttgacctgcccagctccgcggcctcccctgagaggctggatgtgactctgagcaggtcaaggcatggggtggtctggccagtgtctggtgactgcaggtgtcatcagagcataaacaacacccagggactcacagacgatttctgaggcacagccacatttaaacacaggcacacagctgccagcttacaggtaaccccgagaccccagctcccggcccgcagcctacctgctccatagaccaccgcgtacaccaccttcttggtttgctctctgtctgcgtgtgtcacctgttccacgggcacatccttcctgcatggagagaccatgtgtgaagttcaggcacagaaggcactgtcagtgcagggcagacagtccaaccacacaccccaccactgtgcttcctctggaaattccttatgctttcatggtggccggcacactggcaggggagacattccatacctgtggtgtcagctcagcaagggccccaggcagatgccttcggcgaggctgcagcagctgctgccagccaagcaccaccccacgttcccaggtgtccacaaatcaaaacccaaaactgctttcaccaaaggcatgcccatccaacttcaggaaaggccgttccccatattggggtgcctgggcctgggccacgtctgtgtctgctgcagtgggggagctggtttctaggcctatctagtcccactgcttgactggatgaacaactctgtcctggcctcccacagacagaggccatgggggtgagccccaccctggagctacagcattcagatagaataaggatcaactcagcatctgactggcatgtgaaccacagcaatctccagagattaaagctgagacatctgagtagcacaggagctccagagcactcccagcaccaccaagagtccctcctcctccgagagcaccttcaaaggacaggcagcctgacatgtaccctcggtgccacctcctgcctgctgcttttgtaaacatccttatcatctacaccaggcctccctgatggagtgggcatctcagattcagaagccgagagaaagagagagagagagagagagagagagagagagagagagagagagacacacagagagaaacagaaaaagtaacagaaacttctcccaatctgttttgtggatggctttgtgctggggcctccttcattgcttagccaggcttttcacagctctaccttagccttcacttcctacttgcactgagcatagagaccagccccaggtgaaagctcaggtcttcttagatcttttctgagcatgcaagctctctgcgcatgtatggtgctttctacatttcccgatatccacaggtacttttgaatgccctaatttccaaaagcatctctctcctcagtttttcttccagagctttcagtgcttcattgtttgcctcaactataatttttagctccaggaagctgcaagttatttgccttacaatgtttccaagcaacgtctgccactcttctgcagcaagtgggttctgagttaggtgaaacaatgacaagtgcctgtggcagcccttcaggcagccaccagactggtgagaataaatacccacttcttttcgagtaaggtgtgctctgcctccagaagcagggaccaggtcccatgctaggaacatgctgctgccttcaagattggggggtgggaggagggcagacagagtcatcaccaggctctcctaccatttttttttttttgagacagagtcttactctgtcacccaggctggagggcagtggtgcgatctcgactcactgcaacctctgccttttggggtcaagtgattctcctgtctcagcctcctgtgtagctgggattacaggcacctgccaccatgcccagctaatttttgtatttttagtagagacaggttttatcatgttggccaggctggtctcaaactcctgacctcgtgatcagcccgccttggcctcccaaagtgctgggattacaggcgtgagccaccgcaccaggctctcctaccatttttaagttttttcttatttttctttttttagaggtagggtcttgcttgttccccagactggtcttgaactcctggtctcaagggatccttctgcttcagcctctgaaagttgaaaagctgggattacaagtgtgagtcaccataccccacctgcctttttcttgattcagcatttgcttggttgctgtaaacctttgcctatttttcaaagttttgatgaagttggttgagacagttttgttagatttttcaatgtttctttgggggacaggcccatggggctgtgtaccccaccattcttgctgacatcccagacttcactgattttttgccacctaatttctaagtaccaatgcatttccagttttcccccttttcctgctgtgttaagctattttgccaccttgtttagccacccttaaacttggcattgttaacagctatatttagataagaagcaaaaagccaaaatgggctgggtgcagtggctcatgcctgtaatctcagaactttggggggcctaggtggagggatcatttgaggccaggagttcgaaaccagcctgggcaacatagcaagaccctgtctctacaaaaatgaaaaataaaaaattagctgggcatgatgatatgcccctgtggtcccagctacttgggaggctgaggtgggaggactgcttgagcctgggaggttgaggctgcagtgagccatgagtgtgccactgcactccagcctgggcgacagagtaagaccctgtctaagtgaataaacaactacatgacatttttgtagactattttataaaatatttttaaacttaaccaaatgaaaatgtatcatagaggtcttggtaagtttagattgatgccaggtacataagcaagagaaggagctagaatgatccatgggtaatgggttagcactggagacatcagtatgaactcatgataagctccatgttgatgcacatggttacatagagaaatatctaaagatgtgtgtatacacacaggttggcatgcatgcacaacttcttgttctgtcagctgagagggcctagaagcaacctgctcagtagcaaagagcacctagcaccagaacttggcctttaatagccattctccagtaaaaaatggggctccttggagaaatggctgattccaggactggggcaggaaacatacaagatgaacctggaatatcttttagtgccagaaagcaaggaagtgataaatgtgtgtgcacatgcacgtgcgtgcgcacacacacacacacacacacacacactgaagaggttaagtcaagggacacaggagccaactgaaagaggtcccaatggccaaagctggaacaatttaagcgagaaaacaaaaaataaattgtattatagctatcccaaagtaaaaaataaatattcatgaatccatacgaatttggattcaaaggattaaataaataaatgggggagaacacagatctcccacacagaagaaatccaaataatgtatatagataccctgttcttaagaagacaaagggtaacccccaactccttaattagaggctatgcttagtgacttgctctcaaagggtaccatgtggaatcggagtagaagagagtatctttatagtagagaaacctgacaaatacgctgtcacccaggtgacccaggtcagcatcagcaggggtaagtcctgttgacagtgcaagtccctgattcagtgtgaagggaacggccctgcacctctgtgctcttcctccctcaaaccccaaatcccagtctagtcatgagaaaaacatcggacaaacaccaattgagggacattctacaaaatacctgaccagtcctcctcaaaactgtcagggtcattgaaaacagggcaagtccaagaaagtgtcgccatcaaaaggagcctacagagactgtgactaaaagcagtgtggtgtcatggagggggtcctggagcagaaaggggacagcagggaaagactgaggaaatccaagtcatgtgtggactttagtttataataacataccagtattgggttcattcattgtgacaaatgtaccatattaatggaaaacattcataacagggaagcaggggtgggatatatgagaactctttgtactatccttgccatttttatgtcaatttaaaactgttctaaaataaaaagtttatttaaaaaagtgatccagttcaagaccagcctgggcaacatgatgaaaccttgtctctactaaaaatacaaaaaaattagccaggtgtggtaatgtacacctgcagtcccagctatgtggtgggctgaggcaggaggatcactggagcccgggaggctgaggctgcagtgagctgagattgtgccactgcactccagcctgggtgacagagtgagaccctgtctcaaaaaagaaaaaaaaagaaaaagaaaaaagagagagagagatccaaaaattatgctagggttcaaatcgtttatatggtatgacttgattttaagtcataaaattgcagataaatagtgggggaaagcccacaagtaagtctagtgggcttatggaaatctggtttttgttattttgataactggtatttaaattttttgtaaccaatgaaaattataaagaaaaaattagccataaaaaattccacggtaaatacaggagagtcaatagctttcctactagtaataaacagaaactacaataaaagaaaaggaccacactcacaatagcaatagaaacctcaacatacctgacaataagtttaagaagaaatgcaccagactttcattaaggaagggggcattaaaagacacagtggaagatgtgctgtgctcctggacaggagaatacaacagtgaaaagacatcaactttgccatatccagttttaccttagcacactttcaattaaggtatcgggaggactggggggtgaatacttaagaaagcaattctaaatttcatctgaaaaacaaaccaaatgagaacagtcaggccaaagttaaaaagggcgagtaatgaggaagaacagggaaaggtacacaaaactcaatactgatgcaggagtaaaaatagataaatcaggggaagcaaagaaaaagccccaaacaggctgtagtatattttaaaacatgatttggcattttaaatctatactgggttggaattgactaattatttgggaaactatgaagttaaatgcctacttcctatcatacacaaaaataaattagaagctcattaatgtaaaaacaatcatgaaaggatgatgttgaaatacatatacagagtagaacagagagcccagtggcagtgctggggctcatgggccttggtgtgttgcagaggtgaaacactggacgtggccccatgcattgacctgggacaactggctcaccatggtggaaaaaatcaaattagatctttgttgccacacaaatcacaaaaatggggtccagattgagtacatgcctaaacatgaaaaaaaaaaatcaaaactgaaataaggctaaagaaaacaaagaatacatgagtctcataaataggagtgtgttgaaaagaaacacaaacaatacaaaccatactaagaaatgtcttttttttcaaggcagctgattagatgcatttcaagcatgcctcatccacttaaaagaaccaaaatgctatgtagacaatcacactttgaatacattatccaagacagaacacagcagttcaacagaaaagcaaaagaaaactccacaatctaggaagaaggaaaacaggcagcctgcatggcccggacgggctgggaaccagagtgactccccagtaccggagggggtgataatctttctgtggtccactttcccactgggggattgtacaatccaggccataggagagcaccttaaccctccccagtcctgctccagggagggaacatgccctgggtcccacgtccttcctaagacctaagcagctagagtaagatgtcattcttggtcctagcttttaacagactgtgtggtgccatgaaacaatggcgttaggcctaggcattaggaaaacttgggctgctgcttgtggaacaagggtgtgagcagagtgtgagctcccacaactagaactgggaagcaagcatggcatgggctgcagccaccatcgttgaaagtaggcacttcccctgggaactgagcaggacgagagtagctgtggaggcttggtcttgagctgggtaggggctcttatgccccagggctgaattgtgggttagatgtgagctgccaggtctgactgaacagtgagtcagctgtgacagctgggatgggggaggatgcctggattggactggggtgtgagagggacacaagttccccactctccagccaaggctgtgatcactggaacaggccctaactcccacagcaggacctcagcatagtggctgttgcccttcactcaaacatttcaccaggggcctggggattgccatgccctccctagcccttcaccaaggcaggtgcatgcactttccactggggggcacttaacactgggggtccagcacaagttcacctggtctggctgtgcctgccttcatccccaacagagtgcaggatccacggtcctgggggttccacaacccaatttaccacctgggacactcaagcacttttccaggggggcagaggtcaggcataaacaccctaccattaccacctcagctggctcctacctgcaagtgctgcctgctggcctgggggctggcctgcaaagcccattgcaaccactgccaacacaaatgcacagcacttgggacccaacagagcatctcacaaccactgctactaccatcactcaaaccatcctggctgcccaggagctcgagagcccactcacccaaccaggacatcactagtacaaatggcatctgagaaagccaaccagaggcccaagaactggtctgcctggaaccgccaatacaggtgccagcatatgttgtcccagggcacaaggacagacatgcttagcccactaagagagagtggctgaaacctgaagagaggcccatctggcattttagtccccacacaactttaccacagcctccaccaatacctacaccctaacatcccaaagaaaccacagataccactaatgctattcacagccaaagaaatcatacagagtcttcactactacacgcactcagaaacaaagccaaagggtcctacccaaccaacagagagtcacatcttcaggaacccccacactcaaatgaaagtaaattaaaaaataagaagcagcaactgttacaccagatgtgcagaaatcaatgtaaggacacaggaaacatgaaaaagcaaggtagtatgacaccctcaaaggaacacaataattctccagcaatagatcttaaccaaaaaagaaatcctcaaaatcccagataaataattcaaaatgctgatttttaaagaagctcaatgagatgcaagagaaatctggaaaatcaatacaaagaactcagaaaattaattcaggatgaattaaaattaattcacaaatgagaaacttaccaaagaaatagatatctctagaaacaaaaccaaaaaaaccaactaaaccgactttctggaactaaaaaattcattgaaaggaatgtaagatacatttgaaagcttcaacaacagactgggccaagcagaagaaaaaatttcagaacttgaaggcaggtcttttggaatccactaagaaaaattaaagaaaaaagaataaaaagaatgaacaaagcctttgagatgtttgggactacataaaacagccaactttataaattattggtattcctgaggttgaagagagatctaaaggctcagaaaacctatttaataaaatagtatatgaaaaattcctgtctagcaagagattttgacatccaaatacaggaggctcagcaatccccgggaaaatacaatgtgaaaaggactttgccacagcacattataatcagaccgtctaaagtgaaagttaaaaagcaaattctaaagtccgcaagagagaagcatctagtcatctataaaggaaaccccattggactaacagtagacttttcagcagaaaccttacaagccagaagagaatgggatgacatattcaaagtgctgaaagaaaaagcaaacaaacaaaaacgctgccagtcaataattctatatccagtaatataaccttcataaatgaaggagaaataaagtctttcccagacaagtaaatgatgactgtatttgtcaccactagaccggcccttcaagaaatgctcaagggagtcctaaacttggaagcaaaaggatgacattcaccatcatggaaacatacaaaagtataaaactcactggtaaagcaatcacacaaaggaggaagtgaaagtaatcaaatagcaccactacagaatttcaccaaaccacaatgacaaacagagaaaatgaaagaaacaaataatttataaaacaactagaaaacaattagcaatatgacaggaacaaaacctcacatatcaacattaaccttaaaggtaaatggattaaatgtctatggcagaataacaatccactgtatggatagaccatatcttgcttacttgttctgctgacagacagttaggtgtttccacctttttgctattatgactaataccactatgaatatcatgtacgagtttttgtgtggacatatgtttccatttctcttgggtatgtactaggagtggaattgctgggtcatatggtaactctgtatttaactttttgaagaactaccagactgtttttcacagtggctgcaccatttaccaatggcaatggatgagggttggttacttttattttgtagaaaagcaggaaggaagatcagtctttgagctttttacccaaacctcccccagtaaacacaaccctgaagcccttaacaaataaataaaactctctggagggatatttgactgagcaacatgggcctatgctgtctctgcacccagcagagagcctcacttgcaagtggcatctccctcttatagtaaaagctgtcccagtcagaccacgtgaaacatgacagctgtatctatggctgaaagaggaagagccccatgaatagactgtggcctcaggtcatggatcagagctgtccacttctcagtgtgagtttctgcaaaggtgtgctgttgctgtcactcaccctccaagtgctgcacacctatcagggtggcagggaatcagactggctcccttcagaagcgtgcacaggtgggggcacacacatgcacacagtcacatgcagcccaagagcaatcacgacagcagctaccctttgttgagatctgccccccaccatcccaactgagccccagtctcaacaacctatttggcctctccacatgggtgcagcagagatgtcccaggctcaacaaatttgcgactgaactcttgttctgacctcccctcacgtctcgtgaaagcacaccacccaccctgctgctggcccccaattgccccactgggactcccacgtctagtccatctccaaacctcatcacttccacctcctaatatcgctggagtctggacctttttatcatctctaccgatttttccctggccatcatctggatggcagcaatagtctcctctgcctttttttcccctacaacccattctctgctcagcaccatgcaatttgaaaacttccttgctgaaaaccatccaacaggcatccagttaaaggtggcacatctgtttctctctgctccctaccaagaacccactaaaataaagcaaaggaattaagaggaataaatctataagaaaaaagagatcaggagagggattatcatcaggcaagagagctccatatatttatgaaagttcaggaagagctggtggtgagaggagctatgacgcagaagacccaagaatgtgagctcagaaatagggaataactggtataacacaaggcagagagggggagctgaaagtagggaggggacatgaatccaacacatgtacacagaatggtcaagcatcctctctgactcaccacccatgactccctaccccaaacattccacacaagtctgtccaggagcccactctcccagacaaatagtgatgatgatgatgatgatgatgatgatgatgatgatgatgatggtgatgataaaatggaccatgggattctctctacagaaactgatggtcttggcaagctctccaacaccctccatattgctgaacttgacagtcactccctagtctgtggccttcttaagatgccctggaagaagaaaacctgttctgtgctgctcacttcactcttattgagcaaactcaggaagagtttactccggtactctttttttttctagcaaaaatgatctctatgggcctactacatttataatgctagctaatgaaattccagagtctgtctttaaaatgcaagtcttcataatgaaaaaaaaatgaatctaagaaagaaatgaagatgttctctctgtcctgcagctgtggagaaagaaacatcattcacagatccaatctgaaaagtgttaaatggggaattttcacgtgaatagccatcctggtttcctgggaactgcaaaaactggcatgaatatcttaactacgacactcttctctcttctgttaccataaaattgcctttggaggtcttgcaagactcctagactttagaatgtattgccatgtcctgtgacaatcatctcgaagaagtcttataattttgatagactgtcttacttgatattttttttgcccagggaataatgctaaaattggcatgtgtgaatgcctaacccatataaatacttataaaacttagctgttgaataagaagagtgtcactggccgtcccctctttcagcacacacaggatcagtaaacagaaagcccagggctcttacagatgattatttaacagatcctttgagagagtttttcagttaaattgcatttatcttttatcatatactaaatgcttatacatatcccagtaggtctttttatggacttcattttttttccattgatctattctggtttttattcataccactgtgttttagcaactgtgactttaacattaatatattttagtatctggcaggacttggtcttttttagtgctcctcttaaaaagtttttaggattattatgcattatttttgcatcataaactgcagattagtttgtctagttactaaaaaaaccttactggtattttttggcatatttgttaggacatttctgtatttacatattaatgtaaggagaagtaacatcttcataaaattgaagtttccaacctgtcttttctgtgctattctatttttcacatttctcagatcttgcacattgtccattatattattatatatattttctttttcattgcaccttttcttccaatacattttctaactggttgtttatatttagggaggtaatttctgtatattaatttgtgcctagtcttcttccaggtcctagttttaatagtttttaatagtttccttttagttgattcacttggtttcgtaggcaggtaatcataccatcttcaccaaatgatgggttcacttccttctttccagtttttaagcttgtctcattatttcatcaactagagtaaccatacatactagcagcaatagtatcttttctcatctgagtctcacaggggtgctttggtgtttcatgtgtgatcttgctgttgtttgttagcttgcggcgggtaaatattgtcagccattgaaggcttggaggggttgcatgagctgactgaatcttagagagataacgggggtagcattagggcatggattggggttggggagtgggggaccagccaggaagttattacaccagtagatgtgggagataacgaaggcctgatctgaggttgtggaaacgcgaagagagaaaaggcctaaggccagggggaccactggcctggctgggatgtgaggtaggagagaggaagaggggaggcaggactgctgcctgcaggtactggccatggcactgagctccctccagacccactgagtttgaaatgcttgtgggacagccagggaaaactgccgctggggcctggaatgcttgcctgaggtcaggacagagaggagctacaatgaccataacagccacatattgccaatgatggacacatcaaccacttctgaggtcttgccataagccaggcactgggccattgcttctcctctgagtgtcacctgatcccatgacacctttgcgatgctcttcatccgagcgctttgcacctttgctccttttgcctggtgagcaccccttcccttcctctgttggatttctcctgactcctaaacactcagtctctcttgacttcttcaaagaagccttcctgactccaagcaatcccagctgagggtcccttctctttccggccagggctcaactgtgatgattctaaacacaggaggctaagagaaggtgcgaggcattgacttgccaagacccaagggctcagatcaaagctccagaatcagactgtatgggtaaggaaggcagccgcttgctcttgctggacaactgtgccccctcaggcacatttcttaaaggccccaggcctcagtttcctaatccataagatagggacaatagcagcatcctaagtgttggctggtactcaatcagatgtgcttagacaaacctagacatatagtaagaacttgataaatattagctatttttattgttaaagggatagaatgcagaataaaaagagggagagaatgctcctgggtacagaaaggaggatatccacaaggtgatcagaacaaaagtgtaaattcggtgaatttttcttctaactctcgattacaggtccaaattaaacacgcattgcatcacatgtattgacgcccattaaaattgaagaatacttttagggtaattttgtcacagttattttctcctggctttctccctgtaaagcatgctgtgtgattctttgcgtgttgctcaagctctggaacttggctgcagctaaccagagacaccccagacagtgccagaagtttgtggctgacaatcaccccttcccccatgggtgccccctcagtatggcacactaatcctcaaaaccttgatgggaaatgacaaaatcgctatggtcctcaggcatgcaaagacactttcctcgtgggcaatgaggaaacagttaaccacgcttttccaccgagagtggtggttctgctcattcacaggagtgggcgtctgctctgcccgctaagcagagctgctgctttggagggtttgtagcgctaggaggctttgagggcttgagaaacactaaatcattaaaaaatcatcaatgattatagaaattttggaaggaattagatgtgccagggatctggtaaattttttagtagaagaatctgaaagattaagcaatatcatttaggaggaaatgattgaatatgaaaaacaaaaaacaaaaggaacctctgaagcagggttaatcatgggaggagtcctttgctataattaattgttatggcataactttcttaaggaagcaccacacagggtctaggaaaaaataatgtatggtaatcaatgtttaacaatgcagacagcctgaaatcagcaacataaattgtatcctaaaagagcaataatcaaaataatacaatatggcatcttaattgcacacttattaaactttatttaaatagaaattccccttctgagaaaagcaatgagactttttcagggaatgaatgattgaatgaaatgtaaattcgatttcactctttagttctgtcaatttttgctttaggtattttaaagttgttttaataggtgtattaaaatttaggattactatatcttcttgatgaattggcccttttatcattatgaaatgtccctttttatccagcaacattttttcttttgcagtttacactgatactaatctagtaattggctttcttatgcctagtgtttgcatggcatgtttttccttatccttttattttcaacctgtctacacatgtatattgatcagtgtcttataaacagcattataattgggtcttgcctccatcttgttatttaacttttatttatcccatctgtattttgttctgtttctcctttcttggttattttgggcaaatcacatatttttattaaatatcccattttttctccttcattgatattttagcttgacttcttttggtattgttttagaggttgccttagaaattataatatgcatcttactcctcagcaaatgtaaaagaacagaaattataacaaactgtctctcagaccacagagcaatcaaactagaactcaggattaagaaactcactcaaaaccgctcaactacatggaaactgaacaacctgctcctgaatgactcctgggtacataacgaaatgaaggcagaaataaagatgttctttgaaaccaatgagaacaaagacacaacataccagaatctctgggacacattcaaagcagtgtgtagagggaaatttatagcactaaatgcccacaagagaaagcaggaaagatctaaaactgacaccctaacatcacaattaaaagaactagagaagcaagagcaaacacattcaaaagctagcagaaggcaagaaataactaagatcagagcagaactgaaggaaatagagacacaaaaaacccttcaaaaaatgaatgaatccaggacctggtttttcgaaaagatcaacaaaattgatagactgctagcaagactaataaagaagaaaagagagaagaatcaaatagacgcaataaaaaatgacaaaggggatatcaccaccgatcccacagaaatacaaactaccatcagagaatactataaacacctctacgcaaataaaccagaaaatctaaaagaaatggataaattcctcgacacatacactctcccaagactaaaccaggaagaagttgaatctctgaatagaccaataacaggctctgaaaatgaggcaataattaatagcttaccaaccaaaaaaagtccaggaccagatggatccacagcagaattctatcagaggtacaagaaggagctggtaccattccttctgaaactattccaatcaacagaaaaagagggaatcctccctaactcattttatgaggccagcatcatcttgataccaaagcctggcagagacacaacaaaaaaagagaattgtagaccaatatccttgatgaacattgatgcaaaaatcctcaataaaatactggcaaaccgaatccagcaacacatcaaaaagcttatccaccatgatcaagtgggcttcctccctgggatgcaaggctggttcaacatatgaaaatcaataaacataatccagcatataaacagaaccaaagacaaaaaccacatgattttctcaatagatgtagaaaaggcctttgacaaaattcaacaaccttcatgctaaaaactctcaataaattaggtattgatgggacgtatctcaaaataataagagctatctatgacaaacccacagccaatatcatactgaatggacaaaaactggaagcattccctttgaaaactggcacaagacagggatgccctctctcaccactcctattcaacatagtgttggaagttctggccagggcaatcaggcaggagaaggaaataaagggcattcaattaggaaaagaggaagtcaaattgcccctgtttgcagatgacatgattgtatatctagaaaaccccatcgtctcagcccaaaatctccttcagctgataagcaacttcagcaaagtctcaggatacaaaatcaatgtgcaaaaattacaagcattcttatacaccaataacagacaaacagagagccaaatcatgagtgaactcccattcacaattgcttcaaagagaacaaaatacctaggaatccaacttacaagggatgtgaaggacctcttcaaggagaactacaaaccactgctcaatgaaataaaagaggatacaaacaaatggaagaacattccatgctcataagtaggaagaatcaatatcgtgaaaatggccatactgcccaaggtaatttatagattcaatgccatccccatcaagctaccaatgactttcttcacagaattggaaaaaactaaagtccatatggaaccaaaatagagcccgcattgccaagtcaatcctaagccaaaagaacaaagctggaggcatcacgctacctgacttcaaactatattacaaggctacagtaaccaaaacagcatggtactggtaccaaaacagagatatagaccaatggaacagaacagagccctcagaaataatgctgcatatctacaactatctgatctttgacaaacctgacaaaaacaagcaatggggaaaggattccctatttaataaatggtgctgggaaaactggctagccatatgtagaaagctgaaactagatcccttccttacaccttatacaaaaattaattcaagatggattaaagacttacatgttagacctaaaaccataaaaaccctagaagaaaacctaggcaataccattcaggacataggcatgggcaaggacttcatgtctaaaacaccaaagcaatggcaacagaagccaaaattgacaaatgggatctaattaaactaaagagcttctgcacagcaaaagaaaccaccatcagagtgaacaggcaacctacagaatgggagaaaatttttgcaacctactcatctgacaaagggctaatatccagaatctacaatgaactcaaacaaatttacaaggaaaaaacaaacaaccccatcaaaaagtgggtgaaggatatgaacagacacttctcaaaagaagacatttatgcagcaaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagcaataggaacacttttacactgttggtaggactgtaaactagttcaaccattgtggaagtcagtgtggcgattcctcagggatctagaactagaaataccatttgacccagccatcccattactgggtatatacccaaaggattagaaatcatgctgctataaagacacatgcacacgtatgtttattgtggcactattcccaatagcaaagacttggaaccaacccaaatgcccaacaatgatagactggattaagaaaatgtagcacatatacaccatggaatactatgcagccgtaaaaaatgatgagttcatgtcctttgtagggacatggatgaagctggaaaccatcattctcagcaaactatcgcaaggacaaaaaaccaaacactgcatgttctcactcataggtgggaattgaacaaagagaacacatggacacaggaaggggaacatcacacaccggggactgttgcagggtggggggaggggggagggatagcattaggagatatacctaatgctaaatgacgagttaatgggtgcagcacaccaacatggcacatatatacatatgtaacaaacctgcacattgtgcacatgtaccctaaaacttaaagtataataataataataataaaagatattataatatgcatctttaagtcatcacaatctatctttacatgccattataatatttcagggacagcgtaagtactttataatagtataattcccctttctcctctgtacttttgatgtcttacattttacttctatctatgctataaacctttttcaaaaaaaaaaatggctgggcatggtggctcatgcctgtaatcccagcactttgggaggccaaggcaggtagatcacctgaggtcaggagtttgaggccagcctggccaacatggagaaaccccatctctactaaaaatccaaatattagccaggcgtggtggtacatgcctgtaatcccagctacttgagaggctgaggcaggagaattgcttgaacccaggaggcggaggttgcagtgagctgagattgtgcctttgcgtgctggcctgggtgacagagcaagactccatttcaaaataataataataataataataataataataataataataataatgtcttttttttttgacacagattctcactctgtcacccagtctgaagtgcaatggtgcgatcacagctcactgcagcctcaacctcctgggctcaggtgatcctcccatgtcagcctcccaagtagcctgcactataggcacacacgtcatgctcagctaatttttgtattttttgtagagatggtgtttcttcatgtttccaaggcaagtcttgaactcctggactcaagtgaccctcccaccttagcctctgaaagtgctgggattacaggcatgagccaccgtgcccagcctgctaatagtcttttgaataattcagaactatatataaactacatacagaactatataaaaatatataaaataaactatgtaaaataaagataaaatttaaaaaatatttaccctgatatttacccattctggtgctctttcttcctgaagatccagggttttatgtggtataatttctcttcagcctgaagaacctcttttaccatttctagtagtgcaggtctactaagacacattcctttggattttatatatctgaaaatgtatcttttgcattaatttttgaaagacaattttctggatacagagttctatattctacattctctaagtgtttcagcacttgaaggaagttattccatcatcttctggcctccactgtgcctggtaaaaagtcagctttaatttgtattgttgttcctttgtatacacatgatgtgtcttttgtcctcagatggctttcaagattttatctttggttttcattagcttgattttacattgtctaatgtgttgtgttctttgcatttaacccatttgggatttggtgagatttttggatacgtagattgacatctttaatcaattttggaaaattctcagccatcataccttccaatatttcttttaccttattctctctcttctgcttgtgagatgccaaatatacataagttagtccatctgatattgttgcacagatcttggattctttggggggagggcttccactttttttttcctttgtatctcattttggacactttctattggcctgtcttcaggttcatggattctttcctatggtgaaatcttatctcctgtgaagctgatctaatgggttctttagtttttgtttgttttttgagatggagtctcgctctgtagctcaggctggactgcaatggtgtgatcttggctcactgcaacccctccacctccctggttccagcaatctcctgcctcagcctccccagtagctgggattacaggtgtccaccaccacagctatatatatatatatatatatttttttttttgtagttttagtagagatggggtttcaccatgttggccaggctggtttcgaactcctaacctcaagtgatctgcctgcctcagcctcccaaagtgttaggattacaggcatgagccactgtgcccggcctcttttttgatgtagtatttttcatctcttccaatctatttgattcccctatgtagttttcacttctctattgaaatttatcaactcttaatacatatcatctattcatctgagacatattagcattttaatcataatttttaaaagtctcttctgaaagtcccaatacctgggccagatatctcctttgttgatttccattggctacttactctcttggtcacagtcacatgttcttgcttcttcttaggtctcataacttagaaaaattattatatgctagatattttgcataaaagaatggtagagactgaagtcaatatttatttcctaaaaaggacacaccacttcttatgtcaagccactagatttggaagcaaagtcaatctgacccgtaactgggctgggtctggacttcattgcaactctagttttgattcagttcactactggtttgaaatgttttgtgaatgggatcagaattttcccttctgtggggtccggagtctaagaactgcacaatttcaggatttcttggagttttatagcttagctgtcagcttttcagacgataggagacccatgtgtttcagaccagctgccagcttttcgggttcactttgccctctagtcccatcccattccagctttctgcaccttgatttttttcccttccaaaaggcctggaggagtttctcctggtttttctgccttattccagctctttgcagctgaaggtctgaaataccttagttgatttcttctctcagctctcctaccctgcccccagctttgatgtctgtccctagacactctggaaagacttgtgggcaagttgataaatggatgtgctctggagctggggctctttagaattctaatctgtcacaccaacccacatgttaattaaaagttcagctggtttcttcttccctcatctatggaagattcctcctcatcctctccttccctaggcatgagaaaatccatggttttttcttttctatgaaaagctcatcgctttctggagttctgttcacttagctatatcaccagctctctgagaagttcagaaaactgattttgtagttcattttggtttgattgttagagttacaacgaatgtctcatggttttttccagcttaactagaaattaatccttcttctcatgaattaccaattaaaaaaaaaaaacccaaatccatgtttcagaacatctaatctagtataggatagggtgtgcatacagagaaagatgtaggggaactcttgttgccttgcaagggcaagtggcctgcaaacttggctcctctaccatgtggcagtgtgacccaggaccccaaactataaggtcacgaagggacttttctgcacccattcatggcattccaacagagctcccttccaaagttgttcttggccttccaggcagaagacttctcaaatggcctctgaaagtcagtctagagtacctagagggcacatattctctgcaacacaaatctgctgactcagacgcctagcaaaactctttaatgaagcagacagaaagtgggatttgatttcatttttaatgaagacatacccaaatactgacaaaacaaatagttgcacctgtgctatacggtaaggacagcctaagttatgctcaaaggcttacacaaaaccagggtttatttcttattcatgcaacatgtccattacaggtccactgcagctctgttccatgtcattgctttctgtgattcgggattgtggcccagactacatctgggtcactggtggttgtcatggcagaagaagaagataaaatgggaaccatgtgttggctcttaagttttctatccagcagtgatacacgtcatttccattcacatcactggctgaagcaagccacgtggctaaccctgagtcagtgggatgaggaagtatactcttcatttagggaggggtaataaatattttttaataataatacagtctgtttgtgacctttttgattacaaatatttgcttttctcccccttgtacacacagaatatatttatcccctcaccatgggtgacaatccaaaatttcatcttatcagggcagcaggctggaagtccaggattttgtgatcatccttatatcaggacatgatgtggcccctttgatctggagactaatgaactaagaaggcaagtctgtcaccccataaatgtgctatgcaatggtgggacagggacaggacagccacaataaacactccatttggaaaggggaagaatgtgagacacacagcagtcaccggcccatggcagctctgaatcctgactgggtaggtgttgagggaggtcttctctaggcttgggcaaaggtcctggattaggcccttaatctgctcccttgggagtatcttcctagtccattgttctccatggccttttgctccactttctgggacttccttttccattacctttcttggttacatgtaagagagcagtgaagaatttgctttccttggggaatgagcgtatttcccaggctgtttcctgcctatagaagacctggagcccaagggttgctttaagtttcaggtaatcagtccctttgagcccagatgggtggttctttgggcagtacaactcttacaaatgtgaacagcttcttacctatttgactttagtcagctctatctatgcaccaacagacacacccacagttaatttggagagatgtatcctttgtctagacttcactgcaggtaccttgagtttatcaggagcataggggagagccacaaacttttacccttttttactctctttttgccagagctatgttgcccaactgtaaggattttggggtgtcagcctaattctttctggtgtgttggcagtaggtattgaggccacatctttgatttctgtgttttaattggcctttgttgctcacaggccttttcagatttttcttttactggctggacatgagaatcatcgatatatttaaatgtgcaagactccaactttcaggaatctcattcttcactttcattcctacttgtacataggccaattcttttctgagtttgtctcttacttataataccttgtcacatgtagacatagctcaaagcacgttctagcattctgttggcccatctctgcctaaagccgcaagctcattagggatattatttgccttacaagttatcacaggtgacagttttaccaaatgttataccatttaccaagtgccatccttcatcctccagtaagcatctcctcactgcctgccctggccctgaagccagtgccacacatttcaggattttttaatagcatcttacagtgcagttcctgcagatgccacgataggccaggttatgctaccatgagaagtcactcccaaccctcactgccttacagcaagaatggtttatttctcatcctcactaccttccatcacaggttggtccaccatttacaatgcaagatgatggagcaacctctatcaaaaattttaccagcagttgtaatagagggaaagagatgaagaggaaccacgtgcagactcttaaagtcttgcttaggagtgacatgtcacttttactcatgttccattggcaagtcacatggccaagtctgacccctaccaggtacggaagcaccatcttccctggacagggagccacagacagcaatactgtcttccacacttgcctgtactttttctgtatattccttggaattttctatattgacaatcatgtcattggcaagtagagacagtctcagagaagcactccaaaaccatcttaagcagaagaaaaaatgaacatattctgcagttaaaagttcttctaagtttcagtctgaaaatgctgagttgaatgcacagctgataagaattgttttgtatttgcattttataaaacttttaggaattcacctaatgagccaaagacgtgatggttccttgaagaaggcgccttaatggcatgtcttggaccccgaagtgcataatggctgtgtcttttgcttgtgtgtgtgtgcatgtgtgtgcacacgtgtgtgtgtgaagctgctggagctgcagtaatcagctctgaggtcctgtctgatgtgcattccctgggcaaatcccagctctgtgggtctcagcaccagtctctcaaattgtggctttatagttgatttctttgatttcttcctaactccatttatataagcttaaaggtttttcaaggaaattgttattctttgaaaacgttactaagtatttcagaatataacatcaaattgcctttttgctttttgtgtttcaaacaataaggcatttacatgaaataaacatttttaagagtgtatttgatcttgctgcttttttaccacatgctattctagtcctctgcttggaacataaaaattatttccacagcaactaattatagtataagtcacgaatgttggattactattgctgatggggaattagaagtaaccaccatgcaaatactaaaagcttcttatttttgaagttctcccaagaactaatacaagctaataaaatgcagggaagacatatgctatattcaatgtagatatgaacttttcaagttggctttatgagtgctcagcttgacacaaatctgaagagaattatttcctaatacattacaactttgtcaaaaatcggttaagcatatttgtgtgggtctatttctggtttctcttttctgttccattgatcagaaggtgcctatccttctgtcagcaccacactctcttgattactatatatataaagttttaatatcaggtggggtgattcctcccattttattttcttcaaaactgttttagttattctaagccctgtgccttttcatatacattttagactaagcttgtccatgtctacaaaaaccttgtttgggttttaataggaattgcactataaacctatggaccaattttgggagaattgacattatttgtatgttgagtcttccataccccgaacatggtatttctcttgaattctttgattcctttcatcagcattttatacttttaggcatatagatcttatacatgttttgttaactgaaatttaagtactttattatctatagagtgattttttttttttgagacagagtctcgctctgtcacccaggctggagtgtagtggcgcgatctcagatcactgcaacctccatctcccgggttcaagtgattctcctgtctcagtctctcgaataattgggattacaggcgctcatcactacaaccggctaattttttgtatttttagtagagatggggtttcatcatgttggccatgctggtctcgaactcctgacctcaggtgatccacccaccttggcttcccaaagtgctgggattacaggtgtgagccactgtgcctggccatctttggagtgattattaatgacattgtgtttttaattttgatttctgcatgtccattgtcaatttatataaatgtgaccaatttttgtgagctgattttaggtcttgcaaccttggtgaacttacttattagttctaagagttaaaaaacaattctttttgtctgttccttgggattttgcacatagacaatcatgtcatctgctaagagggacagttttatttcttcctttccaatctatatgtcatttcctttttttatcttgtgcagtggctagaacttcaatatgcaatattaataagttgttcctgatcttagggggaaggcattctttcaccattaaaatatgctattggggctgggtgtggtagctcatgcctgtaatcctagcactctgggaggcggaggcaggtggattgcttgaggtcaggagctcgaggccaggctggccaacatgctgaaaccccatctctactaaaaatacaaaaattagctgggcatggtggcagatgtctgtaatcccagctactccggaggctgaggcaggagaatctcttgaacctgggaagcggaggttgcagtgagccaagattgcgccactacactccagcctgggtgacagagcgagactctgtctcaaaaaaaaaaaaaaaaaaatatatatatatatccagggaagccatctgagcctgagggtttctttttcaggaaattttaagggacaaactcaatttcttaaatagttataggaatatttaggttatctatttcatcttagttagattttggtagtttgtggttttcaagaaattggtgcatttcttctaaattgttgaattgttatagtattccctttttaaccttttgatgtctgcagaatctatggatatatctcctatttcattcctgatattgatgatttacatcatctattttcattttttgtcatccttgttagagtttatcaattttgctgatttttcaaagagctaacttttttttttaccaatttcctctattgttttcctattgtcaatttcattgatttctgctgtttattacttcattccttctgcttgctttgggtttcttttgctcttctttttcaagtttcttgagatagaaacttttgacttgagatctttcctgatttctaatgtaagcatttcgtgctatacttttcccactttacccatatccttttcccagtactttgacaaaaatgctttgctgtaatacttggttagcaacagccagagcagctttgggcccactgaagaaagtaacatgctcgtgatctaatcaccaacacttgccttgaatcgcagagatcctctcacacgttctaaggtaggaaatccaggacacctattccatccaagcactaaggtggcaacaaagctcaaaccaagaggcaaaatagtcttcctgcctgaactaaaaccatcttctaagacttcccatacctctggagagagagcaggggtgttattaaatttattacatactttaaaaattctatattgtcttatatcttaactggaaggaaagcgaaagtgagaaaaaaggacaccttctgggaggagggacacagagaaagggaggcaagtaaaacaccccagggtgcacctgtgttcagaggtagaggaggggcagggacagagagtaaatgatgagcccacaaaaccgtgctcaacatccatccccatcaaggaaatgcaagtcaaagctcaatgagataccacttcacactcaccaggatggctagaatcaaaaagacaggtaatacaaagtattggtgagaatgcagagaaacttgaaccccacacacctgtgggaatgtaaaatggtgcagcatttttggaaaattgtttagcaggtcatggaaaagttaaatatgggtaccactgaactgcacattttaaatgattaagatggtaaattttatgggatgggtattttaccacaatgaaaaaaagttaaacatagaattattttatgacccagcatgtctactcctaggtatacactcaggagaaatttaaatgtatgtctgcacaaaaacttgcacacagaccaggggcggtagctcacacctgtaatcccagcactttgggaggccaaggagggaggattgcttgagcccaggagtttgaggccagcctaggcaacataggaagacagagcctctaccaaaaagaaaaaaaaaaatctagccaggcatgctggcatgtgcctgtggtctcaggtactcaggaggctgaggcaggaggattgcttgagtccagcaagcggttgaggctgcagtgagctgtgagtgggagtgagccactgcattcccactaagggtaacagatcaagatcttatctcagaaaccaaaccaaaccaaaccaaaccaaaccaaacctcagctgggcgtggtggttcacacctgtaatctcagcactttgggaggctgaggcaggtaggttgctttgtaatcaggaatttgagaccagcctggccaacatggcgaaacctcatctctactaagaatacaaaaattaggctgggtgcagtggctcacacctgtaatcccagcactttgggaggccgaggcaggtggatcatttgaggtcaggagttcaagaccagcctggccaacatagtggaaccctctcactactaaaattacaaaaattagctgggtggtagtggcgcatacctgtaatcccagctactcgggaggctgaggcaggaatcgcttgatcctgggagacggaggttgaagtgagccaagattgcaccactgctctccagtctgggcgacagggtgagaccctgtctcaaaaaaaaaaaaaaaaaaaaagaaaaaaaaattcagccaggcatggtggcatgtacctgtggtcccagctacttgggaggtaaggctggagaatcactcaaacctgggaggcagaggttgcagtgagccaagatcgtgcctctgctctccagcctaggggacagagtgtaaccttgtctcaaaaaaaaaccaaaaccgaagccaaaaccaaaaccaaacctgtatacaaatgtgcataatgcattgttcataattgacaaaaagtggaaacaacccaaatgtccatcaaaggacatttgatgaatagataaatacacggattatttgcttatttatattgaaatatatagaatatattattccatataatagagtatttttcagccttaaaaaggaatgaagtactgttagctcctacagcatggataaaccttgaaaatactatgttcagcaaaagaagccagatacaaaaggttccatgttgtacaatttcattaatgtgaagtgtccagaataggtaaatctagagacagaaagtagatgagtggtttccagggccgggaggcggggtgaattgggagtggtggttaatgggcatgagttttctttttggggtgatcgaaatgttctggaattagatagtcgtgattgtaactttattttttgagagacaggttcttgctctgtcgaggcggagtgcagtggtgtaatcatagctcactgcagcctcaacctgggctcaagcaatcctctctccttagcctcccaagcagccaggactacaggataggcgtgtgccacctcatccggctaatttaaaaaaaaattttttttgtagagatgggagtcttgccatgttgcccaggctggtctcaaactcctggcctcaagtgatcctctcctctttgcctccccaaatactgggattatgggcatgcgccactgtgccaggccaattgtaacattaaaaaggtgaattttatggtctgtgaattatatcttgattttaaaagatggtgagagcttaggagaaggatgttttcccaggagcgggggcacagagaccaggagaaagcaccgggacaggcagggcccagggatgctgcacacccacaaagaccctgtggaggctttgacttgtcccttgctgggggtggggtcctcgttgctgttgctggccctggacctcggagccaggcacatcctggaggcgatcattgtcttagatgtgaggagctccaggcttcaaatacaaataaacgcctatgtaggtaaaatgaaagtttgttttaagaagcaagaaagagctggcagtgagaaagtaaagggagtaagtatagatttcttttgtacctaagcaataaatgaggtcttcaaccaggttgaagataggatttctttctagggttatatttagggcaatcctaaagcaggttttttgtcccccagtagaggggaacgaggaaatcaacaaaggatatgttaacaatgctagagtaaaaatggaaaataaaaggaacatggatgaaggctgccatgtaaggctgggctggttgtgcactgcacagctgtaggaggagccaggcacacaggtctagacatgtggcgactcctggagatgtgcactgcagttcttatcctggcaacagagaagctccctcctttgagacaggagccattggagagggggaggagggtatacggagacagtgaggtggggtggaagggagttcaggagcccctgtcttaggccttctactttgtcacttaagtaagagcgggggttctttttggagattaagagagaatagtagttatttgtggaagatcaaaaaagtctggagcaacaagagaagacaggaagtcaagaatattaagggcttctctcagtccacatggcctgaatttctagtggactcagctgccaccaccttgcaacttccgccagcacctggggtggggtaagaggtgagcaagtaaataatggggatcactcagggctggaaaccagagagcagggagaagtcagaggaacacagcttcctaagggggcagctgatgggctgagcggagataacaatgggtctatgtgtgtcccgggatccatcctgcgacctttcctgagtgcccaggaggagctggagctgactgggtctcagtgcttttggagctcagtggggtgcaggcaagactggctaagtgacagacctggacagagatgccaggaggaaggccactggcagagctgtgagtgaggccagcgaggacccagtgcagatatgggcattgagaggtggagagcttggagtcctagagtgggccccgattggggtggaggccactcatgtgaaaggacagggtcacagagggtaaggtgcagggtctaaggaggaggacagaggacaggagagaacgacaagaggatgccctgcatactgggtgggaggcaggactccagtgcccaaaagctggccttggctcctggtgccctggaccccaccatgtgctgtgctcgtcacatcgacccggtacagtgcctcttcctgtgctgggcaaacacttcattattctttgcttttgtcactttccctgctgtcaccataaacacaatttcacagctactccaaagtccaggtgagtgtagagtaacattctcaatcctctgctccccgtatataaaatatttcttcctgaattttgtcattcaagtaagagtcctgtggtggtagcctttttggagagattttctgattcaaacgcaagtttgcgttctatactattcattcatttatttgacaaatcctttgtgagtccccaccctttgtggagcacagtagggacgagggtggatgaggtctcggcccctgggcgctgtcgctgcagcaggatggacagtagagcaatacatgggaatgtgcatcggaccagagaggagcagagaccagagaggagcggagaccagagagaagcggagaccagagaggagtggagaccagagaggagtggagaccagagaggagcggcgccgtgcccagcatcaggggagggtggtcaggggagggccctgaggagacgccgggagggcccacttggatgaggtaggggagggagacacacggacattcggggaaagagcttcctgagccccaggacaggaaaggccagagtgaggcgggtaactggtgagctcaggcctagccagggcagctgaagagggagcaccaggagagtgggtggcaaccaggccagagagcagccagagccctcgcaggtcccccgccttcagcaaagacagaggcggagacagcgcatggggaggggagtgcagggggccggcctagtgaggggctgaaggacagacccctcacccgcttaggactctgctcctctgacttctccgatccccatgatctgcttcctcatctcccacccccaggtgctgggcagcctttctgtgtgacatcgtgagggtgaacaggtggcaggagatgagctgggacggagggtagggaggggtgagggggccatagggaggggtgagggggccgtagggggagcagaagaggcccaaggtgatggggaggtggcacctgcagctgatgagggaggggacagtgactcagacacacggaccttccaacagccagcacacacttccccctccccttcctcaaaggggcactgatgcacccggcccggtgaacacctgtgatgtataagccaaacacaataatccactcctccttttttctggagtataatctctccacctcccttgcagctggtgcagctgcatgacctgctctagaaagtgggtatagctgttgtctgcaccgggctctccaagagcaccttgactttcctgggcagaggagaggggtgagagagagccttgcacccgtctctccatcctgctttggagaccggagcaggtattccaccaggaggaagagaagccaacgtcctgagaatatgatgaaaaaggacgggcctgggacgacactgccaagctgcccaacaaaacccgagcccatctgcctctggaattctctgtgagtgtaagccactcaggcaggatctttcacccgcagctcaagaagcccctggcccacagatgggctggggcgtgagtacgcagcaagcaccttggctctcctcggagggcagtggctcacagccagcaccgcgggctcgctctttccgtggtgctcgcctgcagggcgcgggactcgctggttattttatcatttctattacattctctaggaatggacttcttttttttagtggggaagaaccatcacttccttcacaattaggtaactcatggcatcctagttatctactcttcttttcaaaatgattagctattagccacaaaaaatataatttctgccttatgaaagtagccttggaataattccaggcttttaaactcatgttggccttcctgcagatctgataatattgtgagttcatatatcttaccactgtgaagtcagagtagaaaatacatcatctctttcagattcctggaataacttcagaagttccggatctccagataaatgtgtaagaatgcgcaattcaatctgtgaaaagtctgtgagatacagttctgcattaatttagagtttgccagcaatgttcctcgtgtttgctgcgcaccccggccaccctcagactctcctgactctgtagcctcaaggtccatgtccctgcctcccatctcccagggtcctctgacctcagtgtcaggaggtgagaaatgaaatggggaggattgtgcaaggtgaggaggctcaggagtgagtgagaatgtgtgcgtggaggggagttgtgataaataggatgaccagttatcctatttataggccccatcaacaaagtgacattgagtaaaggcacggaggtggcaaaggagggcaccaagatggtctctggggaagaggaatggcctgggcaagggcctggagtggagctgactcttagctgggaggagtagggtccggcaaggccgcagcgagcagggcagacaaagcacgggggcagggccaaaggtatctgggatttagatacggtgatgtgacgggacactgcaagaaaaacttgttattatgtactgtgccttagaatttatttgaaagaggccagccgcagtggcttatgcctgtaatcccagcactttgggaggccaaggcaggtggatcacctgaggtcaggagttcgagaccagcccaaccaacacagtgaaaccctgtccctactaaaaatacaaaaactagccaggcatggtggcacatgcctgtaaccccagttacttgggaggttgaggcaggagaattgcttgaacccaggaggcagaggttgcagtgagtcaagatcatgccactgcactccagcctgggccacaaaagcgagactcttgtctcaaaaaaaaaaaaaaaaaaaagaatttatttgaaagaatgaattccataagtacctttgaattgttcaatttctaaacctttgaaccctatgaaaatgcataaagcaagctacagcaacgtacctgctgctagaaaggtgtggcctttggatgaaacaaacatggccctcggggagatcgtgagaatcttgtcttctttacctgaattgttatttcaagagcatttagtgaatttggtcatgaactgatgcatagctattcctcaatacaatattatttgaatattattctgaagtccagagttaagattttaaatttttccgaatatttttattaatttaattattttagagatgggggtctcactttgttgcccaggctggagtgcagtggcacaatcatagctcactgcagcctcgcactccagggcttaagcaatactcctgcctcagcttcccaaagcagctgggactacaggtgcacactgccatgaccagctgattttaaaatttcttgtagagacagggtctcactatgttgcccaggctggtctcaaactctcagacttaagcaatcctcctgccttggcctctcaaagtgctaagattacaggtgtgagccatggcgcctggccttattaatgtaatttaaaaataacatattactactgaaagttaactaggttttctgttttttttaattttctgttctgtctagaattcttaatgaagaaaagaaaaagtcaaacgttgacaaccaaatgcattccagtaaaagcaatcttgaaactctctgagcctcactgattgaaggtctatgtgggaaggggcagcaggggatgaagctgctcaggatccctctccttggaccctatttcaggacagtcacatgtattttagaaaggactgctcattggggcggggagcactggctcacacctgtaatcccagcactttgagaggccgagatgggaagatcacttgagcccaggagtttgagaccagcctgggcaacatggtgaaaccctatctctactaaaaatacaaaaaattagctggccgtaatggtgcatgcctgtaatcccagctactagggaggctgaggcaggagaacccaggaggcggaggatgcagtgagctgagatcacaacactgcactccagcctgggcaacagagcgagactctgtctcaaaaaagaaaacagaagaggagaggagaggggaggagaggggaggagaggggaggggaggggaggggaggggagagaagaggacaagacaagactgctcattgggcttcattgttttgccaggaccttcctgcacagcagggcccccagcacaggggcaggagcgccactgccaagggtaggacgtgtacagggcatgggcagcagaactctcatttgctcagatttgaactttttcttttttagaaatgtacccatcagcatcacagcagaatagcttaaaagaaagaagagtgttcatgtgctttttaatgagctcttaaactctttttaagagtgttagtgtgcttttataaacatttccagtaatgttcaaactttaataagcaccagtgctattatatgtttgttttttctttattgggaggctggtgggggagagatggcaggaggaaagctgctttcctgatataattatcatccatttccacttgtaaactgctaacagggaggtaccatatcactttagctgtttttcattctttcaatgtatgtttaaatcctggtcatgcaaatacagagaacttcaggaaggtgaagcagttagttatatagaaaatcaatgacaagtaactttttaaaaaatgttaaaaagggcacactggctcacacctgtaatcccagcactttgggaggccaaggtgggaggatcacttgcgcccaagagtttgagaccagccttgacaatatggcaaagcctcatctccacaaaaaatacacacacatacaaattagccaagtatggtggtgtgtgcctgtaggcccagctacccaggagattgaggtgggagaatcacctgagcccaggaggtcaaggctgcagtgagctgtgatcgcacaaatgcactctagcctgggtgacagagtgacaccctatctcaaaagagagttaccagagactttagcaaggtagtaagaaatgagttacctttaaaattcttaggtgtagtaatctgaattgggtgcttggagataccttggatattctgttaataataagagactagctttagttaaaatatctactcttaatctgtactacttagggtatttaatgtacatcacattttattaaacattaaaacaagtaagccaatgtaacatgcataagcacattaatacttaatacagttgtctaatatcaaaacataattttggtgaatacaccactaaatgtacttagcagatttgagaacaattccttttgactctagcctgtgtgacccttaacataattatgtacagtcattctttttacagcagcccaaattatgaactcagttaacttaaaaattcctacaacatacgctaatggtagatttatgtgaaatttgtatattgtacttttattttagaacacattttaagatgaaaattctggtctctttgatgctggtcattcccctccctcactgctcctggcacttcgtacctgcctctgtcttagcctgtcctaaacttggtggcttgtgctacgtcccctgcaaactcttagggccatctgttaagcaccttcacacttttacaacttgggcaatgtgcaatagttcacatgcttctagcccgtttcaactattcaaatcatgagaatttctgtcacaacatcctttggattcttggcagtaccttggacaataataccctgctttgtctgggaatagaactcactgggcattattagttggtcttgactccctggctaaatctgacgaattgtgccaagcatcaaagtcctgcaatcttacagcaatgctccttagttccccctagaagccctgggaagtggtaaggccacattgtcatcctcatttttttaagatgaggacatgaaggccttggggtattaagtcagtggctctcaagttttctatacattagaatcacatgatacctcaaaaaatacccaatatttacaggataagctcaataatagtgtagagatgacagagaaaacagctattgaatttgaagagagatcaatagaaatgatccaatctaaagaagggaagaacaataaacaaagactcaaggacctgtgggctaatatcaaaatacaatatcaaattgtgttctcttagttcctagagaaaagaaagagaattgtgcagaaaaaagttttcttaaagaaataatggcttcaaattctgaaatttagtgaaagacatactttttccaatttgagaagctgaacaaccctaaatatggtaaattaaaagataaccaggcccagaaacatcataatcaaactgctgaaaaaactgtgatttaaaaacaatcatcttgaaactagccagggtaaaatgacacttttcatgctgaggaacagcaatgtgagtgactgcagatttcctgtcagggaccatgcagaccagaagacaatggagccacaacttccacagactgaaagaactgccagctcagagctctttattctatcctccaggaatgaaggtgagtgaaagacattctcagatgaataaaaattaaagtactctgtcatctgcagacctgctctaaaagaaatgctacaggaaattcttcaggctgaagggaaatgcttccaaagggaaacctggaacttcaggaatgaaagatgagcaacagaaatggtcagtatctgggtaaatataataaatcagcttttttgagttcaatggcttttgtaagccttttgcatcttatttgaagtggtagaatatgaaatataaaaatagcttgtggctgggcacagtggatcccacctgtaatcccagcactttgggaacccaaggcaggaggatcacttgtgcctaggagtttgaggccagcctgatgtaaatttacatggctattataaaaaatggcaaaaaaaaaaaaaaataacatgctgtcaataatgcaaagaaagggggaactctgatatactgttggtgggaaagtaaattagtgcagccactatggaaaacaatatggaggttcctcaaaaaaagaaaaattaaaatgccatatgatccagcaattccactgcaggggatgtatggaaaagaaaggaaatcagtatgacaaataagtatctgcactcccatgtttactgcagccccgttcacaacagtcgagatatggaatcagcctaagtgcccatcaatgggtgaatggataaagaaaatgtggtaaatatacacaatgaaataccattctgctataaaaagaatgacatcctgtcattcgcagcaacatggataagcctggaggccattatgctaagtgaagtaaaccaggtatagacagacaaatactgcatgtttaattccagtatatgtacatagtggtagcagaattgttcacctgtacccctgtggaaaacaactttattaactagagtgcaataattgtgttcagttgcttctgtcttttgtctttaagactccatttgtttcaggtcagcatctcttttctccccctgccccccaacaactttccccagtgaggttgtttcacacaaatttaatataattagatggacatgtcacattctgtctcccatcctgagatcccccgacttcataaatgacttttaaaaatttacatacattatagttcactcttgctgttgtacattctattggttttgacaaatgcatactgtcagctatccaccatcatagtatcatacaaaatagttttaccgccctaaacgatccccggagctttacttatccaacctcatccccaagtgccagctctgaacttttggaaaccactcatctgtttactgtgtctacagttttaccttttccaaaatgtcacataatttggaatcgtgtggtatgtagcctttccagattgatttatttcatttggcaatatgaatttaagattcatccatgcctttttatggctttgtagcttattcctttttatcactgaataatatttctcagtatgaatgtgtcacagtttatttatctattcacttctaaaaagacatcttggttgtttccagtttttggtgattatgaataaagatgccataagcatttgtgtgcaggttcttgtgtggacataagttttcaaattaatttggtggatgcctaggtgtgtaatggctggatcatatggtatttagttttgaaagaaactgccaaactcgaaaagtggctgtaccatttttcattcccaccagcaatgaatgagtgcctgttgctccacaccctcaccaattaataatgtaaggtttttgtttgtttgtttgttttgctttttgatcttagtcgttctaataggtatgtagtgggatctcattattgttttaacctccccacctttttgataccacgacttctcctcatccttcaaatctgcacacaagcagacttcctcctttccttaaggaggaaacctcctctagctccctaattaagcaggctgggggtctgtcacaatgctctgaagagcatccttgacatctctcagttcagaccaagtactgatcacaacgttgaacagctggagacctggatccccctttccaggagcacctcacacatagaaagtatgtaatacgtgcgtgtttactgaatgagtgagacagagaggcattgaaagcatgtcagtaataaaaattgaatacacataacgtacaaattgccaccttcgactaaactccttccttctgcttgtgccttgtgcacgcatccccccaatactgatgatgttccgctacagagaaagcaccacgatatgcagcccagggcagcaatgcaaaatgaactcgcacacaaatctggccttctgggagttattgtctgtcatgacgtgtgtatcacacatacaagtcacataacgcagggttcaaatgaacaaaatgaaagggtgtcacaggagactctccatggtgctctgagggaagaagagagtacttcaggcccctgaggagtgaggctggggaaatcagcctcactcatggcagagttccaagaaatcaggagacaggaagcggccacagaaccacatgtgtttcttctgtaaccaaccttcatgggccttcagcaaggcctctctggaggagatatcagcccgtgccaagcttttcatggccaatgctccccgttggttgtggcactgtgcgccaaccagatctgtgaatgtctgttcatgtgcacgggttcacatttccaaacacatgaaacactgctgcgcttctctatgggcctctgtgatgcaagcagccatcagacagagtgccgtccctaacgcctcatgagcaaacgcatgttcacaggtgtctacgtgagcaattagcacatacagcacgtgaactaccaaagaccgagggtgaccaaagtgactgtggtgggaagcgacaactaacaagagtccgaacatctgggaggaagctgggtcccaccaggtgagagtccaaatgtgggagaagcctgtgggggtcacccagcacactgggggtgtggatgaaagcgtggctatcacacgcccatgagagcatcgaagtcagacatcactctagcaagcggctgccgtcacagaccaacaccacgtgctagcacgcaggggaaccgttcgtggaagaagaatagagaagcgatcactacctgcaggcatcctctactgggaggggctagactccccattactctcctcgggcgaggagctggccacccaggccgagagcaaatggtgatatctgaatgtttctgcaggtgaaagcctcagaaccagcatactcctaatttgttggagtcaatcatgttatttacattacataagctggtcccctcgtgttgaccacccatgaacatttcatctcccaggtccaacgaatgtccagggggcggagaccatgcccatgtgtctcctaagctgagcagagagagcacacagtaacgcaatcatacagcagaatgactagtttaagttccccaaactacggagatggaagcaaactggaataattttcttacaattttaatctcctctagggtatacagttttctgctattactgtggacatcaaaatgtgtggagatcacttctcagctgcctgttaaataagcccagctgaaccccgcagaggaaggcacctgtgctcagccctcatgggttgctctgggcagcccaagtctcccatgagtggttgcaggggaaagtgccagccatgtggatggggcacatcccagcatctgttttcatggtgaacttggtatgtttttgcaaataagagaactgatctaaaaaaattgaatgttaacagcctttatttaacattcagtgaaaggcaaggtgctgagatgacgttttaattctacaatgtggcatttgttaaaatctcagtagctgttagtggaatgctatgcagggaatagtctcagctgtgggtgaaggggttgcgcccaggaggtacatgagcccgttgcttttctccctaggtattgtgtgggcctgggtatcttcatctgtctacctgactgaagctccagatggaaggtgccaaactggggaggtggtggaaataaggaaaaggtgatggcagccctgcttttaatgtgttgactatgtccttgcagcctctggaatgaagccaaaggaaagtgatagtcacagggtcttggccagcctgagggcatgctggctctccttgtcttgagaaagctgtggcagtcgccccacacgtgccaggctgtgtgaggcacctgagaggtgctgtgcagaacagccacacggcactctgccctctggacacagcctcccggggcagggcccacggcgttttcaccgtgtccccagcacctactacacagcccagcacacaggagcaattcacaaatagtggctgaatgagtaagacgaaaaataaataattttcacaataacctagcaaagaaggtgctgcttttatcatttcatggatgagaaaagtgaggtttccataagttaagtaacttgctagagtaacacatctattgactgagctgagatttgaactcagttctgccctaagccaaggttctgttgcctccagggtccgccagacaatgccagcggtctcttgaaataatttttcttgattaaaagaaaatccaagtgaaaaccacaacaaaaacacagaaaagggcagctggcacagagctcagagtgagggccacagcagcacacctgctatggcacctgagccaggctgatgccactgcacttgacctaagcagctcgtggagcctgacctgcagcctgaagggcagtgtggccctgacaccatgtggggtctggaaccctgtgagtggcttggatgggcagccccctctgcctgctcctcctgatacactcccgtggcccccctcacccactaaagcttctgctcagctgccccctccccaacctcttgaacactgctttcccgaggctggcaatcgtccccccactacatacgttccatacattcacatttcactctcctctgtatcgtttctcattccacatgcgtattggctgtctcatgccctctatctccaagactccatagagcagaggtgtttcttcggtcggggggcgggtcggtgggggaacagagtcttactctgtaacccaggctggagtgcagtggtgtgatcttggctcactgcaacctcctcctcctgggttcaaatgattctcctgcctcagcctcccgagtagctgggattataggtgtacgccaccacgcccagctaattcttgtatttttggtacagacaaggtttcatcatgttggccaggttggtctccaactcctgaccttgtgatccgcccacctcagcctcccaaagtgctgggattataggcatgagccactgtgcccagccaggatagagttttgacccatacagtgcaagcaccctgaacatcctggcacacaggtgttcagaaaacatctgttgaatgaatgatgatgaatggagagtgacaggaaatggggttggagaagcaggtggggtcagaccacccaaagccctaagagctaggtgaggagaccagacattagttaccccaagagctctgggagccactggagactttagggattggagctgtggagctgggcttgcatttctgactctcccggctggagggatgagagcaggaaggtgggtggggagctggaaggctggcaccaagatgtgcaggcaacaagggtggggacagctataccaggaggcccaaaggctttggtgcccagcccggacccctgggctccagcctgtgtgaccagttgagctgaggaatcgccacccccacagggtagctcagaggagaagccaaagatctggcttaaaaatggtgaaatcagccaggcacggtggctcatacctgtaatcccagcactttgagaggttgaggtgggcggatcatttgaggtcagcagttcgagaccagcctggccaataagatgaaagctggtctctagtaaaaatacaaaaattagccaggtgtggtggtgcatgtctgtaatcccagctactcgggaggctgagctactctgaacccgggaggcagaggttacagtgagccaagaatgtgccactgcactccagcctgggcaacagagtgagactctgtctcaaaaaaaaagaaaagaaaagaaaagaaaaaggtgaaatcactgtgccttttttttttttcctgatattcctgaaggaaagctgaatgaagagggttgagactggtgagcatgtgcgcaggcatggaagctgccgggaaaggagatgctcatgcagtggactccgaggagcaaggatgagcacccttgaccacaacaaatgggcagagggagaggagcccctcctctgggaaggggacaagccgcagggtcagaggggaagggcagagccacactgggtcaccagcagggcagagtggggagagggaggagccacggaaacgggccaggcccccagggggaagcgtgagcctctgccaagcagggctggccggagcttggggcccgcagctcccctggggtcagcaaggctgtggtcactgtgctgggcagcgtgactcaaagggaggccaggctcctccacctgccagcctttggccctgataatccattttaaactgcaggtcccagttccttagtgggtcacaaacagcactttcaaaggtgaactgaatagaagagaaaatagcaatgtgcgctgcacacagtggaacctgctctgcatatgtccctgtcaagaggcaatgcacagaaagtaccagaacgctcctcttcccactgtgaggtgatgcatggaatgaggggatggctcagtttactctagatagaaataggaaaatattaaatcactcaaaataataaagtataaagattttaaaagttcatttgggtttcaaatagtgcagatttagcagtaattatgtggtatatgaacaccttgctaataaatcttttgatagatatttaaattatatgggaggaatattcatcaggaaagcagaaaaataacatggcaacaacgtaaaggccttgattagaattacttcagaatagcacttatatcatttatgtgggtcctaatgaaaacagagcctaaagactacatcaggaaagaaaggcagagctctccatctgggggtgcaagtcagtgccctgaagaaaattttataagactctccaggaaataacaacttacgagtggctggggttctggaaaacagaatagaacacttcctattagaactcaaaaggtaagtaataaatagctctttcaccttttgttgggtacattcaaagggattatttatttatttatttatttttttgagacagagtctcactctgtcgcccagactacagtgcagtggcacaatcttggctcactacaacctctgcctgccagttcaagtgattgtcctgcctcggtctcctgagtagctgggattacaggcgtgcgccaccacacctggctaatttttctctttttagtagagacgggggtttcaccttgttggtcaggctggtctcgaactcctgaacttatgatccacccgcctcagcctcccaaagtgctgggattacaggtgtgagccaccgtgcctggccaggatttgttaaattgatgcatggaataggtttaaaatttgtaactcttatttctgctgactgtaggaataaaataatttgccacttgggctggacgcagtggctcatgcctgtaattccagcactttgggagaccaaggtgaatggatcacttgaggccaggagttcaagaccagcctggccaccatggcagagccccatctctactaaaaatacaaaaattagccaggtatggtggttgtacatctgtaatcccagctactcaggaggctgaggcatgagcattgcttgaatcagggaggtggaggttgcagtgggccaagatgacgccactgcactccagcctggatgacagagtgagattctgtctcggggaaaaaaaaaaattgccacttgtggaggacacagctatttggggccacacaatactttcttttccattttgtttagaaaatggcactcggatcttcatgacggtgcccaccacccccctcctttaagccaaccagcagacttcatcgtcaggccgtggagacacagggagacacttgccaaggcatctgtgagacgcacttcttcatccttctgtgaagctgcatgaggcgctctgcatccccactggagagaaacccagcaagcaccgcccaggcctgctgggacccgtggggaggctatgcaagaaagaggctgaggaaagggcagagagaagctgggtgtgcccatataatgtaggctgccagatcagaccttgcctgaagctagcccttcttcggccttctaggtcaggtaagctgagacatacccttaattgtttaggtcagctgagtttggttttgtgtgatctgcaactgaaagtctgcctgaacacatggattgtggtattttaacctccagtttagacatgtggggaaagcacttggtcagtgtggcattcacagctggtggattcagagcccagctgctctcccctctctgtccttctccttccactcacacttctgcttcccaaggtggtgtctggggtggtggatgatgctgggagcctacataccccccggcacctgaagagagggtcctgtgtccccagctgtggccaccctgtccttgtgggcctcggctgcccatgtccttgccctgtctgctctgttggtgaagtgttcatgaaggactgcggtgcgttctgtgctctcagcacggccagcatctggcatatgtcctctgccaactgggccctggtgctggctctggcgacactgttacctcctgaagctcaatggcaccctccctgtgcacctggcttttggctgtccatctcacagctctcctccatgaaccagtgagaacccagaaaacatgggcagccttggtttccataccaggggagtgcaggaccccaggaccacaggagcttccagccccctctcaggctccttggagagctcggccccctcggcatggcactcctggagactgcgacccagcctgtggggcgctggcattcccctcctctggctttccacccacgctctgagtttctaacccagaggggccagaggaagtcagagcctttcaaagactctttcaaagtgtgctcagctcttggttctgctctcatgctctccccctcagcacctcttccaagccaaggaggtaccctctccctcctgtgaagtgggtctcttgcatcctctctactcaatggcttcctttataatgttaaactctaaaaatacaaggctttgagtcttgatatttaaaaggaagcttctgaaattcaaaaattaacaaaacaaaacactttttgatctctcatgccgatacttttcttgtttctgctgtgccctttcacaagttctagttgaaagccagagctgaacactgattcctttattctcagctgtaactccctctccctctgaagtaatagaggcctcagccctactgggcaggcagtctctaagtagcaagaggtgctgggaacaaaatatgcactggagggtttctcaaaactacccctgtgctatcaagtattttgttcgattaaagctgccaataaggagacttctgcttccaggaaggttgtgtaaacacgttccctatccctgtcccaagatacaactaaaaccctgggcaagtgtaagagactcggaaaggtggagaaaatacggcagactggctagggaccgtgggacccaaagaatctcacagaggtgagtcccaggtttctttttgcctaatgtgtcccagacaagccagtagcctggaaatgccaataaccacagacaaaaacaacaacaaaacaaaacaaaaaaacaaaacctaacaaaagcctgctctcattagccaaaggaccaggaaaaggacagcctagcgagaaagaaaacctttagacaataactatactactccagccaaacaccacacaaaaacccgtgattgtggtttttttttaatcccccacccccacctccgccatccttgatacccagccaagatttttttggtaattttccatctactgaaccctcaccccctctgttggttataaatctccagctgccagtgtggtatttggagttgagttcaatctctctcccctgttgctataatcttaaataaactctcccttacacgtttaactctgatgcaatttttttttggacaaactataacatgtcaaaatgtatgggttaaagatagagcagtgctgagaggaaaatttatagcactaaaaatgcatacatgagaaaaaagaaaaagtctcaaagcaataatctaggcttatacctaaaaagcctagaaaaagaaaagcaaaataaacccaaatcaagcagaaaaaggaaataatatggaaatcgataaattgaaaatagaaaaatagtagagaaaatcaatgaaaagatcaataaaattgacaaaactctcagtagattgacaaagaaaaaacagagaagacacaaattatgaatatcagaaatgaaaccaggaatatcactacagaccctaagacatcaaaaggataaggaaatgttatgaaaaatcacacgcacgtaaatttcacaacttagacaaaatggaccaattcttcaaaaagcaaaaacaactgaaattcaccaaatatgaaagagataatgtgagcaactgtataactattaaggaacttgaactcataattttaaaactccccaaaaataaatatctaggcctagatgatttcattagaggattctatcaaatatttaaaggagaattaacaccaattccacgatatctcccaaaaagcacaagaggaaggaacacttcccaattcattttatgaaactagtagtaccctgaaacaaaaaccagatgaagacagattaatatccctcataaacatacacacaaaatcctttaataaatattagcatatagaattcagtaatatatttaaaaatatatgatccaacagttgacttgtgcacacttatcccagaaaaataaagacaagtacacacaaaaacctgtatatgaatgtctttggcaaccttatcttaataacccaaaactggaaacaacccagatgtccttcaaaactgaagtgcaacttatacccagcaacttcaggtggtaatacattgcccatgggaacttaatatattgtcttcaaaatatcatatattttaaatatatgatttaaatatatgattttgaacaaccaataactttccttaaagttgtaaaaagggtcttctataaaatacatattcactgttaaaaatttgttctttttttttttttttttttgagatggagtctcactctatcacccagactggagtgcagtggcgtgaactcggctcaccacaacctccacctcctgggttcaaatgattctcctgcctcagcctcccacgtagctgggactacaggcacgtgccaccatgcccagctaatttttgtatttttagtagagatggggtttcactgtgttggccaggctggtcttgaactcctgaccttgtgatctgcctgcctcagcctccccaagtgccgggattacaggtgtgagccaccgcccctggtcctaaaaatattcttaagaagactcttttcttaactagaagaattcattcattgtattcatcaaaatcctgccacgtgccagctattatgaaaaatgctagttcttcaaacacataacctacaaataattaatatttaaataatatatacactactggaggaaattccgttacctagtgaatataggctgtaagaatgaatgctacatatttttccttaaaaattgctcccccacaccccaataatccgttagctgtatttagcactcgataactaagatgtaagtccctggttttactctttccttcaataacatttagcgattacctatcaactggtagacactgtgcttgtttcttggaataaaatattgaaaaaattcaaggagcctacagtagagggaaggcaatccctagcaacggaacgatgaccacgttaggtagtcgacactctgggaatacacatctgtaatgaaactattggaagttaaaagagtggtaagaatatggaaatagaccaaaggcacagaattgagagcctagaaacagacctatgcatttgtcaaaattcacaaatgacagaggcattacaaattactgtagttcttacaataacaatagctataacaaacagttacccaaatggaaaaataatcagatcgctaccttagacctaaataaaaacaaattccaagggaattaaagactcaatgtaaaaagtaactttattaagagagaatttgctatcatagaacacattataggcgaaaaaaaaagagaatttgaggatctttatgatctccaagtaagatagggttccttaaatgagacacagagaggtacaaaccttaaaggaaaagaccacaaatttgacaatattttttaaaaatctgtaaatcaaagacatagaatccaatctgagaaaaacaaaccaaccacagactgggagaagataattatataagggcacaaaagactagtattcataatacataaagaacttttacaaattaataagaaaaagacaaaccactaaactgaaaatgggcaaaagaaataaacaagtgagtcattgaaaaaattcaaatgacaaataaacataaaaatacactgaccctcattactaataaaagtaatgtgaattaagtcacaataagatactaatccacactcatcaaattggcaaaaacttaaaaatctggtaataccaagtgcggtggtctgtagggcgatgaggtctctatcacactgcaggtgagaacatgagtcagtccactcatttggagggtgtttagtgatgtcaggagagttgaataccagcatgccctatcgtcaggcaatactggtgaggtgctagagaaaccctcgcacatgttcataaatactcttcccagcatttactttttttcttgcagcattgtttttaatagtgaaatattggaaacaacctagtatatctgtacaatgacatactatatagcagccaagatgaataatttagagctacgtctgtcaacacagataaatctcaaaaacataatgttgaatgaaaacagcaaatttataagtacaatatgctataatttatataaactttaaaatagcaaaaaaaagacaatctatcatttaaggaaatatatatatttaagaaaatataaataaataaataaatgcacgcattaaaatgggatgataaagactaaatgtagaatagaaaagggagctgaattgggaagaacacacttgggaaaggattaacaggggctttaaatgttgtcaagtaggccaggcgtggtggctcacacctgtaatcccagcactttgggcggccgaggcaggcggatcacctgaggtcaggagttccagaccagcctggctaacatgacgaaactccgtttctactaaaaatacaaaaaaattagccaggcgtggtggcacgcacctgtaatcccagctacttgggaggctgaggcagaattgcttgaacccaggaggcggaggttgcagtgagccaagattgcgccattgcactccacttgggcaacaagagcaaaactccatctcaacaacaacaacaaaagcactcaagtaatgttgaagcttttaagctgaatgatgaatacacacatgatcactgtattgggctctatagcttgttactaggaaaaggggtatctcactgagctctggtgtggggaggggcaggcagataggggcagggggctgaacaaggcttttgaggacatgtcccctgcactgaaatcagaagaactaacgggcagcagccaggccaagaaagctgggcttaaagatatgttcatggatctaggggcagaaaaagtatctcgacagaggtaacaacagcaatggcttgaaggcaggcgaaagcatgaggaatcaaggaaacaaattatatcaaagtattaccaccataggacaaaatgttaatttggctccatcccagctagatactaaaaagctagtacaaacatgctaatgcaacagtgagcatatatttaggaaaataaaaaaactaaggaggagaaagactcaccaaccaagaaaccaaagcaaatatccagctaaataatccctagattttaacatttccaattaatatagctataacatttttaaaaattaaatactacgctgcaagaaaaatgagaactcaagatactaaagaattcataagaatacaatgtgaaagatcagatattttgaattacataatgttgataaattctgagccagtatcatgagtggcactgtagtgaaatgaggacattgacaaaaactggctctgctgatgcagaaacattaggagagacctcaaagccacgtgtgataaggaggtattagatttaagaatgtggctcctggcagtgcaatgagaaaaaaggtcctcaacaccttcccatgaggaggccttcgtaaaaaatgacagttctaagaggggctttcaaaacaaggattgacaagatgatccctaaagtatctgagttggggaaagaggaggatttagaaaaacaagactccatgaccaatccatgcccagggtgaagagggtgacagtccagcatggagaacagattggcccacactgtcaacaggccataatactgatcatgaccccaaaccaaatgattttgagacactgaaagacaattcaagagtagatcagacatccagtttttcttttcttttttttttttttttgagacaaagtttcactcttgttgcccaggctggaacacaatggcgtgatcttggctcaccgcaacctctgcctcccaggtttaagcgattctcctgcctcagcctcccgagtagctgggactacaggtgcacaccaccatgcccagctaatttttgaatttttagtagaagtgtggtttctccatgttggtcaggctggtctcgatctcctgacctcaggtgatctgcctacctcagcctcccaaagtgctgggattacaggcatgagccaccgtgcccagcccggtttttcattcaatacacacttggtgcctactgcattccaggtacagagccaggcttggggaaatgtcagtgaagcacacagaaaaggctcccattctcatggaatttacagtccagtgaggtgaacagaagtgcaggatgttataatacagtataacgagcactatgctagaggaagtatagggaatatctaggaggacacagactgaggttctaataaagcaaatattgaactagagcaatcagtgaactagacaatatagtaatagaaactattcaaattgaaacagaagaaaatccaaggaaaagaataaaagtgagtctcagtgagctatggacaaattcagtgagctatgggacaaattgacctaatatatgtaattataagtggagtccctgatggagaggagagaaaaggaggcccataaaaagtatgtgaataggccggctacggtggctcatgcctgtaatcccagcactttgggaggccgacgcgggtagattacaaggtcaggaatttgagaccagcctgaccaacatggtgaaaccctgtctctattaaaaatacaaaaattagctgggcatggtggcatgcgcctgtaatcccagctactcaggaggctgaggcaggagaattgcttgaacccaggaggcggaggttgcagtgagccgagattgcaccacggcactccagcctgggcgacagagcgagactctgtcccccccccaaaaaaaaaaagtatgtgaataaataatcaccaataaattttcaggtttgatgaaaaccataaaccaaagatccaagaaactcaatgaatcctaaatacaagaaacatgatactatatcataatcaaatttttcaaaaatggtgataaggtaaaagcagtaaagaaaaaagacacattatgtgaagatagtgatgaaagacttcctatcaaacaatgtgagaagaaagtaacatcttcaaagtattgagaaaaaaaaccttttaactgagaattttatacctcgcaaaaataactttcaaaaaccaaaggtgagggctgggcacagtgacctgtcactgtggttacaggctggatgtgggtatgtaatcccagaactttgggaggctgaaacaggcagatggcttgagcttaggagttcaagactagcctgggcaacatggtgaaaccccatctctacaaaaaatacaaaaattagctgagcgcagtggtatgcgcctgtagtcccagctacttgggaggctgaggcaggagaattgcttgcgcctgggaggcagaagttgccatgagctgagatcgcaccattgcactccagcctgggcgacaggagtgaaaccctatctcaaaaacaaacaaacaaacaaacaaacaaacaacaaaaacccaaaacaaaaaacaaaaccaaagatgaaataaagacatttccagatctacaaaagccaggggaattcatcaatggcagacctacaatgcaggaaatgttaaaggatgtcctttaggcagaaggaaaatgatgccaaaaagaaacctggttgtaaacagggaaatgagggcattggaaacagtaactacatgggtagataggatttttcttattattggaatctatgttgcccagactgatcttgaactcctggcctaaacgatataggatagcaagacccatctctaaaaaaaattaagaagttagccaggcacagtggcatacatctgtggtcctagctactctgaaggatgaggcagaaggatcacttgagcccgggagttggaggctgcagtgagctatgattacatcactgtactctagcctgggcaacagagtgagacctgtgtctaaaaagagagagagagggccgggcgcgttgactcacacctgtaatcctagcactttgggaggccaaggagggcggatcacgaggtcaggattttgagaccagcctggccaacatagtgaaaccccgtctctactaaaaataccaaaaattagctgggtgtggtggtgggctcctgtaatcccagctactcgggaagctgaggcaggagaatcgcttgaacccgggaggcagaggttacagtgggccaagatcacgccactgcactccagcctgggcaacagtgtgagactccatctcaaaaacaaaaacaaaaacaaaaaacaaaaaacaaaacaaaacaaaaagaagtgggagagagacacatacacacacacacaaatagtttaaaagtaaaagaatagaaaataccatgctaatattcaaagaaaactggagtggttatttaacattaatattaaattatatttttattaattgtattatttccaaaattattctaacattttattagctaatattaaattaatattttaatattagacaaaatagatttcaaagcagagaacaataccagggataaaaaaggttattttatcaaaataaagtggccaattctccccagattgagttctcgattcaaggtaatcccaatgaaaatctcagcaggcttttttgtaaaaattgacaaactgctgattataaagttcatatggaaatgcaaaagaccaaagacccaaaataacctttttttttcttttttaaaaaaacaatgttggaggacttacatgccccaatttaaaaccttactcgaaagctacaataataaagacaacgcactgctggcaatggtaagtatatagatcaactagactgagttcagagtacagtattaaacccttatattgatagtaaatgtattttagacaaaggcgccaaggtaattaaatgggaggaaagatggtcttttcaagaaacggtactgggacaactggatgtccacttgtaagaaagatgatgttaaacactcactttacaccatatacaacagtcatagctctaaatgtaaagcccaaaactataatacgtctagaaaaaaatgtagaaaaaatacttgtgattttggtttacacaaaggtttcttagatacaatatcaaagcatgatccatgtaagaactcattgataaatcagaattcattaaaacttaaaacttctgctcttcaaaagatggtgtcaaaagaagacaagccacagattggaagaaaatatctgccaagaatatacctgctaaaggacttgtatctagaatatatacagaactctcaaaacttaatgataagaaaataagcagtccctttaaaatacgcagaaggtatgactaggtgcttcactgaaaaagaaaaatgactggcaaattaacacatggaaggactctcagcagtagtgatcagggtaatgcaatgaaaactgcaatgagacaccacaagacatctagcagaatggctcaaattagaaagaccggccagatcaaatgctgctaggagtgtaaaagaagtagaattcatacactgctggtaggaatgtcaaatggtagaaccactctggaaaaacagtttggcagttgcttaaaaagtgaaatctacacctactgtatgactagctacttgactctttggtatttaaccaagagaaaaaaaagtatctatccatgtaaggacgtgcagtcaatgtgtgtagttaatatcccaaactgaataatatccccaaactggaaatgacccaaatattgatcaacaggtgaactcataaacaaagtggggtacacacagtccatggaacactactgagcagtaaaaagaaatgagctactgaaacacagagcaacgtagctgaagctcatagtaacaacgctgtgaaaggagcccgacaggaggagtccatgctgtgtggctccattcacagaggtttccagaaactgcaaacgaatcgatagtggcaaacagcaagtcagtggtggccaaggacatgggtaaaagatgaggagtggggagggagatattacaaagagacacaaggatacttttgcacaactggtagcaatgactcttttttccttctttttttatttccatataaaggaccagaagcaataactttctcttaggagggggtgtgtgtgagaaaattagctttctgaaaatactgagaaccagctataacctaaacctaattttcttttttctttctttcttctttttttttttttgaggtgggatctcactctgtcaccaggctagagtgcagtggtatcatctcagctcactgtgacctcctcctctcgggctcaagcaatcctcccacttcagcctcttgagtagctgggaccataggcgtgcaccaccatgcccacctaatctaattttctgtattttgggtagagatgaggtttcaccatgttgtccagcctggtctcgaactcctgagctcaagagatctgcccacctcagcctcccaaagtgctaggattacagacatgagccattgcacctggcctgatttttttttttttttttaggagacaaggtcttgctctgtcacctagggtgaagtgctgtgatgcgatcacaactcactgcagcctcaaactcctgggctcaagtgatcctcctgcctcagcctcccaattagctaccatgctcagctaatttaaagcatcttaaaatttatgtagagatggggtcttgctatgctgcccaggctaataatctgatttttaaaaatattagtcaactgtattttgtgcactttaagcaaaaaaaaaaaagtaactgaaattctagccattttatggcattatcatgtaacctacatagtattttcttaaatagtgtgcagctggattcaagttttatgtgtaaaaaaatggaagcacaaatgttctatcagaaaacagaggtgagtatttaaataatcttggagctgaggacagcctgtctaagatgacactaagacagaaacaatgagggatgtcagtacaggggaaagtcaccatagagagtggagaaagctctgccacacattgctcagggcagagacaggctgaaagcattttggaaggcaatctaataaaagctattaaaagtaaaaatgtaatatcctctgtacccagtacagtaattactcagtaatttcatacctgaaaatctgtcccacaaaaatacaagtaccaatacaacaggacatacgtgcatggtgttcattgcagctttacttttagagggcaactgtacaacacacccacatgtggaacacaaatagctagagtgggacaggcctctgtcaggtgagctgcagggatctccacaagctgttgctgagagcaaaaagcaagaggcaggaaaggaaaattctaaatctgtaaaataaataatgacaaagtacatgtctctatgtgtatatgtacagatatatatgggcctatatgagattgcataataagtcagaaagaaaatatggatatacaagctctaggctgcaatcatgggctaccaagagcactgggattgagggtggagggctgaggtatgtaggtgtgagagaagtgtctacaataaaaacaacatatataatgtgatcccacttatgtaaatgtgtgtgtgcataaagaagtaaattagaggatggttaccaaaatgttaaagatggctattgcggggatatggagttttgagtgactttttactttgttacttacatttttatctattgtttgaattctttagaaatatcatgttatttgtataatttttttttttttgagatggagtctcgctctgtcacccaggctggagtgcagtggcgccatctcagctcactgcaagctctgctcccagcttcacaccattctcctgcctcagcctcccaagtagctgggaccacaggcgcccactaccacgcccggctaattttttttgcatgtttagcagagacggggtttcactgtgtaagccagaatgttctcgatctcctgaccttgtgatccacccacctcagcctcccagagtgctgggattacaggtgtgagccactgcacccggctgttatttgtataattttaaaaagccattttaaggccaggcgcggtggctcatacctgcaatcccagcactttgggaggccgaggcgggcggatcacaaggtcaggagattgagaccatcctggctaacatggtgaaaccctatctctactaagaatacaaaaaaattagccgggcgtggtggcgggtgcctgtagtcctagctactcgggaggctgaggcaggagaatggcatgaaccagtgaggcagagcttgcagtgagctgagatcacgccactgcactccagcctgggcgacagcgagactccatctcaacaaaaaaaaaaaaaaaaaaaaaaaaaagacattttaagtatggcaaaccagaatatatatcttaaaagttaaaaggcaaaagaaaattggaggaaaataattcaacatttcataaagggttaatttttattatataaagagcttttccataccaataggaaaaaataaacaccctccagagaaatgggcaaatgacatgaacaggcaattcaaagaagaataattgtttcatgtagtcaacctcaacaaatatttaaagaaatggaaattgaaaaaatgagtcaggaaagtaatcaaaacgaaaattccttgtgttggcaaggattaagggaccaagcatttcacatactatgtggtgggaatgttatttttggcgagaggctaatttggcaacataaagccttaaaaatacatatatactgtgactcagaaattctatctctaggaaattgcactatagaaatcaacagaaaaaagtaccaaaaatgttcatggtattggttatggtattgctattgaagtttgtatggtattgctatgataaagtacaggtatgtttatggtatttctataaaataattaaaactgcaaacaatctaaatgaccatcaataggggcagccattaaatggaatacaatgcagctgttaaaaagatgacacaaacttccagttaaaggtcatggctgaatgcacatgttatgtttacatctcatctttccaaaagttcaactgaaataacagaaaaataaataggtaaaattagagcttcactgagaacctgggaggagtgctactcacaaaccagacccttcagaaacttctggaagagaataaaacacagcaagagatttactgaaaatgtaatggaaaaagaaacttataactgcataaaaacaaaagcaaggacctccacgaaaagtttctcagcagaattcctaaataactcttagataagaagtatcaactaagagaaactacagcagttgtggttggttgagaaattagcccaagggtaacgtggcagcagtgcctgcattcagaggagatggcactggtattcacatggatattggtgctggtattggtattcacattactattgctattactaccactcttcgctagataaagaccccagaagagctccctaaagtgcaaggccagagacagctggcagcccgagagctgactgaccaagagtgggtgtccatgcacccaagaggccacacgattagcgcaaactcaccccatcccagcctctcttcctcttcctcacacagtcacctgagtgtgtccctctgcctgcatgcactcggtacaccatctatgcaaatgcctgggtgaaggcctgacccttaatggagggaacccacgggacagacacatgttacggagggaagggaaagatgactaacatttgctcattctgtaaacctccacatacttgtatttctttaccatgaatacatattcatatttatatatatatgttagtgtgtacttaaataattcacatatttaattcatatatttaaatttaaatatagattcaaatcaatattaatgtagaatgatatcaagagatgttaaaataagaaagcataatataaaatagcatggctttatttttgtagaaaaaaattgtattttttttttgacagagtctcgctctgtcacccaggctggagtgcagtggcgttatctcggctcactgcaagctccgcctcctgggttcacaccattttcctgcctcagcctccctagtacctgagactacaggcacccgccaccacgcccagctaatttttgtgtttttagtagagacggggtttcaccatattggccaggctggtcttgaactcctgacctcatgatccaccgcctcggcctcccaaagtgctgggattacaggcatgagccaccgcgcctggcctaaaaaattgtattttataaatatatgtgcttagcaaaaagtgtggaaagatagataccacagttctgcacagtggataacaagtgacttattactatttttatttcttttctgtatctaaggaattttctataatgagaaattaatcatgagtcttttttagttcaaaatacagagccatttagaaagttaagtgctttaagtgtgatgcaagctgcatcataagttcaagggaatttagagctttttttttttttttcttcatcagagatacagcttcaacaaccaccaaaaaatggagctgttcatcatagcatcagatacttcaacacatttctggaaatcagaagccacctgtctggcacaaatctgaaaaggaagatggggtacgggtgtcctttttgcctgcacactggagtgcatgggtttctgggtgtgaagcccccctcttgctaactcagcacttcatgagaagagaacccatctgtcttgttctcctgctatgttctcagaataaacagaataaaacacaacatatcagtatgaagtcccctcttggaaacagaaagtgcacaggcaaacacatatggagaaaaaacttcaatagcaaggcaggaaaatggcgtttaacaaagacagttgtttaaacaacttacaggatgcttggctgaaagtcttccagtcacagttccagtctgattccatgtagaggaaatggagccctttattagttaaaaagaatcagtgtaaactccagcaatgctatgtgaagttaagaatgtggcggagcctccactcacaacatgcaacactcgctgctcctccagaggccaacaagctgctggccctaaacttccaaccctgaaatgtccttggggttacaaaactcctgacacgtgatcagggaaggctgaagaaggaggtttccccctaacccatgtaggaactgccataagactttatgtcacttacaaatcccatgcatggggagaggaagggctgttgggctgtggggagcttggtgcgggctcgaggtgggactgtgcgtcacagacaggttctgtcacttgctgtgtgaacttgaacgagtcacagaacatctcttgactgcagtctcctcaagtctgaactaaaacagtaacatcttcctcaaatgagtccagaacagagatgcaatcgtggatgtgaaagcaggtcagctagagcttcctcataaacagagggtttcaaggcataacatcaacctatgctgccaggggacctaaatgatgccaatatcatggctcatagtttcaagaatattagattatttcggctgggtgaggtagctcacgcctgtaatcccaacactttgggaggccgaggcaggcagatcacgacgtaagagtttgagaccagcctggccaacatagtgaaaccctgtctactaaaaatagcaaaaattagctgggcgtggtggcggacacctgtaatcccagctacttgggaggctgaggcatgagaattgcttggagccgggaggcagaggttgcagtgagctgagatcctgacactgcactccagcccgggcgacagtgcaagactctgtctcaaaaaaaaaaaaaaaaaaaaaaaagaatatttagacgatttcatcatttactaaaattacaaaggttctatatgtatctgaactcatacaaaaaccacagtcctaatcacagtatctttttgtaaagcttgttacctttttcatgcaagctagtaatccatctacaaaggttgacttgatcttgtgaacctaaggtggaaagacaagaataatcattttctttaagtcttaagtctttttttgtggggggaaggagtctcgctccattgcccaggctggagtgcagtggcgtgatctcggcttgccgcaacttctgcctcctggggtcaagtgattctcttgcctcagtctcctgagtagctgggattacaggcatgcgccaccatgctcggctaagttttatatttttagtagagatggggtttcgccatgttggccaggctggtctcgaacctctgacctcaggtgatccgcccacctcagcctcccacagtgctgggattacaggtgtgagccaccatgcccggcctaagtctttaaacaggaatagtgtgaatagtgtttcacagagtgccgggcacgtgctgctactatcaccttagatgactccgagaggccctggaatgaccttaggtggtaccaggattaaataacactgacccacagagaaagatgtcattccactctttaaaaatagatctattaattctagaatcattctagatttacaggaaatttgcaaagataaacagataaacaaataccctgacacagtgtctcctctggtggcccctttacatcgttgcagggagaaagggccaggctggagccaatgtgctccctcacagctgccaggccctcaggatacagcaggccacaggctcagtgaatactaggacctatgctgtgggcagtggcaaaagctataaacgtggttcacaaccaaaagagaactttggaaggaaatggcaggtgtgtgaacagagaaagggaatcaccaggggagggaagggggccactcatgaaatccctggcaaatgtaagtgcaagatgacacaacactactacggtatggtcttggcagacctagaagccagggaggggttgtgggaggctttgagactaggtactgctgggcgtctcctgcacaccgacgacacacagccgtggcatgccacctacttccgattcctcattgtcttcttccattttgactcctggggttcacgagtggggctgattgcagacttcggtaaaatcacatggggtacaagtaaacagtgccagtacaaggttaacctgacaaaactctattcccctgagaacactgggagggctacttcagccattatggatttgtgttgacagacacagggccatatggttccccctcatcaccttttaccttttacgtacaaaaaaattaacttacctgcctgtattccaaaattatcttgggtaatggatgaaggtctcgcagagcatttaactaaacatgaaaatagatactaccaatgtaattcgtccattttaacattttaaacacgtattttcatctggagaaagtcctcataataaatggtctaattgagcatattttccaaaataaagatgcataataaactcaagtttatcaagtgtcttaatcctaaccccttacaaaaccattctgatgtctacatgggcactaaaaacacctcagttaagcttggaaataagattcctcttgagatttaagttagcgaaatctaaatccagggtaggtaaaataacatgtcagtgcctacaaacgtatagctcgataactgcataatttcagggagggagtaatggattacgagtttaaaaattaactttaagaatcaaaatataacatacctataggaaagtgcaagagagtaagaaaagtttgttaattatcacaaagtgagcacagttgttaaccaccacccacagcgagcgacgaaacattccaatctccccagtaggtactggctccttccccagagctaaccaccacctggacttctaccacaggttacctgtttcctgtcgttggtccaatatcattttttggggttcatcaacatatgaagcagtatttcatttatttgcacggctgtgtagtattcaagtgcatgaatgtagaacattacccattccacctttgatggatatgtgtttttttccaccttagggctattatgaataatgctggtacagagatttttgttaatgtatgttcacagttctgtggaatacatacatgaagaagggtgaaactgctgcatcaactttagcagagatactgccagttctccaaagtaaacatacctgtttatacccctttcagcaaaacataaacattcaagctgatccacatttttgccaatgtatgtcatcactggtgttaattttagctgttctggtaaatgagaagtgatctctcactgtagttttagtttgttatctccccagtgactaacgctgttggacactattcatatatttgactaattgtatatcttctttcattaagcccctgttcgtgtcttttgcttagttaaaaaattgatttgtgtgtctttttctccttgggttgtagaaatttgttattctggacagttttttggtctgttatatttattggaaatatcttctctccttctgtggctagcttttttaacttttaattttttttttacataaggtcttgctctgttccccgggctggagtgaagtcgtgcaatcataactcactgcaaccttaaactcctgggttcaagtgatcctcccctacctcagcctcccaagtagctggactacaggtgcacacaaccatgtctggctaattttttaaatttttggcagagatgaggtctcgccatgttgcccaggctggtcttaaactcctggcctcaagtgatcctcccgccttggcctcccaaggtgttggtattacaagcatgagccacagtacctggctttttcacttatttaatgatgtcttttcataattagagatttttaatttgattgttgtcctgtttatcaagttttccctttatggttgatgcatttgctgtcctacatatgaatgtttacctacctcaaggccttaaagatgtcctcttgttatattttctccaatctttactattttgcttttgatatttagatacacaattcacctggaatttatgtttgtgtgctgcatgaaatgggggtcaagatgcactggccctttatgtaacaagccctccttacttaatgctttgcagtgatgccctgtgagacacactctctctccctctctttctttttgagacagggtctctgtcacccaggctcgagtgcagtggtactgagaggtgacaccgcgctggcactcctcacagccctccctcgctctcggcgcctcctctgcctgggctcccactttggcggcacttgaggagcccttcagcccaccgccacactgtgggagcccctttctgggctggccaaggcgggagccggctccctcagcttgcagggaggtgtggcgggagaggcacgagcgggaaccggggctgcgcggggcgcttgcaggccagctggagttcagggtgggcgtgggcttggcaggccctgcactcggagcagccagccggccctgctagcccgggcaatgaggggcttagcacccaggccagcggctgcggagggtgtactgggtcccccagcagtcagcccaccggcgctgcgctcgatttctcacccggccttagctgccttccatcagggtagggctcgggacctgcaacccgccatgccttagcctcccaccccctccgtgggctcctgtgcggctggagcctccctgatgagcgccgccccctgctccatggcgcccagtcccatcgaccacccaaaggctgaggagtgcgggcgcacggcaccgggactggcaggcagcttcacctgtagcccctgtgcgagatccgctgggtgaagccagctgggctcctgagtctggtggggacgtggagcacctttatgtctagctcaggggttgtaaatacaccaatcggcactctgtatctagctcaaggtttgtaaatacaccaatcagcaccctgtgtctagctcagggtttgtgaatgcaccaattgacgctctgtatctagctactctggtggggacttggagaacctttgtgtggacactctgtatctagctaatctggtggggatatggagaacctttgtgtctagctcagggattgtaaatgcaccaatcagcgccctgtcaaaacagaccactcagctctaccaatcagcaggatgtggatagggccagataagagaataaaagcaggctgcccgagccagcagcggcaacccgctccggtccccttccacactgtggaagctttgttctttccctctttgcaataaattttgctactgctcactctttgggtccacactacttttatgagctgtaacactcactgcgaaggtctgcagcttcactcctgaagccagcaagaccaccagcccactgggaggaatgaacaactccagacgcgccgccttaagagctgtaacactcaccgcgaaggtctgcagtttcactcctgagccagcgagaccacgaacccaccagaaggaagaaactccaaacacatccgaacatcagaaggaacaaactccagacgcgccaccttaagagctataacactcaccgcgagggtctgcggcttcattcttgaagtcagtgagaccaagaacccaccaattccggacacagcaccatcttggctcactgcaacctccacctctggggctcaagctatcctcctgcctcaacctccagagtagctgggactacaggtgcatgccaccatgcccagctaatttttttgttttttgtagggatgaggttttgccatgttgcccaggctggtcttgaactcctggactcaagcaatcctcctgccttggcctcccaaagtgctggaattacaggcatgagccaccatgcccggcccgattttattttttttttacctttaagctctgttggacttgatgtttgtggattttctatcttggtccattggcctatttactgaccctcgagtcaacaccacatggtattgcttaattaattcctagtaattcctattgccttataagtagtcttgatattcaatagactatgtccttaaatagtgatcccccgcgcccagattattttggctctttttagtgtttagtatttccacagaaatctgagaatcaatttttcagttcctaccaaaaaaaaaaaaaaaaaaaaaaaactcctgccaggattttaattaaaattgtctagaatctataaatccacttgggggagaactgattatatgattttgatgtaataggtgaaccattaaatcatagtgctctctgaataaagactgagaacacaagagttgtggccataaaacattaacagtgggcggtatcttgcctcagtataatccagaattgcagtttttgtagaaaagctatccctaggtgggtgaaagtgcatggaaatacttagccaagaaaacagcttaagatcttctaactctccttatcttgatgacttactcacaaaataactttctaaccaatagtctcccagtatatcttgacttgagcagcctgagaacactgctcgcactaaccgtgtacagagcactgagtgctggctgagggccagaggtggagcgccatcagccaccatggctccgcgggctcacccgcgctctgcgccggctgcagacaccacattcgtctgacctcccttctcactcatttcccgctggtgcctcttctctcactgacctttaaagatcagtttctcggagtttaactctgtggttatctatgctggctgcgtatcgcaatcaacagggagcttcaaaagcaggcccatgactaggctcccccgcccaattctgactcgtgggatcagctgtgggcctgggcatccgtgttttccaaatctccgggcagggcagaggaccattatcccagggcgactttagtaaaaatcagctggcagcttccaagtgtggattcccagcatgggacttgtcttgagccccgtcccacaggcccaactgctgttttgtgatacggcacatcaatgtgtcatatgcacttctgtcctaacatatccaaggctgaacactggacctccccctccataaacagttcctgttccagttttccctgagtagtggctgtatctatttgcccaagtgcacaactcagaaaactcaaaactactccacatgctgacttctgttcacactcacatgaacttatcacaaggtcctttctgttctaaaaatcctctaaaaatccatctgctttccatctgctttgctccattttcattgccatgacctggactgcagtgacagcctactaatgagtatcccccattctccaaccagctaaaagagtgatcttggctgggcatggtggctcacacatgtaatcccagcactttgggaggcagaggtgggcagatcgcctgaggtcaggagttggagaccagcctgaccaacatggagaaactctgtctctactaaaaatacaaaattagccaggcgtggtggtgcatgcctattatcccagctactaaggaggctgaggcaggagaattgcttgaacccgggaggtggaggttgccgtgagttgctatcacaccattgctctccagcctgggcaacaagagtgaaactctgtctcaaaaaaaaaaaaaaaaaaaggctgggtgtggtggctcacgcctgtaatcccagcactttgggaggccaaggtgggtggattacctgaggtcaggagtttgagaccagcctggccaacatggtgaaatcccatctctactaaaaatacaaaaattagccaggcctggtggtacacacctgtagtcccaactactcgggaggctgaggcaggagaattgcttgagcctgggaggtggacgttgcagggagctgagatcatgccactgcactccaacctggccgatggagcaagactctgtctcaaaaaaaaaaaaaaaaaaaaaaaaaaaaaaaaaaaaaaaagagtgatcttataaaaacatacccaacacctattagaatggtgaaaatccagaacaccaacaccaccaagtgctggcaaggatgtggagcaacaggaactctcattcattgttgaactctcattcattgttggtgggaatgcaaaatggtgcagctacccaggaagacagtttggcggtttcttacaaaactaaatgtactcttatcatttcatccagcaatcatactctttggtgcttgcccagataagctgaaaatttatgtccacctaaaaacctacacacagatatttatctccgctttatttgtaattgccaaaacttggaaacaaccaagatgttcttcgtaggtaaatggaaaataaactgtgatacatccacgcaatggaatattattcactgctgaaaagaaatgaactatcaggctgtgaaaagacatggaagaaacttaagtgcctaccactaagtgaaataagtcaatccgaaaaggctacatactgtgattccaattttataacattctggaaaaggcaaaactgtggaaacagtaaaaagcacagtggctgtcaggggctggtgggagggagggaggaataggcagagcacaggatttttagggcagtggcgctgctctgtatgatgctgtaatggtagatgtatgtcatcatacatttgtctaaacctacagaatgtctaacaccaagagtgaaccctacacccaagagcagtccaagagtatattgtgtaactacggactctgggcgataacgatgtatcagtgtgggttcactgactgtaacgatggtaccattctgtcgaggatgttgatagagggggagcctgtacatgtgtgtacagaacagcgagtacagaacagggagtatgggaactctctgtactttctgctcaattttactgtgaacctaaaactaaaaaatagtctttttttttttgagacagtgtctcactctgttgcacagaatggagggcagtggtataatcactgctcagtgcagccttgaactactgagctcaagtgatcctgccacctcagcctcacgaatagctgggactaccagtgtgcaccaccatacctggctaatttttaaattttttgtagagaaatggtctcactatgttgcccaggctggtcttgaactcctggcctcaagtgatcctcctgcctcagcctcccaacgtgctgggattataggtgtgagccaccatacatggccattaaagtctatttttaaaaaatctaagatcatagttgctcccttacttaaacaattccaaggctacccatttttctaaaaatctacattcctccccatggcctacaaagcacagcagaattgggtccttgttcacctcaaccccatccctcccattcttctcagtcacaaggctccagcctcagcccctgagcagcctgagccttttcccattgcaaggccttgttcttattccttgcataggcacttcctgatcttcgagcttcagcttacacataactccttagcgttctctctggaccactcagtctggagtgtgtcactctccctgttattaccttaatggctcttatcctgctggatggttcttataatatctaattttaggtgtcaacttgactgggttatgagataatgagacagctggtaaagcattatttccgggtgtgtctgtgcgagtgtttccagaggaggctggcatgtgggttggtggactgagcagggaagacctgcgtcaatgtgggcagggactatccaatcagctaggggcccagttagaatgaaaaacagaggaaaggtgaattcactcactcttctggatctgggacacccttctcctacctttggacaccagaattccagactctcccgtgtttggactctagtacacacactggcgacactcagccttggactcagagttacaccgtcagcttccctgtcccaaggctttcaggcttggactgagccacactatcagcttccctgggtctccagcttgaagaaggcctatcgtgggacttcacagcacccccaactgcgtgaaccaatgtccctaacaaatcccctctcatatacctattatctgtatctatatctgcatatatcctaccggttctatttctctagagaaccctgttacagttcctcgctggaatagatattccatgatgataaagaccttttccccactaaaccatcaacggtgtctaacacagagccagggccacaatagtgtttgctgaataaaacaggaagggcatctgtcctgctcacggctgtatcccacatactggatgcccagcagtgggtcagtgcacacacatgacctggagaccccatcacttcagttagtcaaggggtcgcagaagcaactcccagaaatgatgagtggctggtccaggaatcctgaccccaaggctggaccatcttcccagagtttgaactccttatgatgttctgagaacatgtgacttcactgcagaaaaaaaacaccaaagcttccttcagttcgttagggagggacccttgtttcccactcatcatgtgcctgctgaggggagggaattcccactataccccagcaggagtgagtggaccagctaggtaccacaggactctaaactacactgcacaggtacaaggggacatgtgttcttcagcccacgaggagcatctgagaaccctgaggtgagtgtcaaagaactgacattgcatagactgtgttctcttatcacacttcatttaatttagaaatcaaggccaggcatggtgactcatgcctgtaatcctagcactttgggaggccgaggtgggcaggtcacctgaggtcaggagtttgagaccagcctggccaacatggggaaacaccatctctactgaaagtacaaaaattagctgggtgtggtggcaggtgcatatagtcccagctactcaggaggctgaggcaggagaatcgcttgaacctggaagggggaggttgcagtgagctgagattacatcactgcactccagcctgggtgacaagagcaagactctgtctcaaaaaaaattttttttttagaaatcaataacaaaaactatctgggaatcccccacacatttggaaatgttaagacacacttccagacaactcgatggtcaaagaattataacagaaatgagaaaatatgtagagtcaaacaatgagaaaaaaataatacgtctcaaaacttgaagggttcattagtgacttcttgagcatccactatgtcccaggcattgtactaagcactgggaacatcccaggaacaaaagaaaagtcatgcactgttagggctacatgtagttgggggagctgagcagcagcaaatgtgtgtgtgacacaggggataccatcagctggtttccccgacatcaaacatggattcatggaggaaaagggcagggaggggacaggcgctggggtgagaggagccacaacgctcaccaaggcctccaggaaggggaaagggaggatggagagaagtcatgagaagaaatctgaatcttgaatttggccacatacctggcacaagccaatcttttcacatgcatgaatgagcaacttgacttcctcagttaaatcaaagagtgaggctaatatgatttatgctcatcatgtctttatgggagaaaaatgagctcctcgtgaaagctgttgtcttaacaagagagcacatcggcaccagaagagagtgatgcgtcctttcttgcactgttggttgtctggagagggaagggagttgcaaagggaagggcaacagtgccagctggtgccaggacagaggtgagctcaggtgcaggtgcgggatgctccctgctggagctctggggcatgctgcccatgtccactgtgtggtgttgagacccaagccttagtctccacagcaagacagatgctgcttccaggaaccatcttatatgacccagtgctccacgaacacaccacagatgctgagttcagcaccaggagctggtttggttctgggaacaaactgaagtctttgatctgcacaacctacattctaatggaaaagcaaacacacacctaagataaactttaggtagtggtgagttgtgtgcagaaaataactcaaggtgaagaaacagctgtgacttggggccttactgtagtctgggtgaccagaggtctcctgaacacaatgtttaagctgacaatcagaagcaagcaggaaaaatttgtggcacgagtctggggacagagaaggagctggcgcacagagctgcaggcagctcagcaggcgctggagtggggggagagaggaggtgccgggccaggaaggcacagccagagcacgggcctggggatacgctctgcagctcagatttgatgctaagtgcaatagaagctactggaagtcctagggcagtaacgtgacttttccaatgcttttaaaggatcactctaggtgtgaaggatgagcagcaggggcaagaatggttggagggatctaagtgagaaaggtctatggtagagacgggggaatggggaaaaggaggcatgctcaggacctattttgtgggtagagaccttgacactcactgtgagaggaggcggaaggaaagtcaaggacgactcacaggacttttctcagaatggccgatgcttactggtcttttgagagcttttacgtctggcacggtcctaagtgctgtttcacacagacacatggacacacacacacgcacacacactgaagccttacaagattccagtagggaaagtactattattatttttcttttatagatcaggaaactgaggcacagagcagtcgagcaatgttttcatgttgtccaaaccatgctggccagtgatggctgaccccactgcccttgttcttacttactactctgtactggctcccaaggacctggaaggaggacgggcccttcactaaggtggagaaagcttgaagaagaagaggatttggaagagggcagtttcaagtccctccagtggagcatcctctgtgggagtccattattcacccagtaactgtccattaaaccagcaaaggccaagtgcaggcacagtcaacgagctcaggctccttgagggcctgtactctaagacaccctcacagggcggagactggaggaacgtggtgctggagagggaatagggccagaggagacatcttagaaggaaaccttcctctgttacaaagtcgaatgctggacagagcacagaaagcacaaactggagcctcagaagctggttctcaccacagtaaccaatattcacaataacatgaattcacttatttactgacttccactctgtgtcttttcagtaaaagcactcactgtcttctgaatatcgatctatactctcccactccaacacagcacaatctcactactccttgtcttcaaaaaaaattgattcctctcaagagaggggtaggtaaaattctctaaaataaatctgaggaaaggagaagactgatgacccgtttctagttcctcttggggacacgaagcaaagaggttgtgactggattgtcaagaaattggttttaagaacaaaactccaccaaattatgcttttcaggaagtcaagccaattaactgcttctgcaaaagtgtactgtctgcctctctcccttggtccatagcgagaaaagcaaccttggtgtggggagcccctcttctgcagaaactgctgccagcatgaggggacggcctgagagtctcgggtgggtctgaaggtcagcacacatgtggtgcagacatgctgtcattctaaaaagaaaaaggataactctgaaaccttaccactgcttctgatgtagacgggtatttctgcaaccccgttctggggagactgttcctttgactcagcaggtgcagctttaacttgccaaagaggatcttcaacaaaacaaattaaacatggtgagggaatctcacatttgagagaaacagaacattactatagcagagcccatgccaacagccagagaagacacacccaaacagacattacaacatgcttaaattctcatttagtacttttctacaagttaaaggctttgaagtaatgaatctcaatgtgttcattacttgtgagagaacatgaaaaacttacttttcagatagttgacataaaataatacttataaattcaaaataaatctccctttaactcctgaataagaaatacattttatgaaagaaccaaaattcagctttacctctcgaagctggttattgctcgttataagaaaccgttctcctgcaacaaaatgagcttcttgctccaattccttgagacgagcctgaaaatatgatacacacaattaatttcattcatagttttcacaatttaagattgtttaatttgttcatcaaacaattctcaacagcgagatgggcacggtggcttatgcctgtgataccagccctttgggaggctgaggcaggaggatcacttgagaccaggagtttgagaccagcctgggcaacatagtgcgaccccaccactaaaaaaaaaaaaaaaaaaaaaaaattagccaggcatggtggtacacacctgtggtcctagctgcttgggaggctgaggtgggaggattgtatgaacccgagggttcaaggttgcagtgagttataactgtgccattgcactgcagcctgtgtgacagtgagacactgtctcaacaaacaaacacatacacacaaaattcccaaagaaagctcttaaaagagtaataaataacctataatttatcaaaataagcataaaaatacacactttggccaggcacggtggttcacaccggtgatcccagcactttgggaggccgaggcaggtgggtgtcttgagcccaggagtttgagcccagcctgggcaacatagtgagacctcatctctacaaaaaaataaaaataaaaataaacatattttgcctcatggtgaaatacctaggctcatagaagcatcctcccccaaaggtaagaaaacaaacttaaagtagtaaaaataatgggaaagaaagaatcaattctccaacaatattaagactagaaaagggatccaacatcacatagaacaagacagaggtagaaagtataggaaacaggcttgtatccagaatacatcaggatatcctatacatcagtaagaaaaaatataaaaatgggcaaaagacttgagcagatcctttacaaaaagaaattcctaaaagctaatgatgctatgaaaagctaatcgatcccactaatgtgaaatgtgacatacaaaaatgatatcactctggtccagagctctaaagtagagtcagggagccattctaaggactgcctgcatgacctgaaatgctgaaaaacaaaaacaaaaacaaaaaacaggaacttgaattgaacctctgaactgggctcaactgcaatgaccacaacatcctggaaaacagctagattttgccagtgctgcaccttctgaagagcgacaaccaatgagctcaacggactcatgtactaagccaaccgcctccaacaatgataattctttcacaacaactgtgtattcgcccttagcttccttttaaaaatctcaactccccttcctctcttcagaacacttattggcctttagctgaacctgtgtctcctgaattgcagtttctaagaccccaggaatgccttgtctaactgctttgcagtctgctctttcacctcttcttggttgacattagtaatcaggaaaatagaaacaaaactcataatgagatatcattatagcctcaccaaaatggctacaatgtaaaagtctgatgcacccaggggaagtgaggatgtgcaagaatgggatcccgtatgcattctcatgggtgagactctgggaagccattgggcattattgaataaaactaagcaacagcttccctgtgtcccagcagcactagtcacctcacagcccacagaaacctgtgcccacaggcacagggaatgcactcagaggtacagcgtggtttgtaacgactgccacttggaaacaaccacacgcctatcggcagtgggacagagacaccaagggcagcacagtccacagcgggaaactccacagcactgagtgacacacagaaacacaggtggagctgagatgtagaaggctgggtaaaaggccacacgtaagtcactgtttacttacagttcaaaagcaaagctaaactacattgcttaggctttgaagtgggaaagctagaaagaaaagcaacgatgaaaaggctacaaaagtcagggttgcagttacttttggcagcaagaaaggggttctgatagggaaagcacacaggactctggaaagtctgtgctttgaaccaggtgatggttatattggggtttcctttaaacattttattttaaagatgctcctggcatgtgctttagcctttttaaaaatttgtgcagatgtatgaggtacatgagaaaatgtattacgtgtatataatgtgtggtggtcacgtcagggtattcagagcacccatcattcaagttcaatacctttttgttaagtacagtcatcctacgctgctatcaaacactgaatttatttcttttattttactgtatgtttgcaccctttagcctgcttctcttcatctttgccccgccccgccactgctcacccttcccagtctctgtgtctattttcccactctccacctacatgtgttttcttaagaaaactgaagtagagcatttttaagtattttttcatgcatctttacacatctctgtatttttgtttttcaagaaacccaagaattccttcaccaaactacaggggacaatgtccctgtaagaaaaacgtaacttttgaggaggatcctgaggagccattaaagaactccccggacacacacgcactagatgctgtttaggtcttttcaatgcttggttctcccctgcaggcgtcagaaagagggagaaacactgtcaacaccaaacaaggaagagaagaaaaggagaatctactctagacctgccactgggaacaactatctcatgcaggaaagagatggccagtacaaaccatctggaataataacttaccccaagaagtgctgacgtcttctccatctcctctttgttcacctgaatggcatggctttccatcactgtgattcgaaacccaaaccagatcatatttgcattaatgtattctttttactaaagactaaaatgcttcgctccctgatgaggacaataatgactgcaactgccatttactcagcacctgctgcatgccaacctctgcacaggatctgtcaggatccctgtgtcatacaggcaaatgggcgcattgacagagctggcctttgaggtgggagtgggcgaggggaccgcactggccagcctggcccttcccacactgtgaatgccccctggctgacgtggtgcccatcaggacctgcggtcaaaggcaaaggcagaagagagccctgcatcagttcttgcaggaaggttctcaaggttataaggacagcaaaccagaatgagagacaaccactaacacataaaacatctagagaagcctactcctccttggccaggcagcacagaagggatcccatatgaccaagatgtcagaacctcgagtctttccacaccaagagggaatgcagtccaacccctcactacagaaagggaaaataataggcttgctacctctctggtgcccatgagatatactatctactcctaagtaaggtatggagaaatgttcatcccaaacaatatgaagaaccctctagaaaaatggctgtacttcatctttatggtaacttacctgccaaaattggtatcagaggaagctccaaagtacgaaatagttgccataaaccataatcctgtttaataggaagaaataacatcaacgtcaatttaaatattattgtatctgcattttgttgaaaagcctacttttttttttttttttgagacagagtcttgctctgctgcccaggttggagtgcagtggcgtgatctcagcgcactgcaacctccacctccagggttcaagtgattctcctgtctcagcctcttgagtaggtaggactacaggcaccccccaccatgccaggctaattttaaaaatttttagtagagacggagtttcgccatgtaggccaggctggttttgaactcctgacctcaagtgatctgcccaccttggcctcccgaagtgctgggattacaggcatgagccaccgcacccaaccaaaaagcctaaattttgtcgagctagaattaaggtgacccctatcatgggcatggctggtctcccacccaacctcgactcctcttacttgctcttcctaatgaactcttatttcccttaagtaggctattttattaccaagatctagtagagatagttagaaatatagataggttcaagtcaaacattggaagtggaaaaaaagaaataaaaagaaattctgataggccaagccccatcctcaattttcttcactctttttcatttttaagattgatttaagcatttgtggacttttagtctaccattttaatttcagaataggcttactgaattcccaaaatttaccaataattctcattgatttttcactgccactatggattaatttgaggaacattagaatctttattccaggccacctcccctgagagcatggaatctctatttatccgggccttcctgtgttcttcatgagtctcattgtttttagttttcctgctgccattagagagtcccaggctccatcctccaactcttgccctcatgttctctcctgcccctccagacccattctctgccctgcccttgcccataaggcggggcaggctcctccaggtcacatcacccgggccactcctctgctctcagatggggcatagggggcaggagggagggaaacaggctgagctactgcctgtccctggagctttctccttctggctggttccctttgccctccctggcctctggacacagtccctccactcagctcttcttggtggctcattgcagtggctgtctgcttcccaggaagactctggttgagtgaagctatgtccatcccactattaatcaaaatcaatgctcagcttttacattaactatggcattggaaacatcccacttaaaaaagaggctttaaaaaatattacaattgttttcaacctacagaaagcatttttaaaacttcagttcttatcattctagacaacccttttctgagtaatgcacaggttaatttgttcttagaactcaacgtttcgtttccttcacattcaaactccctgggagtgcgggtgccaatgaaaagacatctcttgtgagcctctgtcagccagaaattataataaaatgccttgccttcagtttagagcaaaggtccattgtaagtctgtagagtgtcttcaggttctcacgtacattctgattctttaaaagagcaaaagtatttttaaaaatcagataaacttggtggcagtgctcaccacagtctgtaactgacatgacttgaaaaatgtttcctagtaaaatcccatgaggttttcaatggcagatgtcatgtacgtggtagtatcaccaaacacctcgactagacaagttcgcatctgtagaaagtgcttctactgcgcaagtgcaagctatccatagctggacacttcctcccaaccgagggtatttcttcattttatagactgagaaacagaaccacaaagaagcttaatgtctcaggtacaatgattaaatggtagcagggagaggagaatgcagacctggcctctctggagtccacagctccattctctcagccttaccaccttgcacccacgcacagctgctgccacgttccacacttacccctccattctcaccccaggagatgcacacagaggccctgggagatgacaaacaagggtctgtgttcagctgacaaagagggagatgggatgagatgtgtccctcaatacagagtctaattacccttcccctaacctggagtgccaggacctcttcaacaccccattctgccaaacaaatcccccacctccagcccactcagacccaattttctgctgaaggcctgagattagagtgaacatcccatgggaccagtggctaagtgcacacaccttggcattgttttctagtcatcttgcttgtggctctcctgtgaatgttgggagaacatcctacagaagagtccctccatgtcaagttcttgactgccacctggcagaattctacctggctgcctgcaggagccttccacaccccaaaactgaccatgtgactcctagtttgaatacccccaggacaggcccagctccctggtatggcacagctgcacgaggagcccctaaatcttctctggctccccacagccatgcctccttctccccaggttggtcttgctgtcctccatagaggcaccatgttctctgagagtcttaccatatccctgctgctccctctacctggaactctcttccatttatctgaacaattcatgccacctctttggagagaatggtgtaacctgtgatctgtagattaatgattaatggctggacttccatctcccaccctcatccatgccctgcatggctcaactacagagacatatctggctgatgagacataaacagaactgcatctgaggctgcctcttttctgcctcgagtgtggatgagttgaaccctggcctcaatttgaccctgggcaaggcacatgtacgttaacctttctatacctcagttttctcatctgtaaactgggactgataattctgagatggacaactccttctttctaatatctcagcttctgtttggagaagtctccctgcctgacggcatgaagtgtgggtagggatactaatcaagatgcctggcctccctggtggggtgtagacacatggtacaaggagggaaagaaaacactctccaagtgctgaaactttgacttttggacagagaaaaagtcatggctcagtgctgccaccaagcctaccagttccagctccctgggactcagggctgcgtggctcctgttcttcccaaggcctggtactgcctttcctctgattctgtgggctaccccatatccttctgataaatctctttttatattaagggagagtgcatttctgcaacttataaccccaaaaccctattgttacaaatcttcacatcacagatgatctgtgaggatgaagtacatgaggcaaatatccccagctcagtgcctggtgcctgacacgggctcatatcacctcttacccccagctcagtgcccagtgcccagcatgggctctcatcacctcttatccccagctcagtgcccagcacacagcttgggctcacatcacctcttacccccagctcagtgcccagtacatggcgtgggctcacatcaccacttgctttgctgtgattgcttgagctagctcagtagcctgtgtgttcttccagcagtgattttaccatgtaactgttcactgacagctaactagaaagcctgaacagggtggccccaactgtggccacattgccaccactagacacctctcctctggggcctgctgagaagtctctctctctgggttctaggcacagttctagaaggtgtgagtgcctttgttttccagatggtgcttcctgataactaggggtatctctagcaggcgaaggcctggagagaggcccaagacagtttttttttttttttgagacagagtctcactctgtcactcaggctggagttcagtggcacaatcttggcttactgcaacctctgcctcccaggttcaagcaattctcctgcctcagcctcctgagtagctggaactacaggcacctgccaccatgattggctaatttttatatttttagtagagacagggtttcaccaggttggctaggttggtcttgaactcctggcctcgagtgatcggcccaccttagcctcccaaagtgctgtgattacaggcatgagctgctgcacccagcccgagacccagggcagttctgaccattctctccacacagactgaagagtagccatcccaggacctctggcactgtggccacgtcaccagccctaaggatttatcaatgagtggcattctgttcatggagcaggtgacactgacatcagagagtcatctggaagagtcacactatggacagatttcctaggaacaggtgccatagaagaacagccatcacctatccttattcaacatcctccaccagaaatgccaaggtcacaactatttgtgctgaataagtgaaaatgaatgttgacaatgttctttttactattaggctatcaataaaatagaaaaagcttccagaaaaaataggatgtattaaggttgataaaactttatcttaaacaactcaccacaatatttcttgaggaatttccatatgtgctgttcactttaactgtaatggatttttcacagtatttttctactaaatcttcaaaagagggtgtggcatcactaggatctataagccatgcagcaattctgggatctagccctataaaatcagcaactgaagagaaaaaggtcattcagtcatcccaagaaaaaccaatagttgtttttcctgctttgacaaagttcttaagttcaaacgaatagtagtagtattgtcatcctctcaaattatagacctaaggaccaaagtgactttccattattctccagaatttagaacccttgataaggcagcctcgatgaacccaagtcccacatggcccgtctctgtgggtgtcacattaaagaggcagatttcaagtagccataaaggagggactccaagctcacttgcaatttggatctctcaaaaacatgttaaaagctgtcgaagtcagagtcgtgggtcatgctacctgcctcccctcctccttgctcctctttccctcaggcatcctctctgccaagtcctgccctcctccagcctgtcactgggctgtctggcaccatggagtctggaatccaagcctctcgagcaaaaggaagaagggcgggagttgcctgagcacacacgacaccctcgtcactgagtgttgaacaggtagtgtgtgcaaggcaaagatactttggcattctccctgaagtgtggaaaatctacaagacaactaatgtgtggcgctttggtactgtggaaggaacaccaggcctggattctgaatcaccctctgagcctgggaggccacctcgccccttcagtgttagtttcttcatccaaaaactggggggaaagattactgtaattatgtgtgatatacatgagaaaatgctttttaaaaagtaaatacaatatttgctaaacaaacaagtttttataccagaacactttagacatgaagggagagtcataaaaggctggggaggtggggcgggctagaaatcaatagacaaactaaatcctaaagtgactgctttttaagttactttaaaattttgaattgtgccatacaaaagtaaggagtttgcctttaaataaaactatagtcttagatcatatcacattaaatattatatgttcaggcatctttaaattataccagtctaagagatttatatttaccaaagcagccagtattatgactttctcatttgatatctaggaaggctcttacagtagcacatttggagctctggataagaggagcacatgtctccgtcagcagcacatgattttctacaacactgtctggtgatgcggactgacccaataggactgtttcactccacttcccttttcaatgctttaatattccaaaagtaatggttatcaacatatgttttttaaaatccttggggaagctctgacagtataagaatgctctgggagatggtccctataatctcttgcaactgacaaactgaagcctgccaggacaaatcccacactagggagaaaatgccagtagctgaaaaagaaatgctaacaaaataagatttaaaacaaactcagaaaattaagaaagagtaaaacctgtaaaaaagtaagtaaatccgaataatatacttagaaattaggtgacttagaaaaagaaaaattatacaaagaaatgacagaatctaggagagaaaatttaaaaaaagaagacatttcagaaataaaaactaaactggcgcaagacacaaaagcaaataaacataatagctaactacttaaagtaaaaaaaaaaagaattaaggaaagggaattttttgtttgtttgttttgtttgtttttttgagatggagtcttgctctgttgcccaagctggagagcaatggcatgatctcggctcactgcaacctctgcctctcaggttcaagtgattatcctgcctcagcctcccgagtagctgggattataggcacccaccaccatgcccagctaatttttgttttttttagtagagatggggtttcaccatgttggccaggctggtcttaaactcctgacctcagttgatctgcccacctcagcctcccaaagtgctgggattacaggcgtaagccactgtgcccagccaaaaaagacagaatatttttttaaataaaaaagaatcaagtccaacagaacttaaaaataaaataaaataaaattttaaaaaatctaaaagaaatgacgaaactgaaaatggattctggataaaaaatgataaatatgacaaaaagataaatatgaaagacagacaagaagattcaacatatgaaataggaaatcaaaggaaagaaaacaaacgaacacagcactaaacactgtaattcaagatgactttaggccgggcatggtggctcatgcctgtaatcctagcactttgggaggccgaagcaggcagatcacgaggtcaggagaggcagatcacgaggtcaggagattgagcccatcttggctaacacggtgaaaccctgtctctactaaaaatacaaaaaattagctgggtgtggtggtgggcacctgcagtcccagctactggggaggctgaggcaggagaatggtgtgaacccaggaggcggagctttcagtgagctgagatcacgccactgcactccagcctgggcaacagagtgagactccgtctcaaaaaaaaaaaaaaagatgactttaaactacataaagacatatacataatcaatacagcgtagtatcgacacagaatagacctacagatcagtggaacagaatcaagagtctagaaataaacccatacatcagtggttgattgattttcaacaaaggtactaagaatggtgttggataccaacaatgggtggaattgtggtcctcaaaagataactccacccagaatctcagaatgggaacttatttgaaataagggcctttgcagatacaattatggtaggaatcttgagatgagatcatcttaagttagggtgagccctaaatccaatgatgggtgtccttatgagagacagaaaagaaggtgacatatagagacatgcagagggaaaaggccacatgaggatggaagcagagactggagggatgtgtctacaagtcaaggagtgaaaaggacttccagccaccaccagaagctgggggagagtcacagaatggattttccctcagagactccagaaggaactgccaacaccttaatttggacttccagcccccagaactgtaagaaaataaatttttgttttaagcacttagtttatggtaatgttacagcagacctaggaaactaatacagacccctacctcacaccatatgcaaaaattaaccaaaaatggatcataagcctaacctcagagagaatatgattaaacttgtatgaaaaaaaatgagtaaatctttctgaccttggattaaacaatagtttcttagatttgacaccaaaaacacaaataacaaaagaaaacacaaataaatcggatttccttaaaaaaaaaaaagtgtgcttcaaaggacatcaagaaactaaaaagacaagtcacagattgggagaaagtatttgcaaattgtatatctgacaataaactcatattagaatatataaataattcttacaaataaacaataaaaagacaatgcaattttaaaatgggcaaaatatttgaacagacatttccccaaaaaaagatataaaagtggccaataagcacatgagaagatgtccaatatcattaggcatcagtataatacaaaccaaaaccataaggatgtaacacttcacatccacttggatgactaaaataaagatacacaagaacacgtattgggcaaggatgtggggaagttacagtgctatatacagtgctggttaaaatggtgcagccttgttggaaacaagtttggcagttcctcagaatgttaaatacagagtaccacatgacccagcaattctacttcttctagatatacacgcaagcaagttgaaaatatgtccacgcaaagacctttacaccaaagttcatagaagcattaatcataacagctaaaagtgaaaacaactcaaatgttcatcaactgatgaatgaacaaaatatgaatattattcagccataaaaaggaataaagtactgatacatgccacaacttgaatgaacctttaaaacactaggttaaaaaccaacaacaacaaaaagctacatcaggctaaatgaaataagctagtgacaaaaggttgcatattgtgcaattctattcatgttaaatattcagaatacacaactccagagacaaaaaaccacagattagtgcttgccagagtctgagaaaggggggatggggagtggctgctaaggagtacagggtttttttttggggtgacaaaaatgttctgatattatgtagtggtgatagatgcacaattctgtgattacttgaaaaacccctgaattgtacagttaaagagtgaattttatggtatgaaattatatcttaataaaaccgctattttttaaagctataccagaaagctatttacaaggtgttctttttttctttttttttttgagacagagtcttgcgagatctctgctcactgcaatctctgcctgccaggttcaggtgattcttctgcctcagcctcctgagtagctggaactacaggcgcacgccatcatgcccggctaattttcatatttttagtagagatggagtttcaccatgttggccaggctggtcttgaactcctgacctcaggtgatccactcgtctccgcctcccaaagtgctgggattacagacgtgagccaccgtgcccagccaaagttttttttttttttttaagggtacatacatatcttgcaaaattgacccaaaacagccaacaccaagacacagtctagtaaaacactagactttaaaaaaaaaaaggaaaacaaaacaaacaaaaacctttggacattcagacaaaaagaccaagtcactaattagggaaagagaatcagattttcaccacactttctgaaagcaccactttatgccaaaaaacaatagtatagcatattttagaaatacaaagaaagatgtaaaccagtgatcttatatacagccaaactgacctccaagtacaaaggattcttcagtatgttttaaaggagatcaataaggttaagtaaaaaccctgtcatcctgaacatgaattagaaatatcagtatgaactcacagtatattttatcttaaaaaaaaatacaaacatcttagcctggtaacaaaagtcaacctaatagtgaggtacatatccagtgaccagattctggtctctaaatgccattttcactaatgtaacagggctccttgaagaaatggctaatttcaggtctagagcaggaaatgcacaagatgacctggaaacatcctaccataccacaaatcaaagaagatgcccagattactaggtttgtatgacaaaggctcacctaactcatcaaagatcatgtgcaatgtgtcaaaacatatcaaatatatttaaatccatatgctcataatgatactaaaatgaaaaaggctttttttgatcaccttttggtgattctatgaaacaattcattattttgaaaacgggtaaataaaggaaaataatcaaattttatcttggcttttctatatgaagtgtacttagggtaaccaaatagatgataaaaggggatttctctttatgtaagtgttatagctaataaatgaagaaagcataatagatcttaaatatcaccatgttgcaattaaggaacctagacaatgacaagcagtagcttctaacatcacaaaaaaagataaacatccaaacattatatacctcctgacaaacgtatacaacacttatgtagtctttctctcccaaatctaacctgaatctgatcaggcatctggatctaattgccaatttacaggaaatagaagagagataacatattaaatgagaagaaagagatgtgctcagtaaaatccagactgtgagaaattctacaggacaaacaatctggtttcttgaacaccaaaacaactgcaagagtgtaagacagaggaagggagaacatatagatgaaaagaggcttaacaaatacaagcacacctggctgggcgcggtggcccatgcctgtaatcccagcactttgggaggccgaggcaggcagattacttgaggtcaggagttcgagaccagcctggccaacatggtgaaacccctctctaccaaaaatataaaaaattagccaggcatggtggcacgtgcctgtaatcccagctactcaagaggctgagtcaggagaattgcttgaacccaggaggcagaggttgcagtgagccaagattgcaccattgcactctagcctgagtgacagagcgagactccatctcaaaaacaaacaaataaacaaaaagaaatacaagttacgggctttgggccccagttaaaacaaactgtaaaaaaacaaaacaaataaacaaaaacagttatagaacaactagggaagtgcaaacactgactagacagctaataataaaaagagattattggtaatagagtgatgttaccaaaatggtagaacacaagaaagccggcttcactctccttcacagaaaaagcaaaaaccaatatacagcaccaagattatcaccagcaatatcccagaacccaaatataaggatgacacagtttccaaggccacacagaagtgaaaaaactccatgcagacagtaagagaatcagactttatgtcccttccccaatctgccagtcaccaaacatgtagaaaaacttctcccaattcagttactaaactgaaaaaagtgagactgaggtggacaatcaactttcccatcatcttgggccccctggcaggagacccgtccctgccacaatccacaggaagcatcatgagtgtctgaagggagaaatatccctgaggacagccagaaatgggcagtggtagagactagcagacactcggctctgtaccatagacagaggagacaccaaatcagaaaggctggtcagtaggaccatgttgtaggaggtacatcctacaggtcccctgggcatgaactcccggctagccttcccatactgcgaggtattcccttagggactttcctcatcagggatggggagcgctctgaagtttgctagagccgaggcacacctgggcttaaggtgccacctagtgctgaaaaggaagcaaggacctagcaaaaacaaaaagatatttaacaggtatattgaccaaaaatctctgagcaaacatacctaataaaaaaccaaaacaaaccagacagagaagattggaacaaaaaaacgaatccttcaatgcaaagaaatagacgtacattcacaagaaataatagcaagtggggaaccatgacattctcaaaccagacaaagcaaggagccagtgactgaccttaacaggatggcgacagtgaagctctttgatcaagaattcaaaattgcagttttaaggaaactcagtgatctctaaaataacacagaaaaacccagaaattaatcagaaaaatttaacagaggttgacttaatttaaaaaatcaaacagaaatcctggaactgagaaatatatttgctgaactgaaaaattcaatagaggctctcaacagcagaatggatcaagcagagaaaacaatcagtgggtctgaagatagactactggaaaagacacagaggagtaaaaagaaaagagagaagagaaaagaaggacacctataagatatagaaaattgcctcaaaagagcaaatctaagaattagtggtgttcaagatgaagcagagcaagagcaaggaatagaaagcttattcaaaaaataataacagaaaacttcccaaattttttgtttgtttgttttgtttgtttgtttgtttagatggagtcttgctctgttgctcaggcggaagtgcaatggtttgatcttggctcattgcaacctctgcctcttgggttaaagtgattctcctgtctcagcctcccgagtatctgggattacaggtatgtgccaccatgcccggctcacttttgaatttttagtagagacagggtttcaccatgttggccaggctggtctcgaactcctgacctcaagtgatccacccgcctcagtctcccaaagtgctgggattacaggcatgagccactgcgcctggcccaaatcttgagaaagatataaatatccaggtagaggaaggccagagatcaaacagattaaacccaaataaaactaccctataatcacccaaatataactaccctatattacactacacatataataaacaagcccccaaaggtcaaggacaaagaaaggaccccaaaaacagcaagagaaaagaacaaataacatataaaggagctccaattcatctggcaacaggtttctcaacagaaggagggagtgggataacctattcaaagtgctgaaagaaaagacaactgccaggcttggtggctgacacctgtaatcccaacactttgggagcccaaggcaggaggattgcttcaggctaggagttcaacagcagccaggacaacatagtgagacccctgtctctacaaaataaaaataaaaaaattatctgggtgtggtagaacacacctatagtcccgactacttggaaggctgatgcaggaggatcacttcagcccaggaatttgaggttacagtgagctatgatcacaccactgcattccagcctgggtgacagagtgagaccccatctccctgccaacccctccccaataaaaaggaaaacaaaacaaaagacaactgtcacccaagaattctgtgcccagcaaagctatccttcacacgtgaaaaagagataaagccccagacaaacaaaaactgaggaaattcatcaccaccagacccatcttccaagatatgctaaaaggagttcttcaatctgaaagaaaaaaacacgggccgggcgcagtggctcacgcctgtaatcccagcactttgggaggccgaggtgggcagatcacgaggtcaggagatcaagaccatcctggctaacacagtgaaaccccatctctactaaaaatacaaaaaaattagccgggcctggtggcgggcgcctgtagtcccagctactcgggaggctgaggcaggagaatggcgtgaacctgggaggcggagcttgcagtgagccgagattgcgccactgcactccagcctgggcaacagaaggagactccatctcaaaaaaaacaaaaaacaaaaaaacaaaacaaaacaaaaaaaaaccacgaacatacaaaaagaaaacatttgaaggattgaaacccactggtaaaagtaaatacacagacaaactcagcatactctaacactgaaattgtggtatgcaatccaccataactccagtgtgaagattaaaagataaatctataaaaaacagtaatagctatggtaacgtgttaagagatgggccatataaaaacacataaatcgaggcaacaaaaagtcaaaatgtgtgtagggggtggaattaaagtgtaaagattttttagtttttcctttatttgtttgtttctattcttttctttgtaaataaagataagttgtcatctgtttaaaacaacttgttataactataagattttttttgtaaggctcctttttatttttagtgtatttattactggtttttgtaaccacaaagcaaaaacctataataaatacacacacacacaaaaagctacaaattaaaagatactaccagagaaaatcacttaaccacaagtaacaaaatggtagtaataagtcctcacctaccaataacattgaatgtaaatggactaaattcttcaattaaaagacatagaatagctgaatggataaggaaataagacacaactatttcctgcttactagaaacccactttacttatacagacttacatagaataaaagtgaggaaatgcaagaattaatattgttaaaatatcaatgttaccggccaggcacagtggctcacgcctgtaatcccagcactttgggaggctgaggtgggtggatcacgaggtcaggagaacgagaccatcctggctaacatggtgaaaccccgtctctaccaaaaatacaaaaaattagccaggcatggtggcgggcgcctgtagtcccagctacttgggaggctgaggcaggagaatggcgtgaacccaggaggcagagcttgcagtaagccaagattgtgccactgcactccagcctgggcgacagagagagactccatctcaaacaaaaaaaaaagaaaaaaaatcaatgttacatgaagcaatcaaagagtcaatgcaatctctatcaaaataccaaccaatgacattcttcacagaaataggacaaaaaggccaggcgcggtggctcacgcctgtaatcccagcactttaggagaccaaggcgggtggatcacgaggtcaggagatcaagaccatcctggccaacatggtgaaaccccgtctctactaaaaatacaaaaattaggtgtggtggcgagtgcctatagtcccagctacttcagagtctgaggcacaagaatcacttgaacccaggaggtagaggttgcagtgagctgagatcacgccactgcaatccagcctggcaacagagcaagactccatctcaaaaaaaaaaaaaaaaaaagaaataggacaaaaatgcctaaaatctgtatggaaccaaacaccctgaatagccaaagcaatcatgagcaaaaacaacaaagctggaggaatcacccacactacctgacttcaaattatactacaaagctatagtaaccaagacagcatggtactgacataaaaccgacacgcagaccaatggaacagaatagagaccccagaaataaatcaacacatttacagccaattcatttttgacaggctccaagaatatatattggggaaaagtgctgggaaaatcacatgcagaagaatgaaactagactcctatctctcaccatatacaaaaatcaaatcaaaatggattaaggacttaaatctaagacctgaaactatgaaacatctggaagaaaacattgggaaaatgctccagtgcatttgtctgggcaatgatttttttttttttactacaacttcaaaagtataggcaacaaaagcaaaaacagacaaatgaaattacatcaagcaaaagctgtacagcaaaggaaacaatagagtgaacagacaactcacagaatggaagaaaatatttgcaaactatccatctgatagtggattaacaaccaggatataaaaggaactcaaacagctcaatagggggaaaacatgatttaaaaataggcaaatgatttgaatagacatttctgaaaagaagatatacaaaaggccaacaagaatatttaaaaatgttcaacatcactaatcataagaaaaatgcaaggaaaatcacaatgagatatcatctcaccccaatttaaaacgactttcatcaaaaagatagggaataacagatactggtgaggatatggagaaaggggaaccctcatacactattggtaggaaagtaaattagtacagccactatggaaaacagtacgtaggttcctcaaaaaacgaaatagaactaccatatgatccagcaatcccactcctgggtatatattcaaaagaatcaacatatcagagcgatatctgcattcccatgttactgcagtactattcacaatagccaaaataaggaattaacctgagtgtccatcaacagataaataaagaaaatgtggtattactattcagccataaaaaagaatgaaatcctgtcatttgcagcaacatggatggagctggagatcaccatgttaagtgaaataagccaagcacagaaagataaatatcgctcatatgtaggagctgagaaagcagatctcatgaaggtagagtagattggtggttaccagaggtcaggaagggtaagggggcggtgggtgggattaagagtagttgattaacggttacaaatacatagttaggcagaagaaagaagacctggtgttcagtaaatcagtagagtgactatagtaaacaataatctattgtatatttcaaaatagctagtaaaggaaaattcaaatattcccagtataaagaaaagataaatgtttaaggtgatagatatcccatttacccggatttgattattacacattatatgaatgtatcaaaatatcacaagttcccccaaaatatgtatatctattatgattcagtaaaatttttagaaggaaaaaaaagaataaaagattattggttattttgcttgggggtggggagagatgatggtgttgtcttaaaaacagaatctcacattttagtcatacaattgaaatatttagagatgaatcacatgatgtttgggttttgctacaaaggatccaggaagtggcagtttggaagtatggggagttatagagcaaaagattggctggagccaggcgcagtgggtcactttgggaggccgaggcggggagatcacaaggtcaggagttcaagactagcctggccagcatggtgaaaccccatctctactaaaaatacaaaaattagccactcatggtggcgcacacctgtagtcccacctactcgggaggctgaggcaggagagaatcacttgaaccagggagatagaggttgcagtgagccaagatcatgcaactgcactctagcctgggcgacagagcgagactccatctcaaaaaaaaaaaaaaaaaaaaattggctggaaattgataattgttgaaactgggtgatgcctacttttgtatatgttagaaatttttgacaataaaaagggctttttccaacatttattatgaacattttcaaatatataatttgaaaagaatcatacagtgaacacacatgtccaccacctagattctacaatgaatatttttgctatatttgttttaccacttagctgtccatctagtttttttatttctcctgagacggaatctcactctgtcccccaggctggagtgcggtggctcactgcaacctccacctcctgggctcaagcaattctcctgcctcagcctcttgagtagctaggattacaggcatgagccaccaagcctggctaatttttgtatttttagtagagacagggtttcaccatgttgcccaggctggtcttgaactcctgacctcgtgatccgcctgcctcagcctcccaaagtgctgggattacaggtgtgacccactgtgcccggccatgtccatccagttttcaaaaagttattaaaaaaactttactattttaggcccggtgcagtggctcacgcctataatcccagcactttgggaagctgagacaggaggatggcttgaggccagcagtttgagaccagcctgggcaacaaagttggactccatctctaaaaaaataaaaatatatatatatatttaaaatctttactattttaaataaaaggtaggtcctatattgttttgatgttaattactctggactgtagtttaattcttagaaagtttataagctatttgtggtaacaagaaatctcactgaccatgctacataagttaactctttcctattttaaattatgaaagtaatatatacttgtaaaaattcaaataacctagaaacatggaggaaaacttcctccccatgcctagggcccatcaggaggcatatcagtctgtgtggccaggtcctccaggagttgtgtgacatggctgccctcaccattctcccattcataggaggagtcacagttgaagagttaaattatagagagaataaaaaatataacttaccatgcttccaactgccatcattgccaaaaaactgcagcactattctcacaaaatccttagcattaaaacaaataacaggacatttacatttcattgtttgaaatagcacgttcctagaagatgaaaagaaattcactgatttaaacattaatttgggattttcgaccttggaaaaatattattactactcaactaacagctatcacttagatagcacatacacacattcactaaagaattccaagaggtcactgttatttatcatctgcgttttacagatgatgaaagtgagacacagagagacgagataaggtacccaaggtcacgcagctgtcaagtgcttatccctgggaaacaccccattacctgtagaataagacctacattcctgagcaaagtacacctactctgggctctttagagccaggccccaagatgactctctagcccgttctcccagagctcccctcaaacattctaccctctcgtcgcactaaattccctttcctccaccacaggctgtgccacgtcctgctttgctcctgggtcactgtatatactgtattcttgactacaattctcttcccacagttttcacaaactgttcaagggccatcttcaggaaggtatgccctaattccccaggcagggggctgctccctcttctgtatctcttctgtactcctatccacacatgtagtacagtgggaagtacacttgctgtattataatgtgccttgaacgtttgtctctccattacaccataagcactttgaatatgggactcacaattgttaaaattgactgaatacttaccatgtgccagataccacgctggacacttcgcagcattgtgtgtgaagtgattgttgcactgaaacctcatcactatcctatctggcatgcactagaaccattttacagatgagaaaacttagtcttgaagaggttaagcaatttggccagggttaaatgactaacaaatggcaatgctgggatctgagaccatatcttcctgctgccagggtccaaactctaagctaccaaagccatcaatccctctttatagtaaatgttcattaacacattaagattctttggttagagctgaggaagaaagaaatcaagagcctaatgagctttgcacacttagccaaactgcagttagattttgcttggacttgttccacagaaagacatttgtaggccttttgcactttgtgtgatttcaccttggtttcccttgaaaagggcgaccaggatggtagggagggtaaagcgccaataacacagcttcagatcttggcttggctggaccggtgaggagggtgtccaagagggagtaaagagcttatgaaggagaagaactggggccatggagatcacttccctttactgctccttcatccttgaaactcaagagttctgtgatgaggtaatctaccaactacactatcttccgctaataagagattatttttatcttgataaaacaaacaacaaaaagaataccttgtaagctaaatggcaattagccaggcgtggtggtgcatgcctgtagtcctaaagtcctagctactggggtgaggttgctgaggagggagaatcacttgagcctgggaggttgaggctgcaatgagtcatgatcacaaccactgcactccaacctgggcgacaaagagagactctggctcttaaaataaaacatgtatttatgtatatgtatatacatgcacacatacatatatatatttatatatataaaagctagatttgaggcttcctcctctgtaaaatggagtgaataaggtataacaaacgtacagagagaatgtgaaggtgaagggagagtgtgtatgtgaaaggccttgcacaggtcatttaataaatgttattaaacatgtttttgtgcaaaaaagtatgtgtgctaatttaaatgtgatttatttaaatttattttgaatctcaaagatataatcataggattgggattattatttccaatttatggtacttgaggcaatgtattaatttgattgtcctagaacttataaaaattaagcctcaacattcattcattcaatgataatattgaataaatattgattaagcacttgctttgtagcattgttcttagatattggggatacattaatgaacacactactgaacacaaatgaaagtcatgtggtggggttggcagtggggtaccatctcatacagggtggtcaaggaaggtctgataaggtaattctgtttttttttttttagcttggtaattcttttttttttttttttaagacagggcctcactctgtcatccaggctagagtgcagtagtgcaatcacagctcactgcaggctcaaactgctggacccaagcgatcctccaacatcagcctctagagtagctggaactataggcacatgccactgtacccgggtaatttttaaattttttgtagagattgggtctcactatgttgctcaggctagtctcaaactccagcctcaagccatcctcccacctcagcctgagccactgttcctagccaaggtaactcttgaggaaagacatgaaggataaggtaaacaaaagcctagttggtagaggaaagttctttacaggaaattttagccactaaatgtggaagaaatgatagaattagaaaaatcaccatcttactagccggaattaaataagtgatttagatgatcctaatcaatggacaaaaccattaagggaaagtttgggggagaagtttataaggaagggatcgtgttgacaccacctgaacccactgctccctctcagcaccatgaaaactgggacaacccaattgcatcactaagggaagtcaggaggataccagttaagtctgaatttcagaaaaatcatgaataattatctgaaaaaaatcgaatattttttagggatgtattcttctagtataagtatgtcccatgcaatatttgggacatacgtatactaagaaattagttatttatctgaaactcaaatttagtgtcctatattttaatttgctaaatccggccatccaactgcatcacagatggagtatgaagcttacagctccacctaggaagtgctgcgcaaaacaagctggacccaaataatcaagcatttagagctaactccagtttacagaaaatatggagaagaggagacagaacaagtgaaagaacttcatgatgaggcaaacaaatgaatccaggacacgggacctcctccaagatagggagaggggctgaggaacgctccagattagaaaaaactagggacatggccacccaatgctatgtcctgatcccaacaagtcaactgtagaaggacatttttgagacaatcaggtagcttcaaatttggactgcgtacacaacttgttaagtttaaaaatggcactgtggctctggaaaaaaaaaaaaaaagcccatggtttttagagtcatgagagggcaaaacaatagattgggaatttctttaatcccagtcctctcccccttccccaggaaagggacagaaggaagtaaggaaaaacctttgataatgttggcctgggtggatgtatatactactctgtacctttgtgttttcatagtttactttttgtttgttcagagaaaaacataaaggaatgaggcagtaaaccatgcagctatttgggagaatgctgcagggagggatggtggcaccaggcccttgggtagaggcgcacaccacatggtcaggaacggcaaggaggtgggaatgcactgagaggccgggagagaggaggaggtgaggttgaagacagcggaggggccagagtaagcagacctcgagggcgagggccttcataggtcctgtggcttttctacacttgatcttagccagaagaccaagaagcagtgatgtggggttttcctcagagtgaagcacgagctgtttgagggtttgggacagggaagtgatgtgatctgatttatgctttaacaggccagctctgggtgctgcacagaaaacagactgaaggggcaggtggaagcaggagtccaatgtggaagttcttgtgatccagtaggaggtaacaacttgtgccgagtaacagcaacgcagtggataagcagagggcagattctatctacacttgaaggcagagccaataggacttgctgagagcttgatatggtttgtggaaagtagagagaagtcagagataaccccaggactttttgcctaagctcatggagggctgacactgactaagacagccaggccacaggaggcagggtccagggaagacaggagttcagtttggacatgtttgcctaaaatgaccactagacatccaagtggacaatgtcaactaaattcagaaacatcatccagatattagggctctgtcctcacaagggctctccatacactagacctgaccagttgttctttaaagagaaaattacataaaaagaaaatgaagggttctgttgggagctgaatgctatgtttgtcacacattccccttctccccaaaagttacctaaaatcacccagagcccagtgagcctgtatgaagcatggacaggctagtaacggggcccaacttcctccggagctgccttgattgcctcttccagggtggctaattggccttaaatcagagggctgggaaggcagtggatacctccatttgaggcagaagcccaagtcatgtggataacctaagcaaagaaacagtgaggaagagtacaagatccatcccagaaagggcttttcagaatccagaagggacggcaggagcaaccccgcctgctctaaaattctgtgattctaagagggccggtccaaagaggtgagacaggtcttgcctctttccacagacatggagctttgaaactagtcccatccttggtggtattaaggacaatttattgtttgcaggcagtgataactttgttttctaatgctgtgaatgaatgaacaagtatgataaggaaaatcatctgggactctgccagtgacaggggattttcagggtctgggggtgatgcttttctccctagcttctcactgtgaagttgcttcaagtcctggagccggctgctcccacagaagaacggaactccattccagatactctctgggagagagagggccagtatttgcagagatttctatcacttggatccattttattttcatgtgcccatacaaaacttctaaaagtttaaactattaaaactggaccttgagcaagtttccattagtataaagcaggcatgtaagtagggtgtgagcccatgtgtgaagatttcttaccgggcaaattgttgatgtgcctcctgttcttggtcccagatagcagagtgctctatttgaatgtagatgcatggatcatctgacacaaagccctccagaacaggaccacaggccggggcatctggacagccatggccaccctctgcttggcgttttactaacaccacaattcctctaacagaagaaacgggggtctgtggaaacacaacaaaataaattaaacccagacaacatatctgttgtagaaagacatacattttaaaattaagcagagagaaagagaaaaggcctaaaattaaacttgtaaatgaatagttttttaatgacaattgagggccaaaagccaaacccatgaccttatgctcgaaatctggtctctaccctgtccaacatcataatggaagtctcatccagggcaatatgataggagaaaggaataaaaggcaaacacatcagaaaggaagcatcatactttccctattaacagatggcatgaatgtctgtgtagaaaatctaaaggaacctataaaaaacgaatcctggagctaatatgtgaatttagcaaggttgcaggaaccaagatcaaagcacagaaatttaatatatttttatattctagcaataaacatgtgaaaataaaattttttaaaacgaccatttataaaactctaaaaagtgaaatacttaagtataaatgaacaaaatacatacaggatatgtatgctgaaaactataaaatgctgatgaaagaaatcagagaagacctaaataacgaagacatataatactcaaggatttaaaaactcaacataataatgtttgtcctttatccccaagttaatcattagaaccaagaagatcaataaacctcaagtacaaggaacatgaagaaaactacaccaagaaaaatacatcaacatcatttgcttaaaaccagtgataaaagggggtgggtggcgagagaacacattacatagatagaaacaaagataaggatgacagcagatttctttgtgggaaataaagcaactcagaagatggtatatatatacttttattttattttttttagacatggagtcttgctctgtcgcccaggctggagtgcagtggcgcaatctcagctcaccacaacctccacctcccaggttcaagcaattctcctgactcagcctccagagtagctgggactacaggcacacactgccacacccagctaattttttttgtattttagtagagacggggtttcactgtgttccaggctggtctcgaactcctgagctcagccaatccgcccaccttgctctcccaaagtgctaggattacaggtgtgagccaccacacccagccaacagttgagtaatattatgaaactactggaagaaaataaactatcaactaacattctttaaccagcaaaatgcctttaaaaaaatgaaaggtaaagcaagacttgcatactacactgaaaactataaaacattcctacaggaaattaaagttttaaataaatggagatactccatgtttatggatcagaaaactcaatactattatattaagatggcaagactcgcaaaattaatctatagatttaacacaatttatatcaaaattccagctggatttttgcataaattgacaaactgatcctaaaactgacaagcaaaggaagcacaatacccaaaagaatcttgaaaaagacaaagttggaggactcactcttcttgatttcaaaacttactataaagcgccaataatcagagagaattaggagatcatggcagatgggaggcaggactagattgcagctcccactgggacagacagagcagagtgtggaggcttgcatcgtgaacttttgctctagaatgactacaagaataaatcaggaaagcagaaagaacccacagatcctttgaaggaagcagattgctcctgctcccaggagacaccccaaatactgtgttggtatccacaaccgaaagacccacagacggttcacatcacaggactctgtgcagacaagccccaggacagcttggagcctggtagacttgctgggtggctagatccagaagacagataacaatcattacagctcagctctcaggaagccacatccctaggaaaatggggagaggactacatcaagggaacaccccattggataaaagaatctgaacaacagccttgagtcctagaccttccctctgacagagcctacccaaatgagaaggaaccagaaaaccaactctggtaatatgacaaaacaaggttcttcagcatgcccaaaaaatcatactagctcaccagcaatggatccaaaccaagaagaaatccctgatttacctgaaaaagaattcagaaggttagttattaagttaatcagggagtcaccagagaaaggcaaagcccagtttaaggaagtcaaaaaaatgatacaagaaatgaggggaggccgggcactgtggctcacgcctgtaatcccagcactttgggaggccaaggcaggcagatcatgaggtcgggagatcgagaccatcctggctaacatggtgaaactccatctctactaaaaatacaaaaaattagccgggcgtggtggcacatgcctgtagtcctagttactcaagaggctgaggcaggagaatcgcctgaacccgggaggtggaggttacagtgagcccagatcatgccactgcactccagcctgagtgacagagtgagactctgtccccctaccactccaaaaaaaaaaaaaaaaaaaaaaaaaacgaggggagaaattttcaatgaaatagatatagatggcatatataaaaaaaaatcaaaacttcaggaaacaatagatgcacttatagaaatgcaaaatgctctagaaaatctcaccattagaatcaaacaagcagaagaaagaacttcagagctcaaagacaaggttttcaaattaacccaatccaacaaagacaaagaaaaaagaaaaagaaaacatgaacaaagcctccaagaagtctcggattatgttaaacaaccaaacctaagaataattggcattcctgaggaagaagagaaatctaaaaaatttggaaaacatatttgggggaataatcaaggaaaacttccctggccttgctagagacctagacatccaaatacaagaagctcaaagaacacctgggaaattcattgcaaaaagatcattgactaggcacattgtcatcagtttatccaaagttaagacaaaggaaagaatcttaagagctatgaggcaaaagcaccaggtaacctataaaggaaaacctatcagattaacagcagaaaccctccaagctagaagggactggggccctatcttcagcctccttaaacaaaacaattgtatccaacgaaactaagcttcataaatgaaggaaggatgcagtccttttcagacaaacaaatgctgagagaaatagccactaccaggccagcactacaacaactgttaaaaggagttctaaaccttgaaacaaatcctggaaacacatcaaaacagaatctctttaaagcatacatttcacaggccctataaagcaaaaatacaattaaaaaaacaaaacaaaacaaaaaaaacaacgtataccagcaacaaatagtacaatgaatggaatggtacctcacatctcaatactaacgttgaatgtaaatggcctaaatgctccacttaaaagatacagaattgcagaatggataagaattcaccaaccaaccatctgctgccttcaagagactcacctaacacataaggactcacatacacttaaggtaagagtggaaaaagacattccatgcaaagggagaccaaaagcaagcaagagtagctattctgatatcagacaaacaaactttaaagcaacagcagttaaaaaagacaaagaggagaccagactcatgcctgtaatcccagcactttgggaggcccacacgggcagatcacttgaggtcaggagttcaagaccagcctggccaacatgatgaaactccgtctctactaaaaatacaaaaattagtcaggcgtggtggcttgctcctatagtcccagctacttgggaggctgagacaggagaattgcttgaacctgggaggcagaggttgcagtgagccaagactgtagcactgcactccagcctgggtgacacagcaagactctgtctcaaaaaaaaaaaaaaaaaaaaaaaagacaaacagtaagatgatataataacaaaaggccttgtccaacaggaaaatatcacaatcttaaatatatatgcacctaacgctgaagtgcccaaatttctaaaacaattaatagacctaagaaatgaggtagacagcaaagcagtaataatgggggacttcaatactccactgacagcaccagacaggtcatcaagacagaaagtcaacaaagaaacaatggatttaaactgtaccctggaacaaatggacttaacatatatttacagagcattctactcaacaaccacagaatatacattctattcatcagtgcatggaactttctccaagatagaccatatgataggccacaaaatgagcctcaataaatttaagaaaattgaacttatattaagcactctctcagaccacagtggaataaaactgtaaatcaactccaaaaggaaccttcaaaaccatacaaatacatggaaattaaataacctgctcctgaatgatcactggctcaaaaatgaaatcaagatggaaattaaacaattcttcaaactgggccgggcgcggtggttcacgcctgtaatcccagcactttgggaagctgaagcaggtggatcacaaggtcaggagatcgagaccatcctggccaacatggtgaaattccatctgtactaaaaatacaaaaattagccaggtgtggtggcttgctcctatagtcccagctacttaggaggctgagacaggagaattgcttgaacctgggaggcagaggttgcagagagccaagattgtaccactgcactccagcctgggtgacacagcaagactctgtctaaaaaaaaaaaaaaaaatcttcaaactgaacaacaatagtgacacaacctatcaaaacctctgggatagccctaaacacctacatcaaaaagtctgaaagagcacaatctaaggtcacacctcaaggaactagagaaacaagaacaaaccaaacccaaacccagcagaagaaaggaaatgaccacgatcagagcagaactcaatgatattgaaacaaacaaacaaaatacaaatgataaatgaagcaaatgccaggcacaggggctcacgcctgtaatcccagcactttgggcggcagaggagggtggatcacctgaggtcaggagttcgagaccagtctgaccaatatggtgaaaccccatctctactaaatacaaaaaattagccaggtgtggtggcacatgcctgtaatcccagctactggggaggctgagacaggagaatcacttgaacccgggaggcggaggttgcagtgagctgagatcgcgccattacactccagcctgggtaacaagagcaaaactctatcacaaaaaaaaaaaaaaaaaaaaaaaaaagataaatgaaacaaaaggctggttctttgaaaagataaataaaattgatagaccattaccaagattaaccaagaaaataagagaaaaaatccaaataagctcaattagaaacaaaatgggagatataacaactgacaccacaaaaatgaaaagatcactcaaggctactatgaacaactttacacacataaactcgaaaacctagaggatatggataaattcttggaaagatacaacctttctaatttaaatcaggaagaattagatgtcctgaacaaaccaataacaagcagtgagactgaaatggtaacaaaaaaattacaaataaaaaaagtccaagaccagacagattcacagcagaattctatcagacattcaaagaagaatcagtactgatcctattgacactattccacaagatagagaaagagggaatcctcactaaatcattctgtgaagtcagtatcaccctaataccaataccaggaaaggataccaccaaaagagaaaactacagaccaatatctctgatgaacatagatgcaaaagtccttaacaaaatactagctaaccaaatccaacaacacatcaaaaagataatccaccatgatcaagtgggtttcataccagggatgcagggttggtctaacatacgcaagtcaataaatgtgatataccacataaacagaattagaagcaaaaatcacatgatcacctcaatagatacagaaaaagcattcaacaaaatccagcattgctttattattaaaactctcagcacaattggcatacaagggacatatcttaatgtaataaagccatctattataaacccacagccaacataatactgaatggagaaaagttgaaagcactcaccctgagaactggaacaagacaaggatgcccactctcacgacttcctttcaatatagtattggaagtcctagccagagcaatcagacaaaagaaagaaataaaaagcatccgaatcgataaagaggaaatcaactgtcactatttgctgattatatgattgtttacctagaaaaccctaaagattcctccagaaagctcctagaactgatgaaagaattcagccaagtttctggatacaaaattaaggtacacaaatcagtagctctgctatacactaacagtgactaagctgagaatcaaatcaagaactcaaccccttttacaatagctgcaaaaaaataaaatacttaggaatatacctaaccaaggaggtgaaagacctctgcatggaaaactccaaaacactgctgaaagaaatcacagatgacacaaacaaatggaagcacatcccatgctcatggaagggtagaatcaatattgtgaaaatgaccatactgccaaaagcaatctaaaaattcaatgcaattcccgtcaaaataccaccatcattcttcacagaactataaaaaacagtcctaggccaggcatggtggctgacacctgtaatcccagcactttgggagtccaaggcaggtggatcacaaggtcaggagttcgagaccagcctggtcaatatggtgaaacctcgtctctgctaaaaatacaaaaattagccgggcgtggtggcacgcacctcccaagtcccagctacttgggaggctgaggcagaagaatcacttgaacccaggaggcagaggttgcagtgagctgagattgtgccactgcactccagcttgggcgacagagcgagactctgtctcaaaaaaaaaaaaaaaaaaatcttaaaattcatatggagcaacaacaacaaaaaagcccacatagccaaagcaagactaagcaaaaagagcaaatctggaggcatcacagtacctgatttcaaactatactataaggccattgttaccaaaacagcatggtactggtataaaaataggcacatagaccaattgaaccaaatagagaaaccagaaataaacccaaatacttacagccaactgatctttgacaaagcaaacaaaaacataaagtggggaaaggacaccctattcaacaaatggtgctgagataattggcaagccacatgtaaaatgaaactggatcctcatctctcaccttatacaaacatcagctcaagatggatcaaggacttaaatttaatacctgaaactataaaaattctagaagataacatgggaaaaacccttccagaaattggcttaggcaaggatttcatgaccaagaacccaaaagcaaatgtaataaaaacaaagataaatagctgggacttaattaaactaaaaggcttttgcatagcaaagggaatagtcagcagagtaaacagacaacccacagggtgggagaaaattttcacaatccatacatctgacaaaggactaatatccagaatctacaatgactcaaacaaattagcaagaaaaaagcaaacaatcccatcaaaaagtgggctaaggacatgaatagacaattctccaaagaagatatacaactggccaacgaatatatgaaaaaatgctcatcatcactaatgatcatggaaatgcaaatcaaaaccacaatgtaataccatcttactcctgcaagaatggccataatcaaaaagtcaaaaaataatagatattggcatggatgcagtgaacagggaacacttctatacttctggtgggaatgtaaactagtacaatcactatggcaaacagtgtggaaattccttaaagaactaaaagtagaactaccatttgatccagcaatcccactactgggtatctacccagaggaaaagaagtcattatacgtaaaggatacttgcacgtgcatggttatagcagcacaatttgcaattgcaaaaacgtggaaccaacccaaatgcccatcaatcaaggagtgaataaagaaactgtggtatatacatatgatggaatactactcagccataaaagtgaatgaattaatggcattcacagtgacctggatgagattggagactactattctaagtgaagtaactcaggaatggaaaacgaaacattgtatgttcttacttataggtgggagctaagctatgaggatgcaaaggcataagaatgacacagtggactttggggactcaggaggaaagggtgggaagggggtgagggataaaatactacaaattgtgtgcagtgtatactgcttgagtgatgggtgcaggaaagtagaggaaaggaaaggaaaggaaaggaaaaggaaaaggaaaatgaaaaggaaaggtttttaaaaaaatcaatagagatcaaatttaaaaattttgtgcttcaaaagacaccctcaataattttttttaaaaatatgacagaaattgggagacgtataaataatatatcttataagagacttgtatcagaatatataaagatccagaataaaacacaaataacccaattttaaaatgggcaaaaaatttgaacagacatttcatcaaagaagatatatgaatggccaataagcacatgaaaagatgctcaatgtcactagataatagggaaatacaatttaaaaccactatgaaataccacttcggaatcactggaatggctaaaaaaacagacaacaacatgtgttgacaaggaggtggagaatttgaaaccctagtacactgctggtggaaggtaaaatggtacacccactctggaaaacagttttacagtttcctaagaaactgatgggagcatacattgtcaatcacttaccactggaggggaaggaaagccttaaaatcttgtttctagctctcctatcaaaatctgacactaagaaaatgggcttcttttatggtgtcaagacagcaaataaaaacatcactgtttactaacctggtcagctcctagctgggtggaaccatcagtatacatcacagttatcaccagggctgctgcctgtttgagcatttcaatcagctggctttttgcccaatcatccaaatgcctaatatcacaaaaatgttttttcaatgctcctgagttcccagaatttaggtagccttcggcgtcatcagtatcttcttccaatgccatttgtttacttgttttctctgacaaattattatatgtaatatgttttcttttaagattaatgcttcctttattttcattatttatattctccattaggaaatgctttcttttatgcccctttttctgtagaactgaagcctcttgattatactgtggaattaaacaacttgaaagagtcaatgagctgatgctcttctgtttttggtcagcagacagctgatctgtgagcctgacactgaaggactgaggagacagcttggcagaacctcttgatgtctgacttcttaaagatttaagatcctacagaaaaatggaaaatatttcattagaatatggactcataagacagatctataaactaaactaatttctggtaaaaacttgtctaaggtaatatggagacacaatcttcatattacctatgatcaaaccttctaaggaaaccctatagtgtcttctagagcagtgatttttctcaaccaaggtaggcatgcatatctggatcaagagctcaaaaaccagccaggcgtggtggctcacgcctgtaatcccagcactttgggaggccgaggtgggtggatcacttgaggtcaggaattcgagatgagtctggccaacatggtgaaacttcatcttactaaaaatacaaaaattagctggcatggtggcaggcgcttgtaattccagctactcgggaggctgaggcaggagaatcacttgaattcaggaggtggaggctgaagtgagctgggattgcaccattgcactccagcttgggtgacaagagcgaaactctgtctcgaaaaaaaagctcaaaagcctccaactggcccctgttctgggaatcagtgcatgtaatgagacatgtcatggataggattatgttgcatatgtgcataagagagaagattaataatttacaacttccaagtaaaagccatttgcagagaaaaatgaaatcaccaaaactatttaacaatatgttaatctatctactgaaaaaatgtttttgggccaggtgcagtggctcacacctgtaatcccaatactttgggaggctgaggctggcggatcacaaggtcaacagttcgagaccatcctgaccaacatggagaaacctcgtctctactaagaatacaaaaattagttgggcatggtggagcatgcctgtaatcccagctactcaggaggctgaggcagagaatcgcttgaacctggaaggtggaggttgcagtgagctgagatcatgccattgcactccagcttgggcgacagagcaagactccgtctcagaaaaaaaaaaaaaaaaaaaaattaaacccagctcaatagcagttctctcattccatcaatgtgcaatatgcattcatagatccacaaactaatcaaggtggggaaagcaatcctatccatttcattataggacttatttacgataacactttatttttaaggtttctttccttttccttttttttttttttttttttttgagacagggtcttgttctgttgcccaggctgaagtgcagtggcacaatctcagctcactgcaacttccatgtccccggctcaagtaatcctcccacctcagcctcccatgtagctgtgactacaggggttcaccaccatatccagcgaatttttctatttttagtagagatggggtttcaccatgttccccaggcaggtctcaaactcctggactcaagcaatctgcccgccttggcctcccaaagtgctgggattacaggtgtgagccaacatacccagccaaggcttattttcaaatttactttatatatatatataaatttactttatatatatatatatatggctttgaataactatattaacattacctttaaaataattttgaaagaaaatgttttaacacttggtcacatgttatgaaaattttaaatttatacttgtatttttattgcagagaaatatatggtttccaagagtaggctttcaagcataaaattacattaaaaattccatggaggagtaaacaagaaaaggaattcaaggagaaaaagaaaaatataaaatttcaaactgttgaagatcttactctgtcttttttaaggggatgattgtgggctgggcacagtggctcatacctgtaatcctggcactttgggaggctgaggcaggaggactgcttgagcccaggagttcaagaccagcctgggcaaaatagcaaaaccctgtccttttacaaagaatacaaaaattagctgggcatggtgtcatgtgcctacggtcccagctactcaggaggctgaggtgggaggatcacctgagcccaggaggtcaaggctacagtgagccgtggtcacaccacactgcacttcagcctgtgcgacagagtgagaaagtctcaaaataataataataataataataataataataataataataataataataaaaaaaagaggccgggcatggtggctcacgcctgtaatcccactattttgggaggcccgggcagatggatcacgaggtcaggagttcaagaccagcctggccaatatggtgaaaacctgtctgtactaaaaataaaaaaattagccgggcatgatggcatgcacctgtaaccccagctgcttgggaggctgaggcaggagaatcgcttaaacccaggagacggaggttgcagtgagccgagatcgcgccactgcactcctgccttggtgacagagactccatctcaaaacataataaataaataaataaataaataaataaataaataaataaaatagtccaggcacggtggctcatgcctttaatcccaacattttggggggctgaggcaggcagatcaccagaggtcaggagttcgagactagcctggccaacatggtgaaaccccatctctattaaaaacacaaaaattagctgggtgtggtggtgggcacctgtaatcccagctactcagaggctgaggcaggagaatcgcttaacccaggaggcggaggttgcagtgagccgagatcacaccactgcactccagtgcaggtgacagagcgagactccgtctccaaataataataataataataataataataataataataataataataataagaggattgtggatatcaagttgtcaaagtgcatatttaattttcgtgaatatattttaaatggtaatgtaacagtaaaaatgtcaatattaacaatagagcagaaatcatgtactttgcaattttttaaacttgtgataaggattttaaatttcaactttaaaatatgtcaggcagtacagatagtttgagaagtccaggtatgggggctcatatctgtaatcccagcactttgggaggccgaggtgggaggatcgcttgagcccaggagtttgagaccagcccgggcaacatggtgaaaccctgtctccaccaaaaatacaaaaattagctgggcaatgatggtgtgtgcctgtagtctcagctacttgggaggctgagttgggaggatcacttgagtccaggactcaattaattagctgggcatggttgcagaggtggaggtagagattgcagtgagctgtgatcacaccactgcactccaccctgggtgacagagtgaaggcctgtctcaaacaaacaaacaaacaaaaacaacaaaattcttttgagagaaagggagcaaaaagtttgcagacccctgccttcgggatccaaggagcacagtctgttcaccactgagagatacaatttccattcatttacagagggaagaagagaagagtcccttctctgtggaagatgcctcttccctccactccaagggcagataatcatcctatgaacccaggggcaaataatcatcccatcaacccaagagacaggtcctattatctcactttactatagggcatttaggtttaaatttaattaggttgggagttgaacacaggtagtttactccaaagtccattctcttaaccactatgttgcctgcaccactttcatacacaaggtctttggtgatacgacctctctggcccacaccacataactcacccattgtgaatgttatagccctgcctttctgaaattctattatttccactacccaaagttccaagctttcttcccttatctgaaaaatttctcaatgttttgcctctactcccttaaaggtggggatctttttattttttatttctattttttagacactgagtcttgctctgttgcccaggctggagtgttgtggtgcaatcacagctcactgcagcctcaaaatccttggctcaagtgatcctccagcctcagcctcctgagtagctgggactacaggagcatgccaccatgcccagttaatttttttttttttgtattattttttgtagagacagggtctccttatgttgcccaagctggtctcaaattcctggcctcaagtggtccaccctgctcagcttcccaacgtgctgggattacctgtgtgagccactgcatccagcctaggtcgatcacctcctaattatccaatagatctcaactcagatataattttcatacttcagaaagacatccctgactcttctcctcaacacccaggagggcaaaatgaaatagcacaaaaactgagttagatgttcctcctattgtccccagagcactctgaactaacttctctcatggcacctacttgcccctccctgcatccaaattaaactataagttcttggagagcaagaacgcctctttttttttttttaaggtgtggtatctacagtgcctagcacacagtagaacacttaataagcatctattgaacaaataagttatctatttaaaattactcatatgtgcaatgatttacctttttttctggtgattgagtcttcctgtcttcaagttgtactgaatacttaacactggacttgtttatcacttccatagcttttaaaaacaacaaaaaagaaacatggggcattaaagaaacattgatatctaagtcacacagttaactaaacactgaaataacctctataatcatgcttatttattcattattaacttacttaaaacaatgtaataaaattcacaagtaaaatgcttagtaccattgcaataaatatttatgtaaagtaccttcaagttaactgaagataactctatataatcataaaacatttattaaaaatcattatttgacatttgcatttgaatacatgactctaaaaacccaaggtcaacttttatagaaaccttaaaaggattaaaggtttggggaaattcttagactgaatactgcagtggaacaattgaaggttcagtaaaacatcattaaaacaaacttctaatttagattttgatttaatttcaataagcctgggctgaacagtaagtgacagaaccaggatccaatcccaggcaataggatttgggagtctgtgctcttaaccactgtgacatacatttcctctgcaggaacaataacaacctgaaatgcaaataggggaaaatatttcacttacaatataaaaacattatacttaggataaatataacaaaaaagatacaaggccctcaatgatgaaaatgtaaaatcttattaaatggcataaaaaaagatctgtacaaatgaaaagacacagcattaggatatagatcacaaaatgtttaattcttctaaatttaaggcaattccaattggagaccctacagggatattttaatttaataaaataatttcaaagtacgaaaagacaagaaatgtaagcttaggccgggcgtggtgactcacgcctgtgatcccagcactttgggaggctgaggtgggtggatcacctcaggtcaggagctcgagaccagcttggccaaaatggtgaaaccccacctctactaaaaatacaaaaattagccaggtgtggtggcaagcacctgcaatcccatctacttgggaggctgaggcaggagaattgcttgaacccgggaggtggaggttgcagtgagccgagattgcgccactgcactccagcctgggttacagggcaagactctgtcctgggaaaaaaaaaagtaagcttaaaaaagagagagagaaaagacctctagaagagaacagacaacccagagactgatcccaagactttatatacaacaaagatagtatttcaattcaatagaaaaggatagattaattaatagggctggtataactagcaccacatcaaaaagaaaataaatgcattgggaaaactatttggaacaaaaatgacaaagggttaactgctatattatacaacaagttctcatacatttacaagataagacaaacaattcaacagaaaaatgagcaaagaataggaagaggcaatacacaaaacagaaaacccaaagaggaaacaaatacaatactcagggaaacgcaaattaactataactggaaacacaggggaagaggtagtctcatgtattgctggtaaaaatgtaaatagactctttctagaaggcaaactgtcaagacttattaaaattaataatgcatacatcactttgggagttgggtggagaaagtgacccacagggagctcaagatgggcctctgggaatgctagttatgtttcctgaactgggtttgggtttgtgaaattttgacctaaactaaacttaggatatgtgtgctgttttatatatatacacacacacatatacacatacatatacatatatatgtatatacatatacatatatatgtatatacctcagccatatatatatgagagacagagtgctcttgccttaacaaaaacagataggaaataatatccatcatctaaccaaataatctctaaccaaataatctcactcttggctgtttcacagaaatatatgcaacagtaaacaggtttaaaccaaaatgtttatagcagtattgctcattatggcaaaggactgaaaataaagtagataccaatcagaagaaaactgaggaataaattacataatatccacatcatgaaatacatagccactaaaaagaatgaccttgttaaaacatagattgcaggggggaaaatgactccagctatagtggttgactgaagatgatgacctcatttttaaaaataatgaccaaatctccccgcttatgcacacgaagatgttacgcacataacactcgggtaccctgggagaccacctctgtgatgaaggtttgcatttgaaaaggtgattggagagtgaaggaagcagaatccaaccaaggaagacaatggctaagatgcagtcactcaaaggcctgccctgagctgagcatggtcctacagatgtgtctcccaatgggtcaagacagctgggcttttatacccctgcacaaactagtcactggaccagtcactcctggggaaggggtgggcccttgggcaaagaagttctttgcagccaggcaatcagggaggggctgtcccaggagcagggacagtgcttcagtactaaaggggcatatgggaaccacagtgcttgctacactccacactgcactgctcatagccacttgcttcagggacgttctgggagcagctcctgtaggattctggcgggccttttccttgggaaatttataaaaggaaggcactgggatgaactacatcttgctgcagctggcctcaaggttgcaaattacattcatctccctcctctactgcccatgctaactcctcacccttgcctatctcctctgctgctctaggtggcttagcttacctgatcaggtaacccaaaccctcatccctgagaggtaagcccctggccaccatgcccttctctggccatagccccagcatttgccatcaaatttgggcaggggaccatgaggtggccaatcacatcacctgggtgcttccctgcccccagttatgtagtaacagctctacctccacctgacgcccacggtcagccaccccagaagatggaaattacattccttgccagccagtctcttggcacaaggagctcaaaatgaccagacagcagccacagctggaaattaaatggcgttcttcctgtgcccctgctggaaaggttttccctttgagagtcaagacctttaaaccttaagaacccagaggagtgtgagggagaaatacagatttctaagtgggtcactgggagtgatgactttcaccttttggttcccagacccatttattacacaaaccaaggacactgcaccacgtactggttagtgatttgcagtgcagactgcaccctggaggtgactgcttcatcacaggtgtcacctccaggctgcacacgaggtgagctgtgccttccacagaccatcctgctgctccatcaggctggcagcttcttggtgtgtggctgtgagggagacagtgagtcctactctcatgtgcccactgctgcagttccttggctgagcgcaggatcctgtggatcaaacactctgtgaaacttgggtgatggagctgactgaatccatgagaatgggaaaggcaaacccatgcctgtaacgtgtgttggttctggccaagatgaatcactgtaccttctagggcacaaggggttcagtgttgtcaaatgactgtttccctccaaggaaggtacaactggggactcagtgtttggtctctgttgctggaagattggatgttctgcagagaaatagctaggtcagctctggtgagggggagccccatgctatgggccatgcacagcatctacccaccccatgattactccatgagagagcccagtgtgccagcatgggcgcagcagatggcagaggctagatgtcaactggccaagtcatcctattaatgtggtggtttggtgtgtccccatggtgaatgttcttgggtgggaagtacttcgtgactgttcccacagatccctccacatgccttactccaggaactccctgatcttccaatctttctcattccaggtacctgagcaacctgtcaagccactaaccgctgcccaagagttccaaatgtgttaacactggggccacttctccttccacacaaagtagatagtcaaggggcaccacccaacgttctacccattgggtttcccttgagcactgtcttccagggctgcctaaatcaggctgttcagagcccacccaccatgaaccaagctctaacttttcctgcctccatcagctggtcttaaggctgcccccgtcagaagtaccagtgccagcaccaatgatgtcatgggttctgggccacatgaaaagcttggttgtgcctgcttgtacctagtactaaatgagccacttccaacttgcaatggacagctgcatgcccacctctcagtgggtctgacagaaccagctcatgctggcagttctggctcatggtcacttgatgtcaccatggcctcacgctccatctctaccagggcccagtagcatgacagttttgtttttgaaaaatttataatttgtttctgcagatagcattgccttgctccagagttctaggagtctgcattgagattcttctgttggggctttgccttaagcttcacatggcatctttccccactacagatacctctaacatcacaaggtctgttgggttggaagtccaagtagctgagccacttgcttcacagcctaggcctcttacaggatgctttcctatgcagtattcccaatgtggaatatgctgcctccactccctaaacccagagatgcctatcaggtgttatggttcactcttaatggttatgtggttaaccacgttgcaggatgactcgaccagttaacatcttcattcttaatgcttcattcttaaaaatgcagtaatttagccaggtgtgcacttgtagtcccagctactcgggagactgaagcagatcactttgaccccaagagtttgaggccagcctgagcaacacagtaagacccagtctcttggggaaaaataaaaaataaaaaaaggtggccaggcgtggtggctcatgcctgtaatcccagcactttgggaggccaaggcaggcggatcatctaaggtcgggagttcgagaccaccctgaccaacatggagaaagcccgtctctactaaaaatacaaaaaaaaaaaaaaaaaattagccaggcatggtggcgcatccctgtgatcccagctacttgggaggctgaggcaggagaatcgcttgaacctggaaggcggaggttgtggtgagctgagattgtgccattgcactccagcctgggcaacaagggtgaaactgccttaaaaaaaaaaaggcactaatttgtcctttacttgcaaggggatatcctacctatcctcagaccactgaacttccaaaaacttcatggttgtggtgggccccagaatatctgtgtgcttatctcccatgttttggacagcaagacagctaacaaacttgccatttcttgcttatgctgattggcatgatgtcatcaaaacagtgggtggcgggataacatagcactggggcaaggtgcaaatttatattgtccattcagagtgaatatttctgcagggatggaaaagaatgtgttcaccaaatcaataattgcatttcatatacctgaggccttgttaattgcatatgccacatccagcccaccagctgtcattagggctataacttggtcacaactatttgtggtgtcaattgttattctccaggatctgacttctgtgagcacctacctggtgaattaaatgaacatatgacagggaccaccctgtgccctgaatcctgtaggggtttaaggatggcactaacttctgccatttctcctaggttgccatattgctatactaattcactatctttgctgggaaggcagtttcagcgtcatccacttgagcttactcactaggagagctctcatcctcaggccaaggagccagtacctgagggttcttccaacagtctgttcattccaaataacatgtggggacttggaaaatggcttcggagtgagccctcccattatagtgtaatctgggccaaggttccatttattgcttgagtccttgcgcctctgacggagaaaccatgatgatactttaggtctccaggtatcaatatcatatgaatgtttcagtatccctttcccccttgtataagttcccagagtaaatggccacaggtttccctggcggaaagacaggaaaaataactgccatatacactcactatggtgttgcataatccttcctcctggggacctggcctctccttcagtcagttggttccaggtctgaagtcactttacgagaactgtatctaccctgcttctgacaggcagcaccacctggcctctatgtcaggatcctatctccctgactgttatcaggaggcatctcctattatcagccctggtctatagcagacaccactgagattctcagtgaagccgatgctccccactccctcatcagctttcattattgcttcggtaaatagagcatccagagcgcccttctgcagaacaatgttacctgctgagtttcccagccctccacaatatggccattctagcatgtccacctctcctggcttttcatgccttcttttaccatctgccctggcagttctaatctttctccttcacttagtatgaaccctctcctacaaggaactaaaagccatcctagcagtatgttggcaccacctcttggaatcttcatcgggttgtcaaatccagtgtctctgaagtgatcccgcataaataaactctcccttatccaaccttagttccacctgccttgatccagcaccctcagacccagcccaccataggtactctcccaggcctgcttgtatatggccagttaggtcctgcagttcctttggagtagaatctctttcgtccctgtgccagttatcaacatactgtctcccagctacaaattcgcctctcagctacaaattcacccctcgttgcaccccacgccctacagaaaatacacctcctttgccacctggcacgatgttaagctccgtcagcagagggtgctagagggacgctgtcagagatgaggcctctgctgtgctttgctttgctttcctttcttcttgctcctgcagctcttaaccagtgtactagacacccatgagcagccccactggccacttcccagctacttctgcagacattctagccagccctccagcaagtttcagtcaatccccgtgggcagcttcctactgagtttcacaagcacccctaccaacttctcagtgagtttagtgataccccataggtgggttcccacttgccagactgactggcacttcagccaacttcttggccacccagtgggctacatccacaacctctgacagtctgaatctcggccttgaggggagagaccctgctaaatttgtcccttccttcggcaccccacttcagccctagcaggggaggctgctccctgtctgctcttgctggattctttagagttttctctaaagctattcctggtagctactcctgctagttagtaatgccttaaacattccctgttcaaattactctacggtttctgtcccttgactggactgtaacaggcccagtacttttcgacagggttattttgtgacttaatgaccaggagaggaggagggggccgcaaaaaagaaaaagcctgaacaaaacatttatgaatcttttcacaatttcttatgaaatgacatacgtatgcatgtgtataactatacaaaaagatctggggaattatgaactttgtttgttttttctgtttctccctccccatcccaaaaacttctcctgaagtattattacataatgacggagcatgtcttatttttcaagacagaagctctccattgttctccagcaaaggtggggggaagcgctcagggtggggccatttctgcaggtctcagaggtatctgatactcaagatttattttttaaataaaatttattattattatttttgaaacagggtctcactctgttacccaggctggagtgcagtggcacaatctcagctccctgcaacctccacctcccaagctcaagcaacagtcccccttcctcagccatccaaatagctgggattccgtgccatcatgccccactaattttttgcagagataactgtgaaaggaaaataaaatcttgggaatcccaagtcactaagctaaagggaaaagtcaaggtgggaactgcttagggcaaacctgcctcccattctattcaaagtcaaattctatgcctctgaggttcacctgagacaaatggggatctgattgcttcccctccccactgtttatgtaaaaatacagattcactaaattgtgtattcagtggaaggctgatcaaggactcaaaagaatgcaaccttttgtctcttacctactttttgtttgtttttgaaacagagtctcatcctatccttcaggctggagtgcagtggtgtgatcttggctcactgcaacctccacttcctggttcaagggattctcctgcctcatcctcccgagcagctgggattacaggcacctgccaccatgctcggctaatattcgatttttagtagagacagggttccaccacgttggccagtctggtcttgaactcctgacctcaagggatccacccgcctcagcctcccaaaatactgggattacaggggtgagctatcgcacctggcccctcttatctaattctaacctggaagccccctcttcgagttgtcccgccttaccagaccgaaccaattacatcttacacatattgaggtttcatgtcttcctaaaatgtttaaaagcaaactacccccagccaccttgggcacgtctcaggacttcctaaggctgtgtcataggcatgtccttaacctaggcaaaataaactttctaaattgagacctgcctgttattttgcattcacatgggtttcgccatgttgcccaaactggtccgatactcaagattttttttttcttggctccctgtggtatttcaatcaagatttaaatataccaatccaaaggttcccatcctgtatctcagggtctggtccctctttcctcagatcaagaccttaatcttggccaggtggaggtggctcatgcctgtaatcccagcactttggtaggctcaagatgcccaggaattcgagaccagactgggcagcatggtgaaaccccatgtgtacttaaaaaacaaacaaacaaaaaaaaaactagccgggcatgcacacctgtagtctcagctactcagaagaatcacctgaggtccggaggcggaggttaaagtgagcctgatcagacctccagcctaggtatcaccaaaaaacaaaaaacaaaacaaaacaaaaacccctagcacaccaccagggctgaaaattcaagtttctctggagcaatcaggactaagtcttgggtctacggctacaggctgtcactttataggctgcccaggaagccctctggctttcacgtttagcctttaattgcttatcacccacggcctttttttttttttttttatttttccacaggatctattattcccagccacagccatccaattccattgtcttcaactgccttgtacttctcagatgtgcagtattgtcccagctggtgcagctgctcccactagtaagccagacaaacccaccttgagccaaaattttaactccactgctaccatctgtattgcacccacaacttgtgatgaggtcatcagtgccagcttacctgcgggagaccaaactccaaaatcacatgtctactttctcagaccactcctgccaccaactgtagcagatcaggttccctgagactgagatttgtcagcagaaagtttactggggagtggccttggagatcagaagaatggagcctggggaagctgaaatgtgatacattgcaagaaatgcctcagccaatgccacctgacgaggggggttgggttggcacagatatatacaagccataattacagtcatgcagggatatgttctgagaaatgcatcattaggtgatttcattgttatgaaaacatcatagatcaagggtccccaacccctgaagtgaggaccagtacctgtctgtagtctgctaggaacaaggccacacagcaggaggagagcagcaggtgagtgagcattcccacctgagttccgcctcctgtcagataggcagcagcattagattctcataggagcaagaactgtactgtgaactgcacatgcaagggataataggttgcgagctccttatgagaatctaccgcctgacgatcttaggtggaacagtttcatcccaaaagcatccacccgacccccatcccgtggaaaaattgtcttccatgaaaccagtccctggcgccaaaaggttggggactgctgtcatatagtgaacttacacaaacctagatggcatagcttactacactcctaagctgtatgatctagcctgtagctcaaacctgtacagcatgtactaggctacaaagctgtacagcatgttactgcactgaatactgtaggcaactgtaacacaacagtaagtatttgtgtatctaaacataggtaaaaatacagtataaaagattaaaaaatggtacttatatagggcacttaccataaatggagcttgcaggacttggcatttgctctgggtgaatcagtgagtggggagtaagtgtgaaaccttagtgcattactgtacactgatgtagacttcacaaacactatacacttaggacacactaaatttatttttaaaaattttctttcttcaataataaattaacctcaatgtactttaacgttttttactttatacacttttaaattttttaaacttttgaactcttttataacatttaccttaagacaaaaacacattgtacagctgaacaaaaatattttttcttcatatcttgattccataaccttttctctattaagatatttaactttttaaaaaatgttcttaactttcttaaaactaagacacacacacacattagcctaggcctacacagggtaaagagcattagtatcactgtcttctacttctgtatcttgtccccctggaaggtcttcagaggcactaatacatatggagctgtcacttcctatgataagagtaccttcttctggatacctcctgaaggacctgcctggagctgttttacaattagcttttttttcataagaaggagtataccctaaaataatgataaaaagtatatatagtatcgtaaatatataaaccagtaacacagtcatttgttttcaagtactctgtactacatataattgtatatacaattatacgtagtatagtacagtgtagtaggctatgccatctaggtttgtgtaagttgactgtatgacatagctatatactatatacagagtgctatacttttatacacctggtagtgcagtaggtttgtttacgccagcatcacaacaaaaacataatgcagctgggtgcggtggctcatgcctgtaatctcagcactttgggaggccgaggtgggaggatcacctgaggtcaggagttcaagatcagcctggccaacatggtgaaaccctgcctccactaaaaatacaaaaattagccaggcgtggtggcaggcacctgtaatgccagctactcaggaggctgagacaggaaaatcacttgaactgggaggtggaggttgcagtgagccgagattgcaccactgcactccagcctgggtgacaagagtgaaactctgtcttgggaaaaaaaaaaatgtaatgcattgtgctatgataacagtacagctatgatgtcactaggagacaggaatttttcagctccattataatcttatgggaccaccaacatatatacggtctgtcgttgaccaaaacatcattcattatgcaacacatgactctccaaccatataaattataatcatagaaaaaaattaacaaaaatataaaaggcacatactaagttgttaacatgggttaacaataagggagagggttcgacaagcaaaaaaaaccttgaaccttctcacaattttatattaaaactatgtatgtatgcatgtatataaatatgtaaaaaaaaatttaagaaaaatgtctttgggaagccgaggtgggtggatcacttgaggtcaggagtttaagaccaacctaaccaacatggcgaaaccccgtctctactaaaaatacaaaaattagccaggcatggtggtgggcgcctgtaatactggctactcaggaggctgtggcaggagaatcccttgaacccaggagggggggttgcagtgagccgagatcgcaccactgtactccagcttgggtgacagagcaagactccaactcaaaaaaaagaaagaaaagaaaagaaaattgtgtggaattacagattttagttttttgtttgttttttctaaaaaaaaaaacaaacacttttcctaatgtattacaaaaagacgccccaaaaatgttgtggaaaaaatttataatactaaaaaaaaatagtaggccaggcaggcacagtagctcatgtctgtaatcccagcactttcagaggctgaggcaggagaatcgtgtgagcccaggagtttgagaccagcctgggcaacatagcaagacctcgtctccacacaaaaataaaaaattagccagacacagtagcaagtgcctgtagtcccagctactcaggaggctgaggtgggaagattgcttgaacctgggaggttcaggctgcaatgacctgtgaactccagcctgggcgacagagcaagaccctgtctcgaaaaaaaaaaaagtaagtttatctctctcccatgttctgaggtgaatggtctcagtaggtggtatagctgttttttaaagtcactcaggggcccaggatccttctagcatgttgttccacaatcctctaggacactgttatcatttgcagggttggagaagaatcatttcagctccaaccgatgggaagcaaagaggccagagaagcaggcaggctgtcttggagcctcccttggaaatggcacccgctgagctcacaactcactgacaggcacctggccacttggtcaaacctgactgcaacaagactgagccatgtagtgtaattgtgtgcctcagaaaacaaggatggattcaacgtggtaagaaatgagtaatcgctgccaaaaagttatctggaataatttaaaatgcccatgattatgaagtggttgccataaaaggcaggataattaatggttacatttcagcagggagagattttaattgagaagtaaattttgaggtgttggcaatgtaagtggtagttacatggatgttctcttacattaatgtgttttgcatttttagtgtttttcatgacaaagtgtttctaaataaggatctatacttgtttcaagaagatataacagtccaatctttactgaatgtgtatcttgagtcacctcagtcagtctagcagataagaaaattagaccccaaaatgacaagtatcacaggtttaatacagtttggtgtgacttagtgtttgtaaaagtaaatatgtgtagtttatttccattaatttctgagttgaaattccatatttatttggtatgaaataggctcatggaaataaaaggctaatttacaatatttttcttagaagaatttgacataacagctcagtatttcacaagaatccagagtcaattaaaactttaggtccagcatcactcatcaataatccaccagcaatccaactttaatttggattcatatgatgaaggaataaaactggtgagaatctgtggtggaaagactccaaggtggccctatgatccctgcctcttggtatcatgtcctcacataaccccaaaccgctttgagggtgaatgggactattgattagcttctaaccaacagaacacaccaaaggcagcagcatgtatttgatcacattatataaaactgtaatgtcagtgctgctagggaaagtgagctgccatattgtaggttgcccacatagaggatcacatgacaggaactggggatgccttccagacaccagccagtgagaaactgagacccttggtctgaaagtctacaagaaactgaattctgtcaacaaccatgtgagcttagaagagaatgcttccccactgcagcctcaggagagacaccagacctggctgacacctggagtccacccttgcagaggacctagcagagtcaggtccaggctcctgacgcacagaaactgtacaacaataattgtgttttttaagccaataagtttgtattaataatgttatacagcaatagaaaatacaaaatccttatgaaaattccactatttttacaaatccaagagagaaaagtagtatcatatctttttctattaccttctcaataaccttaacaaacaaaagccagaattttaacggggtattttattttcagagatgagatcttgctatgttgcctaggctggactcgaactcctgggctcaagtgatcgtcccaggcattaacaatgtattttagaacaacaataagagcttatatgagatggactgactgtcgtaaatttttcatcagagcctcatattatagctgccagaggcatttcattattcttaccggtttttgaaggggagtatatttccacctctgtcaagtatgcaccctctattattcaaaaaaatatggaataatgtgattatgatagtgtcttacactatcaattgctaggcatgtaattcacactcaaaaattcttaccagtttattagtgacttctactataataaagtatataagcaacagatgcctcaatatgaatggatcaaaacgttaagtgcaaatgtatcttaatcaagatgtgtttataagagcttttgtgctaatattcggcaatactctcaattatttcaatgcaatttcattactcaattatatctcactcacttataccttattttgtagaaagagaaaccaaccacaaactattggcccaggcttgcaaatttaaaataaaaactgctttgctagtagcaaaaaaaaaaaaaaaacaccaacaaaaaacaaaacaaaaaaacaccaaaagccctgatgttataaacatttcagtgacatttgtgagcatatcactgctttcacttttttttttttttttttttgagatagagtctcactctgtcgcccacgctggagacctcagctcactgcaagccccgcctcctgggttcatgccattctcctgcctcagcctcccaagtagctggactacaggcgcctaccaccactcccagctaattttttgtatttttagtagagacagtgttttaccgtgttagccaggatggtctcgatctcctgacctcatgatcgccgacctcggcctcccaaagtgctgggattacaggcgtgagccaccgcacccggccccactgcttttactattataccacatcataaatccatatacactgatccaataatccttgccacctaagagtttacatttctatagcagcacaatacacatattgtcaaaaacatatctcttgttcaccacacaaaatagcaaatactatgtacaggtttgatgacctgagaaccaagattaaagcatctcttttgaaaatactaaaatacctgatccagattctaagggaatgtttgacagaaatacctggaataaggaagagagtgttacatttttaaagcaatgaaggttaagggaacacgaaagttagcaagcagaagctcagtctgcactgaatgagtgtaaaaggggcgggagctgggcttcatctgtctacatgcattccattttcaattcttagtctttagaacaattaacattcaaagtatcaagagaaagaaaggttcataaaaattacttactctctgtactctttccccaagtcttagaatccactaaatcacctgaatgcatagcagacataatcttctgagcaacactggagagcggtgtattacagagatcaaagcctaccaatgcctcataattttccattttcacaaaatcctaaatgtaagattaacataagataaatcccatatattaatcctaagactataaaacaggaaatacaattattttcaaaaatttatataccaactttcatttaaaatgtctatattcataaccacagaaaataggcatcaatcatccaataatatagatagaaagaaaaaagcaaaatagctagaggcttaatccaggtatcatagtaaatagataacttattttctaggtgaccaatttagaagcaatctactcaaatacatcctgaggtttgaaaaatgttattaaatcttcaaataggctgagcgcggaagctcatgcctgtgatccctgcactttggtagactgaggcgggtggatcacctgaggtcaggagttcgagaccaacctggccaacatgatgaaaccccgtctctactaaaaatacaaaaaattaaccaggcatggtggcacctgtaatcccagctactcgggaggcctgaggcaggagaatcacgtgaacccagaaggcagaggttgcagtgagctgagatcatgccactgcactccagcctgggcaacaagagtgaaactccgtctcaaaaaataaaaaataaataaataaataaataaatcttcaaataaacctacctagtaacacaacgattataagtaacttgggtaattacggcagacacacaactaccatccgtgccttgatctgccctgctggccccctgggctgagcaagtcaaggtttgggtggggacagtataaatcaagcatctgggcaggggcatggtggcttacacctgtaatgccagcactatggaaggccaaggcgggtagatcacttgaggtcaggagtttgagaccagcctgaccaacatggtgaaaccccgtctctactgaaaatacaaaaattagccaggtgcagtggtgcacgcctacaatcccatctactcaggaggctgaagcaggagaatcacttgaacctgggaggcggaggttgcagtgagccgagatcattccactgaactccagcctgagtgacacagttagactctgtctcaaaaattaactaataaatcaagcgtctggccacacatctaaatatgtgacactaatttaaacagaatatgctaccataaaccaggaaaccaggtgacatattttccacatttttggagaaaataaaaattttaagtaaattctctattccgaaatagaatagaaaaaaacatatacaacaaaaaaaaagttgctcaggtgatagggagctgatagcaaaatcttaaacaaaatttactgctacaaaattaaggtttacataaaattttaaataacataaacacaataattggcaaaatatttttgttcaatgggtttcaaaaatcaagaaggttcatctgtcatctaggtatgcctgttttctgatggttatagctaaaaaattccataaagaccacccaaaacatgtagtttttagattggcattccatattacgaacaggtgaggaatattcttaaaggtattcctacaaagctcacatggtatttaccacaggccatgtataaattgggcactcaagaagcatctgatgtaataacagatgagctacttcaaattattttagagcaacgcttaaaatattttctggctgcccaaataccattgttaaatacaattagacatttttgctcttaaactgattaaaatagtatcatacatcttttgagcaaccacttttacagaattttgaaattcaaatttcatttgaaagtcatttatgatgtgtaagtcacattaaagtcaaagcactgctcagctgtcttgtagaaacttttgagtccccagaattcagactctaaaatgaatgcaggcaggccaaggaagtcctaatactctgtggtacaagtagggacattaaaacagcctaaaggtctatagcagggaattatggaggaatacaatttgagcagcagaattttatttgacagtcaaacatgaggggacttggctatttcacatattaaggtctacagatttaaaaatgctgactagaagttctacacattttaaaatatttaatagcggctgagcgtggtggctcatgcctgtaattccggcactttgggaggccgggagaggggatcaagaggtcaagagattgagaccatcctggccaacatggtgaaaccccttttctactaaaatacaaaaaaattagctgggtgtggcggtgtgcgcctgtagtcccagctacttgggaggctgaggcaggagaatcacttgaacccgggaggcagaggttgcagtgagccaagatcgtgccactgcattccagcctggagacagagtgagactctatctcaaaaaaaaatttaacggcagaaaatttctatttctaaaaaggagagagataactatattaaaaaatatttgcattatgtaataatgctttttccctgtaagtaaaaaattaccaggactaagtaccactaaacacatgctcaagtcataaaaagcactggtattctgaatgtactacatgagaaaaaagacaaattaatataatagttcaattcatcaaattaaatgttccattgacctcaaattttaaaaatttagtagtgtttattatacacagtcttctaataaataaaagaggacacgtaataaagattcagttttcagtaattttcaatcttcaagactaacagccttaatctttgattgagtttctaaattctccacaatatctttcagataatcttcatcttttaaaaaatatacatagaattctctttccatttgatgtaatttattatttgccaaagtttttctttttgtcttcacatcagcaagaatatcagtgaggagatgatttagcttattcagttgagattcaactttatgaaactgctctgttaactcctaaaaaaggaaaataaaaataaaaattaaaacactttattcctaataccaattataaaattaaaatataatttacatggaaagactttaaaggacttaataacttcccgcaattttagcaataaataaacctcgatttaaaatccataacaggtttaatataaattctaagtaagattaattgcaacaacttctgatagataattttaagtgattcaaaggaaactcttgctgaagtgtactcgatatgtaagctgttctgtgcattcatatattcaacaaatgctattgtgccaagtactgttttagagattactgatacaagaataaacaaaatctccctgatggagcttatattctgcttaataaatcaaaccttgttttagcctattctctgtttattctggacagaaggtacagagaaagttgaaatgaagaccaataaaagagaattagctcaacacaaatctccatttttcattttttcatattgtcttaccaaatagaattacacatgacattccacgaaaaccatcctaatcatataattttcctgctcaagaatctagccatgccgacccttcatatttattacagtaaattcaaattcctcagtgtctagcatttaaaccagattattaacaagtttccatagctttctaatcaagcattctacttataaattttagccagtatcaccaaagaggttctcagaaaaatctgttgctctaactaccctcaattttccacagcttctaggcatagtccacaagtatcataattatctgaggtacttgttatgaatacagattcctgtacccccccactagactaaattacttaatctctgtacagagctaggaacctgcgttttgatacgctccctgatgattctaatgtacaagttcaagaatgactacttaagacctgtcataaatgccaattcacagaggagtacttcttaaaatacatacttttgaaaatcaagtaatttcgacattatatctacatttagtgatatcctctaagacaaacttggtaaacttgaatatactgagaaacaacaatctcatctttaccttcaattaaatactaaagatcatacagttgctaaaacaacattgctacagatactgaagttcagcttcattaataatagaaacacaagttaaaattgatacggcattttatatcacattgagctagggaaaaacactaatgatacccactgataagattagagtgagattaccatattttagtgattcttggatgcatttttttttcacattttaacatatctgaaatgaagatgcatcttaatcaagaacatcatatgattgtttctggccaggtactcttaagaaatactttctcatcaacattcctgatacacagtgtggaaaattacagacaactctgagtcaaaaaataacagaagaattgaacattgaaatgtgatgctttagaactaccctaaccatttaaattgacttatttttttccttttaacatatgcccaagagtggtatgataaaaatctatgtctacctacatctaaaaagatcttttctagtaagtatgaaaaacaaaaattcttaataagaaaacattgtgttggtttaactaagagtttttcttttttggcaattcataaaatgatggcgtgccatatggtcaatggtgtctagtagacacttatatagtgctggtagcattataaactcctttaaaaagcaatctggccatatcaaaggcaaaaaaaagtgtatataccaccctggcacaaaaaaccccaatgaccctatttccaagaatgtatccagatgaaagtatccaacaacaaaaagctatatacacaaagatacatatgatattgttcaagagcaaacaaaagaaaaaaaagaagactatcaaaatacccagtaacaataaccagctacaaaattgatggcacagtaattaaatcaagacagtatagttaacattaaaagttaagaaaactatttagagagtaaaaatgtttatttcatcatgctaagtaaaaacaaaactatggtctttgctgagggtctttagaagttagcaccatggcagaagacatgaaggtcaaaattaagaactacaggactgtcccatttgacagccactttgtcaactagaaccagaacatgaactgctggcaaaactacctggacttctaccactccaagacggcaatgactgctaaagggggtgatgtctctgtgtgcaaatggtactggcatgtgtgcaagtccctctgccccatatccttggtcttgacctgggacaaaggcacgtttcctgggaaaatcagaactggctccaccccacctttcctctgttctccatccttctcccagggtggtaaacggggacctgggtacatgatgatccctaccctgggtccgtgaatcaggacttaactaataacaaaaacttactggaaaagtgtaaagaaaagaaaactatatgccttacattactaagcaaaagaaaaatggcaaaggaatattaatattagacaaaacaatatcaagagaaaaagcatcaccaggaatagtcattatgtaatgctaaatgctttgattcactgcaatttaaaacgaccaggataattattcactgcaactttaaacctggatataacttataaaatagactcaaaatacatagagaaaaaaatgatatacaactacatggagaaattttcttcttttttgacaccaagtcttgctctgtcgcccaggctggagtgcagtggcgcgatcttgactcactgcaaactttgcctcccgggttcaagggattctcctgtgtcagcctcccaagtagctgggattacagtcacccgccaccacgcccggctaatttttgtatttttagtagagatggggtttcaccaccttggccaggctggtcttgaactcctgaccttgtgatccacccgcctcagcctcccaaagtgctgggattataggcgtgagccaccgcacccagcctatgtggagaaattttcaaatccaccatcgcagtggaaatttttaaatccaccatcgcagtggaaatttttacacaattctcaatagatcaagaagacaaaaatcagtaatgggagacctttcaaaaaacaaatcacagataccacttcacacccgttgggatggctactgttttaaaaaccacaggaaataacaagtgttggcaaagatgtggagaaactggaattgtgcagctgtgagacatataagaccatcatagcagtatgatctatagtaacaaaaactgtaaataacctaaatgtctgtcaatctaacagataatttcattgtggaatatcatataatggaatactaactatacaaaagagaaaactatgaatgaactatatagctttacgtgtatcaacatgagtgagtctcaaaaacatattaagccattgaaaaagcaagcaagtcattgaaggatacataccttcaatatacatgcctttggtataccaccaccagtataataacagcacataaagttcaacgacatataaaactaaatacacagtctaggaatatatatatatgtgtgtatgtgtgtgcgtaataaaactatacataaaagcaagaaaataatgaacaaattaagcatggtagtcactctttgaggatgagagaggaattatattaggaggagcatgtaccattaagtgtacacagaggattttaaagctataaaggcaatcctgtgtttgctaagatgagtgaaaaaaaaatacagaggcggttttatttattttttaacactagtataaacattacatattcttttgtgtctgaaaaattatatacatttttaaatttctgtgcacactcatcaaaactatctgaaaaacatatttatatgtgaacaaaaattaggagatatagaaatatactttatattaaggcaatgaaattggggtaatattttcctcatgttaacattttctttaatatcttttacaacaagcatttttttaaaaagcatttttaactactatggcaaatacccacctgatcactaagcaaaagctgatttcctccttgatacaaagtatcacaaagcatgtccacatccttattccgtttggacagaaagaaagaatgttcttgagcagatactgccaactgatcttgtactaaagaaatattctgtttcaatttctcagccacttcctcaaggtttccatgagttagaaacaattcttttttcttattctctccctccaaaacttggtaaagcctgaaatgtaaaaattaaaattatagggaaaaattatcaagtcagtatcattttcaaaattacaatccactgtattggggcatttgtggggatagctaagtaacaacttataaaaatattggccgggtacagtagctcacgcctgtaatcctagcactttgggaggccaaggcgggcagattgcctgagctcaggagttcgagaccagcctgggcaacatggtgaaaccccatctccactaaaatacaaaaaaaaagttagccgggcatggcggcatgcacctatagtcccagatactccggaggctgaggcaggaggattgcttgaactcgggaggcagaggttgcagtgaacccagattgcgccactgcactccagcctgggcgacagagtgagactccgtctccaaataataataataataattataattataataataatattattattatttgtgtgcctgcaaaaatcaagcaactgaaaccattctaactgtaatactatttcagtacagaaatatatattctaactactacattagataaacagtctattactgaattcccagtttccccaccatccaagttttagatataaaactcttcttaactttaactgccactaacgtacttcaaagtgcacttcagagataacctccaaagaaaacacatgtctcatagaatataactatgatgtagtagaaacaacaggctatggctcatgcctgtaatcccagtattgtgggagggttacttgagcccaggagttcaagaccagacttggcaacatattgaagccccatctctacaaattttttttttttttaattagccaggcatggtggcacgtgcctgtagtcctaactactcaggaagttgaggcaggaggatcacttgagcccaggagctggaggttgcagtgagctatcatcacatcactgcactcctacctaggcaagagagtgagaccttgtcttaaaaggaaagaaagggaaggaaaggaagggaaagaagagagaaagagagagaaagggagaggaaggaagggaaaggaaggaaaggaaggagggaaggaaggaaaaaacaagcaagcaagcaagcaatgaatttgaaacggaagacctagatctaggtctgagttttctgttatgtgaaagctagggcaaatcaatctctgagacttatttccacatcttaactactacacatcttaacctacctatattacaggattgtggtgggattaaaagagaaaaactaaaattgtaaaccatgtaaaatataaaaataaatgtaaaatttaaacaatgtaaaatgtaaatagttacataaatagctataatagtaaacttttgctcagaattttttaaatagttattttatcaagttgtaacagacttcctaaaactggttcaatcccaaagctgccaattagtcttatagatgtaactacacaattccaggggtatcattcacatagatcataatgtcagtggtaccccctgaaattgtgcaatgaggcaaccctatccaggcccctcattttattaataagaaaacaaaaagattagatgcttttaccctagtcctggagaaaaatgaggagtaggagacagatttttgaggtcttaagactactttagccctccaattttcagtatccctctgccatcaattgctcagacatccagatgaagcctgggagctggcattcattctcaatgattctcctgactacacacaaaaatgaagtcttctcccctctctactgctaccttctccaaatgcagtcagtcccctgcccagcaacacctactatgctgagctgtattcaaacttcctgccccaaatctaaaataaggtatataaataatgatgcctaaaggggaataaacccattcattcctccaactcatccacttaagctataaagtagctattttcagatctaacataaatggaaaaggcagcaaaaaaactaaaaatgaaaaaaaaaaggcatatgaaaatggaaaaaaaatagaaaggccaaaagtgaaatgcaaagaattgttaaaaacttccaaaattttagctcaaactctctctagtatttcgcaaaaacaaaaggaaatatttactaaagaaacaatgaagcatacgtacctatgagtagaataatccttagtatcaatggtattccttggatttatctgttgagaaactgatggatctgttaacatttctaattgcttgtagagcatcatgttactttgactaagttcttgaaccaaattttcaagttgacgatatatgtcccgatgctttcttaattcaatttcatatgataactgtagaagttcaaatgatgccttttgttttattaattgatttaaaactaactcttgtcttgctgtataataatcttgtttagcaatctgcagatcaaaatctccctttaccactggcatattcaataactgggcattctctcttaccacagcaggtaaacttctgtcttttatttgagtgacctctttttcaagtttcataatctcactggtcaagctagaaattttagcatccaaattttctttgtccacagcctatacaaagaaaagcaattacatttcaaactgtatgcctaaatttgaaatcatcttaagattattttcactttccactttaggtgaccagataataagctcaatgaatgaaaactaatttaatattcatataaacaaaaattacagtttaaaagggaaaaatgtggactaagtcaagggtatgaattactaaattttactgctattactaccatatatatagtaacggctaccaaaatagagatcttattatacttcttttaatcagaatcattattaataggacactattcactgaatccaagtatatgttactagtttttcttaagttaaaattacttcaataggtcctagttggccagttgattttagcacttctacgtaattattggatttcctatatcattcaaatgttttgtcagctatagaaactaacttggtgctgatattctgattcagaaaagttacatttttactcaagtatctagcagttatattaccaagaaaacaagctctccaagagtgcagacagacatctgcaatacatctatccatatattctcaaaaagaaatcagtttcagtctactgaacctggacctctgacttcattagcactatgctctggttggagcaaacgaggcagaatacccataataaagcaattagtttctagccacatcttaaaaagaaaatctcagtccagtctgtatctgcattacacaaatttaaaattcggaatgcaaattaaagcacttttgtttaaaataaattagataatgtggtagagattataattactattgctgccctccattaacgtatggaactatttgtatgaaacattgacacagatcacaaataagcactgaacaaagaaaataaaatgtaatctcttctcagatgcaccattctaaagtactttaacagcaatattatctcctctattcctaacaataattacaatgtgaatccaatctcatttcttatgcttaccttgctggttaggctgtgaagactctcctctgcccattttatacttgacttcatgctcgaattacttgcttttaagtgaattaactgatgttgagcacaaatgtatgcgagctgcagtctagccatctctagtcgtctctcctcaaggatttcttgattatcacaaatagatggtgtctgtatatctaaaagttgaaaattgtcttcatttgaactttcaactacttcatgtataccctgaaagaactgttttttggtatacaaagttaatgctgctgtgctttgctcttcctgacttaggtatttttccaaggaaaattgcgataaaaataccagtggatttgtcccttgacctaaattagaatgtctgaagaacatcatcaattgtgtaacttcatcagtaagagcctgaagttcattactgatcttagtgatcattgcatttagaattccttgactctgcttcagctttttagtggcttcttcttctttagcatttaacctcagagatttgtggctagttactgaagccatcaattgacatttattacgtcgctgaatttttaggttctttaatttcagtagagtttgaacctcatcctctaatttctccagctctttatcatccagtctaggtgtcttcaaatcagaagttttacacgttttaagagcttcatccaatgccgccccttctagaataggcttgcctgatttctgaagaatgctaaaagcttccaattctctttcagacaacacgttctgttcattcacattcccacaaaaccacttcagaaacgattcatcttcaacgccctcaaacaaccagtcaaagtcttctccattaagattatcagctttgggataaccaattttttttaatgtttccacaaactcatttccacaactcatggttttaactaccccaattttgttgtatctgatatgggtttacggtgttgatttttagaaaataaatccaagcagaaaaaaagctacgttttataccaagtccacagagaagggaaaatatatttttagaatctataatgattcctcctaggggggaagaaaacaagtattagaccacaaatatgacgacagtgtttttaaaaagaagacacagacaaatatcacatgatatccgagagcgggataaatgacaggtagtcgtagctgcaatgtttgatgatgataaagagaaacagaaacaattaggctagttctcagaaaaccgcaacagtaacgaaaagtaattaacaagaaagtggatctatttggatccattttatctttttttccaaagataaaatggtttaaaatgcattacactttatagagcagcatttgtttttaattcaaaataaatggatccaaacaaacccaagccaccaggaggctaggcagcctctcttccctgccctccgtacgtaagaagacgcaaataagcatggcacatcttctgaagatcaactaaatatttacctcaacgtctcgccgggcaaggctccacctccagagtccaccaccgcgacgcggagaacagcaggagcagcagggaagcgcgcggccacaattaagggtgcttcgggccggccttcagccagcgctgaggcagccccgacgccagggccgcgcgaaccccagaggcagcggcaagccccagggatccgcggccccaaggccgcgatacaccagacgcgccagcggcaaaaccttccttcggagggtcacccagctgtgacacctaagcacgctgacaaaacaaacgcacaagcccaccgaatcgccgtcgacaccgagctgcagaagacgggggtgacaggccccgcacagcccccgccccagctcctcgcccagcggaccgggccctgatccccgggcagctgctggagcacctggaaggagcccccaggagcgcaggaaaaaaaagaggcacctgggtgcagacggggatcgcggccactcctccagccccacacccctgcgcccagaaccgaggcccgcgtcagtcacctcaggaagttccgcttgcttctcgcaggagcccgccgccaccgccctccgtgccccgcgcgcctcgcactgcctcacgggagcgcctggacgcgcgcaagcgcacaaggcgac

SEQ ID NO: 152 - DNA, 4608 bp, Homo Sapiens
aaaggaagtgcctccggcgcaagtggcattgagggacttgtagtcctgcgatttcgggtgtagagggagcaggggcctgcggggacctggtgtgggtggagtggggacaagcggtggagaagggtacgccagggtcgctgagagactctgttctccctggagggactggttgccatgagagcagccgtctgaggggacgcagcctgcactacgcgccccaagaggctgtgcgtggcgagcaggtcacgtgacgggagcgcgggctttggaaggcggctgaacgtcaggccacccgccgctaagctgagaagggagagcgagcttaggaccgcctgcccggggcaaccccgaaccaagctttagccgccgaggccgcgtgtcccaaaggccaggtgagaccccatgggaagcgcctccgggagcgacggggtccgcttggcgctgggggccgtggggagccggggtctggagtgcgcgggattcgcagtcaagaggtcccgccacttttccccctgtgagccttgggccagtcgcgtaagctccgagcctctctttcctccattgtagaaaagcggtaataagttccaccttatggggtcgtgttgtatttttcctaagaccttggacgagaaacatttctgacacttgagttgtttaggcccctttcctgcctacctgtctgtgggacgccgtgaggggatcaagggctacatggtctggtcctcagtccacactccagcagcgcggccggcttgaggcaagagccgaagggttgaacaggcctggagaggggacattagaggtttctgtctgttgtctcagttaaccctggcagcagccctgagagacaggcatggtaatcgttcttcttctgtagacgagaaaataaacctcagtggcttggtaatgtcacacggatggtaaatgccgcgcctagattcaaggccagagcttttgccgctgcagttcacaggggaattattcatattaatcaaatgaataattcattgtcaattaattattaattgattaataatccagggatggacctggaaggacgcgtgagaggatggcgagaggagggcacagctaaggaaaagtgggaaaaggcgggccttattccagctttctgttgagatcccagaatgtagggttaggttgggaaccagaacatgaaagatcgtgatgccatgctgaagtgtttggactgaattagaaggaagaattgaacagtcattgatgctctagaaagaaccctgtgaagaaagagtgggaacaatgaaaaggcctgatggagtctttcgtttcttctttctcttttcttttgtcttcttttcttttcttgacagggtcttgctctgttgcccaggctggagtgtggtggcacaatcatagctcactgtagcctggaactcctgggctcatgtgatcctcccaccacggcctcccaaagtgctgggattactgcccagagcctctgtgcctggccccagtagaatatttcttggagtattggacacataccaacagtgggcacaagatgagttttttatttttttgagacggagtctcactctcttgctaggctggagtgcagcggcacaatctcggctcactgcattctctgcctcctgggttcaagcgattctcctgcctcagcctcccgagtagctgggattacaggtgcacaccaccacacccagctaattttttttttttttgtatttttagtagagacagggtttcaccgtgttggccaggatggcaagatgattttaaattgcaccccctaaaaatcctttttaatagttatacatttaatacatattaaaatataactaatagaacacaaatattattgcttatgagttttccagtttagttttttaaaaaaaattctaagtgaatgaaagtacgggttttagttggaagtagcaaaaatcgtgagggtgatttgggaaacactgctatctgggaaacactgaactctgaagtgcaatactcttttgagcccagtgactacagcatgccagacccctaaatcaggacctggggaggagccatggagttaacatttcagactgagtggtggcgagaaaacgcaaagggaaagacttgaaactctagcaacattataataaaagtagaaactcttatgtgctgaggcgatgatgaagagagtttagagaagcttgtgagaaagccacatcacctccattcagatatgtttgcaatcctttttcaaggctgccttattagtcagggttctccagagactcaaaacaaatcagatctgtttgtttagctggtgtatttgcctgtctttcaggtctgccattatggtccctggactcctcaagccaggccaagcatcctggccttctgtggtccttgatggagacctatgttgcaggttttttttgtgtaataaataatgctgctaccttagaatatcaacagtatcttatttctctaagcacgtggttcaatttctggtactcgttgagccttactattgagtaaattctcctgctagactgagttttttgagaatggggaccttgttcatctttttatctttagcagtgctgacatggtgtcctttttgttgtgtggaatttagttgaaggcatgaagttggtgagataacaccagttataacctttctcctttcctccgtctctgacttgcctttcttttttagtcatccctcctctgtgttgccatgggaattcaaggcctggccaaactaattgctgatgtggcccccagtgccatccgggagaatgacatcaagagctactttggccgtaaggtggccattgatgcctctatgagcatttatcagttcctgattgctgttcgccagggtggggatgtgctgcagaatgaggagggtgagaccaccagccacctgatgggcatgttctaccgcaccattcgcatgatggagaacggcatcaagcccgtgtatgtctttgatggcaagccgccacagctcaagtcaggcgagctggccaaacgcagtgagcggcgggctgaggcagagaagcagctgcagcaggctcaggctgctggggccgagcaggaggtggaaaaattcactaagcggctggtgaaggtcactaagcagcacaatgatgagtgcaaacatctgctgagcctcatgggcatcccttatcttgatgcacccagtgaggcagaggccagctgtgctgccctggtgaaggctggcaaagtctatgctgcggctaccgaggacatggactgcctcaccttcggcagccctgtgctaatgcgacacctgactgccagtgaagccaaaaagctgccaatccaggaattccacctgagccggattctgcaggagctgggcctgaaccaggaacagtttgtggatctgtgcatcctgctaggcagtgactactgtgagagtatccggggtattgggcccaagcgggctgtggacctcatccagaagcacaagagcatcgaggagatcgtgcggcgacttgaccccaacaagtaccctgtgccagaaaattggctccacaaggaggctcaccagctcttcttggaacctgaggtgctggacccagagtctgtggagctgaagtggagcgagccaaatgaagaagagctgatcaagttcatgtgtggtgaaaagcagttctctgaggagcgaatccgcagtggggtcaagaggctgagtaagagccgccaaggcagcacccagggccgcctggatgatttcttcaaggtgaccggctcactctcttcagctaagcgcaaggagccagaacccaagggatccactaagaagaaggcaaagactggggcagcagggaagtttaaaaggggaaaataaatgtgtttccccattatacctccttcaccccagaatatttgccgtcttgtacccttaagagctacagctagagaaaccttcacggggtggagagaggattctaaggcttttctagcgtgacccttttcagtagtgctagtcccttttttacttgatcttaatggcaagaaggccacagaggtacttttccttttttagctcaggaaaatatgtcaggctcaaaccacttctcaggcagtttaatggacactaagtccattgttacatgaaagtgatagatagcaacaagttttggagaagagagagggagataaaagggggagacaaaagatgtacagaaatgatttcctggctggccaactggtggccagtgggaggtgatggtggacctagactgtgcttttctgtcttgttcagccttgacccaccttgagagagagccaccaggaaggcgcatcttagcagatgggaggaactgctgagagaagatgggcagaaagctggagcccctggagttggctgtgtctgtgtttgtgactgattactggctgtgtcttgggtgggcagaaactcgaacttgctatgtaatttgtgtctagttattcagaggagtaagatggtgatgttcacctggcaatcagctgagttgagactttggaataagacactggttttcatgcgctgtttttgttttaaagttatgaagaaaaaagtcaataaaattctaaaagtaaccaaaa

SEQ ID NO: 153 - DNA, 39414 bp, Homo Sapiens
gcgggtgggaaaggaaggaggtgcccgggtttccgctcccagggctcagcctgccttgggcacctacggtatgggagcctttaacgtggaaaggaaaggagatcgatcactcgagcctccacttgccaagcctgtggaagcgagacgcggggatcggctgggaatgcctggaagcgccggcgcgcggagccaggtgggaggtgcgaggtggccgcgcggggatcttgggtgacagggcaccgagggaaggaggacgcgagggcagccaggccctagggagcagggagagtggctcgggctcagtcgcgtggccccaggtgcgcgtcccaggtgcgcggccttgacccagcagcgtccgccgtgctggccggggcctcggctccgcagcagaagccgcggtggtggcagccggcgcgggcgcagctgcccgcggctggggcgtttcatctgcgccggcctatggtgcgggcatcgccctgggccacgcgctgatcgtctccatctcactcagaaaaagttactcatacagtggtcttgtaaagggtctgaagtggtcaaattgtccctttttagaaacggatagttttaggtcttaaagatgtcctagaaattacccttacaagcccagctctgtcattttatagtaagggacactaagatcgcgtacagagcttgtcggaggggcttggtcttctgtctcacgctcagggttgtctcctcgttacaggagaccttgctcttaaacgtttcagagttcgcttttccccttgctgaattcataaaaatgtttttaatttatatgtgtttcttcttgtaggaagaagaaattgtcgagacgaataacatgaggtcatatagaatcccacttttggtgatttcaagtcaagaaagtaaaagtaaaccattgctatctttcaccttaaatatcctgtgttttattgctcagaacatccagtttttctaatactcatgatgtcagaagggaaacctcctgacaaaaaaaggcctcgtagaagcttatcaatcagcaagaataagaaaaaagcatctaattctattatttcgtgttttaacaatgcaccacctgctaaacttgcctgccccgtttgcagtaaaatggtgcctagatatgacttaaaccggcaccttgatgaaatgtgtgctaacaatgacttcgttcaagtggatccagggcaggttggcttaataaattcaaatgtgtctatggtagatttaaccagtgttaccttagaagatgtaacacctaagaagtcaccaccaccaaagacaaatttaacccctggccaaagtgattcagcaaaaagggaagtaaagcagaagatcagtccctactttaaaagtaatgatgtggtgtgcaaaaatcaagatgagctgagaaatcgtagtgtgaaagtcatttgtttgggaagcctagcatctaaattgtccagaaaatacgtaaaggctaaaaaatcaatagataaggatgaagaatttgccggttctagtccacagagttccaaatccacagttgttaagagcctgattgataactcttcagaaattgaggacgaggatcaaattttggagaacagttctcaaaaagaaaacgtgtttaaatgtgattctctaaaggaagagtgcattcctgaacatatggtaagaggaagtaaaataatggaagccgaaagccaaaaggctacccgggaatgtgagaaatcagccctcacccctggattctcagataatgcgatcatgttattctcaccagatttcactcttaggaatacattaaagtctacttcagaagacagtcttgtaaagcaagagtgtatcaaagaagtggttgaaaaacgtgaggcatgtcattgtgaagaagtaaaaatgactgttgcttcagaagctaaaatacagctgtcagattcagaggcaaaatctcatagttctgcagatgatgcttctgcatggagtaacatccaagaggctcctctgcaggatgacagttgcttaaacaatgatatccctcacagcattcctttggagcaggggtcaagctgcaatggtcctggtcaaacaaccggtcatccttactaccttcggagtttccttgtggtgctgaaaaccgtacttgagaatgaagatgatatgttgctctttgatgagcaggagaagggaattgtaactaaattttatcagttatcaggtatcttacgcacgtgtttgttttcaagttttcattccccttttgctgctctgattggggcatgatgtgatgggcagtaatctagtgaccgcaaggagtcactgtggtgttgtgagcaccctgtgggagtgttcatgggagttggagcatagtcgaaggttttattgagagggatgcatggaaaagagacaagattttgtcccgggtgatgtttactcctgctgaactttggttacattggaagcagctgtttttcttttataggtacatttgatagttatgaaacaaccttttccagattaaaaaacaatataatgtgacttagaaaagcatactttgcattttgagcgtgtaatcaggctttccattaggttgttttgttgttcctcaaagatgaaagtagaataaaatacaatacaggaagaaaacaaaccaacctgaggcatattttctttctcccaacaacattttagatttatggactgtgccttttaaagacagggtgtggaggaaatggaaactttcaagctgaaattggtacattaaaaatactagtctatgcctgaagtccttggcagccaggggtggctccaagccagcagtgcaggtttgtagtaaaagccacccttgtgtctttacggtgttattcagagggccatgatgactctgtggaaccatgtccctgagggcaggaaaaaacatggtagtcacactgtcgtttagtaaaatgcggccatgtgtgactcctcagtagataaaaaagagaaaaatcctgaacattactattgatgttcaagggaaggatttctattttaaattcgcacagtgaaattatggtattccttgggttactttttaacatgtgagcgatacttctctgggcacagctgtgtgtagtatccacttccatctctacttttgctgttctcaccagaagatggacataatagcacattggcttttctatccaaactagtcacagatctttggttgggtgctgattgcattcctggagtatttcagagattggtggctctgtaattccatgtaattgagaaataggaacagttttcctagtgcaagttctgcatatgcatgtgtcttgcactccatggagaatcatgtacaatctgttggtgtgtagaaataattactgctaattgtttttgcctttttttttttttaattttaagttcttttagagacaaggtttctgtctgttgcccaggctggagtgcagtggtgtaatcatagctcactgtgaccttgaactcttggtcccaagcgatcctcctgcctcagcctcccaaagcactgggattacaagcataagccataggctgggcatggtggctcaggcctgtaatcccagcactttgggaggcccaggtgggcagatggcctgaggtcatgagttccagactagcctgaccaacatggtgaaaccccgtctctactaaaaatacaaaaattagccgggcatggtggtgggcgcctgtaatcccagctgctctggaggctgaggcaggagaatggcatgaacccaggaggcagagctttcagtgagccgagactgcaccattgcactccagcctgggcaacaagagcaaaactccatctcaaaaaaaacaaaacaaaaacaaaacaaaaaaacaaccaaaaaaaacaacaccagcatgaaccatcatgacaggtcaattttgcctttttaaagaagaaaggaaaataaatgttggaaattttcaaaatacaattaagccattttagagttggccgaaatttaaagataatctgggtaatagggagattgagaccaaacaggttaattaagaagcttggtcaagattgctgggttagagatgactgccctactgaagctagacattttttttggaaaattatttcagattattttcgatcaaatcagaataatgcatattaagctaagagcagagaacaaaataagaattctgggtagggcttttctgagggagtagaaatgttgatgtctagaaaatggggaacttgatcttagaagttttaaaatgaccaataattgttaccaaatttttaaatgtactttcaaaatggtttattccataaaatgaaggccttatacatacagtaagcatatgtgtatttctaaatcgtacatttattcaccttaggtttaaaaggtaaatgcagtgattttcaacatttttcttaactttattgcagctactggtcagaagttatatgtaaggctctttcaacgtaaattaagctggattaagatgaccaaattagagtatgaagagattgccttagacttaacacctgtgattgaagaattgacgaatgcaggctttctacagacaggtatgactagtagaaggagatgtgaaatgaaaatatgatctgaagaactgagcttctgcagaatgatggcagtattattatggtgccctccccggggtggtgcctggtaacttactgttttttaattgaatttttaatcttaggacaacaaattactcatgtgatgctaaagccattcttagcctgagttaagaatactagaataatgagagatggtctgctgctgttttcttgactgtggcaggtttagaatgaaagtcacctgggcatagacatgggtgtgtgccacagaagaaatacatcccggccgggcacggtggctcatgcctgtaatcccagcactttgggaggccgaggcaggtggatcacctgaggttgggggttcgagaccagcctgaccaacatggagaaaccccatctctactaaaaatacaaaattaggtgtggtggcgcatgcctgtaatcccagctatttgggaggctgaggcaggagaatcacttgaacccgggaggctgaggttgcggtgagctgagattgcaccattgcatttcagcctgggcaaccagagtgaaactctgtctcaaaaaaaatggatacatcccttcttggcgctctccttccagcaagagcttgactcatcttactcagagtcctcttctttatgatagaataaagctggttgtttgaaacccatattgcctctaaaaacttcatctgccccccttgcacacacatacagttcttcgattatgttgattgccttaagcattgttgaattgctttaagcctatgtgaacactaaggagagtctatcttctgcagtgatacccttcgttgtcttgtcagtagcattcgttaagtacctacctatgtattgggtacaaaattgtactgtattaggaaagggaaatgtgagccttgggttcaagttgctgacattttagaccaaaataagcgaatcagccagctggtttctttggggcagagtttattgtggggagcagtaagtggggatgaagcgaagtgagcaggaagtgtgttagggtggggctggatggcgtgggatggggaaagttgcgggagaggcataaaagctcagtgaaggcgcttggttgtgaatggttagtggtgggacacaggaccctctgcagagcagcgcttcccacacatcagtgccagcagggtcacctgggaacttgatactcagtccccacctgacttggaaaatgtggtgcagcttccgtaaattcatatgtctgacaggcatgccaggtgactgctgcaggtgagccttgacttaccttcaaatgagcaacaaaaccaggatcctagtggctcaccgtggcactcagtcaagtgcaagtcccatccatgctccagccccatggggcctggctctggctgtccctctcgctttctgccacggccacccagccctcagtgttcttcaccaggatgagtgcattcctgtctcagagccttggactgactttcccctccacccaggtcagtttccaccacgtggccacacggcatagttctcctttccttccccgctgcgtggtgttaccttgtcaaaggtttgcctgactactgtgtgaaatacagccagcctcctgccagcttcagtttgcctcctgagttgtgtttttctttagagcggttattaccacctgataaatttgcctattcatttaattgttacgctgggaggctagctcctatggatgggatttctttcactgtagcatgcccggggccttagaacattaccaggccgacagtgtacacccaataaatatttgctgaatggaggaagaaggcactgccctaaacttgtgaagccttgaaggcaaagaccagcgaggtctgactgagccgaattcctaggccaaggttggtgtcggggcccacagtagccgaacaggctcacgaatgccgagtgagcaggagaggcttgtgggaagaagagggctgatgatcagttctctctgacctggtttgagaggtcccattttgtaggggttttgtgacgagaaaggcagggagtatatattccaagcaggtgttgagatgcccaaaccataatggctatccatgtgtgtctttattttagttatgttttcctttagattttagtgagaaattctattatttgataacttttaagagatataataatagtgttattaatacgttaataataccatgttaataattccacatttaatgattggtttggccaactaattaaaattttcttagtagcatttcattttattttcatctaactaaggtaaataaagctagaaaatagtaaaatttaaaaaaacttttttttttaaccatttcagaatctgagttgcaagaactctctgaagtgcttgaactcctttctgctcctgaactaaaatccctagccaagaccttccacttggtgaatcccaatggacagaaacagcagctggtggacgcctttctcaaattggccaaacagcgttcagtctgcacttggggcaagaataagcctggaattggtgcagtgattttaaaaaggttttgttggctattgttacagtaaaaacatttaaaatgttgatagcacatattaacttacagtagattgtatacttgattgaactgtaattgtttatttcagttgtagttagattgagaaggctggaaaagccttaattgcaatagcctggattctttcttgggttattattcaaaatttttgtcgtaataccgtactaatttccaggaccaagaaaaatcggaaggcaataggcctttggtaaattgtagtattttattttccgagaaaaatacagttttaagtgattcttatgggattttaaggtaaactatttagtcaaatttttattttagtttttgtttactaaacaaagtataatcaggcagtcttaatgtgcaagttttcctgagtttaaacgtaacaatttaccaaaaactgtgagtggcttcttttgtccttgagaagcccttgacctgtttcagttgaaaattacaaaaacttttagaattgatttcttttgcccatgttatttatataatcaaactatatcaactctagcctgggaattcactactgtggagtcgaggatgaaatgagaggatgcttttgaaaacactttaacatgatgttgttatttattttatatatttgttttgtatatttcagttgttatgagcccatccttgttggggaggtgctataaatactaatctttaatgaaacataggtgtaataaggcagacattaagaaaaatataaataccaacacttgaaaaaagctcgtgttatagatttttaaaaagtacttcaataaattacatacttgtaattaattgacttgagaagtatagaatcctcatctgtgtggtatgttaaatgtcttctaagtcctttctttatctaattgtatttcttaagtatttgatgttaaccttatatgtaacattttataagcaagtaaacattaaatttagccaccctctggctgggcacagtggctcacacctgtaatcccagcactttgggaggctgaggcaggtggatcacaagatcaggagttcgagaccagcctggccaatatggtaaaaccctgtctctactaaaaatacaaaaattagcctggtgtggtggcaggtgcctgtaatcccagctacttgggaggctgagtcaggagaattgcctgaacctgggaggtagaggttgcagtgagctgagatcgcgccactgcacaccagcctgggtgacagagtgagactccatctcaaaaaaaaaaaaaaaaatagcagccctttcttggtatatgcacttagcatagaacagataaagtaaataagatgaacatattttatctctaactttggacttgtaggaaaatagaatcctcaaggctgttttagttctagtgaaaaccactgtcctttaaggttgtcctttatttcttcattctgatggtaaagcccagcagtggaatttcagagtccctgccagccccacgctagggcagcgcctggtgcttttactctgctgttatgataaagaaacagaaacagccacattattacagaaaaaggcacattatttatgctttcttaatccttgcaggagtcactgcttagttttctgtgtttaatgcttccttttgcagactggaggctgtgtccactggggcatccccgggactctgcgtggaggtggatgaaatgggtactttggggcagtctgtagatgagtggctctcagttcagtggtggtgtgataggaatcccaccccttccccttcaactccatgatggtggcactcatctctcccacaccctctgggatgcagtgctgcttttggtttaatagcttctgcaccagaagggtgtgacatctttcactagccaagtggttctcaactgggggcatctggcatcatctggagacatttttggttgtcagtactggaggtggtgaagctaatggcatctagtgactagaggccagggacagggcactgctgagcatcctataatttacaggacagcccctgacaacaaagaattacctagcctaaatgtcaatagtgctgaagctgaaaaaccctgctattgatggtgtctaagctgctagagtcagagggcccacatggtcctggatttaatttagacctccaagcccaccttgcagacatccagagttgaactgaattcactccaatgttatcctagaatagagatgctgctggaccattctgtacactagagaaggggtctgcaacccccaggccatagaccgataactgtccattgcctgttaggaactgggccacacagcagaaggtgagcagtgtgccagagagcatgaccgcctgagctttgcctcctgtcagatcagcagtggcattagattctcataggagtgtgaaccctattgtgaactgcgcatgcgagggatctaggttgcgtattccttatgagaatctattgcctgatgatatgaagtggaacagtttcatcccgaaacacctccctcaaccccagtccatggaaaaattctcttccatgaaaccactccttggtgccaaaagcgttgactgctgcgctagagaacagcaccaaactttggcatatacatttgcaccacgtcttggtacacaaaatctgatgttttacctggagcctttgataatgacattttaaagaaataccattatttaatctaaatcatcactagaataaaaaattgagaattgcttcatgttgactaggcaatacttttctgaaagttttcctggtatttgaagcactcatgaccagggtaaaccccaacctactgtgcagccgaggaaggaagcacttgtatggagccaaaccatgtgtggaaccatttggagatgtacattcatttactcctgtgtatccctgggtgagctctcagccccagagcagttaagtaatgctccagtgtttaaaatagtgaatgtcatttctctttattttagatgaaaataatttgtaaaatctgacatccaaatgcttaaaaagctaaaagttatttctacattgtacatttttcagagccaaagccttggctggacagtcagtacgaatctgtaaaggccccagggctgtgttttcccgcatcttgctactgttttcgttgaccgactcaatggaagatgaagacgccgcttgtggaggtcagggacagctttcaacagtcctgttggtcaacctcggccgaatggagtttcctagttacaccatcaatcggaaaacccacatcttccaagacagagatgatcttatcaggtaagatgatgttagctcactataatgtctatatgtgtatttcacaatttagtaaaaggttttgttatttttttccagccaaagtagaaacattaagtccacagccaaaacagtttttaatctttttttgccccacttgtatacatttctatgactatagggaaaatgtagaagtgtgctgagattatggttgccaaaatccaaggaattttgagttagaactacaaaaacttctctggtttatgtttccaagtacctttggaagggagtattttttgtttgtttgtttgtcttaatttgagacaggatttcgcccaggctggagtgcggtggcatgatcaccgctcactgtagcctcaacctcctgggcccaagtgatcctcccacctcagcctcccaagtagctgggaccacaggcacatgccaccacactcagctaatttttgtatttttttggtagagatggggtttcaccatgttgcccaggctggtctcaactcccggactcaagcaatccgcccaccttggcctcccaaagtgctgggattataggcgtgaaccaccgccctcggcctgtattttttttgacacagacatattaacaaacttgacttaggaatatgttgttggcatgaacaagactgaatgtgaatattttcttattagtaacactttaggtaaagctattaataacttgtatattgtatatcatacatatgataattagatatacagatgataaattagaaattttcactaatttatattggcacacggatttagtgaaaatttggtttgtccaataaaagtagattttgaactaaaagtagaactaccatgtgatccagcaatcccactactgggtaatatccaaaggaaaagaaataggtatattgaagagatatttgtactcccatgtctattgcagtctattcacaatagccaagatagggagtcaacctaagtgtccatcagtggatgaatggataaagaaaatgtggtacatatacacaatggagtactgttcagccataaaaaagaatgaaattctccatggtggcaacatggctgagctcagaggacattatgttatgtgaaataagccaggcacagaaagacaaatactgcatgttctcactcatatgtgggaggtaaaaaagtggatctcacagaagtagagagtagaatagtggttaccagaggctgggaggggaagggggatagggaaaggttggttaacagatacaaaagtgcagctaggtagaaggaataagttctgttgttctgtagcagtgtaggatgactataattaacaacagtttattatatatttttaaatagaagaatggatttagaatattccccacacaaagaaatgataaatgtttgaggtgatgcctggtatggcaacacatgcctatatttctaactactcgggaggctggggcaggagggtcacttgagtccagaaattcgggactagcctgggcaacataatgagaccccatctctaaaacattttcaaaaaagtttgaggtgctggatatgctaattaccctaatttgatcattatacattgtatacatgcattgaaatatcacactgtgccacataaatatgtgcaattttatgttaattaaaaataataatagatgccaaacaaataatgggattacagtattaaaaagcaggttttgataagaaagaatagtgtaggtcttaggaaaaaaaatttggatttccttaaaaaaaacacctttggtaagaaaaattaatttggatttcctaaaatgtcacttttgattcttgatttggatttctgactcaaatttaaccaaaattgattgtgatatttgcttttaggaaagtcctgtgtttctaggaaagccaggtgctttaagaagtaagttattgaaatttttgaatcacagcagtgtcagtataatctgattttggcccattttaccttagctgtcaggaagctcagtatcttatttgtgttcaatgggaataacttttttagttaaaatctctaataagactgtttattcttaccctgttttcagttgtctcatatcttttttaccttttttgtttttactggctttacgcttttctggcttgtgagaatgtatactctgaagccaagttccagtttctataccaatgaactgtgaacccaccctgtgcctcagtttcctcatctgtcaaatggggagaataatagtatattcttacagacatgtgtggggtgcatgggaagtgcttaaagcctgggctatggggaatgcctactacatgttcattattattttaattgtcattcttactgttatacccaagttctatgacaaaaccatggttgacaagttcaaaaggcatctcatattctttctagaaagtaagtgtgctgtaaataataaaaataatgagaactcccttggttaagcagagagccttaagatgtaaatgaaactggatttaattgacttctggaaaggtaatagtattcaatatctggtaatgtgatacctggccaggaaacccttgttgtctacctctgtacttgagataatttatccttttaaaatgtttcttattcattcagtacaaatgagtgttgagtaccttttatgtgacttggttaggggttgtagcagtgaacaagagagggcctcagccatcatggggctatgtttcctggggagatagaaattaaccactatttaaagtgtgtgagaagtgctgtgataattgagggacaggctggataagttctttatagacagagtggccctggagaggtgacatttgaagtgggacttgaggatgagaatgaggtagctgtgtcagggtctgggtgcctgcgtcccggccgcgagatagcatgtgcacaggccctgaggcaggaaagagcttgctgagttggaggaactcaggagacccctggctaagatgtgggggtggacaggactgggttgttggtagcggcagtggagagaagtgaatgtgtatgaggcagtttggaagcagtaaagacaagacttgattctgatgtgggcgagaaggtgaggagtggatcaaggatggctctggtgttttgccttggggtggggcgccatccagtgaaggggattgggagaggtgttggtgctggaggcgtcagtgtgtggggtgctcttcagccgtttggttgaagctgttgtgtgtggcattggacttgcggtcaggagctcagggaatgggtctggcctggaaaaagtcaacattttgagagtcactggcatatggacaatgtttgaagccatggaactgaatgagcagcatattataaaagaatgagatctaagaatttgtgagcaaacttttacatttggaggcaatttctttactcttactttacagtgtttgtacataatgatattatgtacttcatgcttttcttttagatgtgagaccaaaatacaatgaacatgtactcaaagtgttaacagaatttgttggtcaaatgtctttgttttttggtagctaaaggagcgatgaaaaattgtctttcttaagctaagttgtgttgtaacatttcagcgttgccatctcccaaagagcatcccttagttattttgaaatattccaggtaatcttcttagcttgggcagcatccctctggctagctctgattgtaaatgattaaattatcagatctacatctgactataattctgatgtcacttacatgtttgctgtcatattgttgaatgagtgaatggatgaatgaatggatgagtgccaaaatcaggaatgatgagctgatccatatcacatttatagaatggaacatgttatgtgataatacagcataaatgtttttatctttctagttgggctttcttatcagttctgggccactccagtgatttggttaagataaattattattagaataaaatttaagtggccctcatattttaaaaaacacacttttacctttcagagtgagatctagtggctaggatgtggtcattctatgggaatgctcattcttatttggaacttggatggcattttcctccagatatgcagcagccacgcacatgctgagtgacatttcttccgcaatggccaatgggaactgggaagaagctaaggagctcgctcagtgtgcaaaaagggattggaacagactgaaaaaccacccttctctgaggtgagagtttttctaggtacctgccaaaatttatacattgaccaagttgttcccaacacttacagtaattttcttcatgaagaatatactcctttttctctgtggttaaaccagctgtggaattgaattttgtgcgtgctttgcctagaatgaaagtgctgtgtgaaatagaaggaaatgtctgaaggtttaaagtgaatttgatataactcagatccctgggcaacacacatgccaaccccatacttgacttgtcgcatgccaactgtaggagtgttggcctccctgagtactggtgagctgaactgaaacgtgagggaagccagcagcaggacggatgtgggaagcatggtaggtgggttcctctgagggaaattcaagtaggtgttaaaaactctgcaaaagacagctcaagcgaactttccaggtacacagcacatgatcttttattttgttgaaaatggtaaacatcttcaatatttattaagacattttttcctttgttgttacatagtgatgagaaaaattagtattttcagatgccactttgaaaaaatcatttaggatatacagttgacccttgaatgatgcaggggttggggtaccgacccctcagacagtcaagaatctgtgtgtaacatctgacttccccactacttaattaatagcttactgttgactggaagccctaccgattacatagtcaattaacacacattggatatgttatatgcattatatgctgtattcttacaataaagtaagctagggaaaagaatatgttattaaggaaaatcataagggggctggtacggtggctcacgcctgtaatcccggcactttgggaggccgaggctggcagatcacctgaggtcgggagtctgagaccagcctgaccaacatggagaaacctcgtctctactaaaaatacaaaattagccaggcctggtggtgcctgcctgtaatcccagctactcgggaggctgaggcaggagaatcacttgaacccaggaggtggaggttgtggtgagctgagatcacgccattgcactccagcctgggccacgagcaaaactccgtctcaaaaaaaaaaaaaaaaaaaaaatcataaggggctgggcgtggtggctcatgcctgtaatcccagcactttgggaggcagaggtgagtggatcacttgaggtcaggagttcgagactagcctggccaacatggtgaaacctcgtctctactaaaaatacaaaaattaggtgggtgttgtgacgagtgtctgtaatcccagcctcggaaggctgaggcaggagaatcacatgaacctgggagacagaggttgtaatgagctgagatcgcaccactgtactccagcctgggtgacagagcgagactctgtctcggggaaaaaaaaaaaaaaaaagaaaatcataaggaagagaaaacatatttactgttcgttaagtggaagtggatcatcatgaaggtcttcatccttgttgtctttacagcaaataggctgaggacgaggagagagaggagggcttggtcttgctgtctcaggggtggcagaagcagaagaaaatccacatataagtggacgtgtgcagtttaaacccatgttgtccaggggtcagctgtatatttatagagaaataatattgacttaaaaatcacaagaagttagattactataaacagaggttgataaacttctgtaaaaggtcacatagtgaatattttaggctttgcaggccatatggtttctgtggcaccaactttactctgctgttttagtgcaaaagcagccacaagaagtacgtatgcaaatgaatgagcctggctgtgttccagttaacttcatttgtggacattgaaatttcagtttcatacaattttcgcataccaaagtgtattattctctttatttattaacaatttaaaaacataaaaaccattcttagtttgcaggacatagaaaatcaggtggcagaccctgggtttggctgtgggccggagtttgctgaccttggtttagaatgatgagttctcatcttactccactgtctgagtgacctaggacgtggtagctggctgtgagaatgtaggtttgtggtgtagaaaattgtacacaactgaaagtatttagaatatacctttttaaaagataggaattcagtctgctttgtcacttgttattattgtcttataataaattaaccaaattattaaactactggtatatgtcttcattttagatgccacgaagatttaccactcttcctgcggtgtttcactgttgggtggatttatacaaggattttgtctcggtttgtggaaatactgcagagacttcacatgtatgaggttagagcacaggtccctgccccccaccattactgatgtgatggcgttaaacatgtgaagggacagctgtcgggctctcagcatttcctgcttatttggttagcacacagtaatataatggaggcatatttgttttgttttgtctttttgagacagggtctcactccatcacctaggctggggtgcagtggcagggttcagcttactgcagcctctgcctcccgggctcaagtcatcctctcacctcagcctcctgagtagctgggactacaggcgtgcgccaccatgcctagctaatttttgtatttttagtagaggtgagatttcaccatgttgctcaggctgatctcgaactcctgggctcaagtgatttgcccaccttggcctctgatgctttgacagtgggggcctaaagtgttgggattacaggtgtgagccactgtgcctggccaacgagggcatagttaatgtaggcagcccgctgtctcttggattagtagagagaagataggtgaagatggacagctgttctgtttgcctgtgtgttgatgaatctgtgtcccaggatggcctgggggtggcggccaccatcctggagggtgccccacaggtctgcagcctgagcctgagtctctttcagaactccttgtgagacttggcaggtccccagaaatctctgagggaccttttgcttccttttgcttccctgtcagctgtcatggattgtctggagacaatttataatcacaaatcagaaatttgtcgtatcctaaactttgtgaaattgctagatttcacttttgttgtgtttgatatttctatattgaaaatgttatctccagaccaggcatggtcaaaaatatatatatacaaaacaagaagaaaagaaaatgggatcttacaaagaggatgtgctaagctggtttcttggcctggggtctgtgaatcccaggggagtgatgggtgggctttggggaaatctgtgaatctcaaacttgcatgtgtatggggatttatgcatttttctggggtaaatcattccatattacaaagacatccatgagccacagaagattaacaaacagaatgaccgaacagtctgtacataatctagaccagagaatgttcctgttgaggtagggtgtttgtatgaggacacccctcattactttcctgcccaccccaaatccctcttgcagttggtcctgtgacctgctgtgttcccagaagtatgtgggtttgccaactgtgaccagtgctcagctgcctggaacttgaccctgtgcgactctgcactggttgactggtttgcagataacactctgcagcactcacagatgtctgtaccccagtgccagctggcagggaccgggtgaagagtgaggatgccttagggaactcatgcccactccagaaggcacctcaaagtccctgtcctgtcagttcggggtccttggcctcattgtagaatggaaagatacgcattataaataggctttaccaatcctatgggcttgtaaatatcattgcagctggattttttgtgaatctaatgaggtttctttgttattgttgcaataggaagccgtcagagaacttgaaagccttttgtctcagagaatttattgtcctgacagcagaggccgatggtgggatcgactggcccttaatttacaccagcacttgaagcgcctggaaccggtactcagtaacaaaacatatctgaaacaccttttcattttagaatcaacttttaaaatatggcaaacttaatgccttaaaatttacatgtaattagaacatgtatttcttttgttaacattcttcttttgtctgtgttcttccaaccccaaaagaataccagggatgccagcacagcatgagcatagagactggaagcttttgtcttctctttgctgattggcgagatgggcttactgtggactctgtgctggcatttaggaatcaggatctaggaattaagggaaagggagagtcagatgactcagccgtcagcaagtcagcaagtgccttcaaggaaggtgtttgttttggaaatggtgactttgttgatttgtagcacagggtctctaggtagaaagattggcgagaaagcgttcctttccctatcttattgcaggtcctttatgcgtgactctgtacttctgtgaggtgttttgctctgccatttggaagcgttgtttgaccttgagcaggcaccagtgctccctgtggtggcgatctaggggcacttggaagcacagggattctgtggccaccacagccaggcgggtgaggccgcagagcctgtgcctgtgggctaggcagcaacagtggttctttgtgtggccgccagcaggcccctccctgtctctattccagccctgcatttgagttgaatggaggggactgtgcctctgggagcttttgattttttcagtggcccattaagtgaatcagggtgatgtaggggtggaaaaaaacgaccactggttaggaaatatgacatcttgtttttattgccgtaaactgaaaaagtgccttgttacctcacgtatcagggaaagagccagtaaagctatttcctctcatggaggagggtgtggggcttccttaccactcggtgtttactgaggctgaaatagcaagagaaagcatctggtagcctagaaccaaatacagaaggagaaagcttgtgtttctgtcgcctttctttcaatgaaataaaagttcaagagagtacagatttcccctctgttcacagttctgctagggggtagacaagccactgagcttatttttgagatttgagctaagcctagttcctcctaacctctgtttccagaggtcttactggccatagctcttgttatttcattagtgttctttgatctttacctcagtctccagggaagggatcgcctagctgagtgctaattcctgcaaagtgctctgcagccagccccggcctggccagggcagaggtggagccagctgggccctccctctccgaggccaggctgccgctgcccggcaccgtcttctgccagcgaacagggtgcccttcagagtctcattctcccatcttcatttccttcagccactcaactctggatggcctgagccttcactgattttcaatttcttggtttttattttttctttcactttttatgtttctattgtggtaaaataaatttaacatccctaaaatacagcattttagccatttttaggtgtacagttcagtggcattcatggtactcatagtgttgtgtgaccattgcctctccacttaccactccaaacagaaacactgcagccattaggcaactacgccccgctttcccttccccaagccctggcgacgacgtctcatctactttttgtgtctgtaaatgtgcctgttcatttcattcatttcattgaagtggaatcctacgatatttgtggttttatgtctggtgtattttgctcagcatcatgtttctgagcttcacccgcatcgtggcacatgtcaggactccgttccttctccaggctgaacacacttccactgtagcatctgataccacatttttctagccactcattggttgatggacactgggttccttccaccttttcggccattttgaagaatgctgcatgaacctctgtttcagtccctggtttcaattcttttgggaatacctgagagtggaactgctgggtcctgtggtgattctgtgttgagctttttgaggagtggctgaactgtttttcacagtgtttacaccagtgtcacattcccaccagcaatgcgtgaggtttctggtttctctacctccttgtcaatgcttattttccatgtttctgattatagccatcctagtgtgaagtggtatctccttgtggctttctgtgtttgtttatttgtctgactctgaatcgccttgggaaatacttgtaattcctccaaacctttggctcctgtccctgtaaataaggaatctgaagcagctccatggttcttgactgcatatgagattgacctggcgctttgatgtggcccccatgcgtgggctcctgctctggaggttctcattgtgtggatccggggtgggacacatgttttcctacaaagctgcctaggtgatgtcctgagaaccactgagctaagttttcctgtaaagtcaggtacccctgaggttcacaccctttgtgaggggcagctgctgggatccactgtccacctggattacagcccggtcacgctccagcacgttgactgtgaaggctctggttgccagatgcattgaaatcctcagaataagatctaaggaaacagcctaaatctctagaagtgctgtttgctcatttgctaatcagcaaaattcaataataaacagtgggcttttctgtcaaactaaatgcatggaagccgccatgggtttttttaggagcctgatgtgtgaccatgctctctgccagactatcaagtgcatcacagaggggctggcggatccggaagtcagaacgggacaccgcctttcactgtatcagcgagccgtgcgcctgcgagagtctccgagctgtaaaaagttcaagcacctcttccagcagctcccagaaatggctgtgcaagatgtgaaacacgtgaggaaagagcctgtgggtgctttggacttaggcgcgtgtacctggtttttttggaccagaagcatcctaagagctgttttgagtgtgtgttttcttttagactcggaataatctaaaactcgttttggacggctgtgtggccattgctcccagtctccccctaacgccctcctccctgaggagactgggttgcttggtgtggtcacaccctgggttgagtgacagatctcctgaatggggcctctcagcatctgccccggtttcatttactcactggggacctgtagagcagttctggtggttgaggctctcccagggccggaccagcgaactgtcacatccccgcagttctgcgtgtgtgagccccacgctgtgtgctctactaagtgactgactttgtggtaagggaggtcaatcctcacgatgctacaggcaggttttcagggacttttgctgacctgaggctaatagatgttattctgctgctgtttcaggtgaccatcacaggcaggctgtgcccacagcgtgggatgtgcaagtctgtgtttgtgatggaggccggggaggccgctgaccccaccacggtcctgtgctctgtggaggagctggcactggcccattacagacgcagcggttttgaccagggtaactgagcaggctttctcttgtggcacccagccccgggtggacgagcagcagcactggatgggctgtcagcagtgggctgctgtcctctctctgtcctctgctcacagtggaagatgctgtgggctgggggatgtcttcctattcttccccttatcaatgataaggagtaggtcaggggtagttgtcccacagggcctggctctgatcttttttcttttataaaaacttataaaagttatggaaggtactgcacaagcctttgtacagaagtcagggggacagtgtgctcaaccccacggacacccacttccattcagtgttccttctgttctctcctgccccttccctgggattttagaagctggccccagatatcctctcaggggccctgcggcccatgctagtcgctttcgggaacagccactgagccttccgcccttgggcctggcaggactctccctgtgcccgggctgcagggttaccagtgttaaaaacactgatattttcagatgtgtgaaaatcaggacatgatttcagtattccccgagtgttcggaagattaacaagtactatagaaagacaaccacaagataggagtttacaaagcccaggttctttctgatgagtgttgagattcatctacataatatctttattacttacagggaagggtgatgttattggggaagacgtgcaaatgccagtgaagacagagagatacagtaggcctgaaatggttagaaatagaagaatagaatgcacattcaaggccccgagagacgtggaaactggacactcgctggaggaggaagcaggctgggacgtgggagcgctgaaatgctttcagttgagccatgagcctgaaaaacacacgattcctttcccagagtagaaactatttttccctgattaaaatcgatgccgtgaaactgggctgaactctggctgccaggctttatgccacagggaattttgtgtcagagcgatctcaacctcttctgggaggtgatttctgaagtactgcaccaaaaatgatttcacttataacacaaatgcacagcatggaccacttaggagttaaggaacgaaccaggcacggtagcttacacttgtaatcccagcacttggggaggctgagacaggaggatcacttgaactctgaagacggaggtgggaggatctcttgaccccaggaggtcaaggctgcagtgagccaagattgtgccactgcactccagtctgggtgacagagtgagaccctgtctcaaaacaaaacaaacaaaggagttcagaaatgatctggcctttatattcctgcctgatcgtcagtgtattcaccaggacggaacactgactggaaatcaggtcctagctccactcctggctgggaaagagcatgaagtgttctaggaagaaaagtcctcctggaagacttggcaacagccaggagtcctgagtgaaccgctgtccttttgaatccctgagacgggctgcagggatgaggggctagaactgacaggaagacaggacagagagcagcacagcctcagaagtgcaggacagaggtgacccaggcaggcatgacgggctgtggcttcctgccctctgctctcacagcacccctgatcccactcactgtggtaccacgcagatgggttggggcctgtaaatgtcaggtgggaccagccagaggagctttgctgccagtactggcatgtcaggatgggggtctggtggtcagcacctcctctggccagtggtcttgtggggagaggcatccatgtggcctcctcctctgtcgggagggctgatgtgcagagaagtacggacttggagggcagctggatgagctggggcttgctcagggacacaggtctgtgtgttgtgccaaggctgaccccctcatcccacaccagaccctgcctctgactctgtgacctcagcacctgacttctgtctctcaggtcatctcccagtcagtaaaacatttgtgtgacgtgaggaggggcactgaagtgggtgatctttaaggccagatgtctctgtaaaagccttgactatcggaagcactgggctagggcagtgtagtacccagggggatgaggtgcatcagagcagcacctgctgaggccaagaacggaggtggctgctgccggcctccgggaggtccccttagggaagcatttcttcaggggtggcccagggacctccggcatcagggcctgcatggggattctgtgccagcccagccctgctaagtcccagccttgggaacctgaggagggtatctgcctatttttcttttaaacatgtttcttaggttattcactaaagtttgagaaccactgctttgtggctttgaaatgttcatttgaatttttctatgattactaagatttttgcccttaaggctctgtatataaacaacatactgtataaaataaactgggaatggcgtgaaaacagcatttgcttctgaatctaaaatatttctattattttcttgaaattgagtgtgcagtaggttatggtggtgttttggaagaaacagataaaacagattttgtgtgtgtgtgtgtgtgtgtgtgtgtgtgtgtgaccttgtcttagggattcatggcgaagggtccaccttcagcaccctgtatggcctcctcctgtgggacatcatcttcatggatgggattccggatgtcttcagaaacgcctgtcaggtactccagtgcccctgccccacgagtaggtccttctgcacacatccgtggctcacgcccacctgggcaccgtgtgtccacagccagcagaaaccatctctgttacggtcctttgggtcatccacaggtcaagatgataacttattttaaaaatctgagtaatagaatttaagatgtaagtatgtgaagttttaaactttaatttagcctccaccttacatttagacctttcgtataaagtaccatcagcatcagccctcccgagcacctgccgtgtcgcaggcactgtgccaaggagctcacagacatgggcacatctgcctgttcagaggtccacccagctaagcgaaaagctgtttttgcaaattattactctaaaaaacaagtttaataaattgcttttatatcaattaacttttacttatcttttgagagaaagaatgtatcggttggccggtttccaagttttgtatgtactgactagtcctctggtgaacacggctctctgcaggcacagtatgacagcttgctttccctgtgacacaggcattccccctggacttgtgcacagacagcttcttcacaagcagacgcccagcccttgaggccaggctgcagctgattcatgatgcccccgaggagagcctgcgggcctgggtggcagccacgtggcatgagcaggaaggcagagtggcttcccttgtcagctgggatcgcttcacgtctcttcagcaagctcaggtaatggttcacctgcatggcaggatttgctcagaaagttaacaccgccccagtgctgtcttttcagcaactttatcaaaatacacatgtgtgtatatgtaaatacatgtatgtgtgtgcatatatatgatatatagtatatatcatatataaaatatatattatatctttattatatttattatattatatattatatattacatattacatatataatatatattatatattatacaatatacaatatataatataatatatgaaatatataatatatcatataatatatataaaatatatattatatcatatataatatatataaaatatataatatattatatcatatataatataatatataaaatatataatatattatatcatatataatataatatataaaatatataatatattatatcatatataatataatatataaaatatatatcatatataatatatataaaatatataatatatatcatatataatatataaaatatataatatatatcatatataatatataaaatatataatataatatatatcatataatatataaaatatataatatataagatatcatatataatataatgtataaaatatataataatatatatattaatattatataaattatatatatgagaataccctatccccctggccccaatgccactgttagtgatggaaacatactagggtgttagaaaagccccagctgtgcctttgccacccctgagttgacagctttcttttgcttgccctgtggctgaggcagggaggataccttctgtgttccttcaactgctgccctctatgaggccatgctgtcgcgttcctgagtgcatcctccacatccctcttcctcagcgctccccagcatggccacgctggcagaagcctggaaactgaccacaggaggaccagtctcccaccacttgccagtgggattccagccatggctctgcagctctggtacaagcagcagaacagcgcatggtgggcctggggtccatgtgcactgaattacatatacactgagcttttctccgtctcgtgatccctggagcctatttccattctctgtcacgagggaagtggctaactgtcctgtgttttgtgttcaggatcttgtctcctgcctggggggccctgtgctcagtggtgtgtgcaggcacctggctgctgactttcgacactgtcgagggggcctccccgacctggtggtgtggaactcccagagccgtcactttaaggtcagttgaggcagaatggaaagtcctgttggtaaccttattagcaactgaatcagaggccacaagtaggcatttcttgagtggctgttggcaagattgaattccttgagagcttttgggccgagggcctgggttcctgtgggcctgtcccctgcgactggcttcatcagagcaggcgggtgagaggagccccagagtgtgagcaagacagagctccatctcttatgacttgatgtggacatgatgttccatcactcctgctgtattctgtggttaggaacgagtctctagtccagctgacactcaaagggagggggtcacaacgggtgtggacaccaggagctattttagaagcttaccgataattgtacattttaaaatgacttaaagagtataatggtttgtaactcaaaggataaatgcttgaggggacagataccccattccccttgatgtgcttagttcacattgcatgcctgtatcaaaacatctcatgtaccccataaatatatacatctactatgtacccacaaaaaattttttaaaaagctcagagagtgaacacttccttgaacgctgtccactagcccagccctgctgcccatcactggtgatttgttttctcattattgagttttgagattaaaaaattatatatcctggatacaagtcctttatcagtgacatttcatcccagtctatggcttgtcttttcattttcttaatagtgtcttttgaagagcagaggtttcaaagtttgacaaaatccaacttatttgttctctagtggatcatgcttttggtgtcacatgtcagaaatacttgcctaatccaaggtcacaaagagtttctcctttgttttcttctagaagtgttatagttttaggttttacattcagttttatgatcatttgagacgccatttgtatacagtgtggggcatgcactggaattcatttgtggtgtgtggatatccacttgttccagctccatgtgtcaagaagaccatgcttcctccactgaattccctctgtatctttgtcaaaaatcagtaacccatatatatgtgggtctgtttctatatactcttcggttccattgatctgtttgtctgtatttcttgattattgtagctttagatacatcttggagtcaggtagtgtaagtcctataatgacttgtttttcaaagttgttctggctcttttgcatttttatttgaattataacatcaaattttaagtttccaagaaaaaaaaaagccagctgaggccgggtacggtggctcacacctgtaatcccagcactttgggagacagaggtgggcggatcacgaggtcaggagattgagaccatcctggctaacatggtgaaaccccgtctctactaaaaatacaaaaaattagccgggtgtggtggcgggcgcctgtagtcccagctacttgggaggctgaggcaggagaatcgcttgaactcaggaggtggagcttgcagtgagccgagattgcgccactgcactccagcctgggcaacagagcgagactccatctcaaaaaaaaaaaaaaaaaaaaagccagctgagattttaattggaattcctttgaatctgtagaccaatctgagaggaattggtatcttaacagcattattttgatcagcaaaaatgggagttgattttgtaaaatattaagaatttttgcatatatgttcatgaaggatattgagctgtacttttcttttcttattatctctttgttgggttttggtttcagagtcataccagcatcagagtgggatggaatagttggtgtagaattagtattattccctaaacatttgatagaattccccagtgaagcagtatgggcctggagattttggggggaggaaaatttaaagctataaattaaatttatttttaaacaacataaggctgttcatattatctgtttcttcttgattgcgctttgctagtttgtgtctttcaaggaatttgtccatttcatttaagtattgtcttaaagttgtttatatttgtttcttttctttttttttttttttgagatggagtctcgctctgtcgcccagactggagtgtagtagcgtgagttagctcactgcaacttccgcctcctgggttcaagtgattctcgtgcctcagcctccctagtagctgggattacagctgtgcaccaccatgcctggataatttttttttttttttgtatttttagtagagatgaggttttgccatgttggccaggctggtcttgaactcctggcttcagatctgcccaccttggcctcccaaagtgctgggattacaggtgtgagccaccgcacacggccatgtatttcttactgtattttaatatctgtagaatctttatctctgtcatgctcttattcttgatattggtaatttgtgtcttttctcttttttccctaatgagtctggcaggaggtttatcaatttactgattttctcgaagaatcagcttttggtttcatttgtttttttatttcctagtttctcaaggtggaagctatggtgattgctttgagaacttcttttctaatagagttaggtagtgctccaaatttccttctcagtgctgctttatctgaacctcacaaatttagtagttgttttcattttcattcagttcacaatactttctgatttcccttttgactcttctttgatccttggcttatttagaagtgagtcatttacatttccaaacacttgagagattttcaggtatctttctgctattgatttgtaatttaactccattgtattcagaggacatattttgtatgatttgaatcccactaaatttgttgagacttgttttatggtccagaatatggtattccctggtgaatattctgtttgtacttgaaaagaatgtgtgtttagcatttgttgtgggcagtatttttaaatgtcaattaggtcaagttggttgatagtgttgtttaagttgtctgtgtccttactgatttcttatttacttgttctataaattattgagagaatattgatatctctgattataattgtggtatttcttttctttttttttttgtttttgttttttgagacagactctcactatcacctaggctggagtgtagtggcagtgcgatcctggatcgctgcagccttgatctcccaggctcaagcaattcttctgcctcagcctgttgagtagcccgaactataggcatgcaccatcatgcccagctgattttttttattttttgtagagatggggttccaccatgttgcccaggctggtctcaaactcctgggctccacgttggcctcccaaaatgctgagagtataccgtgcccagccaatttgtgtatttcttcttgcgtttctatcactatttgcttcatgtattttgaaggtctgttataagacgcatagacttttaggactgtcatgtcctcttcatgagtctacccttttatcattatgcagtgaccccccctttacacctggtaatctttgctctgaaatcaactttgtccgatattgtcaacatgtagccacttcagccttcttttttttaatgttaacatgatacatttttccattcttttacttttgacctgttttatcttatttttaatgtggatttcctgtaggcatcatatagttgggtcttacttttgaatccaacttaacctctgtcttttaatggggtgtttggaacatttacatttaatttgattattgatatccttagctttaaatcctgatacttattttctctttgtctcagaactcttttgtcccttgtctttttcctgagtagctggaaccacaggtgcacgccaccatgcctggctaatttttgtggtttttgtattttttagagatggggttccaccatgttgcccaggctgatctcaaatccccaggctcaagcagttcacctgccgtggtctcttagtgttgggattgcaggcatgagccacagtgcctggccctgtcttatttttaaagattgcatttgatagctttgctggcttgttagctgtaactgttcattgtgttgaagtggttgcgttagtatattatatatcttaaacttatccaccttcaggtgatacacactttagagtaaaaagaacctttcaataatatatatcttcccttccagcctttgtggtgttttcatatattttacttctacgtgttatatgttctataacatattatttttgctttctacagttgattaatgagtctgtatttactcatgtacatagcatttccagtgcttgctattcttttgtgtagatccaggtttctgtgtagtctcattctcctgcttgaagaatttcctttcacgcctgtaattccagcactttgggaggctgaggtgggcggattgcttgggctcaggagttggagaccagcttgggcaaacacagtgagacctcatctctacaaaacgataaacaaattagctgggtgtggtggtgtgcacttgtagtcccagctgcttgggaggctgaggtgagagaactgcttgaggctgggaggtcaaggctgcagtgtgctgagatcataccactgtataccagcctgggcaacagagtgagaccttgtctcaaaaaaaaagaaaaaaagaaaaagaaaaaatttccatgtctagaagttctgctagtaatgaattacagtagttagccctctgtatccatggtttctgcttctgtagatgcaaccatggactgaaagtatttggaaaaaagaaaaacaataaaaagtaactacaacaataaacaaatcaaataaaaatacagcataacaactattttcatagcatttatattaggtattataagtagagatgatttaaagtatatgagaagatgtgctagaatatgcagatgcgatgccattttatatcagggacttgagcatccatggattttggtaacagagggggtccttgaatcagtcccccatggatactgagggatggctgtatttaggttttgtatgtcttagcctttatttcacctttgtttttgaaagatattttctccgtgcaatgaattttatgttgacagttatttttcaatactttaaaaatattagtctactgtcttctaactagcatggtttccaatcagagaatctttttttttcctctggctttaaaaattctggctgctttgactatatcccctgattatacagttgtgatatttcctagggtgccgttacatttgtgtgcctgggattcattgattttcttcaatctttgggtttactgttttcatcaaatttggaaaatttttggccattttttctttaagtatttttttttctcgttcctttggggactctaattaaatgtcccttaggctgctaaatgctgtatttaaacaatttttttctatattttacctatagtttttattgctgtgtcttcaagtctagtgatgtgtagtgaacaaaacacacaattcttgccttcatgaagatgacatgtagtatatatttttatcttatgaatgccatgaaagaagtgcatagggaggatatacttagagctgtgacctctccagatcagtttaagctgagcattgaaaggtaagaagtcaggcatgtcaagaacagggagaaatgtcccaggcagcgggaacagcaagtagcaagtggaagtgagggccttggggtagggaagagactggtcatggcaagaaggttagatttaattgaaaatgtaacagagtaatcggagggttttaagcaaggaagtaaaatccagtgcatgctttaaaacaatttttcatttgctatactaagaatcagtttactcatcctctgtgaagaactgtctagtttctacagaatagaagaatttctgaataaatttcttagctacatacagacgcttctcaacttatgatggccttatgtcctgataaatcctacacatcaactgaaaatattgttaagttgaaaatgcatttaacatatttatcccaccaaacctcatagcttagcttagcctaccttaaatgtgctcagaatgtgtgcattagcctacagttgggcagatcatgtagttcactgcaaaccgtagagtactggttatcctcatgatcatgtggctgactgggagctgtggctcactgctgctgcccagcatggagtatcatactgggaaaagatcaacactcagagtatggtttctgttgaatgtatatcacttttgcaccatttttaagtcaaaaaatcctaaggtgaaccattgtaagtgaaggaccatccgtatatttgtgttacacttacaaatacagtgagagagcagaagagccatttaaatagttgtcagtgacaactacaacttacttgaatggcttttcattcagtaagatactaataacaacttttaaaaatttcttttccagctggtggaagttaaaggccccaatgatcgtctttcacataagcagatgatctggctggctgaactgcagaagctgggggctgaagtagaagtctgccatgtggttgcagttggagctaagagccaaagccttagctaaaaggtatggaattggggatatttggtcatacattaatgtaagattttcaagagtataaaacatgttttatttaattttgttatcgtgcattataaacctgatagtttgacttgtcattttacagtgtctgcatatcacaaaacagtgtttgcttgaatacactcattgattccacacagtgggtaataaacttttttttttttttttttttttgagacagagtctcgctctgtcacccaggctggagtgcagtggtgtgatctcggctcactgcaacctccgcctgctaggttcaagtgattctcctgcctcagggtccccagtagctgggactacaggtgtgcgccaccacgcctggctaaattttgtatttttagtagagacggggtttcaccatgttggttggccaggttggtctggaacttctgacctcaactgacctactcaccttggcctcccaaagtgctggggattacaggcattgagccactgtacccagctcataatgaacttttttaaaagagaaaaattttgttgaccattattggagctggatgcatctatatgattagatgtgcaaaaagctggaaaactcaaaaacaagtgatgattcatctttaggttttttttataaaaaagtagtggctgggcacagtggctcatgcctgtaatcccagcactttgggaggctgagcgaggcaggcgcatcatgaggtcaagagatcgagaccatcctggccaacatggtgaaacccatctctactaaaaatacaaaaaattgggtgggcttggtggcacacgcctgtggtcccagctactcaggaggctgaggcaggaggatggcgtgaacccgggaggtggagcttgcagtgagccgagattgcaccactgcactccagcctgggagacagagcgagactctgtctcaaaaaaaaaaaaatttaaaaactagcataaccagtgtttccttcaagtaattaattatatgggaaaccgagattcttgaattaagtttttctttactgccctatacacatttagctgttaaacttttatgattatctaagaagggctgaaacagttgaaattccaatttctttaggaatcaaaacattctcatgaagttgtgttgatttataacatgtaaatgcttgttctactgattgggcccggatcatgaaaggaatgaagtctttatcagaggcagttgtccttcattgtccatctccctgggaccatccctaataactagataggggtattttctctgttgacagtacagtcaaatcggctgctcatcaccattgtgggagggtctcaggctgggcaagggggtgtggtagaaaggtgatttatccatgcgccaggcccgggagtcagggactggaaccccagtctgtctcttgacttctttgaagccttcttgggggaatattactccccagtttttatatttatttattgaatggaaggaccagttagggcatgatctatcaatatccacatggctttaactttagccacttccgaattgctgttaaaaaaagttactgatcactacctggctttagagggcaagcagaaacatcccatggatgacacagaagtatgggtaggagaagatgccttcacctcttctatcaatcactgtgttccagtagatgatttcatactgacaacaacaaacagtcgctgtggaattttattaagccatcaaaatttccttcacattcaatactgttgaacaacaagataacacatcttcttgctcatcccacttgaactcaagtcatcaattttaggcacaaaggttttagttttctcgggaaatcaagttttaaccacttgaggttactactgcagcaagcagattttgttgacaaatgtgaacagctttcaccctctgttagtacaaattaatatcctttccttaaataaagttagttagctatttttggtttcaaaatcagtttccatcataaaataacagcaagacactgtacacctttacgttcaatactagaaatttcacccagtgcatcagcatctgtgcggcattccctcagcacgggctctgctggcgggcagcaggggtgctgagctctctctagtgcgccctgtgcagccacaccactgctgtcaccacatgtccctctgacggcagaggtggtataagcagcttcaccctggcccgactgaaggctgtcatagttgtttttcatattatgcacaataaactgtagcacaataatcatgatataacaactgtccagcaaaaataaaagtattttacatttgattatcatacaaaaatatgcatttttctatttttaaccattattaatagtacctaatatttttaaacttgtaaattaacaacaataaaatactacaagagttaaaataaacgtgaaggaagaaaattacagagggaaaaatgctcaatccaaaacatttagtaataataaaaaagcagctaaatgaaaaagggagaattgtgattacactgtcaatggcaggatacgctgtggtgttataaggagattgggtctggtttctaatcaaggactgtaaaatgtttaataattctatttgtataaactgaaactagcccttattttctaggcaacaagttggcaaaaaccttgggtttacccataaagtgaatttcttaagatattttttaagaactcctgtcctgttatatccagagacattatcaaattttaaaaggcaaataattcaaaaagaaacagctattcagtacatataaaggtaaaatacagttatcttgaaaacacttgttttagaaaaggaaataagctaactagacactttactataaaaattttccatatcttaggatggcagtttaagaaacagtcaaatttgaaagtatccatgttttaagcggggaatgaggagtgtgggggaggtggtgccccgtttcactgctgtaagaagcttcagctttgaccgctacagtggtaggtaggctcttgtcacacagtttggaaatactttactttagagagattcagatcaagcaaacaactgtgtctgctcattctcctcaactttgctgtccaaagttgggggctgggggagcacttctgtcgctattcaaatggcagtgttttgagagaatccatttttttatttctcctctattcctaagcattaggaactatgagagaaggacatctgtgcaggtgcccaactcgtaacctcattagttatttccagggggaagtgccagcaatagtttaccacactggaaatactgatggccaagcccagcacgcctcccagcaagccttgtttgtttttgagggcgagttttggcatagatggcactctcctgtctacagcatacacctctgtggaatcagcaccccagaggccactccccagtggctttcagaggaacaagactctggggactcctggctatgaagcttagtatgaaaagcctatttcaaatatgcaatgggattttcccaccccaattttaaaaagtgaaattatattttcttctgtaatatttgtatcctaaagtcaaaggcacttctaagtttaattatctgcagcaaatgctttaaaattaacagtgcatatcattttaaagttgaccctatgaagttaaaagcaaactcatgatttcaaaacacagtgatctaaggttccaaagaaggtgatctaaaatcataaattctggccccagaacactgaaccttcatcaggtgagttcaattagagacgacagaaagtaaccagaaaaatacatgaatacttcctaaaacctgctggaggttttatcagatgctcctaaaaatgacacgaaacacaaatttcctaactttcctgttgtctgctgcctggggctgctaatgtgactgactatcagatagccttcaggaggtggtaggaaaaatggatggagacaaaaatgtagcagacaacatgaacagtttgatcacggttacaagagccagacctgtaatgacagaaagaggacaggaacaaaatttacatctctcttaaaataagtgtgaaagaagcatgattcaacatgtttttaaatattagtgcaaattccaactattattcttacatataaagttattagagattcaaacgcctaggttagcaatgttaattcagaggaaaaaagttgacagcttccctcaaaatgttcagaaaacaccctattttagtcttcatttgctaatgtctcagtagacaaccatattttggccccacttaaaaatttgcttaatggtgttcctaaaatgcttcgtctgcacagattccctacaggagaaaatggaaatgaggaggagagaaactccggtgtccccgaggtgtcggtgtggtgagggccgctggcgttgaagtacatcctgctctggcccagctccccatagcaggcctccagggggccactgcgctgttgccgcagcatcctgctcagtacgtcgacttcatcagccaggagggagagcttgtgaaaggctgtgatggagccacccaggctgatctgggcctcgggaacccagcggaagtagcacagtttccacagttttatgtgtgttccagagacacgtggcagaataacaccgtgcaggttggcgggtttggaaaaccattctctaaaatactgctccgtatcactgttctggctgtcggtttgctgagctggatctggctttggttttaatatcaatgaatttctccttggaagtaattcttggtcactgatgattccattctttaaggcagacggcattcctcttagtgtggagctgtagcttttctatacagaagagattttattatgttccggggattccctttttagaaagattgaaggatgcaatggcaaatataaactcaatactatgaaaaattaatggaatttcagcctcaaagaacattttcctcccttcctttgtgtccttattctaatcctcctcccctggaattacacttttttatgtgttgactctacctaggctgttactatcagcctgaatgggggcgggatgagagtacctcctatccactaatttgcttaaggataagttctaagacgggctagaaaaaacactagacctggccgattctatcaagaacaatggcaaactgaacagaggcagtcaggaggccaaatgtctgattctttgttctgtacctttcagtagtctgcaaattttctaccaaaaaaaatcccaagaatttatttgggaattattaaaaaggcaaacaatgaatgttattaggacaagaatatagcagtcaggaggccatgactacatcacagccaggcggcattccctgccacagtggcggcttgaatcatcaagaaatggataaatggggctttagtaaatcaggcttgcaggctcaaagctgcaatctgcccactctcaggtactgagactttgtgggcctcagacaccaggaagaaagctgggatacagtcatttgagttaaaaagggaatgacccctcagaaacccgcattagcagtgttactcttggaagtgcctttacttttaacgctctctgttctgaaaaagaggtgtttggttacgtgtgagccaacatcacgttttgttagctgtgatttacctttgtccgtttaaaagacttcacggagccattctgtatacaaggtgtgctctttccaatgtagaaggggttatggaaaagggtgcgatcctttgctgtaaactggagagaccagtcccaaacagaggggaattttaagcccttctcatcacccaattggatgtttttgcttatagcaaattcctgcaaaataaataaataaatatttgcaaaactaaa

SEQ ID NO: 154 - DNA, 2126 bp, Homo Sapiens
ccgatgtggaagaccccgaggtggagtgtggctgaggccctgagtgtccagccacatggtggcaccagcaccactcctttccttaccacatcaactgattaaagcagtgaccagcaggaactgcccagagaactggctggccttgtttcctgagtctgatctgtttggcggagtgggaggggtggagcaggacccggaccctgagtggctgggatccttcttcctgtccctggctgttgctgagcccgtccccatggtaactgatctgccttgaggaaggagccctgccctgcctgtggaattgtcctgagtcattgctttgggctggggccatgggaagaaaccattgtgtggcagggaaggaggtggctcttggcccaggcctaaaccaggaaagcctgggaaactgggacccacaggtgggcatgaaagggccgcagcaggggctcccagcagtgtgtaagaccgggagctggtctggcaccactgccctggtccttccagctgcctgtcactggtatgatggccccggtgcattgtgccaccagcaggccacagctgtggatcttggaaggcctctggggtcccccgggagcaggggagtgggtgtgggggggaacggatggtggtgagagggacagaccaggcaggctgacgagcagggcgggcctggctcacgtgggcctgtaggcgggcccacgccaagtttcacttcccgccactgctgccagcgagagccgcgggagagtgtgcagccgagtcactactgcctgcctgcctgcctgctacggtgagtgtggcccccacaatgggatggcgcagggcaggagggccatgggttcccccaccccagactaagggggcactaggggaggggccgagtcatgtgaagagggagaccctctcagacagtcgaatgtgctggtcccactaaggaaaccacctcaccctctccaacttcctgcctgaaaatgggccctggagctcgcagacagggcaggattgtgcagggaaggcctgagatgtgcttctgcccaccccctaccccactccctccccttcggatcttaacactgggcactcacacacccaccccatgctcctctccaggctcagcagcaggtacgtacccaaccatgggctcgcaggccctgcccccggggcccatgcagaccctcatctttttcgacatggaggccactggcttgcccttctcccagcccaaggtcacggagctgtgcctgctggctgtccacagatgtgccctggagagcccccccacctctcaggggccacctcccacagttcctccaccaccgcgtgtggtagacaagctctccctgtgtgtggctccggggaaggcctgcagccctgcagccagcgagatcacaggtctgagcacagctgtgctggcagcgcatgggcgtcaatgttttgatgacaacctggccaacctgctcctagccttcctgcggcgccagccacagccctggtgcctggtggcacacaatggtgaccgctacgacttccccctgctccaagcagagctggctatgctgggcctcaccagtgctctggatggtgccttctgtgtggatagcatcactgcgctgaaggccctggagcgagcaagcagcccctcagaacacggcccaaggaagagctatagcctaggcagcatctacactcgcctgtatgggcagtcccctccagactcgcacacggctgagggtgatgtcctggccctgctcagcatctgtcagtggagaccacaggccctgctgcggtgggtggatgctcacgccaggcctttcggcaccatcaggcccatgtatggggtcacagcctctgctaggaccaagccaagaccatctgctgtcacaaccactgcacacctggccacaaccaggaacactagtcccagccttggagagagcaggggtaccaaggatcttcctccagtgaaggaccctggagccctatccagggaggggctgctggccccactgggtctgctggccatcctgaccttggcagtagccacactgtatggactatccctggccacacctggggagtaggccaagaaggaaaatctgacgaataaagacccccgctgccccata

SEQ ID NO: 155 - DNA, 1768 bp, Homo Sapiens
tcaggcctccaggctggggtcatcaggcggcaagtacatgggctcgatgtgggcccacccacgggcctgctcatcggcccaggcgagcagctctgcggcgcggtgcaggaagatcaggagcagggtgtgcacgtcgccctcggctgagtgggctgcgcttggctctgcccggaagtagcggtggaagaggctgccgaggctgtaaccctggcggccccgggcccgggtgccgtggctgtgggcgcggtccaggccccgcagggccggcagcgtgtccaggcagacagtgtcccggggcaggcgggcacccaggcgccgcagctcggcacacagcagggggaaatcataatcaaagccattgtgggccacaaggcagatgggccctgcctggcggctcaggaaggcctgcagcgtccgcaccacggcgccatcaaagccagccttccggcatcgcgccaggccctcactgctcaggccggtgatctcgctggccttggcagtgaaggggcgctccgggcacatgcacagcgtgagcttgtccaggacccggggcaatactagggcaccagactcgtcgtgctccgggttctccagggaggagcggtggacagcaaagagggacagctcggcaatctcgggctccacactggggagcccagtggcttccaggtccaggaagacaaaggtctcggcccggggtgcctcggacatggtgatgttcccacggggatagcaagtcctcaaactgtccgagcgagaggcacaaaccctgaggactggagagaggggttcgcccgggccctgctgtgtaccatcctccccctagccaaagctctgacccttctggggctcacttcctgccacccccgaccacagcacctgtgacctttggctctgggagcgtcagccccactcctgtcacctactgaacagaaaaggcaggcctcagagcgctctactgcctgcctccagccacagtccccagcagggattgggagaggcagaggcagctcagggaccgcaccttggcggggtccagccccttcaccggaatgccttggctgggaacctggggcatagcacactgggtctccagccctggaaccagctgccgggaagcaggcaagcagccacccgaaagagcccatgcagtgcacccagctcccgctgggctcgacctccccacccttgtccctggcacacaggtgctggtcccgagctggcctctgcctgcttgcccccaggctcccggggagactgtccttgccaaccccaccacaccagcttacctggggcgggcactgaccggcttcctgggcttctgggcacctgtcgccacacaggctgctctaggcggcctttaatcagcggccgcagcccgcccccagctgcctgttggccaacaatgaggcctggggcctcaggacctgcgcagccggctcgctcgccaccccctcgctagctcacagccactgagacacacgccccgtgtttacaaattaggaagcaggccccgagctcttcacaggcacggggaggaagccagagtggtgcggaaggcagtaacctccacctagccaggctgtggctgccaggcctggcaggcctggggtcaatgcctcccccatgctggggccaatgcctcccccatgctggggccagttacacaaaggcaacaggtcctctttgccaggcctcagtctccccgtcactggagatcaggtgccgctcgtggggatgaagcgagctctggagtgtgaccaaggtg

SEQ ID NO: 156 - DNA, 41973 bp, Homo Sapiens
accatcggccatcagcgccagtgccactcgcgccctcaagaagccgcacggagttcgggccggcagcagcggctgcagtcgtatggcagtgagccgctgtctacccagcgagacggagagctcaggacgcaaccctatgagttggaagccgcaggaggcggaaccgggttgcgggatacgcgttgacgtcacatcctctgggcggggccgcaaggaacccgcgcaaattgaaaggtcagcctttcgcgcgctgtgtaggcaagttacccgtgttctgcgttgccggccgtgggtgctctggccacagtgagttaggggcgtcggagcgggtttctccaaccgcaatcggctccgctcaaggggaggaggagagtcccttctcggaaggtgagaggagcgggctgtgcggaggctaatgggtgggttcccttgggggtcgacctgcgcgtcacctccgaccctcctctcgggattcgggtcttccaggaagggaaggagagggtctggcgtgatcttcccaacccaacagcggagcccttagcctgagtggagtatgtgttttgttccgaggggacgtctggcaaccagaggtctgcagttcagtgaacggagggagataagagagcagacgattccgggctggagcaggcgccagggttgccagacttacctcatttttccgcagaagctggcagtccaggttttacatgcaatctctccacctttaaatgttgacaagtacattttcccataatattttgcaggcctaaggaaacgtgtcgtctggaatgggcttgggggccacgcctgcacatctccgcgagacagagggataaagtgaagatggtgctgttattgttacctcgagtgccacatgcgacctctgagatatgtacacagtcattcttactatcgcactcagccattcttactacgctaaagaagaaataattattcgaggatatttgcctggcccagaagaaacttatgtaaatttcatgaactattatatccgttttcctcggagtgagagaaaactctttttagatatcatctgagaggtaagagactgtttttctgaaactgtggcttgaggaccacctgcatccagattaactgctttgtttaaaattcattcacagcagaactagtgaatcccagtcactgagtggagttgagagtctaagaacctctgaaatttgagaactgctggaccagagcctttagagctctgataaggtgtcaacagggtaaagctgcctcctgatcctgtactttctttcttcctttccttccaaacttaacgtttgataggagagatttgtattatgaaatgctaagcaactgctcagtgcccattactgactttttattgtagagtggggggaggtcgtttcatcagaaagggttgtgacagttccagaatctctgtatagaaagggcttagggggctgcaaccggaatggaagggggtggaaagttaaagcatttgtcttgaagctgtatttgcatagcagacgcagtttcacagttctttagggtagctttcagagaggctgatggagttgcccctgggcgccaccactgtttattaccagaatgttcgtgcttagaataatgcgttctaatagcagtgaatttcagtcctaaaaaagtacaggatcatttctgtaattctttttgaatttttcctttgttttttaattgaaatacttaccttcctacaaactgttttgagtttctactcctatttgaatttgcacgttgacccttatgattaatgccctttgtagaggcaatgcgatgccatcgcatgcatggttttgtttgtgcctggctccttgaagcatgtgtcaggagtgaaagtgcaaaagcactttggaaagactaaacaaacaataagcaacagtcaagtggcattagaggtagtattagtgattaatgtaaattctaccctatggaaattgtttgatagggaggagcccagctaaaatattaaagagcagtgattcttgaatatctgaacaatttctggccgggcgcggtggctcacgcctgtaatcccagcactttgggaggccgaggcgggcggatcacgagttcaggagatcgagaccatcctggctaacatggtgaaaccccgtctctactaaaaatacaaaaaattagccgggcgcggtggcgggcgcctgtagtcccagctactgggaaggctgaggcaggagaatggcgtgaacccgggaggcggagcttgcagtgagccgatataggccactgcagtccctcctgggcgaaagagcgagactccgtctcaaaaaaaaaaaaaaacaacaaaccaatttctgcattggactccaagctttctcttcatttgtctaagatgttttaataaatgtatttttctttaaatattactgttctccctgtctcttttcatatcaggtagttaatttggcaccatggggatacagggattgctacaatttatcaaagaagcttcagaacccatccatgtgaggaagtataaagggcaggtagtagctgtggatacatattgctggcttcacaaaggagctattgcttgtgctgaaaaactagccaaaggtgaacctactgataggtaagtctggaccttatgttaattctttgacaattaagaatgagacctacagtgcctttttttctcccccagaaacggattgttttcactcaatgccagaacttatcaggaagtaaaagttgtatgttttagaatattcccaaatcagggatgacttccttctgtgataataggcctagttttctttctttataataagccagagtatcaagacactgatggacaaagactattaatatctcctttattctttttttttttttttttttttttagatggaatctctagctcaggctggagtgcagtggcacaatcttggctcactgcaacctccgcctcccaggttcaagcaattctcctgtctcagcctcccaagtagctgggattacaggtgcacaccaccatacccggctaatttttgtatatttattagagacagggtttcaccatgttggccaggcaggtctcaaactcctcaagtgatccgcctgctttggcctcccaaagtgctgagattacaggcgtgagccaccatgcctggcccaattcttaacctaagataaattttttaacaaatgctttgaaaatccgtgatgatttctgactcccacattcttgggtacagaaaacatactgctaatcctggttagcaaaaaaacaaatgtgttgtaaaattcattataatttcatatttgctttctcctgaattttgctttatgatcagcaggtcccaatcattgttccataccaatgcaagttcactgtcactgatctacaacacatagaaaaaataaggataacaatgtagtgagtctttcatcaagatgacatatttaaaaggtcatcttttttttctttattttagctgctaagtttgcgttatgcaaaaagattaaagattgttttcccattcctgtttttgagctaaaatgtccttttctttataaaatgatagaagttgtaaatgcagttgtttttgtcacaatacctaatgtaatacctgacccttgattggatcctggatttggaaaaaatagtagcagtggtgtcctggagccaattcatatgagctctttatacaccatgtcttctcagctcagcattcatttgagttcaagtaggtagctcatctgccattgagaaatatttatctcagggaaatcaggcacctcttcccgcagaactggttgttaaacatttaccaggacaccactgaatataagaaacattgttgagacaagtgtaccaattataatataaactgagtattagataatattatgttactattaaattacttagctgtgatatggtgtcgttggaagaatccagtgtttattgtactattctttcaacttttcaatagatttgaaattttttaacataaaatgggggggaaagaccagatttgaaaccaaagatgtcagaattagaagggatatcaaagctctttaattcacagataaggaaaccaaggcttggagggtcaagtagttcaccagacatcacatggctcgtaagtatccaaggcaggatttgaatccaagtctagtaagttagagttccaattcctatgaaaacatctgcttaaaataacaaaataaaaaaccttctctttccatagttttctcatctggcctaaaatagagcagaagtattaccttaagaaaggtgaagcactgaatgtttttctttttttccataggtatgtaggattttgtatgaaatttgtaaatatgttactatctcatgggatcaagcctattctcgtatttgatggatgtactttaccttctaaaaaggaagtagagagatctagaagagagtaagttaattctctacttaatctctaacttcattgcactaaggtcagacactgtagtctatatgataccaatttttaaaattttaagccaggctcagtggcttgcacctgttgtcctaggtactcgggaggttgaggcaagaggatcacttgagcccaggagttcagcaccttagtaccctatgatcatcgctgtgaagagccactgtactccagcctgggcaacatagtgagaccccgtcactaacaattttatctttattttttgacagtctcactctgtcgcccagtctagagtgcagtggtataatcttggctcgctggaaactccacctcccggattcaagcaattcttgtgcctcagcctcccgagtagctgggactacaggcacgtgccaccacacccggctaatttttgtgtttttagtagagatggggttttgccctgttggccaggctggtctcaaactcctggcctcaagtgatctgcccgcctcagcctcctaaagtgctggaattacaggcatgagccactgtgcctggcctaaaaaaaaattaataaataaaattttaatttgttgaggcttattttatagcctagtatgtgaacagatttccttaaatgttatgtatctgctacattatcacttttgtttaaaagtatcttcgttactacattttctttgacaaaaagaattgctgtggaaaagcctaatggtaatcttgtgtgtgtgtgtgtgcatataatcattctaagtcacttgttctttttgccttagaagcctaaagcatctgggttaatgttctcaagggcctggtgtgtactttctaatgagtcaaaaacttttttcagttctaggaaagcttcttgaattacagttctgttacagtttcttgagtcagcctcttaaatgttttatatttaaaaaatgttcttcccttgcagaagacgacaagccaatcttcttaagggaaagcaacttcttcgtgaggggaaagtctcggaagctcgagagtgtttcacccggtctatcaatatcacacatgccatggcccacaaagtaattaaagtaagacaaaggggcagatgggcaagttcaccaaagctagttacaacttgtttattgatgggagaggaagaaaatcaagggtggaaaattgttctaggcctaacctcaagtaaagggcagatgtcagaaggagaagggaacagcatcactagatagagaagacttcagcaatttccaaggagaaatcctaaggcataagtaaggctctctcttttaagtcatgttattccatagcaatggaaggaacagggccaggcacggtggctcacaccagtaatcccagcagtttgggacgctgaggcaggagggtcatttgagctcaggaatttgagaccatcccgggtaacataatgagaccctgtctctattaaaacttaaaaaaatgaagagatggaaggaacaaattcctggaggcatcggtctcacccaactctcctacagtcttcaacacttactgtaaccggcactcttgaatgacagatctgtgatgtagcttcgttgccccaggcaccctacagacttctgttccctttcacctcctccttgcagcagcttctttccttattcctgtaaatcttagtgtcaaggtgcccacattcccagccctcactttcccctttttagagcctgcttggttaaggtgttgtggtttttttgttcgtttgtttgttttgaggcggagtttcactcttgttgcccaggctggagtgcaatggcacgatgtgggctcactgcaacctctgcctcccgggttaaagcgattctcctgcctcagcctcccaagtagctgggattacaggcatgtgccaccacgcccggctacttttgtatttttagtagagatggggtttctccatattggtcacgctgggctcgaactcccaatctcaggtgatctgcccaccttggcctcccaaagtgctcggattacaggtgtgagccaccgtacctggcctgttaaaggtatgatggtaaaggtgaagtcagctttttctagcttacagttctgtcatccagttcctgagctaaaataggcgctacacttctgattttggctttgtcatttgagtctctggctcttttctgtatgggtcaagctagaaggaaacgatgcgatgcaggacagagcgtgaagtataaagaaatgtgtgctctgtgtagtcaggagaagagaggctgcattgtgtgcggaagtagaggagaaaccctgattggacacaaatagtggtgtaaaagtgtgtccagaattggtgggttcttggcctcactgacttcaagaatgaagccgcagaccctcgcggtgagtgttacagctcttaaggtggcgtgtctggagtttattccttctgatgttaggatgtgttcggagtttcttccttctggtgggttcatggtctcgctggctcagaagtgaagctgcagacctttgcggtgagtgttacagctcttaaggcagcgcgtctggagttgttcgttcctccctgggggctcgcggtcttgctggctttaggagtgaagctgcagacctttgcggtgagtgttacagctcataaaagcagcgtggacccaaagagtgagcagtagcaagatgtattgcaaagagcgaaagaacaaagcttccatggtgtggaaggggacctaagtgggttgccactgctggctggggcagccagcttttattctcttatctggccccacccacatcctgctgattggtagaaccgagtggtctgttttgacagggtgctgattggtgcgtttacaatccctgagctggacacaaagattctccactgtccccatcagattagttagatacagtgtctacacaaaggttctccaaggccccaccagagcagctagatacagagtgtctattggtgcattcacaaaccctgagctagacacagggtgctgattggtgtgtttacaaaccttgagctagatacagagtgccgattggtgtatttacaatccctgagctagacgtaaagattctccaaggccccaccagactcaggagcccagctggcttcacccagtggatcccgcacggggctgcaggtgaagctgcctgtcagtcctgcgccgtctgcccgcactcctcagcccttgggtggtggatgagactgggcgccgtggagcagggggtggtgctcgttggggaggctcgggcggcacaggagcccacggagggggtgggaggctcaggcatggcgggctgcagtcccgagtcctgccccgcaggaaggcagctaaggccccgcgagaaatagagcgcagcgccggtgggccggcactgctgggggacccagtacatcctccgcagccgctggcccgggtgctaagccctcattgcctggggccgacagggccggccggctgctctgagtgcggggccgccaagcccacgcccacccggaactccagctggcccgcaagcaccgcgcgcagccccagttctcgctggcgcctctccctccacacctccctgtaagctgagggagtgggctccggccttggccagcccagaaaggggctcccacagagcagcggtgggctgaagggctcaagtgccgccaaagtgggagcccaggcagaggaggcgccgagagcgagggagggctatgagtactgccagcacgctgtcacttctcaaaaggatgagagtaggactattgctggaccaaaaaaggaaaaaaaatgagaaaaatagcaaattgttaccaaaattgatagcagcaggatcttgatacctctttcctctttttttctttttttctttttttttttttaacttcccaaagcctgtcttcaggccttgggaaccattttcccatagtttagaacatggaagttccagttccagctgcctagattttgacacagcggctatgataggggctgtttttcttggcaagtttattttaaaagtattttctcataatgcattggtttaaatatagtgctatagcctataatatatatgtaagatacattattagaggagagttatgtatgtgtgtatatatacgtgtgtgtgtatatgtatacacacatatacctacgtatatattttccccccaagacattgctggatatggtctataattttatcaatactgtgtcagtacattgactttcgtagcttgacaggacaacctgttatttttatggggaagatatattcaaaactccaaacaaatgtatattttcggaacatagccattcttaagatggaagttttctataatttaaaataagtgggccaggcacaatggctgaacgcttacaatgccaacactttgggaagctgaagcgagtggatcacttgagtccaggagtttgagaccagcctagacaacatggcaaaaccttgtctctacaaaaaatacaaaaaaattagttgggcatggtggcatgcacctgtagtcccacctactcgggaggctgaggtgggaagatcacctgagcccagagcccaggaggtcgaagctgcagtgtgccctgccggctggcaccactgccactccagcctgggtgacagagccagaccctgtctccaaaaaataaaatgattacttttgtaacttgtaggattcttttttcctctggctgtgtagcagtatttcttttctccaaattttataagttgattttttaaaaatgtcttaatggctatataattagttcaacatatactaaaacttacagtagaaaaactctacttcaaaggaaatgatttctcaaagtaatattagcatgtgcctgctgaggctagtaataaagtgggtttgaaacaggaagttgtttagtactttccagatgccgtgctagagattcactgtgattctctcttctaggctgcccggtctcagggggtagattgcctcgtggctccctatgaagctgatgcgcagttggcctatcttaacaaagcgggaattgtgcaagccataattacagaggactcggatctcctagcttttggctgtaaaaaggtactcacctctgactactatatattacttttctatgtagatagtagtgtaaatcaaggagctgaaatttttcctgtccaggaaattatgataatttataatatttataaaatttataatatttataaaatattacaaggtaaattattgtatttaatagatatttgcaactgacatctatttttataatgttaataattatttaaaatgaaaagaagggttttgctgcttgatgtttgtgtaatgtggatactttttcaaagtaagcccttaaggttggaggggtttgttattgttttatgcagattctttagtagaatgtggacgtaccagttttattttttaataatgacaacatatgctttatatttcttgattaggttaggtatactaacttatgtactaaagggttgccatgcagttatttagaattatgtataaaactatttcatggaaaactttatttaggggagaattaagatacaaaactacaggatgttctcatttttgttaatgcctatatttatgactagaagggtctctatcaaaaggttaatactaggttacagtgataaatgagggaatagggatgacttgttttcttcctgaatttctatattttccaaattttctacaataaacatgaattgcttcaataataaggaaaaagattacttaaaaggtacaagtgacagagaaagagaaaatgtttttcgtatgcattactgtttgattatcatgacaaccctgtaacacaagtaggaaataaagagatgcaaaaagagcttgctttataccagaattgtgacagttgagtcctagctgtatagccttgtctagtcatatcctatgcttcagcatactttatttgtaaacttagtaatcatcagcctgtctatctatgtctcctgtctttcagtgttatggtgaagaacaagaaagatttcttaaaattattgcagtggattagataatgacaaaagtggcccttctaggtattaacaatttcccttccttttgaaggtaattttaaagatggaccagtttggaaatggacttgaaattgatcaagctcggctaggaatgtgcagacagcttggggatgtattcacggaagagaagtttcgttacatgtgtattctttcaggttgtgactacctgtcatcactgcgtgggattggattagcaaaggcatgcaaagtcctaagactagccaataatccagatatagtaaaggtaagagtgatttgctaagtgtcatattcaatttctgaagcatttccttaataaaataataaatcataatatggatttaaatattctgttatgcgaataacctatattatattattaaaaggagcaaatgactgaggcactagaactttgccttagcaactaacatatattgggaaaatcatgttttctgcaattggcaaaaaagtagtgatttttaaaacaaagactagtataaagaggctcaaggagaaaatattctagggtaaaattaaactcggagtcttttgacttctgtgctataactctatagtagtggttctcaaactgtttggtcgcaggatccctttacactcctcaagctcctttatggtaatattttttgtttatgtaggcgatagctattgatatttactgaattaaaaattaaaacaaaaatttaaatgtttatcaattcacttaaactttataataaactcattacatgttagcataaatagcatgcttttatgaaaaataatcattttttaaaacaaaaattatgagagagaggaatcatacatttatgcaaatctctttaatgtggcctaatagaagacagctgtgttcgtatacaagttgaacatccctaatccaaaaatctgaaatgttcaaaaatccaaaactttttgagtcccggcaggcaagtgaaaaattccacacctgatctcatgtgaagagtacacaaaataattaaaaatactgtataaaattaccttcagtctatgtgtgtaaggcttatatgaaacataaattgagttttttttcttcttcaccctcttgctgtcagtgtgtggaaacgtaaatggattttatgtttagacttgggccccatccctaagttatctcataacgtgtatatgcaaatattccaaaatctgaaaaaattcaaaatctgaaacacttctggtgccaagcattttggataatgtgtacccaacctgtatctgctgccttattaagcctcatttgataccatgtatcatatatcatctggaaaattctgagactctggacattgctactttgtagtttgtcttaaaaaataaacatcaaagaagctcattttcccccttggatattctctaaacccttaacagtttgcagagcagaaatttcatttttctatttccaggagtataaggcctgagtcctcaggactaagagtgatgtcatgtaatggaaagatctctaggttggaagatagtgtcccaggtgggaataggaccacgtgccttaactagcctgtgactccaggatccgtttggttctctgggccttccctttttcatctatgaatttactatgcaatgtttaggatcctttccagctttaagcatccatgactctcacagaaatcagaatgtcaacttggtttaaaaatatgatctagaaatatttgcatttttttaattctcagattttggatgttctttttttttcctttcttgataaaaaggactttgaagatgaatggataatgtatctcaaagttacacctagaagcacaaacttgatgtactatataactgtatttttttatccttcaaattagtaatagaaaaaccaaagaaaatactagttatgagacttagaattttaagtgatgtaacatggttgtgttagctggtagaattttttaatgtagatgaaagcagttaatgtttcaatccctctttatgaatgtaaatcaatcagccttgaggataatatgttccctgttctttagttgcagataaaatatttttgcatgcattgttaggttatcaagaaaattggacattatctcaagatgaatatcacggtaccagaggattacatcaacgggtttattcgggccaacaataccttcctctatcagctagtttttgatcccatcaaaaggaaacttattcctctgaacgcctatgaagatgatgttgatcctgaaacactaagctacgctgggcagtatcctttctgaaacagaatggtagaatttgtgcatttttcttcaatatttttatggtgatttttttgtgaggcatttagtaaaaagcttgcacattattttttgctctcttttttatagtgaaatctgtatattgttcatttaaattaccatgctagtgaaaattgagaacaactttttgtttataaacccgaggctcatccactatgcatcctgattacttagattgactgacagtagcatgcacagggtccgtcacttacggtacacattccaaaggtggctcttgagaggacctcctcgtggcaagcaagctcgacttatcaggaagagcattctgggcatttgagtgcatcaggagaggatgcccttcccatagccactggccatgtacatgcaggctgatgcagagccctgagtcacttaggtggtggctaggactttcccctctgtttcccttaaaggcagggagtcagtgatggcctgggccctcgtcagaagacaccaactcctgcagagacagatagagactagcaaactgtgtctgctttcagtaatgctgatgtataaagtaaggagactccatttaagtcataaacctatggattttcgtgacaatagaaaacatttttccatcttagtataatatcatttggttggttgttaataaatacatttttccttaatcttgctaatctagatatgttgatgattccatagctcttcaaatagcacttggaaataaagatataaatacttttgaacagatcgatgactacaatccagacactgctatggtaacgttttgatgaccaccctatgaaaacacgttttagttatgtcccgagctgtgattaaaggcaaatcttcatacactaagcttcttttaagcgtttctatatccaggctctgtgcagaatgtacattaaaaacaacttgatcctagagaaattacatgtattagagcataggtatattggttaattttttaaaattaagaagtgactgttatttattatcaaacccttatccttgagcatttcatttgaatataccaagcatttgatgcctttttttctcatctcactccgttcggcttctgtggcatttggcatcattgaagacccaagcctaggaatgctacgggagttaaagctgttttttcactcatgcacaatttaacaaatatttaatgcacgcccctgctgtttctttaaacaatttgctgttttcttttatttttcttttttgagacagagtttcattcttgttgcccaggctggagtgcaatggtgcgatctcagctcaccacaacctccgcctcccaggttcgagcaattctcctgcctcagcctcctgggtagctaggattacaggcatgcaccaccacgcccggctaattttgtatttttagtagagacaggatttctgcatgttggccaggctggtctggaactcccaacctcgggtgatctgcccacctcggcctcccaaagcgctgggattacaggcgtgagccaccactcctagccgcgatttgctgttttcttctgcttcttcagtattgtatgtattccttaagatactgtctcccatcattgtctttctctttgtatttctgtttatcctctgttctcttttctgtttacatttcttccttaggtaagtccttagggctttaatcccatttacgtaaagaactcacatctccatctttactccagtctctcgcctgtgcaccaaccacagaattctcactgtctcttgcgtctctgatttcctgtagcctccaagtctatttataggcaaaactaaactcttcatgtttttaatcaacttttaatcacatttctcttttatttcctacttagcacttattactgtataacatgcttctattcttttctgattctttccaatagaatgtggtcttcataaaggcagaacttggtgatcctcactgctgtatgatatttactatgtttatatgttgagtgaatgagtgttagccacaggtctcttttgttctcacactggaaaacttggaaataaactttggcttccatttcgttgctacatcctcttgcctctttgagttgtccttctggttaacattttcttcttttcccaagcttccagtttaattcttgctcactaatttattcctttactaaacatttatcaagcactgaaacaatgtaattaggttagctagggttctggaatataaagaaaaataagaaatacaggaaaagtaagatccttgcctgtcaaatgcccattgcctaaataggaaggagaagggattctatagaaagaaatgcggtaagtgctacgctaaagaggtattccaggctctgtggaaataaaaagcatgtccctcactccacctaagagaatgcttcctaataataatggcaaacattttctgagcatttgctactttccaggtgctcttttaagcaccttagacatagtaagtcatttactcttcagaaagcctctgaagtcagcaccattctcattttacagatgaggaaacaattagaggacacttaagtaacttttccagctgaccattttcgtaaataggggagctgtgattccaagccaagttctctactgtctgctgaaagagaaactgatgtgtatcctcagtttgcaaggattagtagagtttttcaagatgggtgattccaggctaaaaaaaaaaaaaacaaaaaaagcgtatgtagaaaaaagtgatatattaagggaactcttagattgttcattatggatgggctaagaatatcttagtgtttaccatgtaaaggaaccagatcttgagaaaaaaagaagtgagcctggaaaagatgaccactaacaaactggtgatccattcagcatggaaaagtaaccattactgtaagctgaaataagccaagcctaccaagagagcacaaatctataacgaccctaaaaatgaactttatcagcttcagtgatgtaaaccttacactcaggttgctattcccctattttctaaccttgctccatgtaatacggtagccactagccatgtgtggctatttaaatttgttaaaattaaatacaattgctattttacttccttagttatagtagccagctttcaagtgcttagtggttagtggctaacatagtggacagcacagagcttttctatcagtgcaggaaattctgctgaattctttacttctactatcatatttttatatctagggactctttaattgtacttttttttgaagatttagatgtcatctcttatctttctcagaatatgataattttttgaacgttttcttccgctctctgtaactgctgtgtacctttttcctgtgttgatattttctccctcatggtggtaacttctggccagtcatatttgaaggggccccgaaaagctcatggggaacattgtgtgaatgagtggggcttatgatgttggacttcattcttggatgatgtggttggtaacacattggatttgatttgtgaattctccaatgttggaatgttctctgcacagttacatttttccaaaaagagatgtctgcttagggtatctaaactttggctgtctgtattttgaaagcaggatagggaaagtgagttggggcaggccaggaaagggtagcatggttccttgccattcaatatttagccttttgtttcatctctgttttcagacaaatgaatctatcttcagaaatgcctgctatgtctgttactctttgtgggtttcaaaagttcaattgttctggttctgaaggcaggtagatgtttgttgactgtatagtcaggttggagatggggacacagggtcaaataattctctctttcgttagtcattcccccaccaggggcttctgtaattccaagactttaattcttgagcctttctccaggtttctgtaggtggaattggcttctctttgatattctcttctgcagacaaagtcttttaatttcttccatctatgttctatcttcaccgtggtttagaagtcacagattatctcctaatttttttgcaggttaattttgtgtttcttattgttttgaggaatgattatggaaagaaggagactgaaaagtgctatctttacacagctgaactattgacagtatttatcatttctttctttctttttttttttttttaaatttgagacagggtctctttctctgtcctccaggctggagtgcagtggcaccatcagagctcctgggctcaagcgatcttcagtaactggcatcaagcctcttgagtagctggaactacaggcacatgccaccatgcctggctaattttgtgtgtgtggggggggggtctcactatgttgcccaggctagtcttgaactcctggcctgaagcagtcattctgccttggcctccaaaacttctgaggttacacatgtggagccaccacacctggccacagcattatatatatatatatatattttttgacttgaatatctctttttttttttttttgaacagaatctctctctcttgcccaggctggcacgcggtggcatgattttagctcactgcaacgtctgcctccgagtttcaagtggttctcctgcctcaggctcccaactagctggaattacatgcatgtgccaccacgcccggctgatttttgtattttagtagagatggggtttcatcatattggtcaggctggtctcaaactcctgacctcaggtgatccacctgcctcagcctcccaaagtgctgggattacaggtgtgagccaccatgcctggcctataatttcattaagaatgattcttaagcttttcctttgtctcagaaactcaaaaatagttgacagtgttgagtatgtcccattaccaattgtaatgttatggaatgctaagatggccatccttcatcagctcaaattcctgtcagaattttgtccttctcatagagaaatttctataggaaccataattgtacaccaaatgagttatttttatttatctaaaatttatttagtctggttttctacttgtctatttctctttcttatttagtaaaaccatcagtgggatctaatgccatgagccatactgataaagctatctttttatattcgttccctcaattaaattaccttccttattaattctcaaagggtattctgaataatgtcaccggttttatttatttttatttttgtcctttctttaagtgaaaggctttgattagattctgagttcatgtgggatttttgtcaggtgggattgtaatgattttttttgtgtctttgctaattttttccctttggctgtccttctctgttagaatatcattgacatcctcttagcagatcattgtcttccaaaatttgtagtaattgtgaataacttatattagcattaaaagtgattgctttccttttttgtttgtttgtttttgagacggagtctccctcggctcactgcaacctctgcctcctgggttcaagtgattctcctgcctcaacctcccaagtagctgggattacaggcacacgccaccacacctggctaatttttgtacttttagtagtggcagggtttcaccatgttggcaaggctggtctcgagctcctgacctcaagtgatccgcctgcctcagcctcccaaattgctgggattataggcgtgagccaccgtgcctggctgctttccatttaaaagacaccgttttcctgaccacatttcttcagttgtggtcttatttcttgcaccatttgtattacgaagatttttatttatttatttatttatttacttttaatcttttttttctacagctgctagcaactcttgattttttttttttttttttttagaaatgagctaacaaagttgcttgactctcatcagaagaaaaacaggcctaggaatataagacacatttaatggaaaagtataggaccagcaaagtaggaaatgttattcaaggacagctgtttcatcaacagctattgtttttaagggtaacttaagatgtttatttataatttatgttgatacagaaggaaataaattgattattttctttctgcaaataatctttttccttttccttttctagcctgcccattcaagaagtcatagttgggatgacaaaacatgtcaaaagtcagctaatgttagcagcatttggcataggaattactctcccagaccagagtcgggtactgtttcagatgccccacaattgaaggaaaatccaagtactgtgggagtggaacgagtgattagtactaaagggttaaatctcccaaggaaatcatccattgtgaaaagaccaagaagtggtacgtatttcagttttgcaaaatgctggtgaatattggtcatatttaaagaaatcattgcccaacgcaaagtcgcgaagattttctcctgttttctcctagaagttttatagttgtattagtccattttcaccctgctgataaacacatacctgagactgggcaatttacaaaagaaagaggtttaatggacgcacagttccatgtagctggggaggcctcacaattatggtggaaggtgaaaggcacttctcacatggtagcaaacgagaagaatgagagccaagtgaaagggttttcccttataaaaccatcagatctcatgagacttattcactactataagaacagtatgggggaaacggccaccatgattcagttatctcccaccaggtccctcccacaacacataggaattatgggagatacaattcaagatgagatttgggtggggacacagccaaacattatcattagttttagctcttacattttacagttttagcctgtgagccattttgagttagtttttttaatacgatgtgatgtaaggattatggcttttttttttaatcttgtatatatggctgtccaattgttccagcaccctttgttaaaaagttttcctttccccatttaattgccttggcacagctgtttaaaatcagctgaccacatatatgtggatctttttctgaactctgttattctataccattgctctccttacttatctttacatcagacacattcttgattactgtggctttatagaaaatcttgaagcggggcagtgtaagtctcaagttagttttcttttgaaaagttgttttggctattctgtgtttttcacgtttccatgtacattttagaatttagctttttaatttctaaaaaaaaaaaggtcaggcatggtggtttgcacctacaactgcaacgttttgggaggccaaggcaggtggattgcttgagcctaggagttcaagaccaggcttggcaacacactgagaccctgtctccacaaaaaaaatttttaaggccgggtgcggtggctcacacctataatcccagcactttgggaggccgaggcaggcagatcacttgaggtcaggtgctccagaccagcctggccaacatggcaaaaccccatctctattaaaaatacaaaaaattagccaggcatggtggcacacatttgtaatcccagctacttgtgaggctgagacaggggaatcacttgaacctggaaggcagaggttgcagtgagcggagatcacgcagtgcactccagcctgggcgccagagaaagaatccatctcaaaaaaaaaaaaaaaaaaaaaaaattaagaaagctgtcagctggttattctccaaagctgcagcttctctgctcaaagggtcttactagttcagaatacattatcgtaaaacaaaaaataaatacaaaagaaattttttaaacattagtcaaatgtggtgacgtgtgtctgtagtcccatctattcaggaggctgaggtgggaggatcgctcgagcctcagagttggaggctgcagtgagccatggccacatcactgcgccccagcctgagtgacagaacaataccctgtctcaaataaaaagtaaaaagtctattgagagttagttaaatccatacatcaatttggagaaagtggacattttaacaatactgagttttctgattcattcatttaagtctttaatgctttgtagctttcattgtacagatcttaacatatctgttgtcaaattatctttatatttcgatttttgatgctgctgtaaatagtattttcagttttgttttctagttgttcattgatggtatatagaaataccattgatttttgtacattaatcatatatttgcaaccttgctcacgtcacgtattagttctagtatctcttttgtggactatgtaggattttctatataaatgactgtgtcacctatgaataaagacaatcttgcttctccttttccagtttaaataccttttatttctttttcttagtataagaatctaagcttgttttcttttgaactgcctgatttcaagattatactgcctgacttcaagatttcctatgagccacagtgtgtgatgtaacagtgtatctgatgtaaagataggtaaggagagcaatggtgcagaataatagagttcagaaaaagatccacatatatgtggtcagctgattttgaacagatgtgccaagacaattaaatggggaaggaaactagaatctgtagtacaatattgaacagaagtgctgagaggaatatactaggtattggggaaacgtgggaattttttcaccatagaggatgtttaaaatgaaaagaatgattataattgcttccttctctcttaacttccttccctcagacatctacatcggtgaatgaaatagcaacaataaaaataaaacaaagacttgcaaattttagttcatgcttttatttttcaaatttaagcatagattatacatattcggccgaaatatcctgattccttatgaacctaaatgattttcatgataattatctctgaacctttgtttcttcatatgaaataaaaggtttttgtgtatgttatataagataatatatacttgttatataagaagtacagtgtacattcatcttccttccttccttccctccctccctccttccttccttccttccctccctccctccttccttccttccttccttccctccctccctccctccttccttccttccttttttgagactgtgtcactgtgtcacccaggctggagggcagtggcgtgttcttggctcactgcagcctccatctcctgggtttgaggaattctctgcctcagcctcccgagtagctgggatacaggcgtccactaccacacctggctaatttttgtatttttagtagagacggggtttcaccatgttggccaggctggtcttgaactcctgacctcgtgatccacccgtctgggcctcccaaagtgctgggaatacaggtgtgagccactgcgcctggcctgtacatgttctttcattttcttctgctacaatcaagacacgctgtccattttatgtagctagctcactgtcagcaagtttgcgagttctttatgtcagactaagtctacttttctataactacaacttatcaataggttttgtcccctttctatacacacaaacacaaaaacaaaacaaaagaactagagtaagtttaattcctatttcatgtaccagcccttcagatgatttaaagatagccattgtgacactcctaaatttctcttccaggctattatgttccttggccattcaggttgtgctctggatgtaatataggtttttaagaattgtctagttgttacagtgagtatgattattgaaatgtgatctgcttaccacagaagaaatatttagaattgtggcactgtttcagtcctgtgcttttattattgcaaactaagattgcattcacattcttgcaatctggcattttgctggaatttgctgagttgataattgatatttgccagttgctgttaagccaggtatagttacattttaaacttaaatgtgggttaactcattcctcttacaataatcttaattcattttagttcattgttctgcctgttaatttttttgttcgaatctttgtattttctaataaatgcatattatgtatgtcatctggaaattgatgagtcttaaagttttggttacagtacgtttgcttatataatgtttaactgaatcagagcaagtacagaaatctggagtatatgagacagacttccttttgactaacagttgccagtagtagtcttttaggcctgcgcaattgctgcaaatccccataactaatatacagtagatatggctttgcattgttggctaggatgatatgagagacactcaaatgtcttgccaaattctagatatgcttaatttatggagtccccaaataactatgctaataaccttattgagaaaaaaaaaatgaggttaatctggtgtggcttctgaaagccttgttggggaccctggaacacttgtttttcttcttctgcaaggactcacaattccctgcataataaacagatttaacttttgctggggatcaacatctaatttgctgatacagctttttaaaaatctgtgccttttaaaaatttgagacatctcgtttctggtattttggtaaccccaacctatcttaccaacttcacaaagattatagtagtgtgcacttacacctctgtggagaaggagctgttcagactcagaattagtcaaagtaattcaaagaaccttagtgctgtctctatgtacttacctgtctcagattttaaacttttgttattatttagtcttatgatttattttaataccacagaatacatttgacacacagcaatcttcttgggcctcatagtgaagtaataacgatcagagctacagcacaaattacttacgactatatgacattcacaatatacatcaaaacccagaacacataaaccatgtgtatcaatagctgctggttttattggaacattttaacgattgatcattaaccatatatttacatataaattttcctggagatttttttatattcaaaattagacccttagtataatgaatacatcgccacacaggattgattgtgctctgaaattttgatttgggtaattttaacatgaaattgtataaacaactgatattaaatcttaaactaatgtgtgaaattataaaatagacctaagggagtttttttgaatcatccttatccttatgttttcttttctgaggcatagttttttttttttttttttaaagtccttatttttaggacaatgggatataaactgaagttaaggccaaatctctaagtacaggtgaaacaaagatttacagataattttgtttttatttagcagagctgtcagaagatgacctgttgagtcagtattctctttcatttacgaagaagaccaagaaaaatagctctgaaggcaataaatcattgagcttttctgaagtgtttgtgcctgacctggtaaatggacctactaacaaaaagagtgtaagcactccacctaggacgagaaataaatttgcaacatttttacaaaggaaaaatgaagaaagtggtgcagttgtggttccagggaccagaagcaggtatagttatgtctccagaatgttgattgtctgttgtattatgtactctgttggtatttattttgtctttttttagaattaatttatttattatactttaagttctggggtacatgtgcagaacgtgcagttttgttacatgggtatacatgtgccatggtgatttgctgcacccatcaacccgtcacctccattaggtatttctcctaatgttatccctcccctagccccctaccctgccacaggccggggtgtgtgatgttcccctccttgtgtccatgtactctcattgttcaactcccatttatgagcgagaacatgtggtgtttggttttctgttcgtgtattagtttgctgagaatgatggtttccagcctcatccatgtccctgcaaaggacatgaactcatcgttttttatgactgcatagtattacatggtgtatatgtgccacattttctatacccagcctatcattgatgggcatttgggttggttccaagtctttgctattgtgaatagtgctgcaataaacatacgtatgcatgtgtctttatagtagaatgatttataatcctttgggtatatacccagtaatgggattgctgggtcaaatggtatttctggttctagatccttgaggagtcgccacactgtcttccacaatggttgaattaattcacactcccaccaacagtgtaaaagcattcctatttctccacatcctctccagcatctgttgtttcctgactttttaatgattgccattctaactgacgtgagatggtaactcattgtgggtttttttttttatactttaagttctagggtacatgtgtacaacgtgcaggtttgtcacatatgtatacatgtgccatgttggtgtgctgcacccattaactcatcatttaacattaggtatatctcctaatgctatccctcctccctccccccaattgtggttttgatttgcatttctctaatggccagtgatgatgagccttgaataaacattgagtctagagggaagcaggtgtagaacctgccttaatctgattactgtcttatcatgtattgtcttagttctgacataaacccctttaacttctagtactttcgtaatctctccgtacagaatcagaataaaagaggattgtagcccctattattaattttgctttacagaaattgtttttttggggagttcccttccccctcttttttttctacttttttgttttctttgagggcttcatacaattttgcaaagtattttcagaaatatattctaatgtagatgactgtggagctgtaatattaattgagaacctgatgccatgctaggtgctatagttcaaaaatgagaaagacagtttttgtttttcagaagcttgtagtccagttggaaaaataaatacataaaaatctttccatacagtatggtgagtacagagataaaggcatgaatacggtgttttgagggcgttcaaggggcatctaatgctggggcaatggttggaaagggtaagaaggaagggatgagtgttgggtgtccctgcctaggtttaaatgacaggtgaagcaggcaaagaccggcaccaagtaccttcccagtacagtcagacagcttgaggaaaggtgtaaagatggggggcagcatggggctcaggacaactccttgctgtctgtcagtgctgtgatgacctctgtcagaattcaagctggggaaagatgggtggtgaggggagcagaaataggcaggagaccattcactgaaggcttgtatgccaacgtgggaacttttagtcttctttagaggcgatagaaacattgagagggtcgccgggcacgatggctcatgcctataatcccagcactttgggaggccaagtgggtggatcacctgaggtcaggagtttgagactagcctggatgaaatggggaaaccccgtccttcctaaaagtacaaaacctagctggacatggtggtgtgcacctgtagtcccagctacttgggaggctgagacacgagaattgcttgaacccgggaggaggttgcagtgaaccatcatgccactgcagtccagccagggtgagacagtgcaagactccgcctccaggaaaaatagaaaagaaaagaaactttgagagggttttaatcaggggaggtggtgtatgatttgatctctgttttagatcaaccattctgagcgccctgtgaagagtgggctgaagagggccacagatggggcacaaggaccagttgggctgttgccatagtccctgggagcaatcatgagattgtgaagagtcagtttaatttgtggattaggaatttagaacctggagtcaggcttcctggaatcttgttgtgttcattgtgagatgtgtgacttgacaagttaacttctggatacttcagttctctccttttaaaaattgggactaacaattataacagccttagggccgatgaaaggattaaatgagttactatcagtaatgcacctaaagcagtgccttatagatagatgataaacatacagtaagtaactcgtattatgttgactttagatggtggtgccacaacatgaaaaaggaaatgtaagtgtcagaagtgatctaggcatgatagagtaacactaagagagaaaagttaccagctcctgtattccactagaagacttcgaatgaatagtctttgtttttcaagttttttatttttttatttttatttttacttgagacagaattccactcttgttgcccaggctggagtacagtggcgccatctcggctcactgccacctccgcctcccgggttcaagtgattctcctgcctcagcctcccgagtagctgggactacaggcacccgccaccatgcccagctaatttttatgtttttagaagaaatggggtttcaccattttggccaggctggtgtcgaactcctgacctcaagtggtccatacaccttgtcctcccaaagtgctgggattacaggcgtgagtcaccacactctgccctgtttttcaagtttaataaatcaggcagcagtcagctttgtctaaccatgatgatgggagaagagcatgaaagaatgaaccactggtagtttcttagtctcacctcgggtgatgtttcaaacccttctcccatggagtcttctcaaggaaacagttgcaatacaatatgattaaatgatagttttgattcgtcttttgctagtcacccttgttaaaggtgcttgttaacagtggaatgatgaaaaattggccacaaaactggaacagtgttctagataatatacactgattgggccggccgtggtggttcatgcctttaatcccagcactttgggaggccaaggcggtcggatcatgaggtcaggagatcgagaccatcctggctaacatggtgaaaccccatctctactaaaagtacaaaaaattagccgggcgtggtggcgggcgctagtagtcccagctgtttgggaggctgaggcaggagaatcgcttgaacccgggaggcggaggttgcagtgagccaagatcacgccactgcactccagcctgggtgacaaagcgagacttcgtctcaaaaaaagaaaaaaatacactgattaaaaagttctagaaagttgacttctctcacttggaacagtttttctagcttggttttgtttttccgctggggtgagagtagagtgtccctgtgctgctgcttcatgttgagctcttctttggagacaacaaatgagaatgtttgtgtgtctctacagggctcgcctatttagtcattatagaagcttaaggaagtcttcaagtttgagactgtacatcgctgctttatgtagtttagatgtttcactagtaacttgttcagagggtgcattaagagatacctagagaaataatttgttttctctgtcagctttctgtgagaaataattatcaggagtaagtcagtctttgatgtgtcattttatggcttacattatacagcaacatctgataatgactagacagggtataggctcacacctataatctcagcactctgggaggccgaggagggtggatcacctgaggtcaggagtttgagaccagcctggccaacatagtgaaaccccgtctctactaagtattcaaaaattagctgggcgtagtggcagatgcctgtaatcccagcttctcggggggccgagggaggagaatagcttgaacccaggaggaggaggttgcagagagttgagatcgcacccctgcactccagcctgggtgacagagcgagactccatctcaaaaaaaatttctttttaaattaactggatattattaaattagttttcaaagttaattttcaaggtaattttacatgtttttctatttctcacaacaatattatgagatacataggattgctgctatcttctctatttgaggttaagagattgaggctctgagaggttaagcattctcaaagttgtacagttagtactggtgataggaagattcctagtcacagttgatataatggattggaagcggcatacaatccaataggcctggatttgaattctcactctgtcatctttttagttgagtcgtctttcacacactgttcacctccctgagcctatttgtttataaaaaatggatgattatatacataaggctgttgtgaaggtaaatagaaactgcgtgtcaagcacctgccataatgcctagtcattaatatatgtgcaagcattcattaccactcctctccttttaattgaatgcaactaaaaggagatactaaacatgtaaaacgttgtcaccaatttgcctgcattttggaagcctgttttaagtcttaattatttttattatgtaggtagttatcacagaaacgtgccagttttatctttcgagatctggaaatacaagtcaattaagtaacagtatgggccagttgggaggaagtagccatgaactgggaagggttctgagttttacttctgtttgttgctagccaagtaattttataaccctgggcattgtcactatctcttctcttgcctgtgaaatgatatgtaggagaatacttgggcatcataggaattgccgttgatttaaaaatgaatttgccgtcctatctaggagctcatgttttctgcttactgaaaagcctagtaagagcttttcttccacgtactgcttcctgccccctccccatacaactaatctagggatttggtgaaaggatagaaaggatttttactctctagcatttagtaaatattctgttcattatcttggatttgaactaatgcctattaaggaggtaaattctctttaagttttttatttatctgatcatgtataataggatatttgttaaacctaaaaactctctttgcctcctcaataatgatactgatctttcattttcattggaatttttttttaaagctgctatactgaataagtaatacctctttagtaatatggaatttatgattgatttgaaagaaagtcttaacctgtatatttaaaagagtatagaagtttatagggtatataacaagctggtagattagtatactactgcaagttcctagatgatataatgctaggaacaaagctaagatgaagggtaaatagctaatttctttaattttgcttcctacaaaatatgagagaatagttgtcaattgtccttttggttgcatatttctatatcttttcatgcgtttgaccatgttttagccccatcctaggtactgtggaagatacaaagacatgggaagtacctgccctcacagagtttatcttctatttgagagtttaaaagtttagggaaagaacacctatatgatgattaggtataaataaagtacagaagttccaaatacatgtgtatatagaagactgcttttagaaagtcctctctaggccgggcgctgtggctcacgcctgtaatcccaacactttgtgaggccaaggcgggcggatcacctgagatcaggagtttgagaccagcctgaccaacatggagaaaccccgtctctactaaaaatacaaaattagccagcatggtggcgcatgcctgtaatcccacctactcaggaggctgaggcaggagaattgcttgaacccggggggcggaggttgcagtgagccaagatcccgccactgcactccagcctggtgacagagagagactctgtctcaaaaaaaaaaaaaagaaggaaaatcctgtctaaaaattcatcgtataaatagaattctaaatgtgtgaatgttggcataatcaaaatttgaattttgactaaaatttaagattttttatgcctttatgaaattatatatttatgagacttttttcaaaaagaaactgattattccattttgaatcttgacaccccttgagaaaactctaaaatactcatacttacttattgtttctattgctttttttattaggtttttttgcagttcagattctactgactgtgtatcaaacaaagtgagcatccagcctctggatgaaactgctgtcacagataaagagaacaatctgcatgaatcagagtatggagaccaagaaggcaagagactggttgacacagatgtagcacgtaattcaagtgatgacattccgaataatcatattccaggtgatcatattccagacaaggcaacagtgtttacagatgaagagtcctactcttttgagagcagcaaatttacaaggaccatttcaccacccactttgggaacactaagaagttgttttagttggtctggaggtcttggagatttttcaagaacgccgagcccctctccaagcacagcattgcagcagttccgaagaaagagcgattcccccacctctttgcctgagaataatatgtctgatgtgtcgcagttaaagagcgaggagtccagtgacgatgagtctcatcccttacgagaagaggcatgttcttcacagtcccaggaaagtggagaattctcactgcagagttcaaatgcatcaaagctttctcagtgctctagtaaggactctgattcagaggtaagtcaaatcctgaaggctttgttttcaaatttatatgtaagaaaaaatagattgttgctcaaactgaggaaatttttcctacatgtgaatgacgagctatattattttttcattctaaactctactgtgcagaaagttcacattttattcatttgaaggacttctctgtatctttcacattttaaactgcaatacatttaaattaactctgtatatttcctgaatcactgtatgttcgattggtgagtatctcaaggggtgccacagttaaaaccgaggcagagtgataatctgtgaaatgaaaaattattatcaatttactgtttaaatccttaatatgctcttgaattcagataacatttaagaccttgtaaggggccaggtgcgatggctcatgcctgtaatcccagcactttgggaggccgaggcgagcggatcacttgaggtcaggagtttgagaccagcctggccagcatggtgaaaccctgtctctcctaaaaatacaaaaatcttaggcaggcatggtggtgggcacctgtgatcccagctattcgggaggctgaggcagggtaattatttgaacctgggaggcggaggttgcagtgagccgagattgagccactgtactccagcctgggggacagagcaagactgtctcaaaaaaaaaaaaagaaaaaaaaagagaccttataaggaaataaccctgttaatgcaatggtattcatcttaagttttagtacttcagaaatatattttcatttactcttcttattccttctaaatttctccttatgacaaaacaaaacagtaacacaggtgtgcatactggtctagaagactgtctgtttctcttcctatgaacgtctttatctcgtctttttcatttctgcttcatactgcatcttctcttactgccacttgggtaccacggcagtggctatcttgaacatctttcataaaaacatcactgtcaatttgtgaggatattaagtctgctgagctcctttggggttatcttttttatatttccagcatgcatcttactatttcatttactttggaagcgtttagccatgttttcctgagaagccttatcagttcacactgtaggctggtagaactccacattttgtcttctgggctaacctttttttatgtactaatggttatagaaatgtgaatcctcctcccctagccatgccccactgaaaataaacgaactgaacaaaactaggaataattcattaagtcctctctcttgctgccagatgtagtaaactcctactagaatagttaattctcaaagaatctgatgctgacagttgacatgaaaatcatataatctttctttgatggagaaaatgtttcagaaagctgtgaaacattggggcatcattttgaatatcagtttttatcctatagttcagaagaaaatgcttcaatatttgagccttctgtcggtagttcactgtgaaaaacaacaaccatagattctgtgttgagttcattgaccatatttgaggttgaagtcttcttaggaccttccttgtgatcttcaggaagtgatttagcccagagtcaccaatactgttagctatgagcaaagaatgttagagtttctgtaaggtataatacaagttaatggagtgcttttcactattgggttttttattgctcttttgttttgttttgtttttttgttttttaagtctgctctgttgcctaggctggattgcagtggtacaatctcggctcactgcaacctccacctcccgggttcaagcgattctcccacctcagcctcccaagtagctgggacaacaggcatgtgccaccatgcccggctaatttttgtatttttagtagagacaggatttcaccatgttggccaggctggtcttgaactcctgacctcaagtgatctacccacccaccttggcctcccaaagtgctgggattacaggcatgagccaccgcccctggccttactgtcctcttttatttgactttcatgggaatgcagattataagggaactctccatctatagagaagtcttatctgatagaattgggggcagaaaggtctgaaagtcattgctaaaggtgaagtgcatttaatacaatgctactccacttgaaagtggatgcgtttttttctttttaaagttgaacgtgttacatgattaaaagaagggatggagctgcaccagttcaacttattttagctagtaagatgaaaacttaaccacacgtgcgtaacgcagcgtttttacattaggagactcttgttttatctgactcagcattttaacatcctcttctaacagttcagaaaagactttaattttaaatagatattttatataatttacctctccagctgaaacatcttgttagcttcttcaatgaaattggcaaatatcatcctttccatattattcattttcttttattaattctatcccatgttcttatttatcttccattttgttgaatattagtttgttgtcataaaaattctacagtaaaaatctaattttattttattttttgatctggggactctaggaatctgattgcaatattaagttacttgacagtcaaagtgaccagacctccaagctacgtttatctcatttctcaaaaaaagacacacctctaaggaacaaggtaaaacatttatttaattttttttttaatttcagaagcggtgtatgcttacaactagaaaatgagaaatacaagcagaattaaaaatcaaaatacctgtagtctcatttatataaaaatgtctactttaaaactttatgcttgactgtaggtgtttaagttgtgaaacttattttctcttgcagtgtatatgaaagatcactttccaagtacttttagtcattaatgtaatgactttataatatgcagttgtataggtttggtcaatccccttatttttgtcatttaccctaaatttttttgctctagcaaataatactgcaaccaagatcttgtggataaatatttgaggacatgttcttgattagtttgtaaggatgaattgcatggagtggtattactggtcccaaggcatgtatgatttaacattgatacatactgccaaaaggccttctagaaactgtgtacccatgataaactaggtttgttgaatcaaaatatataaatatttgtgttactacatagtaaagcatattttatatattaagcacgaattaaagcatattttatatattaaatgttcttgttcatcagtataaaaacaccatttcctaacttaaaagatggataaaggtcataaacaggtcacaaaaggaaaagtaccaatggttgattaatatgtgtttaacctcatttgtttaaccgtatgtttaacctcattagtaatcaagtagtgcaaattaaaataataaaatagtttcttgcctcttcatatttcaaaaaaatgtttttaattatactcattttttatgagagtatagtgagataatcacatgttttaaaaagtaagtattggtctgccatttctagaaaaaaatttgaaagagttcaaataatttaaaccagtaagtgcattctagaactttagcctaaggaaacattgagaatttaaatacaagaatacttaatactgcattggttataatagtgaaaaattggaaataacctaaataacaataagggagtgagttattaaataatcattggttttagctcttactggtagaaatataggtgaatttttttctgttctttttcttgtgtttttctaccatgagcatatattatgtttctagtagcataaaaacttcttactttttaaaattttaataaatggccctggctatccatttgaaagaagatgtagtctcacacaatataaatgtaaattctactgtagtcaatatgggttgctataacagaataccagaaactggatttgcttaaatgataaatatttatttctcacagttctagaggctgggaagtccaaggtctgagtgagagcccacttcctggtttgcagacagatgccttctcgctgtgtccttacatggtagagggagagaatatctcttttgtacctcttcttaagggcactaatctcattcatgagggctctactctcatgatctaatcacctctcaaaaatcccaccatcacattaggagttaaggggttaggacttcaatatgaatgtgagggagacacaacattcagtccacagcaaattccagtacattaaagatacaaatatgaaatatgtaaatatgagattattttttaaatttttgagcaagaagttttttgcaatcatatctactaacttgaaaagacattcattattagtgaaaaggaaaaatatgttattaacaatatgtatagtgtttttgtttaaatactttaaaatattcatgtacacatttgcatgtttgtggcatcctattaagaagtctggaaagatacatgcagaattatttacaatgatggatagaactggagatgtagaaagtacttttcctgaaggagttatgtctagatagtaaaccatcatattattattattattctcagacatttgcattgtcagggatttaactaccacttctgttttggtgacccttcaggtgagctctccctgatacccatctttaatacctaaaatcaaactcgtgtcttttacctctatttcttctcggaacgttttttgttttatctattaaataaaattatattatctgccacttagtttcaaaatcctaaggttgtcctttttcttgataactgtcagtttgatccttctacagcagttagagaaaaacaaccaaacatcgatacctctccaaattctaacgtttatttctttgccttcttttttctccctcactttttccccatcacaacacatatttaaggatttcatctttactgtgtgaacctttattttgttttaactttttcattcttcctacacacactgccagattcatattgtaaaccttttttaatatacctcattcttactatcttaagaaacaataacaaaacttcattgtctccattctgtccacagggtaaaaatcaacccttagtagaaacagcctaaatgtcaatagaggtttgtttaagtaagttatggcatatatatacaatgcaagaacaggcaacctattcaaaataaaattctatttcctgtgaactgaaaaaaatctctaagttacatcattaagaggaatcaagatatattaagtgagaaaaatgaagtgcacaacaatgtgtactatgctgcctgtgtgtgtgtgtgtgtgtgtgtgtgtgtgcacgtgcacgtaagtcagtggatgcataggaagctgggagcagcaattgcctctggaaagggaggcagcgagagacattcattttgctctctgttcctttacaaaagagagaacttttaaattttatgccaggtttacatattacctgttaaaataatttatgatgacttctgtaatagacttttataaatagcacatttttaccattgctcatgggttattttgttcttatgtataaagaatagtttggccgtgtgtggtggctcatgcctgtaatcccagcgctttgggaggctgaggcgagcagatcacaaggtcaggagatcgagaccatcctggctaaaacggtgaaacgccgtctctactaaaaatataaaaaattagcgaggcgtggtggcgggtgcctgtagtcccagctactcgggaggctgaggcaggagaatggcgtcaacccgggaggtggagcttgcagtgagccgagatcgcaccactgcactccagactgggcgacagagtgagagtccatctcaaaaagtaaataaataaataaataaataagtaaagaataaagaatagcttgaaattaaagttagttgctttaacagaatggtcttaaaatgggtgtttaatcttcaggttcctgggctatataagtccagttctgcagactctctttctacaaccaagatcaaacctctaggacctgccagagccagtgggctgagcaagaagccggcaagcatccagaagagaaagcatcataatgccgagaacaagccggggttacagatcaaactcaatgagctctggaaaaactttggatttaaaaagtgagttgccttgtttcttattctgaaacaagataaactgttattttctgtaatttccatccctttctcccaactcttcctagtttcgtatgagtttttgtttctctcactataaaataattatttttctctcttccctttagctaactctttatacttaatatcaatttctataccttcttttcataaaaagatggcaaactaaaaaccagttttcagtctggttttggagtctctctgatgtgaagcaaattgctttcctaggccttaagtctcctgccttccttttcttatctctcaggattgtaaagagaataaaattttatttggttttttgttttttgttttttgttttttgtttttttgagagagttttgctcttgttacccaggctggaatgcaatggtgcgatctccactcaccgcaacctccgccacctgggctcaagcaattcttctgcctcagcctcccgagtagctgggattacaggcatgcaccaccacgcctggctaattttgtatctttaatagacacgaggtttctccatgttggtcaggctagtctcgaactcccaacctcaggtgatccacccgccacggcctcccaagtgctgggattacaggcgtaagccaccacgcccagacaagaataaaattttaaagaaggggtagaaacacagtgcaatatcgtacttctctaatttatcacatctaaaatggggagactcattgagtttatatgatgaatttgccagatttgcagtgtatgtggccagcactgttttaaaagaattcatcttctatatagttaaatttttgttaaccataatacttccttctgttagaccacaaaattagccacagagtagcattaccttatagctattttcttgttctcaataaaagaaatgtgctgtttaataaaagttttttttaattatatggaatgataggattaaaccttacctagtagaaatattgtcatagatgaggcggtatgagtgggaaacactttgtaaataagtaagtgctggacaatcgtttcttattttacattgtgtaaagtctaggattaaaccatatgacagcagttttcaaactttttcttttcaggaatgctttatactcttagaaattattaaaggccccaaaatactttggtttatttaggttatatttgtcaacacttaaccatcatagaaattgaaatagacattttaaaatatctattttaaaataatgataagcctattacatgaatgtagatagtacatttaaaaaataaatagctatattttccaaatccccccaaaaggtaagaaaagtggcatggctttacatttcattttgcaaatctttactatctagtttgcaaatctttactgtctggcttaatagagctcagccggattcttgtatctgcttctacatttgatctgttatgatttggtgttttggttgagtatatgaaggaaatagacatatttgtagttagaaaatatatactttgatagcctttttagatagtggtaaattttcttctttgctgttatgtctaaatccaacaacttgtagtttctttaggtcagtgatagtgtagaatatgaaaccatatcaactgactttttgtactctgtgttttattgcagtccactggtgtcccttttttctgttgcctaggctggaatggcacaatcatggctcactgtaccctcgagctcctgagctcaggcagtcctcctgcctcagcctcttgagtagctgggactacaggcttgtgccaccagccccagttaattatttaagttgttatgtgaggtgtgagccaccttgcctggcctacactggtgcacttttaatgcatcttttacatgtaacatcatgagttggtcttttggaaaatattggttaattgagatgtacttccaaatattgatatattttattatacaatataagaaaaaagtcacaatcaacaaagcctttaatattggaaaactgttgtgtggcagatacgttttccaaaattttaattttcatttgaaagcttgaattttatcattagcaacaaatactcttagttgtttttctttaaagtaacaggctctctttgctcattttatttgtttgtttatttatttatttattttgagacagagtctctctttgtcacccaggctggagtgcagtggcacaatctcagctcactgcagcctccgcctcctgggttcaagtgattcacctgtctcagcctcctaagtaggtgggattacaggcgcctgccaccatgccttactaatttttatattttttgtagagatcgggtttcgctgtgttggccaggctggttttgaactcctgacctcaagtgatccacctgcttcaacctcccaaagtgctgggattacagacatgagccaccacgcctggcccctttttgttccaaattttagagaagtcctgaatgaccttagtgtcacacatgcttttacttgaggtaaactatcatacttccatacacaatagaagtgttttgtttgtgctttccattttgtcacagaatattaaaaagtataccaaagaattagctgagcgtggtggcatgtggccgtagtcccagcttctcaggaggctgaagtggcagaattgcttgagcccgggaggtggcggttgcagtgaactgagattgcggcactgcactccagccagagtgcaacagaacgagaccttgtctcaaaaaaatttaaaaaaaaatgtaaagtataccaaagggttgagatttaataaaattaatgatttgtactgcttccatcaagaacatttttgagacttttttttaactgcaagtgcgcagaggtggagaatacaaatagtcctggtatgactcgtacggtgtgatgccactgtcttgattcacactgagttgtcagcagtttcactctgttctgctttagcaacatccatgcaagggtcagcacagtggaaaggatgaacaaagtctgaatattgtaagaatagttttggtcttggaaaccgttcaaaggatcttgggactctccaggggttgtggaacatgctttgaaaactgttgctagacagaaattaagggtgcaacagtattcttaaatacctttgagaaaaaaagatgtactggtatttaatttttgttgacaggagatagaattacctgtaatatcttcataacaggattaatttttatagatagcttccttccagaaaagaaaaaagagaaaacaaccgagaggggaataaaagacagggcttaggccaggcacagtggctcacgcctgtaatcccagcactttgggaggctgaggcaggcagatcacttgaggtcaggagtttgagaccagcctggccagcatggtgaaaccccatctgtagtaaaaatacaaaaattagccaggtgtggtggtgcacgcctgtagttccagctactcgggctgaggcaagataatcgcttgaacccaggaggtggaggttgcagtgagccaagatcgtgccactgcactccagcctgggtgacagagcgagaccatctcaaaaaagaaaaaaaataataataagatttaaccagggcttaaccatttgttcctgcttcacttatattagttcttaaccagacttgagaagggcactaaggagaaaagaattaaagtattggaatcattctgccttagctaatatatctagtggtggcccagcacctacactgaatagtgattttgaaagcaagaagaggcactaagaagtgagactcagaatgtattgggagtgctcacaggagaacctgattgtgttatataatgaattgaaagagatcgtacagtaaagggtcttatcctcttcatgtccctctattttgtccaggtagaatatttcttctctaataatcagtaccttaaaaataccaaatgtattttattgtattttgcagagattctgaaaagcttcctccttgtaagaaacccctgtccccagtcagagataacatccaactaactccagaagcggaagaggatatatttaacaaacctgaatgtggccgtgttcaaagagcaatattccagtaaatgcagactgctgcaaagcttttgcctgcaagagaatctgatcaatttgaagtccctgtttgggaatgaggcacttatcagcatgaagaattttttctcattctgtgccattttaaaaatagaatacattttgtatattaactttataattgggttgtggtttttttgctcagctttttatatttttataagaagctaaatagaagaataattgtatctctgacaggtttttggaggttttagtgttaattgggaaaatcctctggagtttataaaagtctactctaaatatttctgtaatgttgtcaagtagaaagatagtaaatggagaaactacaa

SEQ ID NO: 157 - DNA, 141258 bp, Homo Sapiens
tcaattaaaacaaatgttttaatggagcaaaaagcaaaatggactgacgcttaattttgatgctggttctgtcactaacttggtttgcagttttgctttggctaccaggaacctcacagtcaaatttattgttcatgtttagtaaccctttagaagttcttatagcctacatgttatgactgcaattccacttgcccctttcactcagccattatacttgattttccataatcacagctttgtttttttttttagattttcctatttcattgtatctattcttgtaatccacttgaattactttatgaaacaaggcagaatataaataaatagaaatcattttgtgagtcactcaactactttacatgttcttttcctgtgtttcaaataagagttggggactctgtccaacattcctttcagctctaaccctgttgattctagtctttcatttctgcacctcaaaggccataatattaggtggtctttatagagccttgacttagtaaatatagacagcactgggctctccaatacattttacttgttccttatacgtttattaggagtcacttatgctctggaagattattgtcagtagaactaatgaattttaaatgactcattttgaagatttccttccatcctataactactagttgctccattagtatccttagaattggagctatcactccaattaactccaatataacacttgaatagggctgaatgtttgtatagaaactattaacttgactaacagtttgaaatgatcccactttgatctttagcaaccctatgtgataagtcaagctggggacacatctgcattttgtagataaggaaagggaaatacaaagagattcagtgacttactcaaagtcacacaagtaataatcagcacgaggacttcaagtctgatcttctgactctactccttggccctctgcaacctcccagcctcaataaaacactgggaggggatgcttccaggtcacacacctcctgtgacagcctctttgttatgttgccctggagagccacctgctccagtcccatggagtgccatagaattgtcttatccctctttcacatacagaccttctacttcttgaaaacagtaatcctgtaccctttaaatcttttattcctgagctaaacatcagagtcaaattccctgagagctattttatctgtgaggcacacgaaactcagtggctagggtccattgcttttcaggggcctatggaaaaaaaaaaaaaaggttccaagatacagataacaaaattgaaattaatagccatttaattaactacctgaaaaatgtaacattatgtcaatgtcattgttaaatttattattcatttataaatttattacaggtgagaacacttgtagattagattctcttgttttgcaagaattcctgagtaggcacactgattgatttatgcctactcgggagagtagacacagacaattgtaaattgaataatcatgtataggcaaataacttcaaaggcaaaaatataaaaatcccttcaacatttttatggaaaattttacatttaattcaagatgtgggtgcattttaattcgtttgatctaagtgatgatgcctccaaaagagtctacataaagcttaaaatggtcctgagtcttccatggcctaaatttctccatgtaggccaacataacttttagtaaaattgctccttgtggcttcacagtttatgtaatttcttctagttgctgaatttgaccagtaaattgaaccccatttacatttgtttggaagaaaatgaagtttctgggagcactctgggtcctgccacaattccaccaacatgacctatcatgttgtcagaagcgtcctctctccacaccacacaaatctaatctcttccagacatgatgagaaactgctgtaactctggcaaaagagccactgaagtcagccacattgccaagggcacggttttaattgcctcaaggagccctggggtgcacgggcagcaccctaaatatattgtaggttaaaaccatcttgcatccagacacagactgttaattctgttaaacttcttctattcaagtgatatgccaggtatcgaaaatgggcaattctttaaaggtgcaacggctctgtgagtgctcctttcacagggcctaacgtgagaccatctggcacaaaggcttcatctgtgatgccctcagaagtcaccaagaggaaaagctgggaggatctgcttgtgaattcctagggccggtaatgatgacaaacctgctttctagagggctgggcctatgggtcttggcttcaatctcaggcctgcgggaagtcgtggggagctggatgattgaggcaatagtactgatggtctctgccaaagccacagccaattctagaactggcttccctgctgggaagatgaaagcctgagttttatctgggttctaggaggacctccagagttcctcttccttaggcaggaaacaaagcaagctcttaaagggggcagggtagggaacatggggctctgcatcaaggtgtgtgtagaaaaagctgctacccaaagctactctgttctcagaggctcagcatcctgaatgaggatgcatttgcctcacaaaagccctgtctcagtcaagccctttggagtctatccaaggtgaccacctgccctatcttctaagtctacttgttccatctctgtgcttcaaacctgagtttgcctctgtcccagcccttcagattgatgttcagatcagcttgggtctagtctctggcttctctgatgctgtctgcaggcttccctgtactcccaaagccagtcctgactctaaaacccagccaggcctgcagagcttcaccatctctggttgtccaggcaaaaactctgaatgctgtaatgcagagatcactagagcttctatgtagagactcagccaagacccttgaagaagggagacaagtttggccatgaaacaataaaccacctttagaaactcaacagcacttattgggtgcctgtggaatggtgctaggcactgtgggtacagcaagctctgccttcacagagcttagagtcaccttcagacctgctgaacagacactccgcttccttaccttctgctggtagcatggtgtttaggcttccagggcagcttacctctttccagttctgatatgggcaataagagaagtcacacctgtgtggaccaacaccaccgggaatagcaataaaacaagggatcagacaaccaaggtacattccatcccttccagctgattctttctagtttatgcattgttgctctgggaaccccaggatctatgggtatcttcagcacagatccatgaagttgcagctgtagagcaaaaggaaaaaatatataatacacgataaataccctagggctgtttggtgtactaaacattgaacttgatctttccactggaataaggagaagtaatttacctcattagagagtacatggcagcaagaaaaatatagctcatgaaccatatttattttccattaatcttaaaacaacatccctcatccagattaaaatactcaaaaccaagggcgtatgattgattaaagagaaacaaccctgaatcatggggttgattcctggaggggtaaaacaaggagacagattatttgctctcttattacagattccaagataaaactcctcccacctatgaccatggatggatactggcatctctgaatctttcaaagcttggaatatctaacttaaatctttccacagtatcatttaatccttattctcttatgctaccctcagtgatattaaattttgaagattaatacacatttttaggtggtagaccttaaaaaccaagagccgatttaacatttttcaatcttaaattattcttaaattgggaacttcatggtcttctctatatttactgcgatcaggtgtgcctcactttgtagaataaatgcatcccagaaggttcacctttaaagtgaactttccccctctgagagtcatataaaaccaatcccaagacaaaatgaaaccatcttcaatgattaaatccttttttaatcatgcattttaaaggagaaatttttgataaaataataatacacttatgaaaacaaagtttcttttgtctggcaggatcacttctagagataaaggaaaaaacagcaattatagcttaagaacagaacatcctagactaaaaattcactcagcttttatcaaatctcttcactgtcattgtacaagagaataacaggaaattctctttgggtgctcagaccttgtttcctagcaatctatggaggctgaaggctcttaagaataagcaatagagctaagatcggggaagggtagagaccaaggtcccaaatatgagaggaagtggaccaatgaggcaatcatgagaagggggccttcctcatatgtgttcagtgttacctgttatccaatttaaagtcaggctttagacgtcatataataattcctttaatcaaccagaaaccacatatatccataaaggttgagaagaggggacagaacaggtaggaaaaaaagtaactgtttaataaaagagagcccaaaagttgagtgttatgagtcaggctgtagaggagctgggagttcagtacctgatcctaccctaagataccagttggagagaaagaaagagagaaagtgtgtgtgcatgtatatgtgtgcgtgtacatgtgtgcatgcctgtatatgtgcacacacaaataacaatgtaataacagcctcatgactttgccaagagttgatacagactaactcagaagaaaagataagggagaatcggaatgcaaatctaaatatacagcatattttcactgatgtaaaagtaaagaacatttaccaaactttaactgtggttattcctaggattgtggataatcgtggatggcttttctttgcaggttttgtattttcctgatttttacaatgagcatgtatctttgacttccatgtataaagatgaaatgttttattttaaaaaagaaagaaaaggtttgagatcaaggaacagcaagcagagacaaattcccctgagaagagaaaaccaagagaggaaagaactccaaactccaccaagaagctgtggatgaagctggtagagaaaatgttaagatccacctaagaggctgagcctaaacagaagccggggtcgggcctaagcagcgctctggaagtgaaacaaagcaggagccataaaagtggtaggactcattagagcagctctgtagctgtaatttaacctgcctgtgtgtattggtatcatccaaattgcttcacactttaataaaatagaccttggacctatattaccaactgaatgtgtgaactcaagacccactccagaagggcatatgaggagtggaagagaaagacaaccaccccaaaaggtgcaatctagacaggacagcccctgatgccagtggaaagaggccatgacaagcaagtctcaggagtacactggtagggacccagagcaacagcttccaacccagacagacacccagacgcaatagcatcccgaaggcagacccaggtctggagtggaggagactctgcagaccacctcccccgccctgccaccccagtgtgagaattgcaattcaatctttctttcccagtgactgtaatacaatccaggatacaacaacctaaaagtggacctttaagggatgtatatgatgtacatgatgaaagaaaagcaagtcatgtatgttaattccaagcatttctcctcctcccatgcttaacagaattttgtttggacccttctcactcaacttccatccatggaccatgctgctttgtgaaataagccctttggggcctggtaatgcagaggaaggaaattggggagtaggtaagaagcatagggtctagagcttgggaggggggtatggagggttttgctggaggaaggctgggtaagggagatggagcagcttcagtgtgaaggaaatagatgagaaagaaaaggatatgtggaaggtatattgctgtggtctctttatctccccttgcagagttctagaaaggcagctagatggctgagatatttggaaattagttttgaaaactggactgtattactttaaccacagtgctctgagaccgtcccacaaggaacagcctttttaaggattgaacgttgatgaggcacatctcattcctgtagggaccttggggttcaggggtgaagttaactagagtccaataaaaccacagcaaacagctttacttcctaaggttcttgtgtgtactggctaaaataagggtccttagcccttactgtttccccctgggattcttttgctaacagaattgtccctgaagctcctacctctgaaagctgctcaaatttctctgacagtacagaaagtataaaagtgcatagtgttgaaagtgacggtaggaaaattataatgtcttccctaagcctgagctgtgcagaaatgtctactctgggtatatttgaaagaatgaataaccaaatctgaaatattcttgtgtctagagcatggtgcttgacagtcttatacattggtactctctaatgtaagccctttaataaaatcaagtgtatttagctgtatcagttaggaataatgtgctattctttgtacactaagatggtgctactaatcttatatgcgtttagccatatataaaaggtgcaccctggtaccttctggaggtcctaggagctcaatagtaaaccctgagtcttggtgaacagtcaagagctaaatggtagcaaattacttccttgatgtggtacaggaatattcactgcatagcacagttgaggaaaaagatagcaggaatgtggtgtgtgctaccatcacacctccagtgaccctgacagccatcaggaatccattgatacagtctttcctgctgaaccaggtatagtcccagaatccttattgcagctccccaggcagtcagagctggcacatgagaggaaatctattagccattcctactctgtgagatgattaaggacaaaatgttaatttggggatgagcagggattttagtgttgataacgcagagacgaacggatagcagagttggccttctgcaaaggtcacagacagggcatgtacaagtggcaggtggcagagaaggtccccctgcacataatcatcccttggaatccacagacctctcccattttacctcttggtgttaggcactgagtgttgctcttcaaacaaaggaaagagtaccagttcaggaaagagtaacagtttgagctattgcctttcataaacaccttagttcaaattaaatcttcacatcaacaagccagatacttggaaagaccctgagggattagggttcaaactgaatctggtttgaagaagcaaatgagcatggattagtcaaagaaggtgccaagggctgggtgcagaagaccgcttcccacccacagctctctggagggtcagccttggaacaaggacgttctcctttgtaaactgagcatcaaatactcaggtggcaatcaaagttccacagtaaatagctgatgaaaaacatctgatgaggactttacttttagtaaatgaaattaaaatttaagacaataagtttgttttatcttactttttaattaggttataactggtgcaaccatgtactaagtctttgaagaactcaaatatttatgctaggatggcataaatagcaccaacaaaaaggtcataatagtagcataaaatatctttcatttcacactcgatttctgtagtacaatcttaaagaaggtcactactccaaaaatagtcaaaggattactaatttaccaatattaacatcttttggtattcaaatcatttgctgaagactataatgtcataatccttactggctttctcttctctagttgttaatttatctgacttacccaagcttcatgtatgtataatttgagcaatactccaacatcattttctccaacttcatgaaatcctgaaatgtttgcaagataatttcacttcagaacctatttatattgattttgcatttatactatcagatgttacaatatccatcagtaaaactgactggaaaaaatgtgttgataggtgaagagatggaggtgctagcattaagcaggaggatatttgagagaagacaaattgtacaagttagtgaatgattattctcatgtgatggtaaattttgcttccctatgaaactacataatcattgtgaatgagatgataaacactcagatattgaggatgcctgtattatgcaaccctccttcctgggctaccgctgactggatcagagaaggacacctgacccaactatatcaatcattttctctttcctagaaatttgaatatatatatacacacacatatatacatatatatgtgtatatatacacacacatatatacatatatatgtgtatatatacacacacatatatacatatatatgtgtatatatacacacacacatatatatatatatctgtgtcttgagtcttgattgggtgcagtggctcatgaatgtaatcccagcactttgggaggctgagacaggagatcacttgaatcacttgaggccaggactttgacactagcctgcacaacgtagcaagacctcatctctacaaataatgtaaaaattaaccaggcgtggtgccacacacctgtagccctggctgcgcaggagctgaggcagaagaatacttgagcccaggaatttgaggctgcattgagctgagatcatgccactatattccagcccaagtgacagtgaggaatttgaggctgcagtgagctaagatcatgccactatactccagcttgagtgactgaaaaacaagaaaactgtatctcaatcccaaatatatataatatatatgatctctgaacttttttgactatacatctctatcagtaaaaaaatttaactacatactttcaatggatatatttttatttacaaactgtattcataattacatttattgataaattatatgaataaaatttttaaatcttttttaaaaatgtaaaagaggaatgaaagtatttttgttgttttttgtttgtttttattattttttctttgagtgaaggtatttttaatatttttagtttataactaataaaaatgtattctctataacaaaattataaatattttaatttttaatactaatttattattcattgttttaaaatacttcatttaattctatgatgcaaaagttcacatttgatgctgtataggttcagtttattccaagagttggttttaatggcagtacaactgaaaacctaattcagagtgacaaacaggtccaaatgaaataaaagatacatcactggccaagtttcttattttttaatcccaaccactatgcaaaggcttttgttgatattaggttcacaaataattcttactttctcatgtcaatcagttctcaaaaactaatcaaacccactgactttcctggagatgtttacacagttagaaaattctgttttttaaactaccaacatcattttttacggaattagaaaacaacctgttctaaactatatatggaaccaaaaaagagcctgaatagccaaagcaaacctaagcaaaaaggacgaaactggaggcatcacattacctgacctgcaactataatgcaaggctatggtaaccaaaagagcatggcactggagcaaaaatagacacatagaccaatgaagcaggatagagaacccagaaataatgctgcacacctacaaccatctgatctttaacaaagtcaacaataacaatgaggaaaggactccctattcaataaatgctgctgggataactggctagccatatgcataagaatgaaactagacccctacctttcaccttatacaaaaatcaactcaagatggattaaagacttaaatctaatatctataactataaaaaactattggggtgatggctcacccctgtaatctcagcacttgaggggctaaagcaggaggatcacttgaacccaaaagttcaagaccagcatgagaaatgtagggagacccagtccccacggaaaaaaaaaaattaattagctaggtgtagaggcatgctctgtggtcccagctactcggaaggttgaggtgggaggattgcttgagcccaggaggttgaggttgcagtgagccaagattttgccactgcactctagactgagtgacagagtaaaaccctatctcaaaaaaattaaacaataaaactagaaaaatcctagaagaaaatgtagaaacatcattccggacatcaaccttggcaaagaatttatgactaagtttccaaaagcaaaaattgacaagtgggacctaattaaacaaaagagcttctgcacagcaaaagaaactatcagcagagtaaaaagataacctatagaatgggagaaaatatttgcaaactatgcatccaacaaaaatgcaatattcagaatctataagaaacttaattcaacaagaaaaaaatgaataacctcattaaaaagtgggtgaaagacatgaacatttttcaaaagaagacatacatgtggccaaagaagcatatgaaaaaatgctcaacctcactaatcgttaaagaaatgcaaatcaaaaccacaatgagataccatctcacaccagtcagaatggctattattaaaaagtcaaaaaataacagatgttggcaaggtggcggagaaaagggaacacttatacattgtcaggaatgtaaattagttcagacactaaggaagcagtttggagagttctcaaagaatttaaaacagaactaccattcaacccagcaatcccattactgggtgtatacccaaaggaaaataaatcgttctaccataaagacacatgcacttgtatattcatcacagcactattcacaataacaaagacatgaaaccaatctaggtgctcatcaacattgagtacacatggacataaagatagaaacaacacacactggagactactagaagggggagggcaagagagaggttaagggtcaaaaaactacctattgggtactgtgctcactacctggatgacagaatcattcgtacaccaaatcttagcaacacacaatttactcaagtaacaaacctgcttgtgtactctctcaaactaaaataaaagttgagaaataaatacatacatacatacatacatacagagcaaatcacatagattgtgtttaaaattttttaaaagaaaactgtggtttttgaagtgcagaactatcaagatatttatggatgagactcatttttcaacaataaaattgcatagtaatagaaacaatgccaaacatctattttcaagatgttcttccataggaagagttcttttgaaaagcagatataatactttctctctcactaacaaaacatcatcttttccttgaagaaacagaataaacttattttaaatagctgttagtattacagaaaaggtcagtggatttcgaataagtttcttcttgaaaaagaaaagtatataactcatctttaagaaaggccatcctttttttaacttttaggttcaggggtacatgcgcaggtttgttacataggtaaattgcatgtcatgggggttcggtgtacagattattttgtcaccaaggtaataagcatagtatccaataggtagtttttcaatcttcaccttcctcccaccctccaccctctaagaggccccagtgtctgttggtcctttctttgtgttcatgtgtactcaatgtttagctcccacttataagtgggaacatgcagtatttggttttctgttactacattagttcgcttaggataatggtctctagctgcatccatgttgctgcaaaggacatgatctcattctttttatggctacatagtattccatggtgtatatgtaccacattttctttatctagtctaccattgatgggtatctaggttgattccatgtctttgctattgtgaatagtgctacaataaacatacacgtgcttgtatctttatggtaaaacaatttatattcctttgggtatatacccagtaatgagattcctgggttgaatcatagctctgttttaagttctttgagaaatcgccaaactgctttccacaatggctgaactaatttacagtcccaccaacagtgtataggcattcccttttctccacaaccttgccaacatttattattttttgactttttaataatagccattctgactatgtgagatggtatcttactgtggttttgatttgcatttagtaaggttgagcatttttacatatgcttgttggctgcatgtatgtcttcttttgaaaaatgtctgttcatgtcctttccccactttttaatgagattatttgtatttttcttgttgaattgtttaagtttcttgtagattctgaatattagccctttgttgaatgcatactttgcaaatattttctaccactctgtaggttgtctagtcactctgtggtttcttttgctgtgcagaagctctttagcttattaggtcctgtttgtcaatctttggttttgttccaattgctttgggtatcttcatcatgaaatttttgccagggctatgtccagagtggtacttcctaggttgtcttccagggtttttatagttttaggttttgcatttaaatctttaatttatctcaagttggtttttgtatatggtgtaagaaagagtccagtttcaatcttctgcatatgactagccagttatcccagcagcgtttattaaatgaggagtccttttcctgttgcttttgttgactttgttgaaaatcagatggttgtaggtgtgtaactttattgctgggctgtctattctgttctattggtctatgtgtctgtttttgtaccagtaccatgctgttttggttactgtaacctcgtagtatagtttgaagtcaggaaatgtgatgctcccagctttgttctttgtgcttagaaatgtttttgctatttgggctcatttttcgttccacataaattttaagatacttttttctaattctgtaaaggatgtcattggtagtttgataggaatagcattgaatctgtacattgctttcagcagtatggccattttaacaatgttgattcttcctgtccattcaatgagcatggaatgtttttccatttgtataatctttgatttctttcagcagtgttttataattcttattgtagagatctttcacctctttggttagctacattcctaggtattgtatggaaagaccattcttttgccacaagatgaccagaaaacttcttgtgattttgcgtaatcgaccctcttagttttacaaaatattgggggtgattctgctactaaagtccttgtttttataaaattaaccacataaatgacctcctgtgtactcttttgacttcaagtcttttctaaactagattgtctatgaataacagtgaatggatttcacatagggagtttctactctagtcttacccttgaactatttttattctaattatagcaagtactccattagcggttacacatcagcataaaacattattttattaaagagttcatttcttgtctgacaatggctgacagctgtgtgtctgtgcattaacctgggcagcagaaatgcctcaaactggctgggtgcggtggctcacacctgtaatcccagcactttgggaggccgaggcgggcggatcacgaggtcaggagatcgagaccatcctggctaacacggtgaaaccccgtctctactaaaaatacagaaaattagctgggcatggtggcgggcacctgtagtcccagctactcgggaggctgaggcaggagaaaggtgtgaacctgggaggcggagcttgcagtgagccgacatcttgccactgcactctagcctgggcgacaaagccagactccatctcaaaaaaaaaaaaaaaagaaaaaaaaaagaaatgcctcaaaccttagaagttcagtttcaatgggtcattttgccagtagcaaacaagatgtgagtgaacatttgtccatcgtcaggaatctaggaggcacatttcccacttgtcccctttgcaaaagaaagaagctgttttattatcagtagagacagctgttacattaacatgtgagaaagtatcaattatcatgacaagaaagtacagagcaaaaaaaagtgagaaaaaatgatcactggtggaattatttaaatcctttctctttatcagggctactctgcagcaaacatcctgtaatcactctgaagagctctgaaaatgggttatttagcttcctagtcctatgatctaatgcgaccagatggaatttgccctttaaaaaaaacccttttctctcttttgttctcaagtgatatcacagtaatgatgagctggatacccaaagtctagttattagttttaaatgctaaaatggctcagcctacctacactctcaaaatcatctgattcactggaggggattaagaaaatgtactggagtgttagaatggatttccaaaggaatcacatgtttacctcaaatcagaggttcttggccatagctacaagctttggctcttattctcaccttacatgaaatattttgggatgtttctcaccgtttcaaagatttgaaatttaatttcaagtagctgaatagaaatgacatttcctaaattaaaaaattagcactaactgtatgacacccttcatacaaatactttttaatcttaaaataaacaaagctcctctgactacaaatgaaatttaaatcagaaactggaacaccacctctagtaggccagtctttccttgccatccctgagtgagaggggtctctggtaaagggtatcaatcctacatatatgttattagcagcattgctttctgtttcttaagataggatgacaagaaatcttgctttctcaaccctgtttggaggtgagagtattcaattcagcacacatgtgttgagttcctgctttgtgcaaagacttggtctcaatactgcgagggcgtagagttcatactcaggaaagaagagacatattcatttaaaaaaaagatgttaggaagctcaatattatgagttactaactattgaaagcgtttagttccaaaattctaaatcattaaattataacatttagtcagcagaataatccaggctaaaagctaaactcacttttctcctttgatcaaaactaaaatttctgtaggttgaaagtagagaaggaaaaggtataaggacacagaaaagacaaacgcagtaagtatgctttactattaactgagcttttaactctttcataaatattatctaactctgtgtttgcctttttgaaggggcacaaaatggggaagtggagtgactcagggcagctggtgttttaatgacaggtcctccaagacagcactggggctgaatcatcaggatctactctctggtcttgactcagtcaggtctgacagcactagacccaagaagagtagcctttctatgacaaactcatactaaatgagccaaaccaattcctaaaactagaaagccaatctattcatcctgcatccaaaccacaccttattccacagcaaatttaaggccacttagaaatatgtgggcaagttatcagagaaaataaatcaaaaatttaaaaacagaagaggcaaataacaaataaaaataagacagcaagatggcattggaagtgaagtaagctcacaatgtatagagagaggtatatattcttgtagaatagcctccttatagctggaatcacaacgcatatacagtgagttacatggtggcaccatcatcgtatcaagataccagaggagccaatcagaagattattcagaacaaaggaaatataatgggctgaggagagacattcccctaaactctagaaaaacctgagatctggttcctcaaacaagacccacagctgcagtagttcagtctccacgcccagggttcctccctggacagtgccacagacctgcttctctgcacccacttacttgggttcacacttcccttcaccaatacatgagggatcactgaggacataaagcagcctcaggcactccacgaattcctcatatgagtcttagacactctttgtctagtcccatctttatctttgtctttcatcagaccaatccttcaaatgtattaggtaaaatacactagctatgaactagatagatgactttctcaaagacaacagaagtatttgtaatccatcagggatcttggaaaaggttaaaataagaagagtggctccagatacaaattctctttaagagatcctactgccatcaataagatatattctaagtttctgcacaaaacttagcatgccccttgacagtaattcagccagtgggaattactagctatttggaatttcaaaagaagtggaatttctaaagaagaaatgcaaaatagaaaaaaaaaaaccctatgtccaaatatatctattgtcaaaagatatccatgttgtttataaaaacaaataactagaaacaatccaaatgtctaagaattgagaaactgataagtaaactactgtttcgattgagtgctatattatacatcactaaaatgatgtatattattttacatcattttagtgatatagaagtatatatagaagttctatacttccacatatggaagtatatatagaagttctatacttccacatatggaagtatatatagaagttctatacttccacatatggaagtatatatagaagttctatacttccacatatggaagtatatatagaagttctatacttccacatatggaagtatatatagaagttctatacttccacatatggaagtatatatagaagttctatacttccacatatggaagtatatatagaagttctatacttccacatatggaagtatatatagaagttctatacttccacatatggaagtatatatagaagttctatacttccacatatggaagtatatatagaagttctatacttccacatatggaagtatatatagaagttctatacttccacatatggaagtatatatagaagttctatacttccacatatggaagtatatatagaagttctatacttccacatatggaagtatatatagaagttctatacttctatatatggaagtatatatagaagttctatacttccatatatagaagtatagaaacttgtgtatacattagaattgcaactttgggagctgggcgcagtggctcacacctgtaatcccagcactttgggaggcggaggcaggcagatcacctgagagcaggagttcaagaccaacctggccaagatggtgaaacctcatctctactaaaaatacaaaaattagctgggcatggtgggggtgcctgtaatcccagctactcgggaggctgaggcaggggaatcacttgaacccaggaggcacaggctgcagtgtgccgagatggtgccactgcactccagcctgggtgatagagtaagactctgcctcaaaaaaaaaaaaaaaaaaaaaaaaaaaaaaaaaaaaaaaaagaattgcaacttttggagaaaagttcctgtgcatgggataagaaggttgaaaggaaaatcaatcaaatgctaacaattgttttagaattatgggatcaggggtaatcttttaaaatctattttacaaattttcttttactgtggccctattatgaaatataggtaaacaaataaaaacattcaaactcacttaaaacttatgacacatattgaacaagtctttaaactgttgtaaatagatagataattagatagacagatggagatcatgagaaggctgtgttcgtgaggatataggagaatatctccctgggaatcacttgcaatagggagaaagagtagggagactcacagcagggtaggaagtgctacaatagtagatggggctgatacagacaggagacagggaagtacttggtagaagagggcagttccctggcaaaggccccacccccatgcctggaaagccgcagccctaaatgggaacaggcattcttattttcaggcccatatgttgccttttggcctgccaagccctctgtcctgtacccatataaaccccaagccccaagctccatgagcagatgagcagatgaacagaagagcagaagagcggcagaatggtgcagcagagaaggagagaggagaaggggcatctgaatgttgagaggagttcagctgggcatggtcagagaggagatcagcgctagatggccaaactccaggggaatatcattttcccactccatcccccttctagctccccacccaccccactgagagcgacctcaatcacccaataaaatccctgcattcactgtctttcaagtccatgtgcgatctgatttttcctggacgccggacaagagctcaggatacagaaagctgtcacactggccctctgccttgcaaaaaggtagagggtccactgagctgtttgatatttaagctggacatggatggcaaagctcaaagagcgcactgtaacacacacccatttgggctttgggagtcataggcattcacccctagagcttccatggcgctggaggccaagaaagcacttgccccagctcctgcagttgcccgtctgcatgctccccgtcccataaggggtttgagtgctcacagtagccaaacagaccagccacaccctgtcgcatgtcctgtgagtggggacagggaactcccattttagggcaaaagcacatatatactatatactgcctgttttattattgcaactttttttttttttcttgctgggattacttgagatttttattttctgattggcatttccatggacttgccaaattgtctataatgaacttacactacttttacagctggaaaaacaaagtccattaaacaagaaacagaaacccaggtgaaactgtcagccctaccatctgcagcatttggggtcccacttctgctcagagcccactcctctctgcccatttgggatctcctggctcaaaggctccttaatctttagcacatcctatacaacttcattcttacctgaacactgataaaaccaaggtgctacactatttaaaaatcactgcttagaccagataatagtaaatacaaataatttccaaatatctctccaaagtcatttctcaaaataatctctactaatccctaatggaatcaaagtagtctgggactcccccccatccccggcctcctatcaaagacttacttctgagggagttgagagatcttcggttgtaaaataaaagataataataaatctaagatcctatctgattctccccgctttaattcctggcctttaaatgcaacatttgccacgagaaaaaaataaaagtaagttcagttcatctgtcatatttctgccttctccattaaaggcatctattttacatattgtcttgagacttggcactattcagagagatttaaatagaccttgtattagtttgctagggttgtcataacaaagaccacagactgagtgactcaaataacaaatttcttttctcacagttctggaggctagaagttcaagatcgaggtgtcagtgggattggtttcgttctgaggctgctctccttggcttttagatgttttcttctccctgtgtcttcacgtaatctttcccttgttcatatccatgtcctaatagtatctttttacaataccagtcatatttgtattaggatctaccctaagaacctcattttatcttaattacctctgtaagggccctatctccaaatatagttatattctgaagtattaggggttaggacttcaacctaccaactttgggaaggacacaattccattcacgacaaacccgaatcctgctttctagaaactttccatctaaaacaacatggatgaacaaaaaccaaattaagcaagcactgaggaactcctgaatggtgctttggtccagtgcaattagcactaggattatggagactttcattgccaatattttacccttaatttaaatcatgtcatgaaccatgtcacccaggaatttctagcattatgcttttctgttcctaaatccaatatcaccacatggcaccataagctctcagaaccttcatgttgggccctgaactgctttgtaactgacctttgatcctcccagaagggatcttctaaagtgttacagaaagcatgatttaatcactccatagacacacccacccgcctgtgtaaataggccccttctctgctacaggcttagaaaacaaaaacaagactacttcacggatttatctctaccttcaaatagccctaagttgctcagaaataacaacagaaaggagaggaagctctcccttcactatacactttttcggtgtctactgaattcatagcatagcaaaggtatcataggtgagacaaagtgaaaaggaacatagcccagacttccaactactggaggacttgacagcctggccaccagcacacctccagaagaaattcccattaggttttgtgctttttccctccagaaaataggtaggtcgtaaggatgctcatgagatccctttccccaattctcattgccttatctttttaaatgccaatcctttattttgactgcaaaggtttttcgctaatagatggctatcattcactaataggtggctgtatttaaaatacagatttaaacagaagacattttccctacaagattccaagaattagttaaagagagtagttatgatgcaaacaacctattgacaaaagcatcatcaaacaaagatgtttgaatttgtcattctgataaaatgacccacaataggaatcttcacagagcaagttttcttcccctcctcccaattcagtatatcacatctccctctccaacccacaaaaatcaatttgcagagataaatttacatataaataaaagtatgcctgcaggttgtaagttcaatcaataaagccacaagcatttgttaaatgcttcctatatgcctagttatgttttaagtgcttggaggtacaaaagagctacatggaatctctctggattcatttaaaacctattttgttacattgaaaatgtatcaaacgttccaaagaaaaaaaaagagagacaaagcctcttcaggaaccctttccttttgcgagcctttgaagctcatgttaaatactatagaagagtttttgaaacttagattcttaaagggaaaaataataggttggcctgaggtttgaaagaaatgttgtaacagtcactgtgaggcatccttcaggaaaaatagtgctttcagtgtttataagttattcattagaaaactcagggtctagctggctgacactgtaggtggcaaagcaaaactttcatcctcattggaagctaggagctataaagccaggtgtggggtgtgatttgtttctggagggcagctctaaatcacaagaacataaagaaagggagagagaacaagagctagagatagagcagccttgctgttttgtccatgaaaggaaatgctacatgtcagaggaagagctgctggagaactcactagcagagggaggaagcaaggagaagacctcattttgggaagataatcacaagagctcagagccaataccataatttttaaactcaaaaaccagaactgtacagccttaagactctgatgcaaataagatattcagagttagagacccagcattattaagtagatgattataatgagagagtgtgtttgaacatttttattatgtttaaagataagcgattacagacgtcccaccttctgcatggttctaatgtgtacaaatttcagttaccatagtttagttaaataacatcagtcacccaacaaaacaactcaaagtgcacttaccactgtatattaatggtgagtaatcacataaaatacaaactttgcgctaaactaagcccacaaatcaccatatcagtaacagatgggcatcatgatcagtaaccaatcacatcacttcttttaaagtctgtcagtgactggtcaccaggcatctgttattcagttcaggtacagacaataaagcatagagttgtatcgccttctcgtccccagtgataaattcatataaaagtttacaacaaatctgaaagtgcagcaaagaaatgaaaagtggtaatgcagaaaattgaaattggtgtgatgagaagatttgaaaatggcaacatcaaagcaaagataggacaataactaggccttcaggaagctagggtatgaactatgccgacaaagttcgctgaatataaaaaatgaggtaaagcagcttcaacatattttagcttaaattgcagtaggaagagaaagccacatgtggttgaaatggagtgcttacttctgcttttgtgtccgcaattggttccttccagtgggttcttggtctcactgacttcaagaatgaagccgtggactctacagtgagtgttacagttcttaaagatgtcgtgtctggagtttgttccttcagatgttcagatgtgtctggagtttcttctttctgatgggttcgtggtctatgctgacttcatgagtaaagctgcagaccttcgcagtgagtgttacaactcttaaaggtggtgcggacccaaagaatgaccagcagcgagacttattgctaagagcgaaagaacaaaacttctacaccctggaaggggacccgaggaggttgccactggtggctggggtgacctgctttttattcctttatttggtcccgctcacatcctgctgattggtccattttacagagagctgattggtccattttacagagagccgaatggtccatttttacaagtgctgattggtgtgtttacaaacctttagctagacacagagcgctgattggtgcgtttttacagagtgctgattggtgcatttacaaacctttaactagacacagagcgctgattggtgcatttacaatcctttagctagacagaaaagttctccaggtccccacctgattagctagacacagagcactgattggtgcgtttttacagagtgctgattggtgcgtttacaaacctttaactagacacagagcactgattggtgcatttacaatcctttagctagacagaaaagttctccaggtccccaccggattagctagacacagagcactgattggtgagtctacgaacctttagctagacacagagcgctgactggtgcatttacaaaatcctttagctagacagaaaagttctccaagtccccacccgacccagaagtccagtcagcttcacctctcactttgaatcgagggctgcaataaaacataatctcaatcagttcagctagcatcccaaagtgtgatcattgccatgctgaaagaaaacagtgattctaaggaagccaaagaaacttctactgccaataaagactggtttcatcatttcagatgccagaatgaatgatttacagtaagctatctgattaagtagctggtgaaaataagttttctgccgtgaaatttgaaacaagatttcaagaattagttaaggaaagtaggttatgatgctctcaaacaagagagtggctatgacaaaagcacaaagatgtcccagagaaagggatgctggcaaaaatgtcaggttaaagaaactctcaaagatatttcacaaccttgaaagtgcagaggataaaatgttaaaagtgaatccaaacttgaaaggatggtgacaatttgccaaggaataaaaaaggatgaaataccgggaagggctacaacgtggagaaaccttgaaacattatgcaaagccagtcataaaagaccacttactatctgattccatttatatgaaatgtccagaataggcaaatctatatagatacagaaagtagattaatggttgtctagggctgaggagggtatgatgagagggtaggagggtgatagataaagggtctgagatttaaactgtctgtttaacattatcagagagctgtcaaaaatatccagaatttgaaaggctaagattccaaagaaaaaagaagctgactaagtgagtccaatattctttatacctctttcgccctcaaggcattaatgactcctagggtggccggggttgtagggggtcagggagtagggttgctgagaaggcaggcagagaatgaatgctaagaggcaaagaagctggcaatcttgtggagctgggttggagcctgccaagacagccaggacctaaatagccaagattcctgaagagaggaggcctggggaagacagcctgatactcagtaactttcccttcaacactgaaaaaataggaataattatctagcaagaccaataaaaaaagagaaatcaagcacaaattacataagtaagggaacaaaaatggcctcactacaaaaatggcctacaccccacaaacatcaaagagttactaatgggatattagaacaaccctaggccaataaatttggaaaattagatgaaatggacaaactcctggaaaaataaaacttattaaaactgcctcagaaagatcagaaaatctgaatggtgctttagctattaaagaaactgaatctatcattttaagtctttccacaaaggaatctccagatccagttggttgtactgatgaattcttccactgaggaagaagaaagactaatactaagaaacttctctcagagaaaacaatctataaataagggaactgatcaagtttactagtaaacaagatcaatatacaacaaaacaccaaaaataaactactaaaaatgaaatttgaggccgggcatggtggcttacgcctataatcctagcactttgagaggccaaggcaggtggattgcttcagctcaggagttcaagactagcatgggcaacgtggcaagacccatctctacaaaaaatacaaaaattagccaggcatggtggcgcatgcctgtagttccagctacttgggaggctgaggcaggaggatggcttgagcccaagaggtgaggttacagtgagccaagatcgtgccactgcactccagcctggacaacagagtgaaaatgatatgatagtggctctcatctgctccccgcacccgaccactggggcagattttaattttttaaaaataatcatctgatgctgaatttaaaactttggagggaatcaaaagagaaggtcttgcactcctgttatccaagagacataaatacatgtgtgttttccttttaggccgaaaacaagaacaacattcctggcattcaactacaaggaagcccaataccccgggtgccataagacttccagtatgcctgcctgagctttgaaagagaggagaggaagccaagtcatccagcagatcggacccacaagctcatcctctagtttttttcaaggggcaccattcctgtaaggaaagctttcttgggcttggctgtagaatcttccagaaatgtaaacaaaagagtaagagccaaagaccaagaaccctggctggtgagagtcagagggccagaatttagtgtaaagcccgctctaaagactgttaacacttcctttccaccactgcatcgatgattgtttgaaaaagtgattgtttgtgatagactggattaagaaaatgtggcacatatacaccatggaatactatgcagccataaaaaatgatgagttcatgtcctttgtagggacatggatgaaattggaaatatcattctcagtaaactatcgcaaggacaaaaaaccaaacaccggatgttctcactcataggtgggaattgaataatgagaacacgtggacacaggaaggggaacatcacactctgggaactgttgtggggtggggggagagggaagggatagcattaggagatatacctaatgctaaatgacgagttaatgggtgcagcacaccagcatggcacatgtatacatatgtaactaacctgcacattgtgcacatgtaccctaaaacttaaagtataataataataaaataaaataaaataaaataaaataagaaaaagtgattgtttgaacaagtgtatcaatgattgaacaagtataaaaaaggtttattatgcctttaataaaaaggaacatatacatatcaatctaaaagacctctaaggtctcaaaatataaatgggcaacaaaaccggacagaatttacagaaaaaatgtctaataaaaatacaaatgtctagtaaccatgtgaaaagcgtttgcctggagtagaaatcaaaattaaaatgaattaccagtttttgccaaacatattaccagagatgtttttaataaacattttccaaaaaaaaaagagtgacatgggcaccctcatgtctgatgatgggagtatattaatacatcttcaaaatctataaaatgttaacagataagagatactgacagggctgattctaacctaaatactacaaagaaacatatgctgtgggtatggagtgagagttaatatgtcccggcccacctcatgtctaaatatgctgaaacagcttctatttaaaataagtgctgtcctccagctgtagcaaataggaagacaagtatcttcatgctgttgacctggttttcctatcgtgattcacgaatgactttaagaaagagctaaatcaactggcaaactacattagaaagaagaatttagggccaggtgtggtggcacatgtctgtattcccagtactttgggaagccaagttgggcggattgcttgaagccaggcgtttgagaccagcctggccaacatggcgaaaccctgtctctactaaaaatacaaaacaggccaggcacggtggctcatgcctgtaatcccagcactttgggaggccaaggcgggcagatcacctgaggttaggagtttcaagaccagcctgcctaacatggtgaaaccctgtctctactaaaaatacaaaaattagccaggcatggtggcaggtgcctgtagtcccagctactcacaagactgaggcaggagaatcacttgaacccaggaagcggaggttgcagtgagcccagatcataccactacactccagcctgggtgacagagcaagattccgtctcaaaaaataataataaataaataaataaataaaaatacaaaagttatccatgtgtgcactccagcctgggtgtcagagaaagattctgtctcaaaaaaaaaaaaaaagagttgaggtagaacacattcagattgacagtatattcccgatatatccctccagtaatacacacacacacacacacacacacacttgcactcacacatgcacacttgcttcatgaaattcttttttatctttatgccttttcaaaacatacctcctttcaatcccctaacttctgtttaaccactttcccctctctaccagccagttttcctctgtctgaccttaaataccccaaatgctttacatccttggctttcttctctttcggtcttacaccttcttgatgaatgtgagattctcagactctgctattgcttcaagaacccttatctctatgcaatttccaaatccatacctccaactctgtatgaacttccctcacagatactagatcaatatttcttgttttgactttaaatacacacctaaaatgaaattttcctttcttacccccatctcaacttctttctgtcctatatttatttattcacttgtttattcactcattccacaaatagctaacaagtaccaggcattattactgcctggtacttactattgaccacttgttcttccaaatagacatgtaagaatcaaccttcattctcctcagtcctttacttgctcaggtcaactgtgtgtactaactcacacaggtgccttagattcagcccttttcttcatccccactaacatttcagccctagccctcatcctctctcaccgggatgcctgcagcaactcctatatattttccctaccagtaaagtcagtccatcttacacacagttggcagaattatcttcctaaaaagtaaattggaccatgtcacttccagttctgaaaagcctttcacagcccatagcaatggtgggatctgtgtatcaaccacataagaatcaggccggggagctccttaagctattgcttgctgagccccagacctactgcaaccatctccttggagagaagacttaggaattcccttttttaatgagctccccaggtgattcttgtacccatgaaaggtagagagccatgggcctgcaggagagaatccaagttccttaggcagaaatacaaggtccttcactccctcggcccaactggtctcagttccctccactctataccgttcaccctacacaccagtcacactgaatttctcactgttgtctggacactttggttcctccacacctccatgcctgtctctataccccgcttccctgccttcccctccacctagtaaaaccctgatcccccttcctctgagaatccttccctgaccaacacttgctgccccaccagagatgtctgctgccccatcagacttgtaccatatgtattatatatgacataatattctatatattatatagaatagagagagattcatattggttctgtttctctggaaaccaataaatatgtattatttagacatacataatagaagatattctctctccctctggagagatttactttagcatttattataatgaattgactcatgtgattatggaggctgagaaatcccaagatctgcagttggcaagctggagacccaggagagctgatgtgtggttcctgtccaaatctgaaaaaggcctgagaaccaggagattttatacacacacacacacacacacaaacacacacacacacacaaacacacacacacacacacacacacatatacacacacatatatatatacacatacacacacatctgtttctctggagaactttgactaatacagtcacaaagcagccatttgaaaaatgtttctatatttgttccattgaaaacactgtccattagcaaacaataggtgtctgaaaaaaagagaaaagaaaaccctgtccattatgttaagtgctccactgaaacagtcatagacacaacttggatgcctgctcacacccgaatatgtacacctcttgtccccaccacttccctgacatccatacttaaggatctacctgaccactgtccacttgacatctcaatgagttatctcttttatttatttatttattttgagacagggtgtcactctgttgcccaggctagagggcagtgatgtgatcatggctcactacagcctcttccccccaggctcaagcgatcctcccacctcagcctctccagcagttgggaccgtaagtgcatgccgccacacccagctaagtttttgtatttcttgtggtagagactgggtttcaccatgttgtccaggctagtctcaaactcctgagctcaagcgactcacctgcctcagtctcccaaagtgctgagattacaggtgtaaaccaccacacctggtccaagttatctcttaagtagctcaaattaaacatgtccaaaacagaattcctgattttgctccccaaaccagcccagtcttcaccatctcaaaagatggatcatcattcatctattgtctcgagccaaaaacctagagcaatctcaattcctctctttctcttctttccttcatgcagcaaatcagcaagtcttgttgatactacttccaatactgaacacttaacacaactccaccagctttatcctggataaagccactgtcatctctcactgagacttctgcaatagtctcccagttggcatccctgcttccactcttgctccctgacatccattctccagacagtagccagaggaaattagaattaggcattcaaatatacaacattgctccttgattaaaatttccactggttcccaatctctcttgggggaaaaatccaaatctctacaaagccatacatggctaccttctctaacctcatctcctaccaggcctctgccactccccaccaccaccaccactgtatcccctactctgtacaagtcctctccagtccaactggctgtttctcaaatataccaagtttttcctacctctgggtcttggagcttccttttccttctcccgaaatgctctttggataaagactgggctggtctggggagcaaaatcaggacttctgttttggacatgtttaatttgagctacttaagagataacttgggtcaggtgtggtggctcacacctgtaatcccagcactttggagaccgaggcaggtggaatgcttgagctcaggagtttgagactagcctgggcaacatggtgaaacccagtctctaccacaacaaatactaaaagttggctgggcctggtagctgggctccctctcaccattcagctgtctgctcaaatgtcagctactcagacatcttcccccgccttcccaacactctctatctcattcatccacttcatttgccttcagggcactcatcactaccaggaattacttactttactgactttattgactctctctccccactaaaatataaaccctatgaagacagagaatttatcttgtacaccttcatatccatggtgcctggaacacagtatgtacacaacacataaatcaatgaatgctctgagagtactgttgtttttaatactctgagtaccattgtttttaatgctctgagagtaccatttaatgctctgagagtaccattttgcggagacacttacctattccagtgcaggaataggtaagaaaatcatggaatgtataaggaaattatgtaactcatcatgtttctcctttgtcttaacttccaggaagctcagtcttaaattttgtactgaagcctaacaatttaccttacattgggtttcctttttaattatctactcattatatgacttttgatcttgtatcattattgtaacatttatacagctatcttttattgtaaagcacctcaattccttcatgtgggcaggctgtaaaaattaatacataccagtcctctgttcttttattgattcacgtatgttaatattgtctctctaacatgattataagcttcttgaaagcagcccaatagattttatccttttatatgccctcaaaacacatattacattcatttaataacattcatcatttaccaatttcttcattgatttgttgattgatcaatagcataaccccaggtggtacaggtgaataattcagggtctaaagaaaattgtcatcaccctttgaaaatttggacacatttattaaaagtgagagggcaggagttatctacatcaaaaagacaacttgccttggtgagttggatggggaggacatgcaggtacagctaagcccgatgcaaaggttagcagcagagaacctagaaggggtaaaatattctacaagaaaatggtcctggaaaaactgctggagagaaagtgaaatgaagggagcaaagtcatgcctgaaaaaagatgaagatactgatccacctcttgctggagaaataatgaagaagtcttggctgagtagatgggattgaggggagatgggataaatttgggattaaaggacaggtgcaggagaaggctttgtcattaacactgaatgacgactacctggaggtcgtccctttatccacctgtggggcccagatcgaggttacagcagaaaagacaggaagagagggagaggtgagttctgatagaaacctggcaggaatgctttctcactaataacttttgacattcagcaaaactcccagcagtgattttaaagaccagcactaaccaggaaggccagcaggcagaagcggatgctcgcatggtggatggagcagttgtccccatcagcatctttccagctggctgggcactacatgtcctcacaaaactctttgcagcggcttcagtgctagacatgtggaaggctcggagtttctgtaggagttcccccacctccagagcccccttgaatccacaatttgcattcctcacaccaggagagggcctggaaaaggcccttcacagcaggcagcacacatccagtctccatttcagcacccagagccttctaatgggcacttcgctgagaccttaatgtctgcataagggcccagaaatagcagaactttcatctgaaatagtgaactttcatctgaaaatcatggcaaataactgcagagtcagagtgacttatataatatgccaggcatttattgttgttgtcattgtttttaatgttctgagagtaccgttgttcttaatgctctgagtaccgctgtttttaatgctctgagagtaccatttaatgctctgagagtaccgttgttcttaatactctgagtaccattgtttttaatgctctgagagtaccgtttaatgctctgagagtaccgttttgctgagacacttacctattccagtgcaggaaatagatgataaggccaatttcaacactggagagagagcagttttgctcaaaggacttttgccctaacaaagaaccagatctacactggcatcttcagaacccctcatgagcatttgttaagtgatgcattagttatcccaccaagagggcaggtacactgatgcacaaggtaagaggtcactcatgaatctaatcagtgtaggcaagcaaaatggaatacattcataacaaatcttggacaaaatggcccactaatggcttccccccttctctatacctgtggaggacagctgtatccatccaagatcctctcatcatctaaagtgtgtgttcactgaaaacttactatgttccatgcattatgtttacatcatcatctcacataagcctcccaacatccctgcaaggaaagtaccaacattagcccatttcacaaatgaggaaactcgttgaggttaagccctcacctagttggtggatccagcagctggacccaggcagtctgattccagagctcccatactcagcatctaaacaacactgtctgtctcccacagagcggcacagggccaatgggcagagacgccaaaatgaggcacatcatcccatgtagccacctctgaagagcaagaaatggctacaactgacaagaagaaacagatttatacatcagagacaaaagagataggccctcttgaatctctgagcataataactgaataaaagtggctttgtttgcttaattaaacttcagcatttactgaaattacagtaatgcagcaatcactttcactctaatctaggttacagtatttgaagtttccccctaaaaagcaaacatttgggcttaagaaaatacctaccaaatgatttctggagaggcaaaacatttgaaaagactttagcaattgatctcaatgcggagatacttttaaaacaaaaaccctaagccctgggtctcagctccctgcacaagaccagacatacacataatccacattcatcacacacacactgcacaaacaatgcacttacaccacatgcacacaccacacccatatatacatagcacatacatacccaacacacaaaccacatacccaccacatagacacacatacaccacacacaagacacccatgccatacaaaccacacacacaacacacaatcaacatacactcatagcacacacacacacacacacacactcagtcacactgaacagcaaagcggcgtgtgctgcctctcctggtggtcccctctgtgtcctcatttatggtataattgcgcatttcatttccaacttgaagagcacagctctgcagggcaattgttttaaacctgagattgcctgaattaaatggcaattttagttttttatagtgcaaaatacagtttacattggcaaaaaaaaaaaaaaaaaaaaagacatggagtttcaaaactcatgctcttaagcctcctgaatcacagtaattttaaaatcttgattctgccattagggtgaaaaagaaaatctattttgtaatctggcaccttctcatgatgagtttcttactgtgactcatgctatagatgccttgtgcaaatgtaaaaaaaaaaaaacagattgatacgtgagaagaatttcaataacgggagaggaaccatttgggtgaatcaagcccttcccagtcttcaataacttggggctccttggacagcccacatcatgccaaaaaaggcattctcacagttgggaagaactgcatcggacaccagtgtcaaaaagaggatttttaaactcgctctgaccaacatccctacgcatccactgacaaatattctctgcgacctaacagctgatattccttttgttctcctaattaaaaacttttatggctaaatgcaacatggtatactggattggatcctggaacaaagaaaagacattagtggaaaaactggtaaaatatgaatatgttctgtatgttagttgatgatattatatcccagttttgacaatgtaccatcgttacataagatgttaacataaggtgaagctgggtgaagggtatatgaaaactctgtaccatctctacaactcttctgtaaatctaaaattatttaaaaacaaaaaaaaagttttagtatttgtggtagaggatacctcccatatcagtctttgctttctttacataaggagaatactggtgcaacacttctcatggagtttataggatattgagagagccaagtaaaaagggctccctggagaatctccaacccacctgtgcactgggaggacggggtggggcctcaggaagtttgagcggtttgcagggggaggagcctggccgctcctgttcccatgtggtaactggggattcaatctagcaggattctcactttgctgagagtccctgtttccctttttttcttccttttcacccaatgaaccctgccctacacaccctacaacgtgtccatgtgcctaaattatcctggtcgtgtcacaagaaactgattttccaacaacaacatttgggcacagtgtaatcatggcctataatctcttttataattctataattttaaatatctgattaagctatttcaaaaaaatttttcttttctttttgtttttggagacgggagtctcgctctgtcacccaggctggagtgcagtggtgcaatcttagttcattgcaacctctgcctcccaggttcaagtgattctcctacctcagcctctcaagtagctgggactacaggtatatgccacctcatctggctaattttttttttttttttttttttttgagatggagtttctctccgtcgccaggctggagtgcaatggcgcaatctcggctcactgcaacctccacctccccggttcaagtgagtctcttacctcagcctccctagtagctgggattacaggggcccgccaccacgcccagctattttttttttttttttgtatttttagtagagacggggtttcaccatgttggccaggctggtcacgagctcctgacctcaagcgatacacccaccttggcctcccaaagtgctgggactacaggcatgagccactacacccggtctaatttttgtatttttagtagagatggggttttaccatgttgcccaggctgatctcgaactcctgacctcaggtgatctgcccgcctctccccatgtctgcgtgggttttcgtagggtactctggctttctcccacatcccaaagctgtacacgttaggtaaatcgggtgtctaactggtcccagtgtgagtcagcgtgggtgcttgtgagtttgccttgcgatgggatgtcgaactccagggttgcttcccacctggcactcagagctgcagggagaggctctggccacctgcaccctgaactggaataagcgggtagttatctgacttgctttcattaatttttcttttttttttctttttttttttttttttttttttgagatggagtcttgctctgtcacccaggctggagagcagtggcgcaatctcagctcactgcaactgccgcatcccgggttccaacgattctcctgcctcaggctcccgagtagctgggattagaggtgctgccactacgcccagctaatttttgtatttttagtagagacagggtttcaccatgttggccaggctggtctcgaactcctgaccctgtgatccacccacctcggcctcccaaagtgctgggattacaggcgtgagccaccacacctggccggctaatttttcttaagtatatgtacggtccactttcatatttcaatgtgtaatattaaaagtgtttggagtctttatttagaagtttggtgatgtttctgtgaccagaaatatgtcataggaacttgactcttgtttatatcaattagcctatggtaaaattggttttgttaataacagatgttggcaagattttggaaaaaagggactgcttatccactggtggtgggaatgtaaactagttcagccactgtgaaaaacagtttggggatttctcaaagaagagaaaacagaatttccattcaacccagcaatcccattactggttatatacccaaaggaatataagtcattccaccaaaaagacacatgcactcatatattcattgccgcactatacagaatagcaaagacataaaatcaaactaggtgcccacctacagtcgactggataaaagaaaaatgtggtacatatacatcatggaatactatacagccgtaaattacaatgaagtcatgtccgttgcagcaacatggatacacctggaggccattatcctaagcaaactaacgcaggaacagaaaatcaaatactccatgttctcacttataagtgggagctgaatgttgagtacacatggacataaagataggaacaacagacacctggccatacttgagggtggagggtgggaggagtgtgaaggtggaaaaactatactattgggtactatgctcactatctgggtgacaaaatcacttatataccaaaccccagcaacacacaatttactcatgtatcaaacccgctcatgtaccctcctgaacctaaaataaaagttgaaaaaaaagattttattatatgtcatcttacttaaagtcacagtttccagagcctatcactgacgttaagtgcggacttactgtacatagatatttacttcctttttttccctgaattaggcaccagccccaatttttttaaaaaacacctttaagtagtagtactcacaatggccaaaaagtggaagcaacgctattcatcagcaggtgaatggataaaaaaatgtggtatatacatacaacagaatattattcagccttaaactggaaaaaaattgtgacacatgctgcaacatagatgaaccttgaggaaattatgctaagtgaactaagccagtcacaaaaagacaatactgtgcaattccatttatatgaggtttctgaagtagtcagattcagagagacagaaaacagaatggtggctgccaatgaaacagaagagttccccgttccccctcacaggacatgcaacaggggtgtggcttagctgttcagtcactgccgctgctcaaacccctgaagggaggggaagcacatagatagacaggtgcaggagcccaagtgggcatgagttacagtgtgcccttttagccctgccgtctgtggacagcttgagtgttaaccagctcaatggactctctgcctttttgcaagggcagagggccagtgtgacagctttctgtatctcaagctcttgcccagcgtccctggaacacaggcttgagggatgaatgcggggttttattgagcagtggaggtggctcttagagggatgggtggggagctagaaaggggatgaagtgggaagatgatctttccctggattatggccatccagcagctgaactcccctctgaccacccttagccaaactcctctcggtattccgacattcctcctcttctctctttctctgctgcgttgttctgccattcatctgcttgtctcttatttcactgcctcctcacctgctcgtctgcttctgaagcgtggggctcagggtttatatggatataggatggggggcacggcaggccaaaagacaactttttgggcacaaaaacagaaatgcctgttcccacttagggccacaggtctccaggcttaagggtggggcctttggcagggaaccaccctcttctccttagtatttccttgtctcctgtccatatcactaggggctgaagggcaggaggaaatggggagttgttcaatgggtgtagagattcagttttgcaagaagaaaagacttctggggattagctgtgcaacaatatgaatatacttaacactactgcactgtacacttaacaatggttaagatgctaggtttggttttgtttaccacaattaaaatttttaatatttttatcttatttctaggggactatttcattcttttgttactcatcaaagtcaagggctgaatgtaggctaccagcccacaataaaggatcacaacttcttaaattttaatatttgtttattatacaaatatttatgttagagaaaaactagaaaacaaagacaagccaaaaataaatataggctggacacagtggctcatgcctgtaatctcagcactttgggaggccgagatgggtggattgcctgagatcaggagtttgagaccagcctggccaacatggtgatgccccatctctactaaaaatacaaaaattagccaggcgtggtggcacatgcctgtagtcccagctacttgagagactgaggcaggagaatcgcttgaacccagcaggcggaggttgcagtgagtcgagatcaccccactgcactccagcctgggcaacagagcaagactccatctgaaaaaaaaaaaaaaagaaagaaaaaagaaatataattgtttttaaaacaaccatcatccctccacccagaaataaccccgggtaacattctggtgggtccatccagatttctttatttttgcaagcataaaatttgtttgttgcatattttcagcagcaatgttaaagatatccaacacttaaagagtgatatcaagaactgcaggactggccaggtacagtggctcatgcctgtaatgccagcactttgggaggccaaggcaggcagatcacttgagctcaggagtttgagaacagcctggccaacatggtgaaaccctatctctactaaaagtacaaaattagctgggcattgtggtgggcacctgtaatcccagctactcgggaggctgaggtgggagaatcacttgaacccaggaggcagaggttgcagtgagctgagatggcaccactgcactccagcctgggcaacaaagcgagattctgtctcaacaacaacaacaagaacaacaaccaaaaaaaaaaaaagaattgcaggactgtagaattttagccctagaaaggagcttagagactgaccaacagagttacctcattttacaaagaaataggaaacaaaagctaaaagagcgtatgttttaggtaataagaaaaccaggccttgagcatcaaacaaatcagaagagagaatgctgaaggtcaaatcaaacagaatgatgttgggatcacttgtgtcccagtatggtctatggttaagagggcaggctcttagccaggatgcctgggtgtgaatcaaggctctgctgtgcacttattggctacttgacctcaatctagttacccaactttttaagcttcatctgtattattgcctatttatagattaaaccaggattaaaatttacagatttatagattaaatcagaattaaaattaaatcagtcagaattaaaggaaataattcaagtaaaccacagaagaagcacttatcgttgattacaattaccaccgttacagtgaaagagatccaagtttccccgagttactggcagcatatctgtatgggtccaaaattcaaccgaggggcataaagcagaaaagagaccaagccaagtttcagagaaggagtggaagtttatttaaaagcctttagaacaggaaagaaaggaaaattagcttgaaagagacccaagcaggcactgaaggtccaagagagaaatgagagcaaaagaagacagcaaaaggggcctttgaccttgatctttataggttcgcctttataggggactatataggctcgcctctctcccaggattcttcccttagggtgggctttccgcatgcccatgctttccttactctttggaattgagcacacacagtgagtttagggagttgtacacatgcccatctgaggctttcttccttttccagtggagggtgcccccagaagatcatatttcaccatttttgtctcttaacacgcatgcccaggaagttgcttctccctggggcctgcattcaattagcattttgatgttaacaggtgtgaaccatcaggaaatggcctctccctggcgctgccaaattataagttttagagaagcgatgcaataattgccaaaccatcacccgacatttctagtgggtggagggagagccctctcctgccccactcatgcctaactacctgtagcactgttactaatacatcatcttcataacaaaggagaataaagagtgaaacctgttcacaacattttctgtgcttgccctggactttgaactgctcatccaaggttctctgaatgtttggaagtagtttagcctagtggtgaaattcctaaattgtcgcctttctctacttcatttctatcagtgggtcattccttcactactagaacatttgacctgcacagcacaggtaaacataagacttagaatccctaggcaaggccatacctggtggggaggattccggtcctgacagcataggcatgagagttgtctgaagcagacaccatatagggcatgttgaagggctcgcactgactgcactcacagggggcctctggatccaggccatctctaagcctggaaagaaacagagccggtgaagatgctttatttcactctgcacaccagaccaccatgatcaggttttgagaggaggatttttaatggcatgctgtatggaaaaccactggttatagagtgttatccaaatatcagtactatcctcattccgtaaatgtaggggtcccattaatttactctcaaagggatatatttccaggtgtggtgaggaggccagccaaggctacatttcctaattcctgatacctctcctcccagtctcgctctagtttccaccatttgttaaaagtttactggctgacaggatttttctaatttctaattttcagaaaagcaaaatttccttacaacatgtgatctctagagagcaaatgctccaactgtgctccttacagcttatctttggaattaccaacataagaacatgattttccctagagattttaatgctgactccagagactccatctagctcatctttgaaatcacagtgtgaagcatagggccacagtcaatgttcattcggccaagactacatgcttggcactgagctagtctgtgatttcaaaattaacacacaaatgaccaaacatataactcaaaattaatataacccactctttgggcctccaggtatgactacagatccgatgcaaatcatttgtgagtatttctgatgcattaaaaatcattttttaaagatgctcaataatacaacattaggggaaagctggggaaatttgaataaggtctgcaatttagttacaagcattgtacgaatgttaatttcctggtttcatgtcctggttaatttcctgtcaatgttaatttcctgattatgtaagatgttaacaggggtagcagggtgaagggtataaaggaactccatttaatttttgcaacttttctttaagtctaaaattatttcaaaataaaaggtccaaaaattcttttaaaaaggatgctcagctttcaggtggcccagtggcctagggcggcgggctacatcagtcagacacagagatgtggaaccctgcccttgtagctcctctccacgcaggatctgcaggcttcctcttctgcactgtgttcattgaatgtttgcctcccagactgacggggagctcaaagggacccaaattctcaaagagaagttttctggagctacagctatccaagtcactgacatttcaggaggctgtaggtgatgtataaaatccaaatcaaaccagaagaatttaaagaaacaagaactgtccctcagcaccagatgattaatcaggcactaaaaaaggaaaatcaaagggatgcacagatggtgggtatttacctctgtccccagacactgacctccatgcccccggggctgtgtagatgcagctgcctaaaacttcggatgaacttgactggaaccactctttcctacgcatttgcaaaaaaaaaaaaaaaaaaaaagtatctgttttgttcgtagacatttccatactacaattaaagaagaatgtgttatctatttagaggttaattaaaggcaacagacaactggtggaggagagaggtgggaaaagatgttcaactcaaaaaacagatggagatctgagcataggtgtctgaaatgactaaggaaatgtaaaactgggacaaatctcattggtgctagaaattaaggaaaggtaccatccatgagccaaaaaattattctagagataatgatattggtagccaaaatgaagaaaggggacaaaagccaatgtccaactgacgtctcatagaaaattagtgtgtctggtgggaaggacttagaggagaacctgaatcccctcaacatccactctctcggaggaactttagagcagtggatctaagggcctaagaaggtaggagggctgggggcccagggcataagcttcaaaccagagcagcagcagtggaagcaggaggcacatcttcccagtgcagcaaggctcagccccgagacagcaacagcaatgtccagaagaggctgggcaggacacagggcatttccttccctgaaaaagctggcaggagcgtgaggaaaaagcccggcggcagcaagtctgactcccagcacagtcatttcctcaaacgaagacggttgtgccatatgtcccaccaggcctgaccaaggcttaacagcctacacatttctctcaggctgtgccatcgctgagcaaggaaccagcctccagctccagttaggagggagatcctaaaagcatctagaagtgagaatacccaagaaatatccttacaacaccatcttggatagaatctcatagatcaagtttgaataaaaacaaacaatagccgggcacggtggctcacacctgtaatcccagcactctgggaggctgaggcgggtggatcacctgaggtcgggagttcaagaccagcttgaccaacatggagaaaccccgtctctactaaaaatacaaaaactggccgggcgcggtggctcaagcctgtaatcccagcactttgggaggcagaggcgggtggatcacaaggtcaggagatcgagaccatcctggctaacatggtgaaaccccgtctctactaaaaatacaaaaaattagccgggcgtggtggcgggcgcctgtagtcccagctactcgggaggctgaggcaggagaatggcgtgaacctgggaggcggagcttgcagtgagccgagattgcgccactgcactccagcctgggcgacagagcgagactacgtctcaaaaaaaaaaaaaaaaaaaaaatacaaaaacttggccaggcctggtggtgcacataatcccagctataatcccagctactccagaggctgaggtaggagaattgcttgaacccgggaggcggaggttgcggtgagcagagatcgtgccattgcactccagcccaggcaacaaggacaaaactccgtctcaaaaaagaaacaatagtaactatatagtgggatctgttttttttttaatgtaaaacatagaaatccagaagcaatacattagcataacattacataatataaatttgtgtttcctccttttcttttcatcttttttttttttttttaagacaggggctcactacattgtctaggctggtcttgaactcctgaactctagcaatcctccctcctcagcctctcaaagtgccgggattacaggtatgagctaccacgccctgcccaacctgtttccttcttatctttttctctctcaagcagtaacaggctctgtgcttccttccttgtggaggtttacggcagggcagaaagcagaagctgctgcaatgcttcccttcctgattgttggctccaaaacctaaagcggttggagatttgccaaatgtcctgagggagaaaagagtctctgagggaataagaaggaacatgagtatattccctaaaaccaagaaaagattcccagaagcctacaagtagataagaccacagccctctcactggcgaagcctggagatgtaagccctccaagaggaatcgctgagaggttcccagttatgccaaaatgctgcacacgccatgcctggcacagaaacagcagacctaggaccggaaggtgcggtgcaagacggctcagtaataatcagaacagactgagaaccaatgcctggggcttccaccccaatgtcctaaagatgtgtgagacctcctttttaccaacctggaatgagaaagtccattaaaaaaattaagtgaattcccaccaatctaacaagatggggtccagagtcaaaattcaggcaaggaacagagagttttaagtgtgatattgcatgcatacctgagtattcactgtacatatgtttcgcatattcactaagttttttttaaaaagtgaattcaataaaatattagtgcctaaacaacttgcctactttcctctctgtcgcttttttcaaatttgtgaaagatgaagcctcttgagttcaaatgtacatccctggtcccatcagccaaagccagtgcaggagagagatgcctctggtgtgctgggcttgcccctccagggtcctcttaagggctgtgagcagggcaggcccatatggacatgtctgggacaaggtgttaaggcagccgcctgagtcggaaaagagtctggctaagagccagacagcctaaaatgagagcaggaagaatgttgtgataccagatatgtgatgacaaaagcttacagaaaactggaagaaatgcagagtagaatcaaaacggcaaaaaattaaatcaataatgtttggacaaatttgagatgctttcccagaaagctaaagaaatagaacagagataaaattatgagaaagaaaatagataccgaaaacagactgacgatctaacatatgaagaacgtatgtgcctaaagaccaaaacaaatagaaaagacagaacaatcatataaagaaagagaaaaaaacctgcctgaactaaaaaagaaagaattacatccttagatgaaaaagactcattaggagccaggtggaattaaatggcaaaagaccagcttccagacataccaagatgcaaataatgaactctaaggtaagaaattaatcctggaagcatcaaagcagcaaaaacaaaattacctacaaagaagaaaagtcaggctaacctttgcccacaacacaaaagctagaattttaagagggaaagatataatccaacagttccccaccagttaagctgtgtttcccatgaaaagcaacttgtgcatgctcagacgtgcaaggccttggggttcaccaccacgcaaccttccagggaaactcctgacaggcctcgctccagccacagatggaaaccagagcatggatgttatggaataaaaagaccgcagtgagcactacaatcctgtaaatgtaaccgtaagttcaaattattacagatattgctattttaaaagtcactcttttttttctgagacagggtatcgctctgtcacccagggctgtagtgcagtggcacgatcatggctcactgcagccttgacctcctgggctcaagccatcctcccacctcagtctcccaaatagctgggactagagttgtgtgccaccacacctggctaattttgtattttttgtagatacggggtttcaccatgttgcccaggctggtctcaaattcctgagctcaagggattcacccacctcagcctcccaaagtgctgggattgcaggcatgagccactgcacccagccaaaagtcacaagagaagatacagagcataaaagaaatagacatacacacagattaaattctgaataatctagtaagtcttctcctagggctggcgactgtcatgaacaccagccctctcactgggactactttcaggaagtaggcgctagggctaggtgaacatgttttagagtaattccattaagatataataatagtgaatttgtggaaaatttacatttattaagagggtagggacagaggatctatactttagaagatgcctactgtctgaaaagatagagccaacagaggcactccacatgttctactgtgtggaatggccctttccttagacagcttgggctggtgtaacaaaatgccataaactgggtggcgcaaacaacacatgtatttctcatagttctgggggctgggaagtctaagatcaaggtaccagcagattccattgttggtgagagctctcttcccggctcgtagacagccgccttctcagtgtgtgctcacctggcctttccttggtatggaaagaaacagaactctgtcttcctctttttatttatttatttatttatttatttttgaaatggagtcttgctctgtcacccacgctggagtgcagtggcaccatctcggctcactgcaacctctgcctcccgggttcaagcacttctccctgcctcagactcctgagtagctgggattacaggcgcccaccaccacacccagctaatttttgtattttaatagagacagggttttaccatgttggccaggctgctctcgaactcctgacctcaggtgatctgccctcctcggcctcccaaagtgctgggattacaggtgtgagccaccacaccagcctgccttcctctttttataaggacattaattgcatcatgaagatccccccctcatgacctaatctaaacctaatcacctcccaaaggccccgcctccaaataccatcacactgggggttagggcttcaacacagaaatgttgcggggacacattcagcccatagcagccctcctccttcccatcagagggcagcctgcagtgctgcatcagtgggacctgctgcccacaccactgtcctctgcagtcccccacaacgtggaccagcacagctttgatggagcctacacgggacaacttcctggcggctcaggtccagacaccagacagctctagctcctgcgccccctccctcctggcctcacacagccctgagcccggtctgtcaactttgagtcaaatgtcaggtagcgtttcaggcccaggggaagtgaccctgagaagatggaggctgaccgcccagatccctcctgggaggaagggaagcggaatgggctggggaggggtgggagggctggcaggtcattcctaggtgtgctccatttccctgcaggaagagaaaaatcccactcaggcagctgcacacgtggcacactcacctgtgagcagcctcaattgcctccaagcttagagctgggggagctaatggaggaaaaggagaagaaggaagttaggctgaatgggttcccccatgaatgggtttctcaaagtgggaggggaggtgaagaagaggggagggcagagcaaggggctgaggacagtgggtgatgcacatagcctacaagtgtgtgcccatttctgcatacagtatgcgccaaatatgtttacattcaatccattttgtacactgactggatgagtttggtttacattataatttggggttatccgtggccatatagttatctcaccatattacttattgaattgtgtttaggtttcagggggcaaaactgccaatgattatttcattttttaatctattatagaagagatcaggtgtatgtttttatataaatgttaattacaattcgcctttaaggatggtctcagaagttttctgtgaatcatttacatcaccgaacatacaggctattcattattccccttcataaaaactactattaaaatagcataatgccagcctcggcaacatggcaaaatgctgtctctattaaaaaaaaaaaaaaaaaaaaaaaaacacgatttagccaggcatggtgatgtgtgcctgtagtcccagatgctcaggaggctgaggtgggacaatcacgtaagcccaggagctcaaggatgcagtgaattttgattgcaccactgcactccagcctgggggacagagtaaaactctgtcttaaaaataataataataatataatgtgtctaaagagtatttcacaaatgttagagacagtaaactaaaaaaagatctaccgtgtgctacaagataggaactaacaggatttttagtgctagaaaaattcttatcttctccttgggtgtcagatgctggagaacagttagttcaatcaaagcaaatgcatttgtcttagacactttttttgaaccttcaaaatctagctaacaagcactttactgataagctggcttctatttttaaaggggaaaattgtattttgcttttccaattttctttcttcttaaagaatttaggtgattttcttccacaccccagttgacataatttgagaataacacaactccagggtacaggtaatttccatgctctgtaatccattccagagcattaaactagggaacaatttccttcgtttaataaaattcacatatccctgaatagaaaaaaacaaaaaataagaaatcaagcctgttacaaatatagaataagttttataatcaagacaggaataaccaatattacagctattatttaacattgctctgaatattttaacaaataggggtggggagaaggcaataaaaataaataagtaaatctatcagaaaggggtaagaattaccgaatgacaatccacgtacaaacttcagtaaatcaactgccaaactatcagaactcatcaaaacatttgctaaggagctggttatacaataaactacccaaatcactaactttgctatatatgaacaataaatcaaatatgatgaatattatgaaaaatatacatcccaccactttaatagcaacatgatctgtttatatataaagaataaccattaacaagaaatgtggagggtatagattgaaagaaaactacaaaactgtgctgtaagacataaagatttgaaccaaatagtttccagcgaagtgcaagggttgtacaactgaagttccccaggcccacggagaccccattcaaggccaaaggcagtgacgacgtaatgccaaacatagagagctgggctttctgcaggatcccagtgatcagccactggacgaagggaggacactatgctgaaaagctcacctggtccatttgttgtcatgttttcatggtaatgagacttcacacaaaagaatataaacgagtggagctgtgctatcttcatagatttcaggttgcctggggtaagagtatttgcctctgtgttatactgtaactgaaggtaatgcttgcagctataaagatgaaccccattttctcaatagtagaacaaaatgaaaattactttctcacttaactaaaagtctaatcattgcctctttgtgcacattaaaatttaaaaaaaaaagtctgattagccttggatagacacgaaggtcaggaaccaggctgatggagccctgctgtcttcaatacaggtttttcagggtgccctgaactttgacatcccaccaacagatggggaaagaggaagaaggatgtcgttcatggaccagatctgaatgagatgccttcccttctgctcacattcctctgaatgcactcagtctcaaggccaaactatccgcaagtggggagcctgggaagtggatccacgctgcttccacatccctcaaggaaagaatggtcaaccgggtctactcaataggtgaagaaggaactacccaattatctttttcatgtaactggagcttgccctttacacatttgattttacatattttgatgaaacttttcctaagatgcataacaatttccctgtttcaacacagtgggcaattgtaagtcttctcctagggctggcgactgtcgtgaacaccagccttctcactgggactaccttcaggaactcttgaggatttgctgatcctccgcctctatactaaaagatccttggttactgtctttttaaaactcttttgaaatgtttttttctgaatccttcctcagagtcagatggcatctgtcacttcttcctgcgtccacaagcatacttctaacagttcctttccctctaatgtcttgcttctactaagggtttatgctaaggtgtacaaattgcatctaaagttaaaaaaaaaaaaaagcaggggggccagtcatagtggctgtaatcccagcactttgggaggctgaggcaggaggatcacttgagcccaggagttcaagaccagcctgggcaacatggcaaaacgctgtctctaccaaaaatacaaaaattagccaggcatggcagcatgctcctgtggtctcagctactcaggaggctgaggcaggaggattgcttaaacccaggaggtcgaggctgcagtgagccataatctcaccagtgcactccagcttgggagacagaatgagacctcgtctctaaaaaaaaataaaataaatttaaattttaaaacaaaattgcctcagactgaaatccattcctgagtaaagagtatgagcttttattacctggactttctagcgttgattttggttatctaatatcctttttaaaattttttcttccaagtttttgtttcagcagttgcaaataaacaattatattggctgggtacagtggctctcacctgtaatcttagcactttgggaggccaaggaaggcagattgcttgagctcaggagttcaagaccaacctgggcaacatggtgaaacaaaaaaatacaaaacttagctgggcatggtgacatgtgcctgtagtcccagctactctgcactccagcctgggcgacacagtgagaccttgtctcaaaaaaataaaataattacgttggcttatgatataatcctagaaagcagaacaaaattatacctaaaagagaatggcctttccaatacagtactgactaacaaggaaagagggctacaatatattgttatgtaggaaagagccagctgcaaaatgacattatagtggaattccatttgttaaattttttttaaaaagcatacatttgcaatgtgagtagttatctctgagatgtaggattactgagaacttttacatactatgccatttatttatgtattgtttggctgttttataagaagcaggtattttacgtaagcataaaaaaacaagaagaagctgggtgtggtggtgtgtgtgtctctagtcccaggtacctggaaggctgaggtagaaggatcacgtgagcccagaagttcaaggtcagcctggaaaatacgtgggaccctgtctccataaatcaataaattaaaatattttaaaacacagttcacagtgtcttctcagagcatgagctcctggaagacatggatgacagatgagcactcctctatatactgcctgctgccacaaataagaagcctctcaaaattaaaacactgatttttatagaccaaaaaataaaagaaaagaaaaaactagaggataaactcaaagttgatctcagacagagcaagttccaggaaagtgttgctggcttccaccttggaggacttctacctggaaatctgctcggtaccatattaagcagtttcaagagcccatcaaagccctggcaagttcatagtaaccagaggcacattctaacctataccagaactatggtgaaaatgtactttgctgggaaaggattctgagttactaaggcttctcaggaactactccattctctaatgaaaacactgatcatctaatgtgggcaattaacatgtatttagtaggtttttgcctcctgttgcatactgaggagatcccacaagacaccttctgcccagcattttcttgctaccatgaatgaatctataaaatattcacatgaatacaaacatgaactccagaataccccagtttaaatgaaaatgcattcactggtaaaagtaatgtattcattaaatagtgccacaaaactgctgcttaacagattcttctgaaactgaaggtcatgcaacaagaagcatttattctcgtgttcataagtctgcaggtctgctgggacagctcagcctcaggctgtgggtgtgcgagtcagttggggcagccctgctccatatgccacactttctattgggaacagcagaaaaccaagaaatgttcatggcaatgcagaagcacaagagggcaagccaaaacccacaagcatattttaagcctttgccaacatcatgttcgctgacatcccattggccaaagcaaatcacatggccaatcccaacatcaataggacagggaaatatagtccctccctagtgagaggaaacaaaaagtcccatagcaaaaggcagggacataggagggttgaagaattgtgaacaaaaatacaatctgtcaaaggtaacattaactcactgttaaccagttatacggtgacatttctgttttaatatttaactggtcttaaaagtaagacactaaaggaagaggacagaaggaaggggaaaagtgagatctagaaatgtgtagcattttggacattgcctaggacagaggaagggctagggaaggagccacagtggcagtccctggaaaagaacatcataaagcacagcatcttcacaattgaaatttgctgacgaaaatcagaaatgaagagcaagaagataagacagcaggaacacatagatacatgaaagatacaagaagtccaagagaatgacaagttttaagaaaaatcacatacagaaatgaagctgttccagcataatgtgtttctccatttgaaactggcattttttgtataatcatccctagtctattacctgtggtttactatttataatctgaaagagctgtgagccactagaacaatttctctgcaagaatccgctctacaagaaaaaagaaaagtgtgtgtgtatgggtgtgtgtgtgtgtacacacacagaattttttttcaaatcaggcagatcagaacctccctggaatttgaactccaaatgtagggaaacaaaattgaaaatagtaagagctcactcatccttatgtttgccctaaagaggctgtattagtccattttcacactgctgtaaagaactgcccaagattggataatttaaaaaggaaagaggtttaattgatcatagttcagcatggttgtggaggcctcaggaaacttacaatcatggtatggtggaaggcaaagggaaagcaaggcaccttcttcacaagccagcaggaaggagaagtgccaagtgaagggggatgagtcccttataaaaccatcagatctcatgagaactcactatcatgagaacagcatgggggaaactgcccctatgattcaattacctccacctggtctctcccttgacacgtagggattgtggggattataattcaagatgagatttgggtggggacacaaagcctaaccataccagaagctgtcccatgattactgatccccaggtcctcagagttgctccaaatttctgatccctccaaagcccctctctgaattccctctcttccacatttcctttaactctatgaaccatcccttcatcctaccaatacattttcaacttaaataagccaaaattgaattctgtggctttcaaccacagaactgtatcaggtgcaagtccctttcccattttctattccccaaggagacaagaaagagtactaaagatgccttaaagcaaataacaaggcatgccatcactcaagaatttagtatctaaatccacttcatgaaaatgactgttactatggcaacttttccatgtgtattattcagtgactttataatgtattaacattttaaggtaaactaaactgtattggcttatttggccttgaatcctttttaaatatagattgttttatctcataaaagttatcagagcctctagtccacgatggcagagtgagccagcaaatttacttttccctctaaaattgctatgaaaatgacactataaaggaaagccctccatgcttacctcccaccaccaccattctagacacacacacacacacacacacacacacacacacacaaaacccactacagtcccagctcttggcatcaaaatctgttctgataatccaacacggttaatatgggcaatacccctcccattaattgataaattaaaaataatcaaaggaaaatcctaattttttaaaatagaatctgacaagttgcatagaacattcatctggaagagtaactatttgagctaataaaatgttttctgtttgttttgtttgttttgagatagagtcttgctgtgttgccaggctggagttcagtggtgcaatctcggctcactgcaacctccgactcccgggttcaagcgattctcctgcctctgcctcccaagtagctgggactataggccatgcccagctaatttttgtatttttagtagaagcggtgtttcactatgttggccaggctggtcttgaactcctgaccttgtgatccacccgcctcagcctcccaaagtgctgggattacagatgtaagccaccgcacccggctgagctaataaaatgtttaagaaaaagaacactgttcagataggccgtgaccatagagaaagtcaaggtaggtcacagtagaatagtccaaagagccctgggaggtggaacataaggagggatgctcctatttctcatcattatgagtcacatgaacttccttattatctgcatccaggacaaattcagccagaatctggggcaacaaattgttcacaagaccatatgggactactgagcaccatgtaactcattcatgtgccacataattctgagattcacccactcactacgtcagagaagagcttcatccttcctgaagaaaccaatcaggcagtcaaagaagatgaataaaggaggaaataaagaaagaggtgaatccatatatcctggtgtcagtgatgtttttacatcttcagagaacctaaagagaatttttaattccagcaatagagaaaaacagaagattttgcataatgcaggtccaaaaagaagtgtaaaaaaaaaaaaagtttgaactacaagtagcaatcctattaattctagaatttccacacaatgcaagacctagaaggcatgatactgggcaccaaagaaatggaaaggtgatgagtaggaaaggtacagaagaagctatagttgagaagatagagaatgaagcatgcacctgcttgcctcatcttcatgggggtactgtattagcttggctaggttaaacggaagtaggaaagacaaaagtagggaggaagaggagaagaaaaggaagggagaataaagaatttctacaaggcaggcgtgttggctcatgcctgtactcccagctactcagaggctgaggcaggaagattgagcctaggagttcaagacaagtctgggcaacatagtgagatcctatacctaaagttaaaaaaaataatttctagaaaattatagtaataaaaattgtgatatgagttgagtaattgctcaatggaaccagaacagggagtccataacagactcatatgtattggaatttaacttaccataaacatggcatttcaaaggaatgagaaatgaagcctagtttaataaataagttgtagcaattaggtaaaaattgaaaaaaataaagatgcatccctacctcacactataccatccaaaaaaaaaatgccagatatgataaagacttcaagtcaaaagacaaaagtataaaattaccagaaaaaaatgtaagaacatatggacaggaaaggcctatttaagcaaaacacaaacatccagaaacaatgaagaaaaaaaggaaagaatgcctaatttagctacatcagggtccccaacccccagactgcgggtctgtggcctatcaggaactgggtctcacagaaagaggtgaggcaatggagcattactgcctgatgtcagataagcagccacattagattctcatgagagtgtgaaccctattgtgaactgtgcatgcgagggatctaggttgtgtgctcctcatgagaacctaatatctgatgatctgaggtggaacagttttattctgaaaccatccataccccaccaaccatcaccaccagtccatggaaaaactgtcttccacaaaactggttcctggtaggaataaaaaggttggggaccacagagttgcataattgttaaactttgtataatgagagaaatcttcaaatgaagttaaaagattgaaacatctaaatctgtaacatatttgcaacataagtaataaataagtcaaaaagaaaaagagaggcaactcgattttttttcttgtgcaaaggaacattggcagagacttttcaacatctccaattttcattttgtcctccttccataataataaaaattttaattggacatgtagttgcccaaaataaagtgcatatttcacagcctcccataaagcttagtcacatgaggccatgtggagtcacatgggctttctgcccacagaaaagtaaggagagagtcatgcggaatttccaagaaccttcttaacagataatctgtgtgagcccttgacacccttcatctgttcattcatcctgctacccagagggcagatgcttctgtcttggaccttgagggctggaagaagaatgcagtaggatacaaggctgcagagggggcaacagtagaccagggagaccaggtatgtcaaattgagcgattcggaccagaccctgtaatcagaagtctcactcaatcctgttacacccaatgtctccattttttttttttttttttttttgagaccgagtttcgctcttgtcacccaggctggagtgcagtggcacaatctcagctcactgcaacctctgcctcccaggttcaagagattctcctgcctcggcctcccaagtagctgggattacagatgcctacaaccacacccagctaatttttgtatttttagcagagacaaggctgggcatggtggatgtggttcatgcctgtaatcccagcactttgggaggccaaggcaggtgaatcacctgagatcaggagtttgagaccagcctggccaacatggtgaaaccctgtctctaccaatgtcccctttctattgaaagattctgtagcttgccctttactatcctgaagtgaaaatcatggatcacgtaacctatctgcactcctaatttttaataatacaatatctttaatataaaggaaaaaaagcaaagtaattaaataaaatactatgctcagacacacccatacctactagaaaagaaatcctactaatctccaaacggctgtccccatccccataaacacttctggaagcaataaagagccaaggaaagcttttcaagcagaaaataacttcatatcttagcccaagttccctagaaaacagagcttaagggtaggattaaggtgctaaaattttattgggaagtaaagcctcagagcagtgaagtgaaggaagaattgaaaacaaatgcaactgcttactgctttatgacaagccataaagaggcaaagcccattttagctttactcaaaagctaaaaagtacactgcttggccacacaagatgtccctggacagggtatgtgggaaaaccgtgccccggacaagtccatggaagggactcctttctcctgctcgtcaaagttgccccagaggatttaaccctgacttctttacccagaagtaggggagaagccaagagtatggttggtcggcctcaagtggaattgcaggggcttgcatagaacaataatccaagggtctgtgaaattgatcaagctgagagaatctacagaggtagggaagatgtgtctgatatacatggttagatttgcgttttcaaaaaaataatccctagaagctgtagagtgtggatttgaagggggtagaaggtggcaacagcagggagacaaaaagaccagataagaagctgggccaggcatggtggctcatgtgggtaatcccagcactttgggaggccacagtgggtggatcacctgaggtcagaagttcgagaccagcctggccaacatggtgaaacccctgtctctactaaaaatacaaaaattagctgggcatggtgacacacatctgtaatcccagctacttgggaggctgaggcaggagaatcacttgaactggggaggcagatgttgcagtgagctgagatcacaccactgcactccagcctaggtgacagagtgactctgtctcaaataataatattaattaattaataattcagcaatcactgcagaaactcaaccctgtcaactgagccaaatttctgaaaagaaaataaattgttacttatttttaaataaaaaagaaccttatttactgttgggagaaaaagctgagtgtccggagagaagctgaggcagggcttgcatgtctgctagacttgcttggctccttgcttctagcactcccattatctcaagccgccatatgtttttcattcacttgatacactgtttcctttcaacccccacatcctcaccacctgtttctttgtttgagcaccactaaatagtgtgggctcccaaagctctgggccttcacaggctccacactcaggatggccccctggtccgactttctctctcaaactgtctttttctcattcctttgactcagcaggacttcgttgcccccacgacctggtgttgggtctgatcaccccaacatttacagataacaagtaaaaaataatcataagtaaacagacaacatgctgcttagaaatggaagaatcatgcttagaaatggaagaattgttcttagaaacactggaaaggatatcatcagggttttctagcgcagtcagtaaagttcggatcagaaaacttctcctactccacatgcccttatcacactcccactcagtgtgtaaatgattgcctgaagtgtggacggtgtgtgcctgtatatcaaagatatgaaataaacatcagtaggatccttatgatgcactcagagagcaggggtagtgtctttagctagaggagtagctgtaactttgtctccgtttgttatgtttgaaggcatgtagtttgctctctgatataccagaatccaattaactcaaatggtttatagaccacacaaatacgaggcagtacctgctgtccaatgcctaccacgctgcaggtactcaacaaatgttaacaaaatccatttgtttatttatgcaaccaacatttattgaatgccaaatatgtgccaaacactgttctagacattggagatagagcaaacacatttttaaaatttctcttttttgtattataaaagtattaaagattgtgcacaaaatgaagcaatacagggatatattaaaaaaaaaaaaaacttaatcagccccgtccataccccacatcttccaaacctacccctctgaggtaaccaattacttttgtttttgttttttgagacaggctctggctgtactgcccaggctaaagtggagtggcatgaacatggctcactgcagccttgatcgcctgggttcaagtgatcctcccacttcaacctcctgagtaagctggggctataggcacatgccatcacactcacctagttttttaatttttgtagagactgggtctatgttgcccaggctggacttgaactcctggcctcaagagttcctcttgcctccgcctctcaaagtgctgggattacaagcataaaccatcatgcctggcccaatgtatttttttctaatatttttaattgacaaaaattatataatttattgtgtacaatatattgttttgaaatatgtatacactgtggggtagctaaattgagcttattaacgtattacttcacatacctattttttttgaggtaagaacacttaaaatctaatcttttagcaattttcaagaacacaatgcattgatattaactgtattcaccataccgtacaatagatctcctgaatttattcctcctaactgaaattttgtatcctttgaccaacatctccccaacgcccaattctcagcctgataaccactattccactctctgcttctatgagttcaacttctttagaattcacgtacaaacgagattatgcagtatttgtctctctgtatctgacttatttcacttaatataatgtcctctggattcatccagggtgtcacaaatggcaggatttccttccttcttgaagctggatagtattcatatatagcatttacattttattaggtattataagtaatccagagatgatttaaagtatatgggagggggctgggcatgatgtctcacacctgtaatcactgcattttgggaggccgagacgggaggatcacttgggactaggagttcaagaccagcctggccaacatggtgaagccccgtctttatataaaaaaataaaagtatatgggaggatgtgtgtaggttatatgcaaatactgttatcattttatatcagggacttgagcatcagcagatttgggtatccgcagggtgttctggaattaatcccctacagatcccaaaagataactgtgcttggtcacttgtttgtctttttttgacaaatgtctattcaaatcctttgaccattttttaattgcattatttgttttcttacaattgagttgtttcagttccttattattttagatattaatcccttatcagatgtatggtttgcaaatattttctcccattctgtaggttgtctcttaactgtgtagattatttccttggctgtgcagaagctttttagtttgatacaatcccatttgtctattattacttttgttgcctgtgcttttgggtttatatttaaaaattcaggcctgggtaccgtggctcatgcctctaatcctaacacttcaggaggccaaggcaggaggatctcttgaggccaggagtttgagaccatcctgggcaacatagcaaggcctcgtctttaaaaaaaattagctgggtatagtggtgcgtgcctgtattccttattacttgggaaactaaggcaggaggatcccttgagcccaggagtatgaggctgcagtacagctatgctcctgccactgcactccagcctgggcaacagagcaagaccctgtctctgaaaataaataaataaataaatttttaaaaatctttaaatagattttatgtttccaagtcattaaagaacatgagatgtctttccatttgttcagataacatttataattttaattgagcttttataactttaaataggtcttatatcttattaattttactgtcaaggtgaaactattttgatttctgaaatttgctttaaagtagtactacagtaggtaaggtggagaggcaggatgaaacaagaagggcagaatattgacgattgttgaagctggttatgggtactattctctgggtttttgtggatggtttggtattttgaaattatactccctgctctgtcgcctgccaccgctccctgagcccgagtggttcaccgtaccatgaagacagatggcagatgccaggaactcgagcctccaatcccagatgctatgtccagcaaaggctcagtggttctggcctacagtggcagcccggacacctcttgcatcctcgtgtggctgaaggaacaaggctatgacatcattgcctacctggccaacactggccagaaggaagacttcgaggaagcctggaagaaggcactgaagcttgggaccaaaaaggtgttcattgaggatgccagcagggagtttgtggaggagttcatctggccggccatccagtccagcgcactgtatgagaaccgctacctcctgggcacctctctggccaggcccggcatcgccggcaaacaagtggaaatcgccaagcaggaggaggccaagtatgtgttccacggcaccacgggaaaaggaaatgatcaggtccggtttgagctcacctgctatttgctggccccccagataaaggtcaccgctccctggaggatgcccgagttctacaaccggttcaagggctgcaatgacctgatgaaataggcaaagcaacatcgggttcccattccagtcactccccagagcccgtgaagcatagacgagaacctcatgcacatcagctatgaggctggaatcctggaaccccaagaaccaagtgcctccaggtctctacatgaagacccaggacccagccaaagccctcaacacccctgacattctcgagatcaagttcaaaaaaggggtccccgtgaaggtgaccaacgtcaaggatggcaccacccaccagacctccttggagcttttcgtgtacctgaatgaagttgcaggcaagcacggcgtgggccgtattgacatcgtggagaaccgcttcattggaatgaagtcctgaggtatctgcgaggccccagcagggaccatccttcaccacactcatttagacatcaaggccttcaccatgtaccgagaagtgcgcaaaatcaaacaaggcctgagcttgaaatttgctgagctggtgtataccggtttctggcatagccctgagtgtgaatttgtccgccactgtaatgccaagtcccaggaatgagtggaagggaaagtgcaggtgtctgtcctcaagggccaggtgtatatcctcggtcgggagtccccactgtctctctacaacgaggagctggtgagcatgaacgtgcagggggattatgagccgattgatgccacgggttcatcaacgtcgattccctcaggctgaaggaatgtcatctccagagcaaggtcactgccaaacagacccctgtacaatgaggagctggggcttccccaatttgcagattttttcccccaagtacaggtgctaattgtgataatttgtcattgtgacttgttttctccagctggcagcatagtgggtctgccaggccccagctttgttccctggtcgccctgaaccctgcaaacgtcgtcatcgaagggaagggtgggggcagctgcggtggggagctataaaatgacaattaaaagatttttttaaattacactcctaagtattttaagcttgtataaaactgtagaaaataaaatagttttctaatttcctttcaaagtacttactgctaatacggagagaagttggtgctttttgtatatttatcttgcatctgcccacttttccaaaatgacctacaattcaaatagtttattactaaagtccctcgagttttctaggcaaacaatgaagtcacatagacaaacataaatagttttatttcgtcttcttcaaagtttatggcaattattttcttaccttactttgacaatgtaacataataatagcacatggacatccttttctaatttctgatttcaatgaaatgatttcagagttttgctatttagaacaatgtttgctattgggtttagagatacagtccttatcctagataagtagtttccttgtattgttacttagacttgtttttaatagaaaagtcatcacaccctattggcttagaatttttattaggaatggctattaaattttataaaatgttcctccagtgtatattgacaggatcatatggtttttcctttatagtattatcataattcattactaacggtaatagatgtcttgatagtgaaccagcctgtacacctgaaatatatagaatagggcataattaaaatactctatagcagtatattattattatataacttgatttttattaatactttatttagaatttttgcatctgtattaataagtgtaaggttacataaataacctaagtgttttttctactctcgactcccgcagagtcactcaacatttgtgacaccggatgtgtgggtttttccccacacaccaagacagttctgcagatgattctccagtggacaccagctagatggctgccaattcaatttaactctgacactatccacctggagattgcatcccacaggtgagggctcagtcccacaagactgcccccaccactgcagatgctggttgcaagcacagattgtggcctgtgcttctgaccaaccagctctaagtcacggtttccacaactccctcctgggattcaattaatttgctaaagcagcttacagaactcagggaaacacttacttacattgacccatttattataaaggatacagatgaacagccagctggaagagatgcataccacaaggcatgtgggaagggaagcagagattccatgcccttctggggtgccaccctccaggaaactccatatgttcagctatccagaagctcttctgaaccctgtcttttcgtttttatgaaggcttcatacctgattacatcactacccattggtgatcaactcaactttcagcccctcttctctccctagaggctggagggtggggctggaagttggagccctctaatcatgccttggcctttccagtgaccagccctcatcctgaagatctctaggggctcccagccaccagtcacctcattggcatataaaagatattcttactactccagagatgccaagggagctttttgctagtatcacaataagtaatctcaagagaacagggacttaacctgttttgttccctgctatattccctgcccctagaacagtaacagacattcttagtaggtgctcaataaacatttgctgaatgcatgtgcaagtgaaattagtctatgatacccttttctttgcatcctctgtacctgattgaactatgaaagctgtgctggctttattaaaggagctttccatgctgttttatgggttgttgttgttgttgttgttgttgttttgtttgtttgtttgttttttcagatggagtctcgctctgtcgcccaggctggagtgcaatggtgtgatcttggctcactgaaacctccgcctcccaggttcaagggattctcttgccttagcctcccaaggagctgggattacaggtgcacagccaccatgccctgctaatttttgtatttttagtagagacagggtttcaccatgttggccaggctggttaggaagtcctgacctcaagtgatccacccacctcagcctcccaaagtgctgggattacaggtgtgaaccaccgcccggcctgttttatggtcttgagtcatttaaatccttgcagtgcaaagagcatggaccagtaacatcagcatcaccgtctgacagcttttaagaaatacagaatttcaggttccacctcagacctattgaatcacagtgtgcagtttaacaagatttccaggtgattcctattgatgtttgatatgtactggtttaaataacactgtattacctgctttttaaaaaatagtcaggtcacattgagctgggaaatcacctggcaccagctcttttttaaggatagagctataatcatttctccaacctcttatggtaatgagtctgttcaagttttcagcttctctttatgtcacttttattcatttatattttgctaggaaatcctcaatatttccaaatagttagagttcaagttaacactctctctctctctttttttttttttttttttgagacagttttgttgcccaggctggagtgcagtggtgtgatcacagctcactgcagccttgacctgctgggctcaagcaatcctcccacctcagcctcccaagtagctgggactacaggtgtatgccatctaaacccagctaatttttaaattttttatagagatgggggttctccctatgttgcccaggatggtctcaaactcctgggctgaagcaatctgcccacctcagcctcaccaagtgttgggattacagatgtgagccactatgcccaaccaacattctctttaaatcatttttaaccttttctatttctgtggttatgcgtggggaaaagaaagagagatcagattgttactgtgtctatgtagaaaaggaagacataagaaactccattttgatctgtacgaagaaaaattgttttgctttgagatgccgttaacctgtaactttagccccaaccctgtgctcacagaaacatgtgctgtattgaatcaaactttaacggatttagggctgtgcgggatgtttcttgttaacaatatgtttgcaggcagtatgcttggtaaaattcatcaccattctccattctcgattaaccagggacacaatgcactgcggaaagccgcagggacctctgcccaagaaagcctgggtattgtccaaggtttcccccaaccgagacagcctgagatatggccttgtgggaaagaccttaccatcccccagcccgacatccctgaagggtctgtgctgaggaggagtagtgaaagagggaggcctctttgcagttgggataagaggaaggcttctgtctcctgcgcatacctgggaatggaatgtctcggtttaaagccgaccattcccattcgttctattctgagataggagaaaaccaccctgtggctggaggcgagatatgctggcagcaatactgctctgttactctttgctacactgagatgtttgtgtaaagtgaaacataaatgtggcctatgtgcacatccaggcacagtacctttccatgaaattattcatgatacagattcctttgcttacatgtttccctgctgaccttcacctgttgccctgctacacttgccttgctaagacagtaaaaataatgatcaataaatactgagggaactcagagaccagtgccggtgcaggtcctcgcatgctgagcgtgccggtcccctgggcccactgttctttctctatgctttgtctctgtgtcctatttcttttcacagtctctcgtcccacctgacgagaaatacccacacgtgtggaggggcaggcccccttcagttatgtctctttcttactcaaaatatcatataattgtgctttcttttttctttaacctggttagtgatgagtttatttactttattgctcttttcaaaaaaaccaacttctgaatttaaataacttttttttttttttttatgagacagagtcttgctctgcccaagctggagtgcagtggcgcaatctcagctcactgcaacctccgcctcctgggttcaagcgattctcctgcctcggcctctcgagtagctgggattacaggcgcgtgccaccacgcccagctaatttttgtatttttagtacagacgaggtttcaccatgttggtcaggctagtctggaattcctgacctcgtgatccgcccgcgttggcctcccaaagtgctagaattaccagcatgagccactgcgcccggcctatatgaccttttggtacatagtttttgctttctattttgttaattttggccttaattttgtaacttcccttttcctaatttctcttggttaaatttctctttattttttacatattttttctaagttcttaagatgagtttatcttcagtctcttgtctgtacaatgaaagctatttaaatcaatctactttattctgaaaatagcttttgctatatcctacagattcttgtataaaatgttagactttacattactaagcgtgcaagttcagcattgatttctgtaataatccaaaagttatctggcagtataattcttcacatccaaatggtcaagatttttagatactttttaaattattaatttataattttaattatgttcaaatactgtggcctgtattagtccattctcacactgctaataaagaactacctgatggtcgggagcagtggttcatgcctgtaatcccagcactttgggaggccgaggtgggcagatcacctgaggtcaggagttcgagaccagcctggtcaacatgggtgaaaccctgtctctactaaaaatacaaaaaataaataaataaataaaattagccagcctggtggcatgcccctgtaatcccagctactcgggaggctgaggcaggagaatcgcttgaatctgggaggcagaggttgcagtgagctgagattgtgccattgcactacagcctgggcaacaagaacgaaaactccatctccaaaaaaaaaaaaaaaaaagaactacatgagaccgggtaatttataaagagaagaggcttcacttgctcccagttctgcaggctgtaaaggaaacatgatgctggcacctgttcagcttcttgggaggcctcaggaaactttcaatcatgtcagaaggtaaaggggacacaggcacgccttacacagctggagcaggagcagggtgggaggtgttacacacttttaaacaaccagatctcatggtaactctatcagcagaacagcactagaggaatggtgctaaaccattcgtgagaaactgcccccatgtccaaccacctcccaccaggccctactgccaacactggggattacaattcaacatgagatttgggtggggacacagatccaagccatatcatggcctgtggtatacctcttctattttttaatgtatcaagaattgcttaggccaggtgtggtggctcaaacctgtaatcccaacactttgggaggctggtggggtggggaaggatcagaatcactttagggtaggagtttgagaccagcttgggtaacatagtgagacctcatctcgacaaaaaatttaaaaattgaaattagctggacatggtgccatgcacctatagtcctagctactcaggaggctgaggcgggagaattgcttgggtccaggagtttgaagttacagtgagctatgatcgtgacactgcactccagcttgggtgacagagggagaccctatctccaggggaagaaaagaaaaagaatttctttgtggccaaatatgggatcaactattttaaaggtactatgatcatatgggaaatgtgtatcttctctattcaaagaatataaagatctttctagatcctctacacgtaagtgtatgtatgcacgtgggtgcacacacacacacaaatgtttactgaattgctcgattcctaaatgtccttattttttcgcctcctggattcattaccggaaaaggagtcttgatccagaccccaagagagggttcttgggtctcacgcaggaaggaattcaaggtgagtcacagagtgcagtgaaagaagcaagttatttagaagctactcccttccagagtacagcaccctcagaaggcaagcagaggaacgcaccatctttgctttaagtttttcttatgtagggggtcttatgtatataaagactaagctaagctgagtctacatgagggtgagcagacagcatgacaaaatgtgtaatactgatttaaataaaactatcctcgacattctagtgtgtgagtacctcaaaccataactacaattatattcaaagcacatactgttatggatatcaggacatctggactttctgttattgtaggagtgtgtccttgcaggcgttaacaagctgctactttagctgtaaacatctaaggaccatgggtcatgactggcaaggaatgtgccttgctagtttcaagatggaggtgattttaaaatggtatcatcctggctcctctaggctcctgcttccctaacagagatgtccaagtttgatatacacatattaaaatctctcactataattattttgtttatttcactagtcaataaaagattaaagaatcatacaatagtcaatcaagacacaagagctaaagtaatccctttgttaagcaccaaatgaatcagaaaaacattaaaggaattctgtcaataaaactctctatagctaaacacattgtggattaaattatatattttttcagaaaaaaaattctttttctgttgatgtctaattaaatccctcacgcacaagaactacacatcagattatttacctcttcccagcctgcaagtcgtaattatttccctttgctcatttttaatgttggcttttgtatgactgaaaatgactgtgcaattagataatgccatttaaaaatatatatatatattaggtttttctccagaaacagagctatatataatgaatacagtgatgatgaactaaaaagcaattcagaaacactttttattataatacaaagtcctcttaagctagcctacaaatatgattgtgagcaagtaacttgactgcattgttcacctttaaagagatttcttctctttttgtaagtcctctttgggttttaaataaaggggtagataacatgcaagactcaattgtgttgtgtctacggagtcgtctcacacagaaagaaatgagtcacagaaggaggaaaaatgccctcatgaccacctttgctattagtgatattggcttacagccttttagatttgggggatagagcacgtggaaaacagcaggaaaggacgcagagggtgactattacagtaacaacagctgttttcaattattcagcatgtttacattccacactggcacagcaaatgattgggaaatgattctttacctggccaaatgtctggacgttgaccttgaagttaactgttgctccagacacttgtgaaatgaactcccctaaacctgtcaccggtcagagcattttttccattttaaaaacataagttttttaatgaatatagaaactaccactgtaatctcttatctttggaaggggggctaaattattttttctcaaaattcttttgaattaaaagcgacttgccttgtcaaagatgtcttacttcgtcctaagcagtatttagcatctaccaaagttgatattttcttaagcctgctcattgttgtgtagttacttaggacagaaaagaaacaaagaatgcagatgaataaatgtattaaaccaatttcacaggcaagtttcccttgaaaaacaactccttgccataatcatcacattcattgagtgaccatctaccaaatgctttactcccatgatttcatgtaatattgacattcaccctacaaagtagatggtattacagtgtctgttttacaagtgagaaatccgaggaacaggaagtcaatttgccaagtgttgcacagctaaatcgatattccagagaatgtcacctcaaagcttctagtggggctgtcatgtaggttgtggtcgctttggataacaggagacgctaaggaaaatcagtactggttactgaggatggaagaggcgcagatatttcaccacaggcgacgaaaaccccacttttaggctggccacacaggagccccgaggaaactatgcgtccccttcctccccgcccccacactgccctggcctgggcggagcagcggccgcagtgtaactgctgttgcccagatcgaaccaagcccggtcccagtgacgagcagcgcctgcggggccagagcgtctgggagcctttcatgaccccaaagcccagggaggtccccgcaccatcggccccgcgccctagctcggtccgccgtcgagggtgcctggaagtcccctgcgggcgccggggagaaagcccggggcttagcctcctccatccccagccatctgtcaccgcctcctaggccccggctggagccccatgggcgcctcccgcgcctaccaaggagccagggagacaaggatcccggagacctctggggcgccctccagctgaggattccgccgcggctcccgcagccgcttctccccattcggtgcagcccacctggcccagctctcggccggtctccctcggaggtccgaaaagggagagggcgggccagggctccccgctggccggagccgcagcccctttccccctcccccacccagggacccttcccggaccctcccgggcgcagccctcacctgctgcccgcaccgcctccgaggaaggccctcgggctccacctggcctcatcaccgcttcccttatccgggaggaggaggaaactcaaccctctaggccaggccctgtgctcactttagatactttatttcgtttaattcttagggttttaacccctgagtttaaggcgaaggatccgaggttccgaaaagccatgcagagcagggaggattcaaacagccaaacctgctggtctccgtgctcttggtagcggaagagattttgatggagtaagtcgttttttagctatactccctctgttaacataattaaaactggaccaccaccttctggaaagaaaggcagctggacagcacaagggcttttatgaaagggactaaaggaagatagcatacccccagccctcgtctcagcttggtaattctcatttgcctttgaacgttaacagaaattccaggctcagtaaccagtttcaggaaaatgctgtgcgtgaatacaagaggaggcgccttggcataggggaagcattctgtcctctgatggacagatcctccactcccgtcttggcctgtgacacaaacaccttgagttgtaaattcctcgagcaaagtgaggcattttggcatttgccaggggtggtgactgacacacagggagcctcagtactgtttatttggtgtctccatacctagcagaccacattttccaggccccatgtagggggtgggagggatctcattttaaagagatcagttgatatttctcttggcaaatctagcacaggacttttgtccccaaagacttctgttctcactgcttgcccacatgcctgggcagcctaatgctctctacgcccatctttccttcaggaatgagttcccatctctttctcaacagtggacaccactccagtgttcctcccaccacctttaactgaaaaaacaaactgcctttacagaacactgtgcacacaggtcagcctggctcctggaaatgcaaactggagtttcaaaaagatgaaaacattcctggagaatttttggtgttttggagagtgcctctgggcagatcacacactgtgacaagttcctcaattgtgaaaattcaatcatgctttccacaaagaactgacttttcacacttaacactggaggttgctcattttcccccaaatcttgaagtggatttgggattaagataccaaagcaaatgcatagttctttgagcactgctcctatctcatggtgtctgcatactggcagacagacacaggcaggaagtagggggcctctgctgatggtttccttggagttagaaaggtttgacacatccagcccagagaaggcagaggctcctgtaaccccaccctgctgccagctgtcagtagaagaaaaacagctggaggaggggggagatctcacactccagtctccctaatttgcatggctttctgctagcaactgtattctttcctcttaaaattattgtaatcacaaattctcattattagggacatgggacattgggagaggaggaaacactttatattaaaaaatttccgcttggttccaagatggccgaataggaacagctccagtctgcagctcccagcgtgatcgacacagaagacgggtgatttccgcatttccaactgaggtacctggttcatctcattgggactggttggacagtgggtgcagcccacagagggtgagccaaagcagggcagggcatcacctcacccaggaagcccaaggggtcaggggatttccctttcctagccaagggcagccatgacagactgtgcctggaaaaatgggacactcccgcctaaatactacacttttccaatggtcttagcaaatggcacaccaggagattatatcccgcgcctggcttggcgggtcccacgcccacggagccttgctcactgctagcgcagcagtctgagatcgacctgtgaggcagcagcctggcagcggcaggggcgtccgccattgctaaggcttgagtaggtaaacaaagcagctggggaagcttgaactgggtggagcccaccacagctcagcaaggcctgctgcctctgttgactccacctctgggggcagggcatagctgaacaaaaggcagcagaaacttctgcagacttaaacgtccctgtctgacagctctggagacctgtgttctcccaacatggcgtttgagctctgaggacagactgcctcctcaagtgggtccctgacccccgtgtagcctaactaggagacatctcccagtaggggctgactgacacttcatacaggcaggtgcccctctgggacgaagcttccagaggaaggataaggcatcaatatttgctgttctgtaatatttgctgttctgcagcctccgctggtgatacccaggcaaacagggtctggagtggacctccagcaaattccaacagacctgcagctgagggacctgactgttagaaggaaaactaacaaacagaaaggaatagcatcaacatcaacaaaatggacatccacaccaaaaccccatctgtaggtcaccgacatcaaagaccaaaggtagataaaaccacaaagatggggagaaaccagagaagaaaagctgaaaattctaaaaaccaaagcgcctatactccccaaagcatcacagctcctcgccagcaacagaacaaagctggacggagaatgactttcacgagttgacaaaagtaggcttcagaaggtcggtaataacaaacttctccaagctaaaagaggatgttcgaacccatagcaaggaagctaaaaaccttgaaaaaaggttagatgaatggctaactagaataaacagcatagagaagaccttaaatgacctgatggagctgaaaaccatggcacgagaactacgtgacgcatgcacaagcttcagtagccaattcgatcaagtggaagaaagggtatcagtgattgaagatcaaatgaatgaaatgaagcgagaagagaagtttagagaaaaaagagtaaaaagaaacaaacaaagcctccaagaaatatgggactatgtgaaaagaccaaatcgacatctgattggtgtacctgaaagtgacagggagagtggaaccaagttggaaaacactcttcaggatattatccaggagaaattccccaacctagcaaggtaggctgacattcaaattcaggaaatacagagaacaccacaaagatactccttgagaagagcaactccaagacataattgtcagattcaccaaggttgaaatgaaggaaaaaatgctaagggcagccagaaaggtcaggttacccacaaagggaagcccatcagactaatagcagatctctcggcagaaactctacaaggctgaagagagtgggggccaatattcgacattcttaaagagaagaattttcagcccagaatgtcatatccagccaaactaagcttcataagtgaaggagaaataatatcctttacaaacaagcaaatgctgagagattttgtcaccaccaggcctgccttgcaagagcccctgaaggaagcactaaacatggaaaggaacgactggtaccagccactgcaaaaacatgccatattgtaaagaccatcaatgctaggaagaaactgcatcaactaacaagcaaaataaccagctaacatcataatgacaggatcaaataaacacataacaacattaaccttaaatgtaaatgggctaaatgccccaattaaaagatacagactggcaaattggatgaagagtcaagatccatcagtgtgctgtattcaggagacccatctcacatgcagagacaaacatagcctcaaaataaaggcatggaggaagatctaccaagcaaatggaaagcaaaaaaaaaaaaaaaaaaaaagcaggggttgcaatcctagtctctgataaaacagactttaaaccaacaaagatcaagagacaaagaaggccattacataatggtaaagggatcaattcaacaagaagagctaactatcctaaatatatatgcacccaatacaggagcacccagattcataaagcaaatccttagagacctacaaagagactaagactcccacacaataataatgggagactttaacaccccactgtcaatattagacagatcaacgagacagaaagttaagaaggatatccaggaattgaactcagctctgcaccaagcagacgtaatagacatctacagaactctccaccccaaatcaacagaatatacatttttctcagcaccacatcacacttattccaaaattgaccacatagttggaagtaaagcacccctcagcaaaggtaaaagaacagaaatcacaacaaactgtctctcagaccacagtgcaatcaaattaaaactcaggattaagaaactcactcaaaactgcacaactacatggaaactgaacaacctgctcctgaatgactactgggaaaataatgaaatgaaggcagaaacaaagatgttctttgaaaccaatgaggacaaagacacaacataccagaatctctgggacacatttaaagcagtgtgtagagggaaatttatagcactaaatgcccacaagggaaagcaggaaagatctaaaatcaacaccctaacatcacaattcaaagaactagagaagcaagagcaaacaaattcaaaagctagcagaaggcaagaaataactaagatcaatgcagaattgaaggagatagagacacaaaaaacccttcaaaaaaatcaatgaatccaggagctggttttttgaaaagatcaacaaaactgatagaccactagcaagactaataaagaagaaaagagagaagaatcaaacagacacaatagaaaatgataaaggggatatcaccactgatcccacagaaatacaaactaccatcagagaatactataaacacctctatgcaaataaactagaaaatctagaagaaatggataaattcctggacacgtacaccctcccaagactaaaccaggaagaagtggaatctctgaatagaccaataacagggtatgaaattgaggcaataatcaatagcctaccaaccaaaaaagtccaggatcagacggattcataaccaaattctaccagaagtacaaagaggagctgataccattccttctgaaactattccaatcagcagaaaaagagggaatcctccctaactcattttatgaggccagcatcatcctgataccaaagcctggcagagacacaacaaaaaaagagaattttagaccaatatccctgatgaacatcgatgcaaaaatcctcaatactggcaaactgaatccagcagcacatcaaaaaccttatccaccatgatcaagttggcttcatccctgggatgcaaggctggttcaacatacgaaaatcaataaacataatccatcacataaacagaaccaacaacaaaaaccacatgattatctcaatagatgcagaaaagtcctttgacaaaattcaacagcccttcatgctaaaaactctcaataaactaggtattgatggaatgtatctcaaaataataagagctatttatgacaaacccacagccaatatcatactgaatgggcaaaaactggaagcattccctttgaaaactggcactagacagggatgccctctctcaccactcctattcaacatagtgttggaagttctggccagggcaatcaggcaagggaaagaaataaagggtattcaattaggaaaagaagaagtcaaattgtccctgtttgcatatgacatgattgtatatttagaaaaccccatcatctcagcccaaaatctccttaagctgataagcaacttcagcaaagtctcaggatacaaaatcaatgtgcaaaaatcacaagcattcctacacaccaataacagacaaacagagaaccaaatcatgagtgaactcccattcacaattgccacaaagagaataaaatacctaggaatccaacttacaagggatgtgaaggacctcttcaaggagaactacaaaccactgctcaatgaaataaaggaggacacaaacaaatggaagaacattccatgctcatggttaggaagaatcaatatcatgaaaatggccatactgcccaatgaaatttatagattcaatgccatccccatcaagctaccaatgactttcttcacggaattgggaaaaacttctttaaagttcatatggaaccaaaaaagagcctgcattgccaagacaatcctaagcaaagagaacaaagctggaggcatcatgctacctgacttcaaactatactacaaggctacagtaaccaaaacagcatggtactggtaccaaaacagagatatagaccaatggaacagaacagaggcttcagaaataacaccacacatctacaaccatctgatctttgacaaacctgacaaaaacaagaaatggggaaaggattccctatttaataagtggtgctgggaaaactggctagccgtatgtagaaagctgaaactggatcccttccttacaccttatacaaaaattaattcaagatggattaaagacttaaatgtaagacctaaaaaccataaaaaccctagaagaaaacctaggcaatatcattcaggacataggcatgggcaaggacttcatgactaaaacaccaaaagcaatggcaacaaaagtcaaaatagacaaatgcgatctaattaaactaaacagcttctgcacagcaaaagaaactaccatcagaatgaacaggcaacctacagaatgggagaaaaattttgccatctactcatctgacaaagggctaatatccagaatctacaaagaacttaaacaaattttgaagaaaaaaacaaccccatcaaaaagtgggcaaaggatatgaatagacacttctcaaaagaaaacatttatgcagccaatagacacatgaaaaaatgctcatcatcactggtcatcagagaaatgcaaatcaaaaccacaatgagataccatctcacaccagttagaatggcgatcattaaaaagtcaggaaacaacagatgctggagaggatatggagaaataggaatgcttttacactgttggtgggagtgtaaactagttcaaccattgtggaagacagtgtggtgattcctcaaggatctagaactagaaataccatttgacccagtgatcctattactgggtatatacccaaaggattataaatcatgctactataaagacacatgcacacatatgtttattgcaggactattcacaatagcaaagacttggaaccaacccaaatgtccatcaatgatagactggattaagaaaatgtggcacagatacaccatggagtactatgcagccataaaaaacgatgagttcatgtcctttgcacggacatggatgaagctggcaaccatcattctcagcaaactatcacaaggacagaaaaccaaacaccacatgttctcactcatgggtgggaattgaacaataagaacacttggacacagggtggggaacatcacacaccagggcctgtcgtggggtagggggctgggggagggatagcattaggagaaatacctaatgtaaatgacattaatgggtgcagcaaaccaacttggcacatgtatacctatggaacaaacctgcacgttgtgcatatgtaccctagaacttaaagtgtaataaatgtatatatatatatatgtgtatgtatgtgtagatacatgtgtgtgtatatatatgtgtatatatatatgcatgtgtgtgtgtatatacatatatgtgtgtgtgtgtatatatatatatatacacacacacgaaaattagccaggcatggtggcagatgcctgtaatcccagctactcgcggggctgaggcaggagaattgcttgaacctgggaagtggaggttgcagttagccaagattgtgccatcacactccagccagggggacaagagtgagacttcgtctcaaaaaaaaaaaaaaaagttttcaatttttaaatttctactgctatcagctttttattctgaatattgtttatttttgccttctttataaatcaacttatgtcattattactgttatatgcaatatatgttttacataagaaaataaatgtcttttctcactaaaaaaaaaaatattccccatctgataatgcttaaaaatgcttcaactggacattcacggaaatgaatctaaataacaatcttacccctttcacaaaaattaactcatagacataatggatcacagacataaatataaaacataaaagtataaaactcctagaagataatataggagaaaatctaggtatctaggtgaccttgagtttagcaatgactttacaacaccaaaatacaatttacaaaagataaaatgtaaaaattggacttcgttaaaattaaaaatccttcaattgaggacaaagctttttgttgtacaaaaagaattgaaatgcaaattcctgtctggaaaagataatagtgatctgtaaaatcatgctgaagtataaaagactaatagcagatcctgtgtttctgtgctcgggggtagaaggctactcatgtataagaaaataggaagaaacaatatttgtgggctaaggtggaaggatcacttgaacccaggagttcaaggctgcagtgagttataatcatgccattgcactccaacctaggtgacagagttagaacccatctcaaaaaaagaaaaaagaaaaaaaaatttgtgaaatatacaaggagcaaagccttatcctacacttaagcatcctgacatgtgacttctctgatggaaacaagaaaacctgatggttcaggtcttgaaactagagtaagtattttcttcttatcaacagccaaggcagtctctgtaaatctcaggtccaacccaacattcaatttatagccataaatattttcattatttttaaaaatttatttcatcataaaaataaaattctttttttttctttttgagacccaaaagagactccagcttgtcacccaagctggagtgcagtggcatgaccacggctcactgcagacttgacctcccagactcaagcaatcctcacctcagcctcctgagcagctgggactacaagtgtttgccaccacacccagctaattttttaacttttttttttagagatggagtctcaccatgttgcccaggctgatctcgaactcctgggctcaagcaatctgcctgcttcagcctcccaaagtgctgggattacaggtgtaagtcaccatacccagccaaaagaaaattcttaatattaaagtatatgaactttgactcaaaagtttttttttaaagcaaaagaaaaggcaaaaataagagttataaagaaaacctacttttctaaaaaacagcgttttataagcagacatctagcaaatattatcaagaaaaaaagaagaaatacaaaatgcaagaaatgagaaattggaataggaacaacagaagtcaaaatgtggccaaaaaggccaggtgcagtggcttatgcctataatcccaacactttggaaggctgatgggaggatcccttgaggccaggagttcaagatcagcctgggcaacatggtgagaccctgtctctaccaaaaaaagaaaaaaaaattaatcaagtatataatctttgtttgtctctcaaaaatatattaaaagggactcatttatacccagagagaccaacccttcttcaaatccccttcttttccccaaatctcccagagccctccaaagctcccacttcccagatgcctcaaagtctgccccaaatattcacctatctttttcagtccttcacccccttctgtcttcactatgtagattggtttagcttcactaacttttttgttttctttccacttctcccattacttgatttctctaacacaaaggatgttctgggaactgatccaacaagccaaaattctaaccattcttctcattttccatcttttcttccccttttcctgatacttttgttaaaatctggggaccaggccaaatacataaatcaatctataaatcttattccccaaacccatcccatcacgaatgtttcagagtcaaagtcaatactgaaagagaagccctagggaaccaagaggattcacccccagaattcaaggtggttcagtatttggaaaccaaatgtaacatttcatatcaacataatttacaagggaaatcatgggatctcaatgggtggtgaaaggcatttgtaagtacaaacagaaagttgctatggacagcaattttgaataactaaaatgtagttggtgtctcgcagacattgaggttaggggcaaacagagaaaaagccactatttttctagatctagtgttaggaatatcagatccatcagatcaaatgaattaccttcacgtgtgtcattctcagactcaagcaaatttggtcttgaaatctggccttgcaggatgcctgtctctggagggccacagaacactcgaatggaactggcattatttgtaaaaaaaaaaaaaaaattagccactttttgttgtatcagctattaatataaataattgaatgttgattacattcctttgtgacctatcactttttaaaaataaaatttgaggcttttttcacactcccaaatatgtattcactgtagctaatttagaagcgtgcacaacaatataacacaatttaaattatccacattcttaccaccaagagaggaccgctaattaacgttttagtatattctctcccagcatgaatttgggaatgcaagcactcttgatgtttaattaggacataagttggttgctgatattataagtcacttctatgtttcaaatccctcaatggaacatcagaggctactagaataaagagttctgatagattctccaggcaagagattaaactttgccccaaagcaccagagagattagatgcccagtggtagcagagtgactttctgtgtgtagtttggaaaaaaggactgccagttggttcaaaataattagaatctaggggatacacacacacacacacacacacacacacacacacacacacacacacacacgcacaccagctgagaagacctgccctagaaaatccatggattattgatttttggggtgcttcccttgaaattacatgcaaaacatatgggaaaggggctatcatcttcaccaaattttggatctatgactccctcaaaatgtcaggacccctggtacataaagtccttttcaattttaatattcttgtactctttggcattggagcttttattctgcctgcttaaaagacagaaggcttggaagagatggaagacagatgaagctaggttcttctatcaaaaggaggtttgcggggaagctggcccatggaaaatgcagacacagccctttaccttctctgtatattgaccgtcctgctttgacagtgcttcctctaatatttgaccaccagcgacttagcaattgtcgatgtaaaaatgatgccatttttgaagaatatgcccaaaagaagtgtctgctaccagtgctactcccaggtattcttgtgatgtgaacaacagtcactaacttggggtcaaattaagaaaatttgccagcatattttcaatgcctaccatgcattgacatgccccaagacccatttcatgattgccagaatcaggcttcaaccttggctctagccaacttattattttttttaatagaaagaatgttttttggggtttgtttgttgagacacagtcttgatctgtcacccaggctggagtgcaatggcacgatctcagctcacagcaatctctgcctcctgggttgaagcgattctcgtgcctcagccagccaagtagctgggattacaggcgcgtgccaccacacctggctaatttttgtatttttggtggagacagggttttgccatgttggctaggggctaggctgttctcgaactcctgacctcaaatgatccgccagcctcagcctcccaaagtgctgggattataggcgtgagccatcgcgcccagcttccagccaactttagagtctatttcacctctcagccaaacagcctcccagtcaatcgtgtatgttttgtattttgacccacacactggttttccctcaaacttctatcttaattaggagatacgttaaacacacatcagtcttattttaaaagccccttaaatattttattttgaagcattgattctgaaacataagatactttataaaagggcttcaaaaacagctttgtcttgtggaagacaattaaaaatttattgttcaaatgctgccatctggtggccaaacatggcaagccccgaaaatagaccattcacagaaaagatacggaaaaccccagtttccctaatcacttgctttgttagcaaagatttggaaaattctgtggaaaaatattaacatgcttatgttccactaattctaacctgtaagatatacttttttcccataaacaatggcagtaagatgtttatcagaatgtttccaaagtcatatgaaggaaaaatgaagaaggcaagaaaaaatgtttaaataaaaaaaattaaagatcaacacctgtgaaaaaaagggatttaaaaaataaaaataactgtttctaagggcaaagatgcagactcactggacaacatgcttgccaatcaaattcagatgtaacagaaaaagttatcttttctacatccattccaagtgtattgacacaggtgtcattcactcaacgaaattttattgcaaggctgttttgttccatattcttttaatttcgttgggtacatgatggagaaccaaaaaaactacctttcctagagaacctcatgagaaacagggaccccacaccgtaagattgtacgtacggttgcaccctatgtggccctcagtctcaagtgagtgtgagctaaaagcttctgcttgcagggcatgccttttctcattcacataaaggggacatagaggctttgagctactgcggggatgtgggggattcagatacctattggggcctccctcccacatcttgggtctctttcctaatgcctggccagctggagggaacacattttagtatttgacctattgaccctcttgctttgtcatgaacatcttccactttgtgggttctcgaaagcagtcctagtctctgagcaatgtatttgtaacctagagaatgcctgtgattcagctgctcaactggctcttcagacatccccagatgcccccttctctgccctgggcccagcttcctacctccagaatgcagctggggaaagagccgcaaaggctggtggtctggtgacccaggacatggaggtgcctctggaccctggcaactccaactagcattctaggaggacctcccacagtttctggagaagattctacaaaaggtctttggccagtaactaattcttcaatgtgaataaatgatagtttttttcctccaataaatgtcaaacagtactagttgggggtgggggcagtgggttgtgtcagctttcaacttgtggctgccagaactacaatgcttcttcttggttggtaaaatatttaaaaaaaaaaaaaaaaaagcctggcgcagtggctcacgcctgtaatcccagcactttgagaggctgaggtgggaagatcacttgagctcaggagtttgagaccagcttggccaacatggtgaaacctcatctctattaaaaatataaaaattagccaggcatggtggtgggcgccagtcctccacagtgacctgagacccctcctgtatatcccagatgcatggtaatgacccttttctcttgagattcttaaactggggtccacagaccctatggaagcacgtcagtggctccataaattccctgataacatatacaaaatgtgtaaatattcattatgctgaagaggtttcacggctttcatcacatttttaaaaattagtctatggtagaatcttcagagccctgcgaaagtctccctccaagttggagttgttggaagcagagggaagcatttaggccaacactgacagatgagtcctaactctctgatatccagccatgtccagtctgtgtgactatcagatgccaggctctagaaaatatccctgaatctaaagacatccttaactaccatctcaagtatgatctagtccctacaaggaccatttgtacctgggtatctcagagacaggcccagagaaggaaaaatacttacgctctgagcctaaggctggcagcgttcattacaggtcccagaccaagccactggactgatctctgggcatgaagagggaacgggagcaactgaggggaagtcatctccagacatggctcctaagagcctggggccaaaggagctctgccaaactcctgaagaaaggaagggctgatccctgtaacgagggactccccttcagctaatgccggaggtctccccagactctgaaataaccctgacacagcagagggaaggcagacctatgacaggcccaggcagctaaccagaaaatgctatttgtgtcctggcagggaacagccaaatccataagcttcagaaatgcaaggtgctttgaagccaaaggttcatttatattgtggttctcaaacatcaataaaatcaagttcatcctgaatggtttaaaatgaagattcttaggccctcaggattgtgattcagtaattatttggtaaagcccaagtgcttacatttttttaaagggaaaccagtaattctgatctaaggagtccatggagtacatatttagaaagtttccaggggcagtaaggcttcagatgcagagagaggcatggataaggtgaattcctctttcccagcctccactgagataaaagcagaggcttccagttaccatttattgagtctttctctatgcaagatactatgctaaaccctttacatagattatttaatccttataactcaactctgttatgctcatttacatatgtgaattccaaagttcagagaaaataagtaacttgcccaagatccctcagctgtgagtagcagagccaggactggaacccaggtctgaatccagagcctgtttttaactaatatgcccatgattttttttttttttttttttttttttttgagatggggtctcactctgtcacccaggctggagtgcagtggcacaatctcggctcactgcaagctccgcctcctgggttcacaccattctcctgcctcagcctcacaagtagctgggactacaggtgcccgccaccatgcccggctaattttttttttgtatttttagtagaggcggtgtttcaccatgttagccaggatggtctcgatctcctgaccttgtgatctgcccgcctcggcctcccaaagtgctgagattacaggcgtgagccaccgtgcccagacaattttcaagagtttctgtgcctggtacctgatgacagcaaataaaaggctatgaagccacatgccctctgcagctgggttggggaagaacgtccaggagccacagtgtatgtagacaaccacctcaggagacgaagcagacaatcaagcaggcccaaaggtccagcatcaagccagatagaagaactatggatggatggactaatgacctaaggattacaatcctggagtgcagaaggagcagagaaaagagatgaaagatgttgggaatgagagatggacaaaaagggctaaaggaactggctgatctcagggaaatcaatgaaatgccacggaaagcttttgatcagcacaggtccaaggcccctgggttctatggcttctgctgttagtcttgcatttatactgttcaattgataagaaaaataatgagttgatgcatcagaatcaataccaactttggatagtgcccaggaaccattgtagaatattagatgctcatccactaaaggggcataacaatagcacgtaacctcatagagttatgtacagtgagaattcaatgagatcacttgagtacagtgtttagcataatgcaggacacacaggagtcagacaaatgtgagctgctatgatcattaattatataattattactatacctatgttcactaagtaaccactgtggcatcttgtttgtttgtgaaagacattgaggtcaaatgtctctatggactgtggctttttctctccagaagaagcttttgttaagggtgtttccttttttctcacaacttgagtgaaaagtcacatccccaaagatatccacaatttcatcaaacccaactttttagttttcccttcacctttagttctaatattatcccaaaaaacaactgaatacaactgttttatccaaatttattctcagggaaaaagaaagtagtggctctacgcaactttttcattcaccaaccacctttccatgcatcagaacctatgctgtgattgttagctgaacttcaatagtttccacctacttaagagagatgcctcaaacaaattaactttattttcagacaacaggtccaagaagacttcacagctcaatcatgacgaacatgtggctgtttcctcacagccaggaaccctcggtattagaagaaaactccaaccccccacaccatcatctagcctcttttctcactgtgaagaactgatgagacagaattcctgagaagggaacatttaggtaatctgggatagaagggcatggaaggactggacaaactaagcctccccatgaaggaagggaaaagaatattacaaaacagactaacagaaaacaagacccatcagtatcttcaggataaacaagaggccactctagatgctctgattaaaggttgtccatgcctacagaggcggaggataaatctaagaaacagaaatgtataaccagcccaatgcttccatactctgcattaggtcagtgtgaacatggctttgctcccaatggtcagacctgacatgggtccttctgaagatggtgggtcaggtatatcccagccaccctcaccagagaatacatctatgacaaacccaaattcctaatcctgaagtactttgagccactctacattgtggccactcaataatagaataaatttgtgaaaaagctgcatgttttaatttaggaaatgagtagaagttcacaagcaacccagaataggtgccagcagtttgctccagtgggccacaccacagcagcagctcaggctctgcagaatcactgtgtccagtgcttcctgagatgttctttcagctgaggaatggaaggcagcagctgctggcactcatgacaacgaaggggcagcttcaagagctcaggcatcccatctcggacagttactctaccagcctcttgtaccatctcgatcacagctgcaggcaaggaagaaaagtcaaatcccagctactctggaaaaccaatatgagataccaaaaaaaaaaaaaaaaaatcaaaaacgtgactccaatcagtatgccaggccaggtattctacagctccgtaagcttagtttagacttccctcaggcaaaatgagcttaatcagattataaatatgagcaacccacctttgaaataatacactccttcaggacacactctaggcaatccatgttactctgtcaagagctcatcagagtgctttacctctggttggcccttggtaaatgccagctgccattgtgaacaccccatcaatgcttaagttcttacacaccaggaaatgctttcctggtgtgtaagaaagcatcacacaccagaaaatgctttcttctacatatacacagggttccccctgctaattcaccactcctgacaggaggcagccccaaagctcccacccaactgatggcagaagagacaaagaattgtccacagctttcttatccatgaactccactaattctcacggcagcctttaagtccccttttgtcacaataaaacactgaccctgacataatagctttctaggtcccccaagaagacaactcacagcaaagtggcaataatactacaatccaaataatccagtttcttttcacagggctcgctttatagggaacacaaagttgtacataggtttttgaggtcagactgttattcagggaaacaaccaaatcaaatataagaacagctcagaaaatgaaacaaatgtgaaaaccaaggaacactgtttaccttgtgattctaggaagtattctgtattgaaagaattccaatgttttttgtttttaaggcaaggagaatcaaaatcctggctgatcacatgaagatgtacatggctagttgaaagaaaaaaaaactgagcattaaactctttaacaactatggcttaatcaaaatgacaaagagtatgagtacattgtatattcatactattgaatactctttgaatattcatactattgaagtgatagtgtgtccatttaattcaattgattcattcatttacttaagaatatttaatgctcaataagtatgtactatggccaaacactgttccaggcactgagactttagcaagaaacaaaatgggaaaagcctctgcccttatagaaattgtacgctaatgaggaaagacaaataataaataagcaaacaaataaacaaacaaaaaaaaacttaaagaattaacattgccaagaaaaaataaacaaggaaaatgggatagagtgcccaggggtagaagctgccctctttagttaacagtgttcagggaaagcatctcccgggaagtgatttgaacggagacagcacccaagcaagctaggtctgtgggaagagtgtctcagaaagtgaggaggccaagagcaggggccctgagatgaggaaaagctcagtgcaaccaagaaagagaaagaaggtaatatggcccaaatgtatggcctgaattgttggagccaagcagcagaaacgaggcaggagccaggtcataaagcctcttaaaggtgacaaagggtttgcattctattctgaatctactgggaagccattgaaggattttcagccgaagagtgctactatctgatttatactctttttttttgttaacaataaaaattgaattataaaatggaccacaatttaaaagtgggcctattttaattttattattcttaaattcattcttttgaaaatgcaaccaggtgcggcggctcacgcctgtaatcccagcactttgggaggccgaggcaggtggatcacttgaggtcaggagttcaagaacagcctgcccaacatggtgaaactaactactaaaaatacaaaaaactaactgggcgtggtggcaggtgcctgtaatcccagctacttgggaggctgaggcaggagaatcacttgaacctaggaggtggaggttgcagtgagctgagatcatgctactgcactccaacctgggtgacaaagttagactccatcactaaaaaaagaagaaaaagaaaaagaaaatgcactttatttttgaaatgataaaagatttaactatgagctgacaaagtagaggtcggctgacattagtgggtcaactcttcatgtagatatttaaatgctgttttttctgtattacatcaaaatgatttgcaataggaaattggaaaaggggagcaaagcagagtgcaaagcatatactgaggtctttccatgggtatctgatagaatgcagattcagcacaataaaatgtagactgcagcagtggcctgtaagtgtactccaagcgtaccgtaagaacctatgtaaaaaccatttttttcttattcctaacagaaaaacaaattttgttttgtttaaacaataaaatgtaatggaaagatctgtactgtaaaactacttgctataaactatcacaaggacagaaaaccaaacactgcatgttctcactcataggtgggaactaaacaatgagatcacttggacacagggcagggaacatcacataccggggcctgtcaggggggtggggggctcggggagggacaacattaagagaaatacctaatgtaaatgatgagttgatgggcgcagcaaaccaacatggcacatgtatacctatgtatcaaacctgcctgttgtgcacatggaccctagaacttgagtataataaaaaaaaataaaaactacttgctgtagcccatgtgttcagtttgttcaacaacctcactcacacatgatgaattacatgaatagaaagtcaccaaataagactcaagacaaaaaaattatctatcaacctccatatgaaaagaccacagctttaatgatttatacaatccttaagcttaatatctggtcagtataggtttccaaatcaaaatcaagtcataagctgttacaataactgcattatactaacattttctttccagtatttcttcctatgagggaaaaaaatcatcagaagctttcactcttgaaaagcgtcctaaactaaaacagtgttcttctccaaaacgaaaatactctacaaacagtaaataaaagctaagctaatttcaacagtcatatttccaaaagtaaaatctattaagtacaatacacctgcacaagaaattacaagaaatgattacagttacagatgcaaaataacatctaattatcccaggcttgtgaacataataattaaaatcaaattcatatgctagtccaaatattatgtacaatttagataagctggtcaagtattatttgaatatacaccatatttgttaaacctaaaattatattaccttttcttgtcctttaatatttgtagatacacgccaatatgaaaaaaaatgtaatttccatttatgtattaacagagaatttctactgcacatgttttaaaccgttaaaaaataaaaaagtcaaggtacattttcacttaagagataaaaataaattaccagaattttaattgataaaagtttcatatcaatttataaaaatgacccaagcacgtggctcatacctgtaatcccagctactcaggaggctgatgcaggtggatcacttgaggtcaggagttcaacattggcctgagcaacatagtgagaccctcatctctaaaaaattgttttaatcagccaggcatggtggcacacccatagccccagctactcgggaggctgaggcaaaaggatacctggagccgaggagttcaaggccgcagtgagctatgatcttgacactgtactccagactgggagagagggtgagactcccatctcttaaaacaaaaacgaaaacaaaaaatgaataaaaaaattcatttataaaaatgggggggaaaaaacctgggtgcagtggctcacacctgtaatcccagtactttggggggccaaggcaggtggatcatttgaggccaggagttcaagaccagcctggccaatatgacaaaaccccatctctactaaaaatacaaaaattagctgggcgtggtggcgcatgcctgtaatcccagctactcggacagctgaggcatgagactagcttgaacccaggaggcaggggtttcagggagctgagattgcaccactgcactccagcctgggcaacagagtgagactctgtctcaaaaaagaaaaagaaaaaaaaaacggaaacagataccatataattatcatatggtctctgatataagaaggtatttaaagaaggggcattaggtcaaaaacaaggactaacccaagtgtgttgctttaaaaatctaatttgtaggaaaactagttgcttggccagttttaaatctaattacaaaatccatccttttttgttttttgaaaagcataacaaatttatttaatccaagttttatgtgacacaggagccttccaaatgaagatgcaaagatacggggaaaactatccatttttacacttgggtttgttgaagaatggaaagccatgtagaaccactactgcttcaaaagggtatacgacttaatgagaatagactgagtggggaaactcagcaaggcctgtctgtccagattcttcttaacctctttgtgcagcattccttcttcccaggtatgggaatggcagtcttatgacctaccatcaaacaaggtagatcagggaatttctttatagccaggtctacatagaaaagaaggttagagtaatattttggggtttttggttggctttgaggaagaaggttctagtttctataacctgccttgagaaagaggaattatagtttctatggcttgcttagggggagaatgaggggcaagagacgggagcaggagaaggtcaaggagaaattttgcttctgaggcctttatttggggttatcattttctaagccccagcaacactatctgtgaaatggaagtgaagatacctactttacagggttgctaagatgatgaaatgaaagaaataaagctcaagtgcaatttctgataaataatagacagcagattttaaatgaggtatcacctgtcccataaacatttatggtatgtatcctcccaccttcaatatccatggtgggggacaggagagcaggacaggaaaaggctacaattctcccttaactacaagccagatgagcactgtttctgctgactccacttccatgacccactttcttacaacagtggttcgcaaaccctaaagctctattgttgatattcactttttgatccatttactatgattgggcttctgtcccatcacactactaaaagcatatttttttggatataacttatgttttgctaactaccaagttggttctcctttttttctatcattaatatatttaatataggtaactttttaaaacttttaggttcagggatccatgtgcaggtttgctatataggtaaattgtatgtcacaggagtttgctatacagattgtttcgccacccaggtaataagcatagtaccccataggcagtttttcaatcctcccccacctccctcccgccactgtcaaataggccctagtgtctgtcattccctgctttgtgtccatgtgtgctccgtatttagctcccatttataagtgagaacatgtggtatttggttttctgctcctgtgttagttcacttaggataacggcctacagctccatccatgttgctgcagaggacatgttctcgttcttttctatggctgtgtagtattccatggtgtatatgtaccacattttcttcatccagtctactactgacgggcatcaatcatggttgatcccatgtctttgctactgtgaatagtgctgcaatgaacatacaaaatctaatttcttaatagtccagatattttggtagttattccaactcaacagaacttccactgacgtccacattcattacagacaacgaatgttatcagtccatcagcactacatttgcacatgtgaacaagccactctgggttccacctgccttggccacctaatgctctctgatgacttctttggtcaagtttttccatatctctctgagcccatcactagccatttcctctgccatcattctagcaaataagacaggaggaatattctcacatggtacattttcccttaaatttggattctttgctctttaagatttgatatcctacttcatactctacttttgcatttcgtacctatattccttaatttcttgatatacagcctcctcaatttgagatcctaattcttcctcaccagctccaatagcagtgtagccatctcctgtttggagagctgcagcaagcacctcgcaacactttaaccaaagagagtcagaagtgcttcgttcctgaataaaagatgaaacacgagtatctagagcatttgtctcaccctctctgctgcttgcactgccaccggagctactttcttctctcgcttcagagttattctgcaatgtaactgcaggttcttttttcttttcttcagggtctttctcggttgatagtaactttttcccagatttcatgacagactgttaaagatgtaacttcttcatctttatgctgcttgccattagcattaactgatattctgattcttctgggggctgtaataattccatggtcatgggaatatttttaagctcctttggcaaatccaatgctccagctgtattcttctgcaccatcttgtccatctacttggcaatgggaaccaccttgtccaatgtggctctggcaggtcttccccacacccagccagctggaggtgagaagtgtgtaaaactgaggtggaaaggatggcaagaaacaagcctcagtggtcctgacaggctgagccaggctcttcctcacaaaccaagcccacaggggcaacctgatttacatgtttaaaagatcactctgactgttgtgtgaagaaaggacggatagggaggaacatggagaaaccagttaaggaggctgctacagcagtctaggccagaaaatcacagcctacactagagctgagctgtagcagctgagatgtcaacaagcaatcctactttgaatgcattttggaatagaacaaacagaacttattaatgggctgcatgttgctttgggagagtgttacttactgagataaagaaggttaggtgaaaaagcaggtttggggaagaaaatcaggaattctcttttggacttgttaaaccaagtagaatgcctttttgtataacagctttcactcttataatcagtaatatttcacgttctcccaataaataatcaaaatcaatcaacatgtgtgcagaatccaaaatgaaatataagcactaataaataagcatagctgtattacaaatgaatgaggaaaccacactaaatggattgaggaagaaaatatattaactatactatagtaacctagctttggagaacagtgttttgactagatacgataaggctaaaaacaaaaagaactataggcaagtactgtactctagttagtaaatgtccttctcacaggggtatgggttaggaatcctgtaactattttatgggtacactaggactgaacaagtaaatgaatttattgtaactaatgagagccaggtttctcactgttggagaaagtagttacaaaaaaggaaaagggaaacaagaatgaaacttagagttggaatggtgtcagagatatcagtatgaactcatggtttttcacatacaaataaaggtagataaacacagaattataggggtgtgtatgtgtgtgtgtgtgtatggcttaggattcatacatgcatttctggctctatggctgagaggacctagaaagcaaggacaccctggaatcaaccacttctctcacagaaacctagtgcccaagaagacctagggctctttggagaagtggttcattccagataagcctggaacatcttgtggggccagaaaataaattgcccaaaagatgttgaaggcgtatctaagtgacacaagagctgacctaaaggagctttcaataaccaaagctgaacaatttgagcaacaaaataattatagtattgaattataacctatagaataaacatccatgagtccataccattaaatgattgaataaagaactaatgagaaagacagaacagcgctttcacacagaataatttcaactaataagttaggtgaaggaagtataaagtcaccatagagtaaataccaatacaataactattacaggcaagatgcaccaatagatgctaaaatcattgggtgcgagtttgaggagaaatagtagtatagtctcaaaatatctaacccaaaatattcatgaattaaaaaaaaaaaaacagtaattttgaaggtgaaaacctggcagacaccaccttaacaaaatgatcaaggttaacatcatcagtaataaaccatctcaacatcatgcccccccatatgacatattgagaaggacacaatcagaaatatcacttcagtgattaaaaaaatgcataacgtcaacctaatcatgaaaaacaaaattagacaaacccaaattaaaagacgtcctaaagacaattagccagtattcatcaaaagtgtcaaggtcatgaaagccaggaaagtaggaactgtcacagattgagggagactaagaagagagaacaaataaatgaaatgtgagattggattctggagtagaaaaagaacaatacaggaaaaatgggtgaaattcaaataaggtctacagtttagtaagttatctaaaataaggtctatagtttagttatctacagttagtattatgaaaggtctttgttctttttcatacttaattttttatattttcttaattgaaaacattacttttacaataggaaaaataattttacttgtttatcaccttttcctttctaatatgttcatttattcaaaactacatcatacagagtaatataaaagggtatataaatagcaactttgcttattggctcattttgcctcccatatatacctaccacagctcttgctgtgagcattctccttagcacgacaacattcactgtaggaaaaaggtatgggcatcacgatcactacgtgaaaagggctcagtggccaagggctctgttagtcaggggctctgcattagggaaacaggattatgggtgactttccctcctaaattttcaaatcagcctttaacaataaaaatatatttatatttttaaagtgaggtacaacatacatccaccctatgacctaacaattccatctccaaatatttattctttttttttcttcttcttttttgagacagagtctcactctgttgcccaggctggagtacaatggcgtgatcatagcttactgtagcctcaacctcctgggctcaagtgatccttccaactcaacctcccaagtagcaggtgtgcaccaccacccttggctaattttttgtattttttgtagagacaggttttgccatgttgcccagactgggatccctaaatatttactcaaggggaaaaaaataaataaagtacatatgtctatgatatacacaataacacacatgaatctcaaaattatgctgacccaaaaaagccagaccaaaaaagagtatgcaatgtatgattccatttatacatggtagctctagaagagacaaaaactatctatgctgaaggaaataaaagcaatgcttgagggaggattaactggaaaggggcacaagggaactttctgggatgaaaggatagacatcttctgtatcttaatcagaatgatagtgaaaagattatacacgcttatgaaaactgatcaaactatgcatcttattatgcactttattgtatgtaagttatgcctcaacttaaaagaatcagtactgactagggaaaaatctggcacaaagatttcatttggttcaagtggccagtaacctaagtcataattattcacctaaataaaatgtgagtgttggtagttaaaaaaaaataagcagagaaaatcctgtcacatgctacaacatggataagacttgaagacattatgtaaagtaaaataagtaagtaaataagtaaaataagccagtcacaaaaggacaaatatgtccttgtatgattcctctaatatgaggtacctagagtagtcaaattcacagggaaggaaagtacaatggtggttgccaggagtgggagggggaaatggagagttattatttaaggtacagagtttcaatttgggaagagaaaacagttctggagatagatggtagtaatggttgcatagtaatatgaatatagtaatgccaatgaattgtacacttaaagatgactaaaatgtaaattttgttatgtatattatatcacagttttttaaaaacaaaataaaaactctaaaatctagacttatcatcttattgcttaaatcaaagaaatcacggagatccaccttgcttgtattctttgaaagaaatcagtcattcctttctgaatccttctgggcataagccacaggaaaacaaattctatacttttctctcattttattttcaaatcctggatctactacgctgtcattacagaagtctatgatgtttgtttccttcagagtaatggtccttaatcattctggggttatagacgcttttgaagaatctgataaaagccactgaccacaattctttatctgaggataatgaagctgcttcatctagttcatatattaggctctcgaagatttatattttgagaggaacaaagaaccaaatatgactgaattataggcagaagtgggaactcaaagcttgcatgcaagtcaggcagagaggtggaagcttcagcccacctgctttggaaaaactccatcccacttccctgggtctcagtgcaatatgtgccctcagcaagcccaggctgaatctatctgcccacctggacagaaccaggagccagcagcactacccacctggcttacctcatactcggaatggcgtggtagcccaatcggaagcggagtttgctggacccagcaaaatctacaatcaccttttcccccacagtgtgcatatgcttaaggagttcaaggtgttccctggccacagccttcagactggaaatggaggtccacggtaagaccagccaatggtaacgggcctttgggtatttatcctttatcaccaccacctgctcatctttgtaaacctagcagagggatacaagagaaggaaacagacatctactaagaatcttctgtgtgcctggttgttatattcactaagtcacttaattcccacagtcttgtgcaaatggttttaatagcccagttttgagagaggagagcactgaaattcagacaggttgagtgtcttgcacaagtcatagttcctaagagggaaatctaggattccaactcagatgtggttgactccagagtctgttttcaaccaccacactacacagaatacacagaagatgcacagtacaaaatagttcccaagaatgtgatgtaaaatctctgtagacataaattcaaaagcatccttctccactccaacatggcagactgtgtgacacgtacacgtgggttccagtgagccctattagacctgccccttgtcaacaaggaatataattgaagtgggactcaaaggctcctcaaggatgatgcctgtttttttttttttttttttttttttgagatggagtttcgctcttgttgcccaggctggagtacaatggtgcaatctcagctcaccgcaacctccacctcccggattcaagtgattctcctgcctcagcctctcgagtagctgagattacaggcatgcaccaccatgcccagctaattttttgtatttttagtagagacagggtttctccatgttggtcaggctgatctcgaactcctgacctcaggtgatcctcccgtctcggcctcccaaagtgctgggattacagggatgtctgactgttaatgccagggcagcacagtactactgtcacagtgtattatctctgatgctcccctgaaaggaaccatactaaggttaatgcaacttcccttaaagtacccagaagtttaaaaggcacaaggcagaggggatattcatttgaagaactcagctttctctccaaacaatgacagctgctactttattgccaatgtgaaaagcctcttgttctcacagaacagcccaataaaatgaatctcattcagaaagactgatatcctttgatttcatttgtaattaagacctctgtggagtggtcatttacaacatgaaatgtactgaaattccaaaattgtattctgacctgcattttggggtcctgcatagaaatcttcaagccttgactccagtggcccagggattcctaaaaaaaaaacaaaaaaaaaaacaaaaaaaaaaaaaaacaagcaatgtaaattacaaatgccaataattaaatttggcaacagttaatactgtgtgatagcacaactaaacttggaaataagcttagtttttgagaattaaacaagattcacttgactctgcttcactccattgccttcctatattctctttttttttgagacaaagtctcactctgtctcacccaagctggagtgcagcggcgtgatcactgcaacctccgaagtgattctcctgcctcagcctcccaagtagctgggattacaggtgcccaccaccacgcccagctaacttttgtattttttagtagagacggagtttcaccaggttggccatgctggtcttgaactcctcacctcaggtgatccactggcctccacctccccaagtgctgggattacaggcgtgagccaccacacccgaccctatattctttctttttttttttgagatggggtttcgctcttgttgcccaggctggagtacaatggcgtgatctcggctcactgcaacctctgcctcccgggttcaagcgatgctcctgcccagcctctggagttgctgggattataggcatgcaccaccacgcccagctaattttgtatttttagtagagattaggttttgccatgttggtcaggctggtctcgaactcctgacctcaggtgatctgcccatctcggcctcccaaagtgctgggattacaggcgtgagccagcacacccagctgttttttattattgttgttgttttttgagatggagtctcgctctgtcgcccaggctggagtgcagtggtgcaatctcagctcactgcaacctccgccttccaggttcaagcaatcctcccgcctcagcctcccgagtagctgggattacaagcatgtgtgtaccaccaggcccagctaatttttgtatttttagtagacatggagtttcacaatgtttgccaggcaggtctcaaactcctgaccctcaagtgatctgcccacctcggcctcccaaagcgctgagattacaggcgtgaaccactgcacccagccagccttcctatattcacagctggctgttctaaatgaaggcgagaaatgccagagtatgagtcataccttctttgccctctctcactgcagctacagcctgaccaattctccactttgacatcagcatatgaattacatgatctatgaaaaccttctatagatgcataaacaactgatccactttagttgttcaatgttaagtacacactgccattattgttgtaccttcaggtggcttacctcaggaatttaagaaaaaagcacataaaggaacattcatccaaatgattttcacgccacaaacaagtgactctttcatcatggttaataacccctcacgcatttctgaactttaaagtgtacaaaacaattaagcagtcattatatttcatttcttctccacatcatctaccaatcacactaccctcacctttttgataggtgcatcttttcccttctttaggggcacagagcattggccagagttgctcccaggttccagccctgtcccagcctcagcttcctgagcagcatccctttctatagaatcactgttgcctgatctctttctcttcctgtgtgtttccaggccagggttctttgcctcttcctcaaactctacaatatatggataaagttcattcaccatgtggagaacctggccaggctgcagcttcacctcttggtccttcccaattacgactgagtcaatgctggtgggattgactcctacctatggaataaacaatcagaaaataattataataatagcaacagcacctacagtaagatagccactgctatgttaaccacttactatatgccaagcaccttgccttatgttcacctatattactccatcacttccatacatgacagagaagccttcactggctggcacagacactctaaagtcaacagcataagaaaatcatcgagtataaaattccaagttataaatacacctacctgctttaccttgacatatcccttgttacactctgctttcaactgtactgaaagagattggaaaaagttaaacacaaatgcaacaaagaaccaggcacttgctcctatcttccctaaagaaaacaagcttcactacaggcggcagctgaacaggtggtgtttccttaaaggcctattagcaatcacctgttattgcaggtggctggagctccaaatcctaccaatttctaaaggtttaaatccttccataaaatgtccaacagcgtacatactcccttagctattgccaagatccctatgaggcagcttcaattaatccccacaagtttccctattccagaacccctggcctgctcatgatcacagactctgccgccagaaaagaagacctgtttctcccagcctgggcagcatggcaataccccgtctctacaaaaaaatacaaaaattagccaggtgtggtggcacatgcctgtagtcccagctacttgggagactgaggtgggagaatcacttgagccccaggaggtggaggttgcagtgagtcaagatcgcaccactacactccagcctgggcaacagagtgagaccctatctcaggaggaaaaaaaaaaaaaaaaaaaaaaaaaaagatccatttctcacacgaactcttgaccaaggattaaatcaggcttccactattattttggaaaaacaacaactattagatgctttaaaagataaaacagtaaaagacacattcctggaaaacagaaactcaggtggctttgggtagaaggagtggaaagaatgttctagaaagatgattgcagagacagaacaatctgagcatgtgtgagaagtggtaacattaagcattcctgttctgataaatgaacaaggtatctggagttgagacagggaggaaagaagaaccaccatagctgctccccagagaggacagggtgccacatacatgccccttcagttgctgttgtgaggaagggaacagagagagaagcagccactgcttctgcatcttgggcctactcagctcaagcatggctttgtatccctccacttagattaactcatataggaaagatcataatcagtgctgcagatgccaactctctaagttcagaacccttgggaaaccttgctgtgggggggtcacactccagccagcagtgtgcatgtttacaggaaaaaacaaggtacatggtaaggatttttttctgagggcaaggactttcatgttattaaaccctaagacaagtgctagatgccactgtctcataatactttgcgtgaagcaatatgtaaaggacggcactaccccattacttctcagaaagacatggtttcacctgtagactccagagtttacatcttgctgcccattgagcaatgtccctggggaaaggagggcaggactcaattccaccatcccatggtaacagtatgaacttgactgctcccaaccttcacccaccctgccttgaacattatcacattgggagggcagaatcaggaataaatagggccctggtgttggctaaaagagctcagttcctgagctgtatttttggcagacaatagattttccatcaagatcacccagaaaatatgcatctttggttatcactatcccacataaccatagtaatctccacatttctatgaccagttaccttgctgtcgagaacatttcttatcagtgatcttggtctctgggccacgcccaatcacaactgcttccaaatgtggaagtctgattcgctggtgccggctgtcctgtctcaccaaccagcacacccgcatcatcactctaagggacaaaacaaaagaatcactagaaaaacagatccactagcacgagtcctccagggccacacccggtgccaccacgcatgtgatctaccagctgttcatcttgaggcaagtgacttcaccaccctagtctcaatttcctcacctataaaccatgataatgatgggactcaggaggctgttgtgaaaattaaatgagataatgtgagtaagtatttacctccctgcctgaatcatgctaggcaatcaaatatttattacacatttatttatttatttattttatttattttgagacagagtctcgctgtgtcccccaggctggcacgcagtggcacaatctcggctcacggcaacctccaccttccgggttcaagcaattctcctgccttagcctcctgagtagctgggattacaggcacccgccaccacacctggctaatttttgtatttttagtggagacagggtttcaccatgttggccaggctggtctcaaacttctgacctcaggtgatccacccgcctctgcctcccaaagtgctgggattacaagcataagccatcacacctggcctgttacacatgtattgatatgtgctggacattaggctacatattgaaagtcaaaggatgaataaaacagggacattgtccctgtccttgaggagcctggagtgcagtaggacagacagaatcatataccaatatatacaatataatgtgataaacactacaagaagagagtaaccaaatatggcattagcccagtaaaaggactgactgactcttgtggagaatattttaaaaggcttcacgaggaagggatattaatgtgcggttttaaaggatgagaaggagtttgcctgccagagaactaaggacataaaaaagatgttctctagtgcttaggtgtctttatgtgtcataggttttccttccctgtcatgacatactgatgttagaacaatatatttcactcccatctgccaggagacagtcataataaatatgcaaatctacaatttctttacttttttttttttctgagacggagcttcactcttgttgcccaggctggagtgcaatggcacaatcttggctcactgcaacctctgcctcctgggttcaagcgattctcctgcctcagcctcccgagtagctgggattatgggcatgtgtcaccacagtcagctaattttatatttttagtagagactaggtttctccatgttggtcagtctggtctcgacctcctggcctcaggtgatccgcctgcctcggcctcccaaagtgctgggattacaggcatgagccaccgtgcccggccgcaaacctacaatttctaaagtgtgaatgtgacaattttgtgcaatacgcaacgcgcaaaacaatggaagtgctgatattcttttgaaaaacaacccttatggccatgtggactatcagtaaaagagaaagagacaagaaattcagaagagagatgagacctcaacaatggccgaagcaaaggggatggagagcaagaagagccaggagaaatctggaagacatacttaattactgatgacatttggggaatgacaaaggaataaaaggacacactggccaggtgcggtgtctcaggcctgtaatcccagcactttgggagcccaaggcaggcggatcacgaggtcaggagtttgtgaccagcctagccaacgtggtaaaaccctatctctactaaaaatacaaaaattagccaggtgtggtggcaggtgcctcccacctactcgggaggctgaggcaggaaaattgcttgaacccaggaggcggaggttgcagtgagcagagatcgcaccattgtattccagcctgggcgatagggcaaggctccatctcaagaaaaaaaaaaaaaggcgagacactcaccaaagacttcaaatttggaagatgcccattaacaaaaatgaaaaatacacaaggagacataatttggggataaaaaggaaagtgaagagagaaggaccaatttcatattgaaatgtaattattttaagttgcctgtggaagatccaagactcaagctgtgatatgtgggtatgaagctcaagagaggggaatggactaaatgcatatatttgagaggcatcaacatgtcacagaggctgaggcaaagagagagaggatgagatcacccaatgaggtgaaacagggaattatgggcagagagagattgcctctctagactccagactcttatcagtgctcaagcctctaacatgcctctcccggaaacctgcctatagtcaaggcagcacatatgccctctgcacaagtttcatgtccataagcaaagaaaaaagaaacccgatttttaaaaatcagtttcattaccatctgcaaagacaagacaatgcaaggcaaagtgagcaaatgacagctgaggagatgcaaattcaaatgaataagattagtgcgagtatatgagtactaaggaggtaaaaagtcctgtattagccagtacaggcttccagaaacctcctggttagagatggctaggagccaaggggactgataaagaagaaatggagtgggaggggccattccattttaaaaagcacaagtgacaacacagatttcggcaatggcaagccataggtcggggtaaaagcagacttagttggctgaaccagaggagctgcctcggagagtcacaaaaaaagacagaggtgttgaaagaatactaggctgaaaagtttacatttaccataatcaagaggagacaactgccaggttttgagcttcacagtaagataaaacaacagcatccaaagaacacttaacagctgtgtgtaggcagtctagcatggagaaatccagagtcagagattagtgaggaggctgttaatataacgtgagccagagaggtcaaaaaggcagttcagcaagtctctgtgaaggagctgatgcaggtgcacgaagagtcagctataaatctaaaatcctaaacctggagcctcaaatgatgatggtgttatgggcaggtcccacttttaaatgctatgcgttccaaggggcatctgtttgcacttgctggaaacagatgaatgagcaggtaacagactgagaagtgaaatatgtcttcactaggcattgggaaatatgtggtgactgactactcatactgacaataagagaagccagaagagaacagattttgagagcagggcaagagaggaatccagtgagcagcagagagcatggctggcagatgcaggataataagaactaccctttctgccctccatcaatacagatactttattcccccaaagttctcaagttatggtgttcctttttactacttcctgagaagctgaagtagtgactgcacaacagttatgtaaccaaccttaaatagtaacttcacccgtttcagcctccaattccaacttttagaaatggagtgttttacaatatggcaagtgcagaaggatgggtgttcctgaatcttcaacccagtccctccagtaaaactccataaactgaaaactatgacaatagaggtcatgtccattttcgcttatcaatatatctgtagcacctaatctaacacttggcatacagcgggcatacaataaatatttacaagtgaattatcaaatgctatttactctctgcatgagagtaataattatcccagttttctttcctgccttctctctcccttccttctatggctcttcttacgatggaatgctctgttcctctctttgggcaatcccatccattctcacatctaggtggataaatcccaattctctatttttcacctctatatctttttttttttttttttttgagacagagttttgctgttgcccaggctggaatgcagtggcgcaatctcagctcactgcaaactccacctcatgggttcaagcaattctcctgcctcagcctcctgagcagctgggattacaggggtgcattaccacacctgactactttttgtatttttaatagagacggggtttcaccatgttggccaggctggtctcgaactcctgatgtcaggcgatccgcccacctcggcctcccaaagtgctgggattacaggcgtgagccaccgcgcccggcccagctctatatctttcattctagagttgaggggatccgtcagaaagaaattctgattattccttaaagaactcaagtgatctgatagaccacacaaggccagaaatcaggtaacctcaaatagtgctgtccaatagaattttctgcaatgacggaaatgttctaaacctgaactgtccaataaattacccaccacgtgacaatcgagcatctaaaatgtagctagtacaacagagaaactacattttttacttaatagttaaataactccacgtggctggggggctaccataatatccaccacagtcctggaaacttgccctgccctgatccatctcaagtccctcaggcctgaagttaagctcatcatactgtaactccacagtgcttatgtatttcacctcccgttcctcttcacagaactagtcccacttgcccatccctctctctcctctcttccccaagaaacacatacatactggcatacctgctttgtgctctgctctattacatttgaaagatattgcattttttacaaattgacagtttgtggcaaatctgtgtcaagcaagtctttcagtgccatttttccaacagcatgtgctcacttcaggtctctgtgtcacattttagtaattctcacaatatttcaaactttttcgttattattatatctgttacaatgatctgtgatcagtgatctttgatctttgatgctactggaagaaaatgccatctaggactttcacaggtagagagaagtcaatgcctgacttcaaagcttcaaggacaggctgtcttgttagggactaatgcagatggagactttaaactgaagccaacgctcatttaccatttcagaaatcctaaggcccttaagaattatactcagtccactctgcctgtgctctataaatggaacaacaaagcctggacgacagcatgactgactgaatattttaagatctctgttaagaactactgctcataaaaaaaagattcctttcaaaatattactgctcattgacaatgcacccaagatccctgatggagatatattatacagggagataaatattgttttcgtgcttgataaaacaacatccattctgcagcccatggatcaaggagtaattctgactttcaagtgttattaattaagaaatacatttcataagggtatagctgctatcaactgtgattcttctgatggacctggaaaaagtaaattgaaaaccttctgaaaaggatacaaccattctagatgcccttaagaacatctgtaatttatgggaggaggtcaaaatattaacataaacaggagtttggaaaaagttgattccaacccttatggatgactttcaggggttcaagacttcaatggaggaagtcactcccaatatagcagaaataaagagaactaaaattataagtagaacctgaagatgtgactgaaatgctgcaatctcatgatcatactttaatggatgaggagttgcttcttatggatgtgcaaagaaaacggtctcttgagatgaaatctattcctgatgaagatgtaatgaacattaccaaaacgccaacaaagggctgggtgttatggctcacacctgtaatcccagcactttgggaggccaaggcgggcggatcacgaggtcaggagatcgagaccatcctggctaacacggtgaaacccagtctctactaaaaatacaaaaaaattagccgggcgtggtggcgggcacctgtagtcccagctactctggagactgaggcaggagaatggtgtgaatccgggaggcggagcttgcagtgaaccgagatcgcgccactgcactccagcctgggcgacagagcgagtctccgtctcaaaaaaaaaaaaaaaaagaaattgccacagacatccaaaccttcagcaactatgaccctgatcagtcagcagccaccaacgtcaaggcaagaccccccctacatcagcaaaaagatcacaactcactgaaggctcaggtgactattagcaatttttagcaaagtacttttaattaaggtgtgtacattgtttgttcagccataatgctattgcacacttaacagactacagtatagtataaacataacttttatatgcactaagaaaccaaaacatgcatatgttcactttattgcagttgtctagaaccaaacccacgtctctgaggtatgcctgtatgtatacccttcaagtataatatactgaacagcatctcccaaataaatcgctcttttttttttttttctgagacagggtctcactctgttgcccagattgggtgcagggcgtcatcacagctcactgcagcctcaacttccttgggctaaagtggtcctccagcctcagcctctggagtagctgggactacagacacacaccaccatgccttgctaatttattttattttgagatggggttctcactatgttgcctacactggtctgaaactcctggcctcaagcaatcctcctgtcttgacctcccaaagtgcacggattacaggtaggagccacacctggcctaagtcattcttaatatggtctcctggtattcctttctcctaaaacccaaatcctatttaactttcaagcctcacctcctccctaaagccttcattgagctgtcttctcttctctacatcttattattggatgtggtcaaactaccttcacagttctctgactgtttaatgtggatgtaattctactttccaaacaagattataatctccctgctaacagactgcatcactgcctacgcattcacaaaacaatgaggaggggtttcgggagatcactgtcctgggccaggcctagtctttactccaggatcccccggttttcagcacctttatcaagtgcatactatgtgctaggcactatgctaaatgtcttacttacatggtctcattttaacactcacaactccattctgagaagagaaaattcaggatgagaagataagtaacatgttcaagtcacatagccaatatgtgccagaactacaatttgaattccaaagaatgggttcttaaccactgcatcatataacttttggcttcactcatttgatcgttcagtcaaaattactacactcctgtgtatcttgtgccattctagtactgggaataaagagataatatatgagcccagccttcaaaaaactcagccttagccaggcatggtggcacgtacctgtagtccctgctacttgggagactgaggtggaaggattgcttgagcctaggggttcaagtccagcttgggcaacacagcaacacctcatctaaaaaaaataaatcttgtggaggagaaaaacacaaacaattatgttaatagtagatgtggtaaacatgatgattgctctgtgcaaagggtggaagcacaatgctagagtacccaaccgagattgggaggaaggaggtgtcaggaaaaaatttcctggaggaggtggacctaaactttataactgagtcccatttataaactgggttaattaggtgaaaaggagcagcctaattaggtgaggagcaggaggtggagaaaggaaacagggagaagattccaagcaaagagaacaagggcaagtacacaaagaagaaatagcacagtacccatgaagatgccattcagtgttgctggaacctaaagcatgaggcagagaagaggctggagatacaggcagggttcagaacaggcagagccctggctgagaagctcaaactttagaactttcaatggattttgcaagccagtagacaatgaatgtttgctgaatgaattagagaaaagaatggatgaatgcatggacagatctttaaagattaagcaggaatttgatacagacttgtttccaaagaccatctgggggtggaggggagtaatgtgaagaaaagatatgggggaacaggcctagaagcagggaaatcagttagaaggccatgatattgcaggtaaaaggacaacagtagagatggagaagactgcacagatttgagagatgtttagggggtaaaactatcaggacttagtgatgaatgtgataagagttaagtccaggaaagacactgagttcagtttcagtcatctgaatttgaagtgtctgtgggacttgcaggcagagctgtccaggaggatagtcagatgtgagggtaaagctcagagaggtctaagctgacaatttcaatttgggggcatgtaggaggtagttaaaaccaagccagctgatgggttcactcaggcaatgtgtacagaatgaaaagaacagttttcattctgaatgctggtaatattatgtatctgtaacctaatctggatggtggtcacataggtataatcattttataaaaactggtcaagcttcacatccacatgtatgtttattgcagcactattaacaatagcaaagagttggaaccaacccaaatgcccatcaatgatagactggataaagaaaatgtggcacatatataccatggaatattatacagccataaaaaagaatgagttcatgtcctttgcagggacatggatgaagctggaaaccatcattctcagcaaactaacacaggaacagaaaaccaaacaccacatgttctcactcataagtgggagttgaacaatgagaacacatgggcagagggaggggaacatcacacactggggcgtgtcagggggtgaggggctaggggagggatagcattaggagaaatacctaatgtagatgacaggttgatgggtgcagcaaaccactatggcacttagtatacacctatgtaacaaacatgcacgttctgcacatgtatcccagaacttaaagtataaaaaaaaaattggtcaagctaaaaaaaaaaaaagaacagtttttcattgtttatatgccaaagtcacaaacaacagaaacacccaacattttagggaaggaggaaaatgactacccatagcagaaatgactggtaagaaaggcacatggagaacagctagaatgtaaattccttaagagaaaacaatttatctgtcttgttcatctctgtatcccaatcaatacttgttgaataaatcatctgagagcactgacacgtaaagcaaagaagaagggagtaaagggatgaccaagttccaaaagcagcaaagagatccagtaataatcaaaaaatttttatctggtttgacaatagtcactggtgaccttggggtgaaatttcaggggaatgatgggtctgagagctagatacagaaggaaacaaaaggtgaggaaatggaggcagagttcagaatactcactaaaacagtttggatataaagagaaagaaagttattggatgacagctaaagttataatggaccaccaaggagtttttctttcttcggcaacgggaagtgtcagagatctgagaaacctggccttgtttatacacgactggaaacagaaatgacaaatgaaaacaaggtctcataagtgacagcataaaatatcagaagcaaacataaagaaactgctctgattagagagacaattcatcctctgagacaaaaggaaaagggtataaatcttgatgactttaaaagggaaagcagaggcagaaatgtgagggaaagcacatctcatgaccctaattttctccataaaataaaaggtaacaaacaggccgggtgcggtggctcacgcctgtaatcccagcactttgggaggccgaggcaggcagattacgaggtcaggagatcaagaccatcctggctaacacggtgaaaccccgtctctactaaaaaatacaaaaaattagccgggcgtggtggtagacgcctgtagtcctgagccaggagaatggcgtgaacccgggaggcggagcttgcagtgagccgagatcgcgccactgcactccagcctgggcgacagagactccgtctcaaaaaaatataaaaataaaaataaaaggtaacaaagagtaggtgtctgggagcttaatggacagtcgaagaaaaacaatatagaacagtggcgaagatcaaggtctctgaagttggactgcctgaattcaaacattggttctaccacctactcgctgtgtgacttgaggcaagttatttaacctctccaagccttcattccctcaagtgtcaagcggtattaacaattgctctacaccatggggttgtcacaagagctaaaggacaaagtatgtaaagctcagtgtctgataaaaagcattcaacactattatcactcttgttaatagcgaaggtagggcaagcaggagctgtggacatataaaaagatcatttgaaagcaataactgcggctgggcacagtggctcacgcctgtaatcccaacactttgggaggccgaggggggcgaatcacctgaggtcaggagtttgagaccagcctggccaacatggtgaaaccccatctctactaaaaatacaaaaaattagccaggcgtcgtggcacacgcctgtaatcccagctccttgggaggctgaggcagagatagcttgaacccgggagacggaggttgcagtgaggcgagatcacgccgttgctctccagcctgggtaacagagtgagactctgtctcaaaaaaaaaaaaaaaaaaaaaagaaaagaaaagaaaaagaaaaaaagaaagtaataactgtgtaactaagaagaacgagcacaaatctgtattgtctcacatatgaacaatccccaaaagttccaaacctagatcacagcaattccaaatagaaattttatccctgctttgttaagccactatcactggtatgtatggggaaaggctttttttttttttctttttttttttttttttgagacggagtttcgctcttggcatgcccaggctggagtgcaatggcgcgatctcagctcaccacaaactccgcctcccgggttcaagaacgtctcctgcctcaccctcccgagtagctgggattacaggcatgcgccaccacacctggctagttttgtatttttagtagagacggggtttctccatgtcggtcaggctggtctggaactcccgacctcaggtgatccgcccgcctcggcctcccaaagtgctgggattacaggcatgagccaccccgcccggccaaggactgcttcttctggcattccctacaaggcctgttgaggatgctgctaaggtccctcaagtgcctttcacgaagcatttctggcggaaacgctgcccttcccgacaagctgggccgcctccttggttggacagggcccattctctaatattttttcggcttgtgttgcgaccaaggtacatacaggtgtcgggagcacacgtgaacaaacgcaaagtgggtcgaagaccaacgcgagcgcccgctgaaacagcccaaggtagtaacaggggaggacggagaaagcagccgtgagagcagcgcatgaaagcagcgtcattcaaggcacatcactcaagggtaggagcagcctcggccgaacgctcacccgcggcattgagcccagccagcagaagagataggctgacgaccgccttacctccagaagtcggagacggacaaattcacgttactcatctgtgcctcaccgcttccggcgctgcgggatgacgtcagaggccggctgtatcgcgaccagtgacgtcaccagcacctctctaacggattggctgaaagaatcttgcccacttcccagatcaaaaagcgtccgccccaattgggttctctctgggccgtggtccaactgaggatcctggaagttatgcctgtggggaccagctctctcagcatctctctgcctgagggccactcgcctgtcactgcctcacagtctctgaattgggtgacatttcagacccaatccctctgtggacgtttctaggtggctgtgcagcttctcgatactccataaggagacgttcacaacctttaaggccatctctcctgctgcagacaacctgctgtagcactgctacttgctttttaaactacagtccgctttctcctttgtgcagggaggaaagaatggagcggtaagaggcagggaaacctgttttttgtagtgctgtgtacactaaatgaactgaggggcaatccgggagaaaaaaagcaagatgcagggataagatgcgtgtactgattttttacagcaattccagaaagttccctaagaatcatattgcagttattcaaaggcattttggcagaaggaacaatccctatctcggaggtaaaagtatagtttataatttttctcaagtacaacacactggcaaaaattctttggttgaattaggtttctgaattttctgctaggcccatctgtgcacttccctgtaaaatccagttttagcacagaccctggctaagtcagtttaccaagaaccaccaccaccaccccgccttatgtggttattctcaatatctgatcaggttccttattctccactatcccccagatgatgtctgattaccttggcctgtctccagcaagaatcctgttaggtatatttagccagaaactcctttaccccgatgtttcctcttagtaattttccatccactgacccctacacagctccttggccataaatgcccacttgcccatgctgctgtttggagttgagcctaatctctcttccactgcaaaaccccgttgcagtgagctctatatacctatcatgaagttcctgaataaagtcttccttaccatgcttcagcaagtatcattgaataatcttttctttaacaaaattgagatttaaggagtcacattcttcatcaaggtggagtattgtttccttccatggaaaagcagagacttaatggtatgatgaagctatcagagccttcaagacagaaggtgggaggatcttccaagaaacacagaggacaggcttgcttttgttagcagagaagatgcaggtttatattagggtcatataaggaagtgggaaaacacaagcagcatctcagcagccacacaggccttacagctgaggaatgttgttcacaactgcccaagataaaaagaggcaactctggtgacctgaccagttttgttgttccctcaattaagcatccctctcggttaagggtgcttctttgacctgcctttgtgtgtcttgcatccaaaagttggattggatcattctaattacatcattcactatataatgtgcaaaattgggcagagtttccacgtcctgcttgttaggcctagtccattgtctatagtgtattagtggccagaaaagcaagatcacatggcacaatgtatagctaaaggtatggcaggcagtgaagactttcaggcacttcatattgccatgctaatcaccagaactttttcatcttgaaaaactgaaactcggccaggcacggtggctcacacctgtaatcccagcactttgggaggccaacgcaggtggattacctgaggtcaggagttcaagaccagcctggcgtggcggaactcgcctgtagtcccagctacttgggaggctgaagcagaagaattgcttgaacccgggaggtagaggttgcagtgagccaagatcactccactgcactccagcctgggcgatagagcaagactctgcctcaaaaaaaaaactccgtatcgattaaatagctccctattttccctcccccacctggcaaccaccattctacttacagttttcatgagtctgaccactctaggtacctcatgtaagtaaaatcagacagtatttgcccatttgcgactggcttatttcacttaatataatgtcctcaagtttcatccacattgtatcatgtgtaaaaagttcctttttaaagctgaataacactccattgcatgtacacaccatactttatccattcatccacccgtggatattccaccatttggctattgtgaataatgctgctatgaacatgagtgtataaatatctctttgagatcctgttttcacaatttgcaattgcaagaacatggaaccaacctaaatgcccatgaactgatgaatgcataaagaaaatgtcgtacatatacaccacagaatactactcagccataaagaagaatgaaataatgtcttttgaagcaacttgaatggaactggaggccatttttctaagtgaagtaactcaggaatggaaaaccaaataccacatgttctcacttataattggcagctaagctttgggtatgtaaaggcatacagagtggtataatgttcattggagattcagaagtggagagagtgggaggaagatgagagattttaaaaaactacatattgggtgtaactattactcgggtgataggtacactaaaatttcagacttcaccattatacacttcatccatgaaaccaaaaaccatttgtacccctaaagccactgaaatttgtttttaatgtgaaacaatttttaaaaattcttctttcaattattttgaatatatacacagaagtgaaactgctggattatatggtaattccatttttaatattttgaggaactgtcacactgttttccatagcagctggatgattttacatttctaccaatagtgtacaagagttccaatttctccacattcttgccaacccttttttttttttttttttttgagatggagtctcgctctgtcacccaggctggagtgcagtggtgcaatctcggctccctgcaacctccacctcgcggcttaaggcgattctcctgcctcagcctcctgagtagctgggactacaggtgcctgccaccacacccgggtaatttttgtattttttttttttttagaagagatggggtttcaccatattggccaggctgatctcaaactcctgaccttgtgatccacccacctcggcctcccaaagtgctgggattacaggtgtgagccactgcgcccggccgcttgttacttttttttgatagcagccatcctaatgggtgtgaaatggtatctcattgtggttttgctttgtatttccctaatgattagtgatgttgatcttttcataagcttcctgtctatttgtatgtatttggagaaatgtctattcaagtacttcattttttaatggggttatttttgttttgttttgttgtaggagttctttatatattctggatattgacctctgatcaaatataagattcccatttcatagggtgcttttcactctgcttgctggctgtatccctggatgcacaaaacttaattgtgaagtactttaatttacctatttttacttttgctgcctgtcttttggtgttatatccaagaaaacattgccaaatctgtcatgaaacttttcccttatgttttctaagagttttatagttttaggtcttatgtttaggtctttgatccatttttgaggtgtggttttatttttttgttttttgtttttgtttttgtttttgtgagacagagtcttgctctgttgcccaggctggagtgcagtgatgcaatcacagcttactgcagccttgaccacccagactcaaacaatcctcccacctcagcctcccaagtagctgggactacaagcatgtcccaccaagcctggctaattttttttttaatagagacagaggtcttgctatgttgcccaggctgatcttgaactcctgggctcaagcaatcctcctgcctcagcctcccaaagtgctgacattacaggtgtgagacactgtgcctggccttgagttcattttctgtactatgtaaggtaaggctccaacttcaattttttgcatgtggatacccagattttaacaatatcatttgttgaaaagactgccctttcctcactgaatggtattgacatacttactgaatatcatttaatcatttatgcaaggatttacttctgggatttctattgtattccatcagtctgtatgtctgtctttacactagtactgcactgttttgattactatagctttgtaatactttttgaaatcaggaagtataagaactttattcttttttttttcaagattgtttttggctactctgctcagggttttgttgtttgtttgtttgtttgtttgttttaattccaacagttagaaatgagatctcacatgaaaacctggattctggctgggctcagtggctcatgtgtgtaatcccagcatttgggaagatgagtcaggaggattgcttgaggccaggagttcaagatcagcccagccaacatagcaagaccctctctctataaaaaaaattttaataaaaagaattttttttaaaaatcaggattcctgatctcttgggggaaaaatcaataaatctagccaagtctaacaacaaatagctagaattgtgaatagctgccatgtgctctccagtttgccactgtttccacccactcacttatataacctgtctggccccctgaaagcccttctttctttaagattttgagactcctgctctaagggaaaagcagttggaggcagagtacctacctgatctaagggaaaagcaggtgaagccagaggctgtggttgcctggtccagagacttgctcagaaggaaaaatatgaaattctgagagagagtatagctgggacacctcattttgttttggcatttggggaaagctgtattagtcagagttctccagagaaacagtagagagggagagggttgtgagggcgtcaagaaagacctatctggccgggtgcggtggctcacacctgtaatcccaacactttgggaggccgaggcaggcgaatcacgaggtcaggagatcgagaccatcctggctaacatggtgaaaccccgtctctactaaaaatacaaaaaattagccgggcaaggtggcgggtgcctgtagtcccagctacttgggaggctgaggcaggagaaaggtgtgaacccaggaggcggagcttgcagtaagcctagattgcgccactacactctagcctgggcgacagagcaagactctgtctcaaaaaaaaaaaaaaaaaaaaaaaagaaagaaagaaagaaagaaaggcctatctgaggaaaggacaattagactgagtccagaaagacagaaaggaaacaaacacatgaagacttgatggaaaaatattctaggtctgtgatccaaactgaggaaagagcatgtacaaaggcccaatagcagggcttttagattattcttttagagttgctagaagtccagtggaggtgaaaatccaatggagttagtgaaaggaagataaggaggcctgagcaaggacaatagtaaaccatttaagaactgtatgtggattcatcattcattgaaaaacccctgaagagttagttaggaagtgacatatttgatgttcattttatgaaggtcattgtggctgctgtgagcaagaatggactagtggggaaggcaaaagcagaaaagtggaaagcagttagcagtttactgatgcagtgcaaaggacgttggcagcctgaacgaagggacagaagttcactgactcaagggatatttgggggcagcatcaactggacaagacaaaacatactcttttctataggcagtcctaggtctgatgccaaatcataaaagttatttagtggtgatagaatgaaaatctagcgaaacataaatttagctgcatgtttcatatatccaaaaacttcttactgcaagaactgcgacattgccttctctgaccatatacaggtctaaagtgaggggatttatgctactaagtgtaatgaaaacgatattaaaaaaaaaaagtaggtaaacatgttttctcacccctagggtgaaacaactttgatgtgtgtactacactgtctccccaacgctccccaccaagactgagcccaggctgcccagaggggtactctgcctatcaacccgtcctctgctggtttccttcccatccctgtctcacttcttcactcccctgctggtaattcttgagatcatctccaaagtaccagcattccaaatccttgtgacactgtctgctctgggggaatccaacctaatgcactcctcctattttctagtatcattttatttactttttagataagttaacctcctactgcttcccaacttcgttatgtcatggcacaaagataaaattctaatatttgcagaacacatgggggtaaatctgaggggaggcctatgaggagcttggtgaaaaaaatttccttattttttctttataattatatataataatataaataaacaacaaagtattggggaaaataacattgattttggctacatatccaagtaaaatatttttagattttttttgatgaggaaattgagcatatttctgtaaatataacctttatgatattaaggtttcatgataaaatagctatacaatttctgactaagattttttttttaaattagagacagggtctcactgtgttacccaggctggtctcaaactgttggcctcaagcagtcctccaaactcggcctcccaaagtgctggaattacaggtgtgaaccaccacacacagcttctgattaagattttttttttttttttttgagatggagtctcactctgtcacccaggctggagtgcagtggcacgatcttggctcactgcaacctccacctccctggttcaagcaattctcctgcctcagcctccccagtagctgggattacaggcatgtgccaccatgcccggctaatttttgtatttttagtagagatggggttttgccatgttggcaaggctggtatcgaactcctgacctcaggtgacccacccgcctctacctcccaaagtgctgggattacagacgtgcgccaccgcgttggcctgattgattttttaatgataatcttttcaaattcttggtaatcatacctgtaattgggacaccagttgagcagttctgttctatacattacagtgtaaacatgatgaggtattcataaaaactacaccctgtaaattcactttaaaatcttccaactataatttaccctctattattttcaactcctgcttttaggactggttaacttctcccactatgtgctgatttcttgaatcttattaactcttaactctttcaaggatctaatttttaagagtttaggagatgattactgtaatcccaagcactgacattcatatcattggtggtttgtggaaaattttatttcaattcagcaatgctgatctgtgtaaatcacagatcttatagtggtctatcctgaaatttcttataaacattaagaagaaaggcacaggaatgccttctaacttacttaacctgccttgccttccaccacctctttagtcccagccttgtaccagcaatattgaacttcctaccctttcccccaccccaatacatcagtatattgagttccttgatgttcgtgctattctttctggaatgttattctttcttttctccctaattcactcttgtcccctccaatccaatcacactgcaactagagaaaatatttcacatgcctgtaatcccagcattttaggaggccgaggcaggaagactgcttgagaccagaagtttgagaccaggctgggcaacaaagtgagaccctctctctataaaaaataaataacttagccgggcacggtggtatgtgcccgtgatcccagctacttgagagactgaggaaagaggactgcttgagcccagaagtccaaggctgcagtaaaccatgattatgccactgcactccagccctccagcccaggtaacagggcgatactctgtctctaaaaaaaataataataaagaaaagaaaagggaaaaaaaattcaaaacacaaacaaacctgatcatgtcattcccctgcttaaatcctttaccaatgctcatcaaattaagaataaactcccttgtttggtcagttttacagaagttcttgtccatctctctaatctcatctaccactctctcctcgcctatttgcccaaacacagggcctttccttcaatttcttgaacccattcagtcaagagtcctgggttgaaacttagaaaacttctctggctactttaaagactgatggggctgccttctgcaccatctccaaaccataagaaccttacggtatctgggccctcaatctcacaatcacagacaggcaatagtagttcccagaacaggagggcctgggctcttggcaccgtcagaccagctcctcttactagtcaactgggagagacatggctataggagcccacacggatacccacatcccacagtctcagggtcttggcctccagtcagatgaaaccaaagcaactctagctctccattggctggcgcattcattcattcattcaactctgagcaacttctacatgtcaggaatcactctaggagctggggctaccacagtgaacaaaacaaagttcctgcgttcgccaggcgtggtggctcacacctgtaatcccagcactttgggaggctgaggcgggtggatcacttgaggtcagaagttcaagaccagcctggtcaacatggtgaaaccccgtccctactaaatatacaaaaattagccaggctggtggcaggcgcctgtaaccccagctactcaggaggctgaggcaggagaatcgcttgaacccgggaggcagaggttgcagtgagccaagatcatgccattgcactccagcctgggcaacaagagtgaaacctcgttccaaaaaaaaaaaaaagttcctgctttcaaggatcttacagtctaaatgggtgaggcagatcataagaaaagaaagatacaggtcatgtgaggataaatgctataaagaaaaaacaagtgggatatagaaagtggtgaggatggccgggcgtggtgactaacgcctgtaatcccaacacgttgggaggccaaggcaggtggattgcctgagctcaggagtttgagaccagcctggccaacatagtgaaaccccatctttactaaaaagtacaaaaattaacagagcgtggtggtgcacgcctgtaatcccagttacttgggaagctgaggcatgaaaattgcttgaacctgagaggcagaggttgtagtgagctgagatcgtgccactgcactacagcctgcgtgacagagtgagactccgtctcaaaaaaaagaaaaaaaaaagtggtgaggatgtcttggtagtgtgggaggcctctcttgagcacagacctgaaagaagaaaaaagtcatgtggatatctgggtgaaatgagaaaccattaaaggattttaatcagtggagcaccatattttttttttttgttttgagatggagtcttgctctgtcacccaggctagagtgcagtggcacgatcttggctcactgcaacctccgcctcccaggttcaaggaattctcctgcctcagcctcccgagtagctgggattacaggcgcctgccaccacgcccggctaattttttatttttagtagagacggggtttcaccatcttggccaggctggtctcgaactcctgaccttgtgatccacccgcctcggcctcccaaagtgctgggattacaggcatgagccaccgcgcccgcccgaagtgccatattttttaaaaggttactctaattattttatggcaccagaatcttaaagagagggaatggtttccaattctgcgtttctttaaatgtatccattcatcaaacacttaagagtgccttctctgtgtcacgcagtggggtccatgttgagtcaacaagccagacacagcccttccccttaaggagctttcagtctactgaggacagctgcaggacacgctcacctttcacagcctcagtgctgagcccactctcctgaacctgcagtctccttactgctagtctttccaatattgcattgctgctctttctcccacttgtctttcttactgcacttcagactggacgtccagtggcattttcctgagcatggtttggtccctcttgacaacaaatttgaatgtctacacatttacaccattcagacaaccccgagacactcctactttgtcattcttttcacaagcaaagctccagctgtctatgtgaaaataatactatttcaacaactgtcttcaccatacgtttaaccacagtaaaacttctgctttcatagaataatattgctcctaaattatgaggcctgtaacaaaaattttaaccaccctccaaagggctttgattcacaagagaccttacttttcacctgtatgacttcttggatattttagagagagaggatatagcatacatgattaaagaaaaaaaaagaacgcaaaattttttagaaaatgtatacttagcctttctctctgtggtagccaattactttagtagacctaattgattctcccctttcagaattcctacccttccatagtccccttccacattgactggacttggctgagtgactggcttttgccaatgggacactaccaagtacaatacaagcagaaccttaataactgcttacacattgtggcctatcctctgggggtgctcctgttcaaaggatccagctgccatgctgtaagaagcccaacttagccacatgaaggagaggtcccagcagagctcccagccagtaacagccagtatatgagtgacccagcttggaagtgggtcctccagccctagggaagccaccctagcagttgctacacagaacagagatgcactatccctgctaagccctgccccaactgcggaattctgattaaataaatgattgctaccttaagtcaccaattttgagggcagcttgctaaacagcattagataaccagaacactcccttttagaaaaagggtgggggcactattcctaccacgttctggaagtcataagattgtctgaaatctgggtcaaggctcaacttcctaatagaagagttgccttatatacttgtgtaaatgttaatgtctgtgccccactcattcgtaagctccatgagaaaagggattgtgtctgtcacagtcaacattgttttactgacctagaaaacaccctgacatatagtaggtactcaatcaatattttagtaaatcaatgtaatgttgatttactagctctactatttcctctgtttgaataggataatttctatgaccattactattagcaaacatttactagtgtttatttatatgtggatactcttctgcacaccttgtacatgttaactcatttactcttcacaataactctatgagctagatactattattatccacttttacagacaaggaaattgaggcacagaaaaaataagtaacttgtttgtggcggggccaggattcagtttccagaatttgtattgttagccactacaatgcctttcccagtttcctgtcctagatctgacagtgccattgctgttgaaaaaaagaaaaaggtaaagttacacagcagatgaacagttatcttcatcacaacttcttcacgatgaagacaacatcatgactaggcaggtaggaagctgctcatggagagccaggcgtggtggctcatgcctgtaatcccagcactttgggaggccaaggcgggcagatcacaaggtcaggagatcgagaccatcctggctaacacggtgaaaccccatctctactaaaaatacaaaaaaattagccgggcatggtggcaggtgcctgtagtcacagctactcaggaggctgagacagaatggtgtgaacccgggaggcggagcttgcagtgagccgagattgcgccactgcactccagcctgggcgacggtgcaagactccgtctaaaaaacaaaacaaaaacaagaccaagctcctgctctaaaatgccttttcaatgtcaatgataacagggagatgaaagaaatgacaggtgggggcaaccaccaggaagaaagacttttacatcaggcctcacccctagggctgtaaatctggcagctaaaagtaactgaactccaacctatgcactcaacccaactgcaatatcccaacaggagtgtaaagagaccctagtcagtagctgctaattcagtgcagagtcccttttaatgctgataccactgtggcttgtgcctaggtcttcccaatgctcagcacagaaactgatggcaaaggcctactctggcaccattaccagccctgcctctgctctgagggacaacctggatgtaggagtctaagccaatagcactcataaggttacctgaggactgacctctcagtctggtaagtacaggactttcttgatgaaccaccactaccaccaccagcaagtgtgtatgaacaaacacccctggcctcactcccatatttggagatgtgggaaatttaacacaaaaatatctaaagggcagtttattagaaatcatggtaggtggtagaaaatggcagtttaacccaacagtagaataaatattccatagctgtaccacttaacagcttaacaaaaggatgcatagctggggagcagcaggacatccttaacaaaaggatgcatagctggggagcagcaggacatccttaacaaaaggatgcatagctggggagcaggacatcaggttttggtaatcaggggagccgccctaaagggggcccttaaactgggtcttgtccgttagacattcactcaacaaacacttcttgacacttgctatatgccaattactatactaggtgctggagataaaacattgctaagccatgatcaccaagacagtcctccaccctagaagtattgctgtagctcagcaaattgccctttgttgtgctgccatcagaggcatccctctacactggtcacccggtcagggatactgtcaaggacactgctcctcacataacacaatgtgctctttataagcatccctgggagacattccaatctgatctccattctaggaatagttttacttctccagagtactggattgatgttttatcttcagataccatgaattgtgggaccaatgaggttgtcagtttagagacaaattcatggcccagctgtatcaaatgtgaaggtcattcttgtatgccttttagctttgtctctggttccattttgttactacccgtgtttttatttttttcattctccacacttttaatgtatggcatcttggggtatattgtctctgtttgttgtatccttggaagtggctgtaaacccttctggatgaaagcattgccttcaatgtttataatacattatacacatctgcacaaatgctatgatggaagtgtgtacactgcgtgatgtgggaacacaaataataacgccttataaattatcaaaggcattagagaagatcttgcataagggtcattgcctgagttgtattttttcttttctttttttgagacggagcctcactctattgcccaggctggagtgcaatggcgcgatctcagctcactgaacctccacctcccgggttcaagtgattctcctgcctcagcctcccgagtagctgggattacagccgcacaccatcatgccctgctaatttttgtatttttagtagagacagggtttcaccatgttggccaggctggccttgaactcctgatctcatgatctgcctgcctcagtctcccaaagtgctgggattacaggtgtgagccaccacgcccggcctgtattttcttttgttctgtgttttgctgagaatgccacaatacaccaatcttaaaacaaggttgctgccacatgcatgcaagaaaacttttttttaatcttacagagtagatcttgatgtcatatcatgggcttataggacacactgaagttgtttataactaatcaaagctatttccatgagagtttcccttcatcaatttttttctgacaacaagattatggggcaaaacaattcatatccgcatctgaatttttgtgcagggaaggaaattcagatgaaatatcaaacttaagttagaatacatttgacaaggtgaggtgaagaattaaaataattatctagaagatgtatatacacaaaatgttatcaactgaatttttttaaataaacgttgccaaatggtatctaggagttcgtattatctagaccaagagtctgagattttgaagggctattaaaagtcattttgttcagtctcatatctgtgcagcagtattcttcccgaattctttccacttttcaggtatattcccaaccttggagtttcccgtgatggtgtgattgcctgtgtgagaacagggtgagagaaagtattgttgctgacacaacatctgaagtgtggtgaaccagcagatactctctcaatacactcaattttagctttttttcttaagcgttttagccatgtaaaaattcatttcaacaaacagcacacagaagatctcaagaaataggtcaggatctcataaatgagcaatccagtttacaaaaaagacagcaataaacatgtttactgcatatcctttcactcttcggtagtataaaacattacaaccatcttcctttaggtttaaaaaaataaaggaaagaaaaagtaaactgaatgtacctcacgacttctttcggctttctaccaggctggagctttaaagacaacactattttgtctctgtattgaggaaaattgtggacttttaacttagagtgactaaatagaatgcattacactcccccccccatttttttagaattaaaaaaagcagaaaaacaaaactatctgaaaagtactcactgctaagaggaaagtctactctgagctcagcaattaggcactctgatgttagaggagggcagcccaggcaggcagaaaaatcaccagactgtgtagtgctgggctggacgttctaagaggccaggaaccatctccgctttttcacaactatatgcccagtacctggcacaaattctggcaaaatgcatattcattcataatttattgagtaccaactctgtaccaggcagtgttctagatgcttgcgatatattataaaacaaaacagacaaaaatctttgcctacaaataaaactgttcctctattcataatactttgaaccaaatgttgggggtggaggggcttcaaaccaaacaattctctaattctctgcagataccaactgggtatcctacaatttaattcagtgtggacactaattatccaacattattgcacatcccacaggttaagggctcagtctcacaagactacctccaatttaagataccaatagcaagtccagggtctcctgtacttctgatagactggctatgaatcggggtgtcttcatctatttgagctgctataacatgccattaactgggtagcttacaaacaccagaaacttatttctcatttgtgtaagctggaaagtccaggatcaaggtaccagctgaatgggtgtctggtgagggcctgtttcctggtttgtagacagagctgtcctcacatggcagaagggactcacaagctctcctgggtttcttttgtaagggcactaatcccatgacgtagtcacttcccaaaggccccatctctgaataccatcaacttggggatttccaatttatgaattctgataggacacaaacattcagaccacagcacagaggttctcacaaccgccttagagtcaataatttgctagaacagctcacagaacttagaaataattcttacatttctcagtttggggaagggatacggaccttcaaggccctctccgggagctcaatccttccaacaccaacctggaagctctccaaactcctttggttagggtttttttattgaggcttcattaggtaagcatgattgattaggccattgcccactggtaatatccagcccctttctcctccctggaggtcatagtgtgaggctgaaagttccaatcctctaatcacttggttagttgccctagcaaccagcgcccccccccccctcccattttcgggctctccaaaagtcacttcattaatataatctcagatgtgattgaaaggggcttgttatgaataacaagataccactttcactcttatcacttaggaaatttcaacggttttaggacctctggccaggagtcagaaatgaaaaccaaaattttattttttatttaatttttttttttttgagacgactcactctgtcacccaggctggagcgcggtggcacgatctcagcttactgcaacctctgcctgctgggttcaagtgattctcctgcctcagcctcccgagtagctgggactacaggcacgtgccactacaccttggataatgtttgtatttttagtagagatgaggtttcaccatctctactacgatggaaggccgaggtgggcggatcacctgaggtcaggattttgagaccagcctggccaacatggtgaaaccccgtctctactaaaaatacaaaaattagccagacgtggtggcaggtacctgtaatcccagctactcgggaggctgaggcaagagaatcgcttgaacccaggaggcggaggttgcagtgagccgagattgtgccattgcactccagcctgggggacaagagcaagacttcgtctcagaaaaaaaaaaaaaaaaaagactgtacttccccaggtactgtggcttatgcagtaatcccagcactttggcaggccgaggcaggtggatcacgaggtcaggagttcaagaccagcctggccaacatagtgaaaccccatctctactaaaaatacaaaaaattagccaggcgtggtggcaggcacctgtaatcccagctactggggaggctgaggcaggagaattgctggaacctgggaggcggaggttgcagtgacccaacatcacgccattgcgctccagcccaggcaacagtgcgagactccatctcaaaaagaaagatatgtactcctcaaaactgtcaaggtccttaaaaataagtaaagtctgagaaactgtcacagtcaagatgagactaaagagatatgataactcaaagtaatgtggtgtccttggtgggatcctggaacagaaaagggaaaaattaaagaaacccaaataaagaacgaactttagttaataataatgtatcaacgttgattcattagttgtgggaactgtaccattttaatgtaaattttaacaataggttaagactgagtgcggaataacaggaactctactatcctgacaacttttccgcaaatctaaaactattcttaaatataaagttcagtttaaaaaaatgaagggtggtgagtgggggtaggaatgaaggagagagttcataaaaaagactgaaattgtacgtagtcagaagagaagaaccacaacaaattggtgctactcaaaaaataaataaataaataaaagtctggccccagttaattaaaaactaaatattctaagaaatttaaattaatttatacaaacataaaaaatagcatttcagttaggatttactttccactttgtgccgataaaaatttttcttttttctttttaatagtagctcagttttattttctgtggtaacaaacatttaagaaccagagaaaacaagggacccctgagcacacaaaggcagtacaggccgaccatgaggccctcccgggaaagtagcaactgtgggaattccctgccctagggaggatggatgcactgcctaggaggagacgcaaggttagacctcgccccattttcccaggccaggcttagcgggaaactgggggcccaaagtgctgcagggtccgcaccaccagagaaagatggtcgagaaagttgataagggaaattcggagcaggcaacagtcttcagctttccagcggacggccaggatcctgccgctcactgtgagatccttcccaaccaccctttggtggggttcggcatctggagccagggacccatgggcaatttccacctctaagggggtcgggaaaggcacgctgagggtgaatatgtgcggccgcattcctggcccttggccacagacgctgcgtttctgctaggacctgacacgtgcggtgggggagctccgctggccggagctgccggggtgtccgcgcccccggggcagctgtgatcaccctagccatccccgcagttggcgcctccgcctgcgtctgcatccacgtcccacataaccgccctggctccgactccttttctttgtaaactaaagaaaaaagtatagctgtagttgtactcattcaaacctggactcaccttttccttcacccaattttgctcctaccctggcttcttcctccttctgggctccctaccccaggaaggggatctccaaccatcctgttgctaaagccagaaagctggaagtcattcctcctccctacctctgcatcaagtcatcatgactctacctgaagactttacatgtttttatatttgtgtttatttttctccctctccatttcttctatttaggcctcatcatttctgatctcatcgctcaccataaaaacctgctaagaatccaaccttcgcattagcacccaagtgattattgtgaaatttaaatgtaatcaaatcagctctaaaacaagggttactgtgaggataacaatatggcaacgtttgtagagtgtttagcgcagtgcctggcaggtcctcacaaaagaaagaacagatgaggaaagagaaaagaaacaaaaagtcagctgtcacaggttatatcaccccatccctaaaatcctccagtgtctctcaagagccttcaaaacaaaattcaaactttttagcataatgcccaagcccttattactttgctcctgccaggcctccagccatctccagctacctctatgaacacttacggccatgtggttattgagttattggccaggcgtggtggctcacgcctgtaatcccagcactttgggaggccgaggcgggcagatcacctgaggttgggagttcaagacagcctggccaacatggagaaaccctgtctctactaaaaaatacaaaattagccaggcgtggtggaacatgcctgtaatcccagctacttgggaagctgaggcaggagaatcgcttgaacctgggaggcggaggctgcagtgagccgagatggctccattgcactccagcctgggcaaaaagagagaaactctgtctcaaaaaaaaaaaaaaagaaagtatgaaatatcccactgaaataaaatataatggtaagaaaagaggccatccatgacagcaacaacaaaaaatgcctagtaacacatttaagaagaaatgatgaagacctagtttaaaaaatgaagaaaataaatatacagttatatgttcatgagtaggaagattcgacattttaaatgtgttaattctctccaaactgatatataaaatcactgtaatcacaataaaactcacaatgggatttggggggaatctgccagaaatattcctaagttcctctggaagaataaacatattaaaaaaaatacaaggaatattctaaaaagcaagaacaatgaagggaagtagtaccatgtatttcagtggaaattaagtatacattaaaagtggtggccaggtgtggtggctcacgcctataataccagcactttgggacaccaaggcaggacaactgcttgagcccaggagttcaagaacagcctgggcaacataggaagaccctatctctgcacatacaaaaaaaaggttggggggcggatttcacattagtcaggaaaaataagattagtgttagacaaactagtttgccatttggagaaaaataaagatcagttacttacaaataatcctcagtccttacaccaaaataactttcagatggaataaaaaatttaagtttaaaatggaacaatgattccagatgcagtggcaggtgtctgtagtcccaagtactgaagaggctgaggcaggagaatcacttgagcctaggagttcgaggccagcctgggcaacacatcaaggctgttaatttaaaaaaaaaaaaaaaaaagggaaacaatgaaagtactagacctaacctgtaaacctgggacaacagatttatatttataatgctggactgatgaaggggaaggtggagagaagaaaaaggccaaaaaggaagagtcacaatttatctacataaaaattaaaatctttatatggccgaaaaatatatatatagatactaagtaaaaagcgaagaatatactaaagaaaacaattgtaacacatgacagactaatatctacccctaaaagggctattattaaaatagtggaattacaccacagaaaaatggtaaaataatatgaacagttgacaggagagtcagtaaacatttaaaacatggttaaacttactaacaaagaaactcgaaacaataagatatcactttttatctccaagcttagcaaagatttaacaacaaaaggccctcatattggcaaggcccactcacacactgctggaagcagttacaaaccagtatggaaacttatttattacaattttaaatctacattcatgttgactcagcaatttcaattctagctgtccatccaacagaaatacttgcatgagtactcaaagctgtatttgctaatttctctgcagcagtttgtaaaacactggaaattgctgaaatattcatcagtaggggaataaattacggtgcctacatactacgccattaaaaataacaaggcagattagttatttatcctggcatagtaagatgacaaagtgaaaagggcaagctgtaaacagcttgtataatgatcccatttctgtacaaacgaagaccacatacaaagttattgccagtttttttattttattttacgtaagaatgcttcttaaaagtgttaacttttttgttagtttcgtttttagacagggtattgctctgtcgtccaggctgaggttcagtggtgcaatcaccactcactgcagccttgacctcccaggtccatcctcctgcctcagcctcccaagtagctgggagtacaggcccacaccaccacactaactctaatttttgtagaaacgaggtcttattatgttgctcaggctggtctcaaactccgggactcaagggatccgcctgccttggcctcccaaagtgctgggattacaggcttgagccaccatgcaccccctactcttcctttattagcatttaacactcaactgtttgtttctggttccctatgttgtgagctccttgaaggcagggaccacgacttatgtgatttttttttttttctgagactcgacagagtcttgctctgtcaaccaggctggagtatagcggcaccatctctgctcactgcaacctccgcctcccaggttcaagcgattctcctgccacagcctcctgagaaggtgggactacaggcacgtgccaccatacctggctaattgtttctatttttagtagagaagggtttcaccaagttggccaggctggtctagaactccggatctcaggtgatccgccaccttggcctcccaaagtgctgggattacaggtgtgaggcacggcgcccggcctgacttacgtgatttttgtattacaaagccctagtacactgcctggtaatattagacgtttattaacggttggtttaaacaaaaaactttataccagaggtgatacttgagaaggcaacacctaagattgaaaaaaatcaggtgtctgtcagccaatgcaaaagcatacaaaggtgaaaaggcgtatatgggaaactgcggatagttctgtgactggaatgcacagttaaaattaatgaaagagaaaaggctgaagaggcagcatgaggatgcttccaaggataaagttcaaaattcttagcgtagcatatataccaacagacaaaggcatgccctaactagctttgaagcctcacctccggctattctagctcccttagctatggctatatccaattagttgcaatttcctaaaaacatcatattcttccacaccttagtatagccttcccctgtgctttgtccactgctctcctcccattttcaaaactcagctcaattgccactttcccaaagaaattctctctgatctatcaggttaatataggaggctctcccctactgacttctacctcatggtttctctggcagtctgttgacttgtttggcttctcactaaagtctaactggggcttttcaactctgcatctccagttctgtttttgttttaaatcgagacggggtttcaccatgttgcttgggctggtatcaaacttctgagctcacgcaatcagcccacgctggcgtcccaaagtgctgggattacacacgtgagccaccgagcgtggcaaactccatctttcttggtgctagatactgacatacctgctgtgtccctggataaagaagcggaccccaattcccattaagcccccgtggtaccattttcaagtccgaggtcttacgttgcagattgtacatccaggttccctgacccgtaggatttaaaagtgaggtcaaataattaaacaaattgttttagtcagacactcttgcggctactctgtagccaaactgggtgaaaacctgaccagaggagtccacggccctctgtacatcaaagacggtccaaacgtctcactgtttagctcagtcccagacacactgagctcaatctgcacgaatcagcgaggtccagggcagataacatgtgtctaggggcctggacttgcacaaaaagccttaacaacttcacaatttgattaattatgccgccttggaccacgcgtgaaaaacagcaagacccaaggcctatgctattggtctggggactagacccacctggctcaagcattttttgctcgccacgttcccaaaaagagaagaggcgcccgtaagaggggggggggggggggcaagactgttccaagagctttcccgttcacacacagctcccgctgggtcactgtactcgagcccttcccgccctcgcgggcccaggcggccaccccacaggtttgggaaccctaggacttgcagtgctcctgggccatgccccaccagccggagacttccgcactctcaggctcgctgagtggagaaaagggctccagaagattccacgagcgccgggaagccgcgctagcaccaacacccacaaggccttt

SEQ ID NO: 158 - DNA, 14237 bp, Homo Sapiens
gtggcgtgggcacgccggccgctcagaaagcgcgggaaaggcacgcagccacgccccaagggcgcagcctaggacaggggcttctggagcttctggcagccgtctgccctcatggcctttgcacctatggggcccgaggcctcgttcttcgacgttttggaccgacacagggagtccctgctggctgccctgaggagaggtggcagggagcccccaactgggggaagccgcctggcctccaggtacaggagctggtgccgaggcgcgacgcagccactctgtagaaaagtcgggcgctcttcctggccccgggctgcctcctagtgttgaggctgaggaggcaccccttggcgggccagccaggaacccccaaaaagatccttcctgagtacccgtgacctgctttgaacccttattttgaactcaaaaaagaaagccaggtggcagccccccttctgtggcttctaggatgttccccttctagaacgttccagaggctccctgcagctgggttggaaggtttcctaagatccttataggttggggagtttggggtacagttagctttgtattttttaaacgttttttgggataaaatttttggttaaactttaagggttttttttggtttttattttttggtttttttttagaaagaaaatgagtgttgtatgtcttctctcagtaagcgaatggttttctcagaattaacaaggacatcaacacattttaagtggtttataataagacaacatgtttaattgttttgcaagtggagagaatgtacatattttaaatgatttatttaaaatcaattacaggaaccctccagctatccatgttagaattaaccacagaaaacatgactacgttattgaccattttcacttaaaaatactttattttgtttcctcgacttgctttcttggttgagcaaagtttttcagccttttatttttaagcccaaaccaaccaccaaaaaatctgaaaaacctacaaacaaaccaatttttacaaaagaatttattttgagggagaacttgggagagtgagggaaaaggagagtggcaagtcccttgttaatatcgcagatgtagacgaatctgattgtatcttaaagttggttacagtattatcctgcaacactttttttctccaaactaggaaaaatgagtatttgggtcagtttttacctcccaatattagaatagattaaatgttttaaaattcattttctgaaacacaagttttcagtaaaaattctgaagttcctgtggaaattaaaactctcaacattttgcccgttttctagagtgcatttgatttctcttcctagacaataagctcatggtgtttataacagaacaacattttttgcagctgatggcttgtgaaattaacagtcagctgacagaaaactgggcttagtcttcgcattttgctgtagagtggcgtaatagctgccaagtcaaccgtttgttgcagaactcacaatttattctttccagggtagtgattaaacgttttcctttttgtatcgctaaatttcaaaagagccgattttaaggcatgagatcaactagggtaatgtgcgaccacaaaaggtgtttcttttgaaatttttgcattgcatttttgggaaagaaattcaaagccaatattgtatcactttttaattaaaacatatatcagtagtatgtcaagtctagtttgtattcaagttcagctagattacagtaggttaatatgataaaattacagttgtaaatttagtcattaatgtaaaagggagaccttccattggtaattgcttgagaagtaaaattacaagcaaatgaaatttatttgtaaatacagttgttttaatgcagtagtaaaggtttaatgggagagataattattgacatggattacctagtctttttttttgtctttttttaaaaccccaccccaattacctagtcttaaaaaagaataaaataaaaagttactttagtattgatctgggaaaatcttacatattaaaaagtcaaaatttatgattaagatggaatcatgctctgtttattgtttcagttctgaggttcttgcatctatagaaaatattatccaagacataatcacaagcttggcaagaaatgaagcacctgcattcacgatagacaacagatcaagctgggaaaacataaagtgggcattttgcatttttattttttaaatgcaatatctatgtcattattaaaattatttgaattagagttctggtcatatttttttcattttattgcctttaccttgccaaaaaaaaggatttaggaagtttacgaaatacataccatacagagaggttatgtaaactagaagtaggtgtgaaagatgaggcaaaggaaaacaatgctagcaccaacagaatggagcaccagaagaggttagaattccaaatgcatgtgataaagtctcataattttgctaagaataggcaccatacttggagctaagctttctagcagtcagagggggagatgtcatgggtgcaattctcacatatgccacaaaagcaaaccacttgctcaggggaaatataaccaatcctgataccagaccaaaataaaagtatcctgaacatagagcacatttaaggctttctcctgacagatcttctgcccctgctaaatcatgtgtccaaaaagggtaaaatcagcaaacagctttatcagaattcttgaacctagttataccggttttttccagcctctcatattttttaagagatacagaaacaaaatgaaaggaattttgagtctccttcatcactgttgttttatgatctatataagtaatataagctgtatacttttcagtcatgttttgaaagatggattttatctagctttgaagcagcttacacctgacatatccacctggtgccttctgccacctttaggggaagcttggcagttcaacttaacctaataaaattgttattttatgtaatgtaattttgcaggtaaatcagaaatgaaacatttcaaagcttattaaattgagtaaaattattaaatgagtaggttattaaaatgagtaaagtactaattgtgaaatatttgaaaacattttacatacactaaaaatgtcttcccagtaaaaaagtatgcacacacacaaacacactcccacaccccctaatcaaaggtgttagctcatttatgttaaatggtttatcttagtgcctctgtatgtcacaaacctaatttcctagttatcacctggaatgatctatgctctcaaaccagttgatcctaaagcttcagtgcttaaattgagaagaaatgtgggttttaaatgatgtgcagaagaccataagtatatattgtttggtgtttagaagttgtctttttcacttttttcctttgctttaaacaaaatgacaggtttgaagattctgtgggtcttcagatggtatcccattgcaccaccagaaagatcaaaagtgattcaccaaaatcagctcaaaaattttgtaagttaattgttcttagcttttggtaataaaggataaataaattttgttatcttctcaattttatttgttgctagttaaataattttacctgtttttaatagatcactttcatacataaaataaatttctataatttttcattgtcaataactatggaagtaggttatcaacataaacatttttcaaggtatatggttcagtgcataattatcctctcagttttgctatccatagagcaattaattttaactgattctgcaggtaattgttctgtacttaaccctcccattttggaaagataattttttaaatgttaactaaaattaagttaaaatccttgatagcagtatcttttgaatcagtaagagaaatgatgagtaacttgtttgttgaattttattttccagctctaatccttaaaatattgtccatgatttataaattagtacagagcaacacttatgcaaccaaaaggtaaatatattgttctagtaaattactcttcaaaatgtaatgtgagaaatagttggattaacttttattatatgctttgaaaagttacataagactaaactatagctcataatttactttctttatatgttgtgttttcatccagttaaagctttcttcaattaacactgtaatacttgtcatattcaaaaagaatatagttaattaaaaatatgtattttaaattttcatagggacatatattacactgacagtcaactctttggtaaccagactgtcgtcgacaatattatcaatgacatttcttgcatgttaaaagtgtcaaggaggagtctacatatagtaagtagtacctaatacaaaacattttattttaaaacaaaatgtttgtataaaacataatttttttttttttttttgagacggagtcttgctctgtcgcctaggctggagtgcagtggcgcgatctcaactcactgcaagctctgcctcctgggttcatgccattctcctgcctcagcctcccgagtagctgggactacaggcgcctgccaccacgcccggctaattttttgtattgttagtagggactaggtttcactgtgttagccaggatggtctcgatctcctgacctcgtgatccacctgcctcggcctcccaaagttctaggattacaggcgtaagccaccgcgcccagacaaaacataattttaaaacataatatagtcttcttttgctattatttgatgcttgcatttttctcactataaatttaagtaatagattctcaatatattcctttgggtgaatggaccaaactgatgaattaccaaatatttttaattcctaaatcccttacatattttctctttcatctctgaaatttcaatccaagtgaaaatgccagtaattcagcagatgaacacaaggagtgacttaatagcataaaacatattcgtgaagcaggtttcaaatatgtctattattttttgcagttatctacatcaaaaggtttaattgctggcaacttaagatacatcgaggaagatggcaccaaagtgaattgtacctgtggtgcaacggtaagaagcatcattgaagttttcacagctttaactcttctagctccttcagttttgaagcataattttatttcttgctttattatgtaacctagagcttaagatttcaaaataaaactgaaagatggataggaatatgctttacagaactgtacattacatagtttcaaattatgctaattgtcaaatgtcagattgaaataaacatacaaatataactcttaaaaatgcactattattttcagataaagtgtggcttggtcattttagcatgttatttagtaatgttcataaaattttctggttctgaaagtaatatttttaatactaaactatttgctgggctttgatacaaagagagcccacagtactaaacttagtacccctgttgggagaattgctgtgagtcatgtgccggttttcttactgaggggtaaagctgttttctactattttttaacagaggaagaagtctctgatgactggtatggtcaaagaaaaataaaaacagagggctttgtgataaactaaaaatgtggttattttgctttttatgtaagataaaaactttttttttaaaaggctgttgctgtgccatcgaatattcaaggaattcggagtatcctttaagtgggaaaactatttaaacttttggaatgttcattcattcattaattcctttggtaagccaagccttcataatgtgtaaggaacaagttaggccctgtagcagtcaagatgaacacaccatggtcccttctttagtactcttttaggagctcaccatctagtggaagagacagatatctgaatatatgaatagatgtgtttatatgtttgaaggtacaaactaaaatgttgtatctatagctgcttttgaattatctatatggcaccttaatttagttggtgattaaattgaaatactcttgctttcaatttatcagccttaacttcacagatttagttacagatgcaaagtttgtattaattgtagaaaaagatgcaacatttcagcggctcctagatgacaacttttgcaacaaattgtctccttgcatcatgattacggtatattatctaactttactacaattccaagactaatgtatactgttatggtgattggtaagaggatttacaatattatctacacaatgtcctgttttcaatataatgcatcctttgggatcatagaacgggaatttccaatgtgtttatttaaacatcctcaaagctggctatcacctcaagttcttttttttttaatagagacagggtctcgctctgttgcccaggccgaagtaccatggcatgatcatagagcactgtaaccttgataagttcatgtttctaaaaccacactcaaaagctttcttccttgaaaagctgagtgttcctgccacttgtcctgtggctatcagtgcagacactgcaatgaggtccacacgtcagagtcagtttgacttactcctcacatcccatggtcaccaagtccttttgaattggccttgggaatctctttcatttcagccctttctccttaatccttcccctttcattcttacacaagacaaccacctggtagcctccagacaggcccctgacttcaattatctctcatccctgccacaccagacttgtcatttccctccttgccagttcaaaaacttttggttttgtctgatacttctactccaaatctggatgcctctgtggaactggtcagcccttctaagactccattccgcctcctctccagggcagcgctcctcactgcctccataaacatctctcgcaaatgcctctcaagaagaggctgggactcgagggccatattaggaagagccatttttcaccaggtcctttaaccctgtttgactcctctactgtgttcatgtgctattatttttcccaaagaacattatgaaaatacactaaatactcacgatgagctaggacccctgctaagcacttgacatagtaagagttcacatttactggtgtttatcacatgtcaacttgtataggctctcaatggccttaggaggtaggtactaacatcatcgtcactttaataatggggtactggaatgcaggaaggtattttaccacgtctctatggctattcaaaaccaggactggatttgaatagttgaaatccatgttgctataatgccatcacttggtgtgataggcatatttatgctgattttatagataaagccatggcctaaagagactaagaaacttgcccaacatcacaccactgatgatgggcagagagggaattcaaactcggagctgtgacccgaagcccattctgaatctctagggctactctgcgctcttcctctgctctctgtttcatttggttttctgcttttctctaacattgttgtaacactcttcaatttacttttctacataattattattttaatgacttcataatattatcccaccatttaagttttattaaaccctaaatttaagccaggtactcttctaagtgctttatgattattaaataatttaattcctataataatctcatatgttgttacagagcatcaaaccacagagtggttttgttactcattcaagttcatgctgctaagaagtagcagagctgagatgcgagctcaggctgcctagccccgcaactgctgcagatcaccgctgtactatgctgcctctccacatccctgttgttagatattttggctatttatattagtttgcgccattttaaataacacttcagtgagcatctttaaatatgtaggatgtttattatttctgtttttgctgaaatatttccttaggaccatttcctaggactggcataattcccagtccttcagtctgtttgtatataatgtacatttttttttcacagtcaacaccagtctttcagcacctgaaatccaaggtaggaagatgtaacccttttttttggtgctgtgactcagatatgaaccagggttgctgtggccacatgcagagtactaaccgttgtatgagcataacctataatttattattactattattattatgattttgaggtggagtttcactctttttgcccaggctggagtgcaatggcgtgatttcggctcattgcaacttctgcctcctaggttcaagtgattctcctgcctcagcctcccgagtacctgggattacaggcgtgtaccaccacacctggctaattttgtatttttagtagagacggggtttcaccacgttggccagactggtctcaaattcctgacctcaggtgatcgatccccctaccttggcctcccaacgtgctgggattacaggcgtgaaccactgcgtccagcctaacttttaaattattaataagagtataattgtaaccattttattctactgaagttaaaattcttaattttcatcttccttttagggaaagggagttcctgatctaaacacaagacttttagtcaagaaactgtgggatacatttcatgttcctgttttcactcttgtagatgctgatccacatggtaatttatcactggactatttacaacaatagtcataactaaatcatatttgttgttgtgttttcttcctctttttttttttttctttttgagattgagtcctgctctgtcacccaggagtgcaatggcgcgatcttggctcactgcaacctccacctcctgggttcaagtgattctcctgcctcagcctcctgagtagctggaactataggcacatgccaccatgcctggctaattttttatatttttagtagagacggggttttaccatgttggccaggctggtctcgaactcctgacctcaggtaatctgcccacctcggcatcccaaagtgctgggattacaggcaggaaccaccgtgcccagcctgtagttgtgttttctactctcgggacacttatgaaacattttaaaagaaaatgattacattaaaatttggtctataattatttgacacaatttatcgttactttgtcatattaaactgagaatgataaatttttcactggtgatgtccacaaaattaaaattatagatagataaaatttgagagtgcaaattaacctgtaatatgtaaggagactaattttatagttaactttcttttaacaggcatagaaataatgtgcatctataagtatggatctatggtaagtatagaaaagcagttttccttttttattatttagacattttatattcattgaggtgatttctgcatttattaatcacccccaagcaggctgagagtgcccaaagtgtacctgagggcctagtatcctattctaggagcaatctgtgtgtcggtggctgtgactccagctcccagtatgaccagtgcaaacacagatgacagagtgggattagctgtgggcaagcagcattattatcctgcactctcttggcatactgaaggaactgtggggctctggggtgacaacaacgctgtctgatcaccaaatatactcgaaatattatatagagccttgaattctgacttttctaatcccttttctcccaccataaggagaaatggaaacaataaatgtcaccaccagtgtctacaattaccatataccagtggtctcacagtgtggtcctaagccaggagcatcagcatcatctggaagattcttagaaatgcaaatctcagtccccatccagaactactgagccaaaatctctaggggtgggatcctccaagcattctgatgcatggtgaaatttatagcagatgaaaaggatggtggagcagggtgtaagatggggaatcatgaacaataagaaatgtaggtcagagggcttcatttatagtttgctttagaaaattaatacagaaacactatatagaagttgtggttgttgttttgttgctgttttgagacagggtctcactctgtcatccaggctggagtgcggtggtgcagtgacagctcactgcaaccttggacttttgagctcaagccatcctcccgccttggtctcccaaagtactgggattacaagcatgagccaccgcacttaacccagagaagttttaacaccttcactaaaagcccagcttagcatagcccctgatggttttcttacttctgtgggctctgggcatgtgaagccagctttagtacttgtccttcttaataagtgaaaaatttgactgaaaaacaagaatgctagttttctacaatttagcctcacctaatatacttttgttctttattttagtctatgtcttttgaagctcatcatctcacagttccagctattagatggcttggtcttctcccttctgatcttaaaaggttagatagtatagcagaactaggatatttaaaatgacagttcattatcatatgtaacaataagcctaaaaagtcactacaagggaaagctcttaatgttttttatttatattgtccacgatgacttatgattatgtaattatgaattaaattcattaatgtttctgtttcaactactaaaatatttaacacatgaatttggttaatgtgttacactttcagctagctaaaactttctgttttacttttatggttaagacattttatacactttttatacttaaaagtacaatacattgtaggccgggcacatggtggctgacgcctgtaatcccagcactttgggaggccaaggtgggcggatcacttgaggccaggagtttgagaccagccagggcaacgtgacaaaaccctgtctctactaaaaatgcaaacattagctgggtgtggtggtggtgtatgcctgtaatcccagctaccgggaaggctgaggcccaagaattgcttgaacctgggagacggcagttgcagtgagccacgatcgcaccactgcactccagcctgggtgacagagcttgactctgtctccaaaaaaaaaaaagtacaatatagtaaatccaattaaattgtaaccattgacaacatcatttgccatatgaatcaatttttgtcatagatttaaatttttaacttcaaaagaaaaatatcattttaagagtattaaaatttgggaacttcaagtttggcaagtttattatatatgttcattatagaaaaaaatattaagcaacaagttaaatatcacctacagatcagcagccttacctttgtagattttttttctgtgcatagccataactttttcacaaaactgagatcatactctgttattttataatctgctttttttaaaacacaacaaaataatgtgatcacttttccatgtcaataaagtacatttcttattttagcatcttttgttgctgagttttaactctagatgtgctagtgtttattcagccattccctcatagccatttaagtggtttccaaatctctattctgataggtcgtgctttgatgcagtctcttgtaactaaatctctatgcacatccttagttagtcccttaggctgaattcccagaagaactggtgggtcaaagaggatccccataatcagggtttgactgttgtctggatagattaagtttcttgctttctctgaagagtaagagtccacctgtccctcagcttatggcattaacattttttttcacctctgctaatgtgatattttaaaatgttttattgttgtaattggtcagtaagaatgaatttaaacatgtttattggatttctttaagtggtgagcaatccttgataacagttgcttgtttcctaaatatggaatgtgaacaggttttgggtgatcagccacttcctataaaatgagggtccaagaggaaacatttcattctttatttttgaatattcacactccactggattaacgtgttcaatttagtgtatgtgtgtcatggtcagaatcccttgggggtgatctgtttgtataaaaacaattttaacacaaattcaagacatatgatctgataattagtaaggtgaatagcttcaagaaactctagctgcatctcataaattctatcagtgcactaaaaagccactccaaatgaatatacgatcaaaggaaaaacactatggtagctacagaagccaggctgcaagggaaatcctccaggcctccctttcaatcaaattgtcacccctatccaagaactgcccctggcaaatggtcataattatggacacattgaaaaagactctcctgggaaatctaggatttgtgacttcaaaaggtagtccacaccataaatccaggacctctcatgttctatttttaaaacacataccatgataaagttatattccacgtttttcaaatttaaaactagataggtaagaatgtgtttgtgtgtgtgtaaagtgataaaagtgtgtgtgtgtgtgtgtaaaatgataaaagtgagacactaacttccatggcccagaatcttcaaatgaattatgaagaattaaatactcaatggaacctaaagtccctcagtgaatctcagccgttggccatgcatattggagctcactgccagaagagtgtgaagctctgagaggcttaatgtacattattaagctgccctggtatctgtatacctgatggtagtgctattggcatttgtttaataaccaatatcagtcttcctgtcatcctgtcatcatcccacgagtgtgacatgaaggaaaacaaaaactttagaatcttactgtggaaacacaaacttccactatgaacttgaaaacttgctggtctaagacatgacagatcccttcaatcctggatgtaagaggtagatctgtactaattttcttatttctgagtttcttgaagtagtaccataaatacaggcaaaatacaggacattcaagttacagaaacacttttttactgatttttttcacctacttttttccagattaaatgtacctaaagatagtttgattccactgacaaaaagggaccaaatgaaacttgacagtatcctgaggagaccttatgttacctgccaaccattttggagaaaagaagtatgtttccttttacaactcaagtgttgcatgtttaattgtcttttactttagtagtggctattcacatcgtattttgaaaatatccctcttgaaattttatatgacacgactaacataagtgttgtttggcagtaaatagttgttgaaattgagtcatatgaatgctaatagatgagatcagtgaatggagctggcctgtttgtatccttatcatggttatatacacattcttgatggctgtatcatagtttgtgggattaaaaaaaggaagaagaaatcataaagatttcagactatccctaattattgaagacagcatacagagtactctcactccagatatttttagctgtagcagctctggaatattctggctgacccttaagactattgtccctggttttggagaataaagcaattctagattactagtttgttgaattgacagaaatgcaactaagaactctggtatgagtacattttacttttattgacagatggaaataatggcagactctaaaatgaaggcagaaattcaagctttgactttcctatcatcagattatctttccagagtgtacttacctaacaaattaaaatttggaggatggatataaaaataaatcagaagaacttctgattgccagaggcttttcattagttttgttttgattggcaaatactattgtggaaagaacatatattatattcttaattctgtaaaagtgaaataaaataactttccgttaattatatatttttgtcaaaacaaatgctgtactccaattttctttgcaaggccttattcttgcctctatagagacagatttctgtcctatcttctaaagcaaattataaaagaatatgttattttgacctttaaattatttttgaaaaaataatattttatacatgtcatcaaagtctacaaaatatttaccttctacgatacaactaatgttaacgcataaagtatcttactggtaacaaaaatcataatgatctgaatttgagatgttgcaaatgaattgtggtgtccggtagtttcttcttacattttcctttgcctttatactttaggggtcttactccattaattcatttgttacattagtaaaattcagtatgaataaatatttggattgatgta

SEQ ID NO: 159 - DNA, 22970 bp, Homo Sapiens
catggcaacgagggcggacggcgtcagagcgagtcgcttccggaagtgacgtgcggaaggggtgcccgggacgaagccatggccctggaggcggcgggagggccgccggaggaaacgctgtcactgtggaaacggtaatgctgtcaggcgacgcgcaggaggcgggggccgaggccgggcggcccttcgcggaccctccgagctcatagtcttcaggctgtggaatcggagctgccaccgcccgagactccaaagcaaagcccagtttccggcgcggaagcggagggatctcaggaattgtagtccgcggggtgggcgcggttctcgcttccggccagtttgtctggcctgcgcttgcgcgggtctccgccgcctgggctcctagggactgtggcctcggcggtatgtcccttgctttcccttgaagcgggagaagacccggcagaggcgctctgtccgctgcagccgcgcgggtggaggaggcagagtctgaggtgtgaccccgaccaagtttgacgcttctgtcctcctagggagcaagctcggctgaaggcccacgtcgtagaccgggacaccgaggcgtggcagcgagaccccgccttctcgggtctgcagagggtcgggggcgttgacgtgtccttcgtgaaaggggacagtgtccgcgcttgtgcttccctggtggtgctcagcttccctgagctcgaggtaacctgggaggacgccgagctcgaggcgggcccctcggtgggctcgggcgtgcggtctccgggacagggagcagtgcaagcgtagaacccggcttctcgttttgtaggatgtcattaatagtctggggagttggccgggcgcggtggctcacgcctgcaatcccagcactttgggaggctgaggcgggggaatcacctgaggtcgggagttcgagaccagcctgaccaacatggagaaacccggtctctactaaaaatacaaaattagacgggtgtggtggcatatacctgtaatcccagctactcggaaggctgaggcgggagaatcgcttgaacccgggaggcggaggttgcggtgagccaacatcacgccattgcactccagcctcggcaacaagagcgaaactccatctcaaaaaaaaaaaaaaaaaaaaaaagtctggggagtcttggaagggaaaaaaaggcaaaaattaagggaattctgtgactattaagaatcagctcatgagctttatcttcaagtctgattgttatcttgggttcttcatctcagtgacctgtccaccacgctcccagttgcccaagctggagatctgcatcctcctgggcccctccgttcctctcgcgtccagttgcacactagctcgcttttattctgcctcttaaatgtcgctggaatctgtccccttgtctgtttcccctctgctccttccctggctgtgccaccatcactcctgtgggttcctgagcagcattttcatgggtgccctggctcaaatgttcctcctcagtggtttcttttccatactgccagcagaccaattttcctaaaaagcaagtattttcctcaaaagcaacaagtcccctccctccctccctccctcccttccttccttccttccttcctcccttccttcctctctctgtctctctttccttcctttccccttcccccactctgtgcccaggctgaagtgcagtggcataatcttggctcactgtcaagatctgatctcaacctcctggactcaagtgatcctcccaccttagcctgagtagctaggaccacaggtgtgagccactacacccggcttatttttttattttttgtagagacaggatctcactatgttgcccagggtggtctccagctcctgggctcaagggatcctcctaccttggcctccccaagtgctgagattacaggtgggaaccaccacacccagcccacaagtcctcttagaacattgaagtgcccttctcatgacctcatggtgaataaagttcactctggttggcatggcttcaaggcccgtcatgacctgtcccctgcgtaatttaatatgacgctggaggctcagccctcaccactattctcagttcttcccacctcctacagcccactgtgagtccctcacgtgtttgctacgctgtatttggcggcctgacctttgcagtaatgtttcttctggaagggtttccatctggctaactactactcatctctttgggctcagtttagacatgacgtcctccactaagctccctctcatcccacaagacgaggacttgtccctcagcaccatgtcttagtccgtttgggctgctgtaatagaataccttagactgggtggcctacccacagcaggaatttatttctcacagttctggaggctggaggctcaagatcagggtgccagcgcaatcaggttgtggtgacggcgctctttcaggttgcacagggccagcttcttaaccgtgttctcacatggtgatccactcacctccctagaggccccacctcgtaataccatcacctatgggttataatttcaacataggaatttggggaggacaccagcatttagaccgtagcaaccctctgcttcctcttgtcttgctgggatggaactggcctgtcttccctactggaatataaactccatgatggtagaaaccatgttgctttgcccaccatggatagcatgaggaagacgctggactcttccttcaagagatacgtgtgtgaatggacagtgggctcatgattcacataagagtcaacagctccggaagcctcttggcgtcactcgcattgctcctctgctgactcccgaaggtgacaaacgtcttcctgcttccatggctttgtgctttacttgggaggcccttttcagtccaaatcaagcaaaaatgtactgagtgcctactgtgtgctaagattgggatattcagcagcccctactctaagaggtcccctggccattgtgtaggctagcatagggagtggggacacagtcttagggtcctgactactcatgctcacacccaactctgccactccccactttgccctctaggcctctgtctccttttttctgacttgaggatgatagtggtattaatatccagctcacagaattgtgatgagcagtacatgaaatgcatggaaagcagttaacacagcattcccttccccctccaacttctcctggctgcaaattaatcacctcatctgcatcctgggcctcttttgaatgcacatgctgttagagcgcttctcacattgtattaaagttagtcatttatgattccatttttcccactgactgtaggttctcaagagtagggtgtaccatatttcttttacaaccccagcaccaagcaaagcacctgctacttcgtcggtattcattgttccggctatgaaagcttagactaggaaaggatcttggaacagtctggtccactggttcctgaatgcccgaccgtggacctgcaggagcagaatcacccagaagtgtgttgagaaacagattccgtaggcacatccacagagacagaaagtggatccttgggccttggagttggggtgggatggatgggaagtgactgctgatgaggatgaggtttatttaggggttaaggaaaatgttctaaagttagattgtagtgatattgcacaactctgtaaataccaaaaccatcgcattatatgttttaaacaagtgaactttatggtatgttaattgtatctcagtaaacctgttaggaaaaaaaacaggccgggcgcagtggttcatgcctgtaatcccagcactttgggaggctgaggcggctggatcacgaggtcaggcgatcgagaccatcctggctaacacggtgaaaccctgtgtctactaaaaatacaaaaaaaatcagccgggcatggtggcgggcacctgtagtcccagctactcgggaggctgaggcaggagaatggcgtgaacctgggaggcggagcttgcagtgagccgagatcgcgtcagtgcactccagcctgagcaacagagcaggactctgtcaaaaaaaaaaaaaaaaaaacagattccagagccctaccccacttactgggggaaaaactctcccagagtatagcataagaatctgctttttaaaataagctttcctgtgattctgaagcagagctgggctggagaaccactggcctgcttttcccaccgtgaagaacactgtccttagcatccctgacaaacgatggcggagcccgttctgtgccagatgctgagccatggctggtgtgtgctgctccgcaggcctctggcggagcccattccatgccagatgctgagcgatggctggtgtgtgctgctccacaggcctggtggagcctgttgtgtgctggacgctgagcaatggctagtgtgttctgctccgcagggagctgactcctacttgtctgtgactcccatcgatcagttctgccttcaggtagcaaaacagaacggatcttccctgccttctgcttgtcagcccttctgctgctggaaacagctgcctgctccttgaccacactgtcccaagaggctgcgatgacgtccagcttcttcactggtcagtggccctctggtcatgccctccgttcacacaatccatctttccgtctgcactcagaatcaaatgcaggaacttggatgtggtctacccaagtccctagacctaactgtcacccacgccatttcagtcggtgtagctggaaacactggtagcttttgaggggcaccaggtcactggcttatgttgagattgctggtcatccagacctgccccctacgctaatcatacagtgatttttcttttcccagatttttaatttgaaaatgtacatacatccccccaaattggaaaaggatacgttggacacctgtattccttctacttaggttcagctgttgctgctctggaatattctctctcgcgcacatgcgctctttgtgtgcgtgtgtaccgtacatcccagcgactgtgacagctcagaagacatcagcaggcctgtcctgagaatgacattctcctccacagccacagtgtcattatcatactgattacacatcatagtcatcccataatgtcacctgaatgataacattatgggagagattcagatgtaagcagccacgcccctcctgtgggaactcaggccacacttgaattccacatgtcactgtgcaaagtgacttttactctgtggggatgtcagtgatccagcctgctggcttctctgtgaacccaaattctgttatcagaatggaccctccccactttgggtcatgggcagatttgatcagtttccccattgagtcattgatgaagatgttgtgagaatgatccccaaccctctgtgctaatacagagcactccgtctgctttggtgtgtttaattattgatccagccacaagtgaggagtggaagttgtgatttgaaagctgtcaccaagagatttgggggattcagtaacaaaactgcaggaaggtagacaggtctgcagaatgtggacatagtgggaaacgtcttcacattaagggcagtgtgactaaggaaaacacaaggttaggagactcaggcctgccatgttgtgctctaaactgcagcctctgcctcctgggttcaagcagttctcctgcctcagcctcccgagtagctgggattacaggcatgcgccaccacgcccagataattttgtatttttagtaaacacggggtttctccatgttggtcaggctggtcttgaactcccaacctcaggtgatcgtccgcctcggcctcccaaagtgctgggattacaggcgtgagccaccacgcctggccaacactgtgtcttctttaagcctccaacaacccatggaggggtggggtggggcatcggcttcaatacacaaaggaggagacaccaggaaagcaaggggcaggcagaggtgatgcagccagcagccttagccttgcttctgatgaagaccaggtcctggggggctcccgcggacctgatcccagggaatcctcctatggaccaggtcccggaggctcctcctatggactagattccagggaatccttctacagtctaggcttcaggggctcatcctatgaactagatcccggggaatcttcctatggaccgggtcccggggaatcctcatacagaccagatcccggggaatcctcctatggaccaggtcctgggggctcctcatacagaccagataccagggaatcctcctatggaccaggtcccaggggctcctactatacacatcaggtctgggagttggggctcctccagtggaccgggtccggggtgggggttctcatatggaccgggtcccagggggctgctgctatggaccaggtcccggtgggggcggggtgggggtgctgttgctacagaccaggtcccgggggagctgctgctacggaccaggtcctgggggggtctgctcctatggaccaggtcccgggggtacctgcccaccaccaatttgcagggtacatcttctagttccttcttccaaacccatcatctcataggtgaggcagggaaggggagccatgagggtgacgtaagggagagggaaggatgaggggggcagggcatggacggactggggatggagcaggtggccgaaggctgtgcttcccactgagctgcgtgcctggtgtcaggtggtgtatgaggagagccgcatggtcagcctcacagccccctacgtgtcgggcttcctggccttccgagaggtgcccttcttgctggagctggtgcagcagctgcgggagaaggagccgggcctcatgccccaggcaggtgtctcatccctaggacgagagaaaggtccctccttccccctgggggagggaaggctgctgcaggtcgccaccaccacagtggcagggagagactcatgagcttcctggaagagaggaatgaggatttctaaaaagctggaccccagagacagtgcccccttcttgcctcagggatggccctgtcctgagggccgaggggcagctcagctgactgtgactctccctgtggctccataggtccttcttgtggatggaaacggggtactccaccaccgaggtaatcctgctcttggaggtccagggagggcactgtggggaagagcggggggagagggcacctctgtcgtcccccacagaaaatgctgggccctcggcctctgccgccagccccctccaatggcttctttctcggcgcaacggggacgcgcagtgcgctcagccccgcctcccccaccgccggtaaaggactgtctactttcgcttcaccccttacctctttcctgtccgccactgccttctctacagtgccctgtgctggctcatctccaggtgccactatccagttctgacctgatcaccaaaagatgtcccagggcccgggctcagagtggccttccctgccagccgcccaacctgcatggcccgtcaggccccttgtccacaactagacaggtgtacccaggcccccactgatgccaggaaccttggcctagggagcgtggctgagggagatgggctcttttttttttgagacggagtctcgctctgtcgcccaggctggagtgcagtggcgcgatctcggctcactgcaacctccgcctcccgggttcatgccactctcctgcctcagcctcctgagtagctgagactacaggtgcccatcaccacgcccggctaatttttttgtatttttaggagagacggggtttcacgtgttagccaggatggtcttgatctcctgacctcgtgatccgcctgcctcggcctcccaaagtgctgggatttcaggcgtgagccaccgcgcccggcctagggagatgggctcttttactgttacatacagagctgcgggcggcgcagcagcacccagagagggcccaggaggggtgacattgggccttcctggccagcaagtgtgactcggccctggctgctgccctcgcacatgggtgcagagccaaagggttgtcatgtgccgacccacatgctcgtgccagcgctggcaggccaccgtcgagggaagaggaagctgggaggtgcaggaaatgaccggagagctgcagtatcccagcacgccagcgaggtgctgaccctggcactgaccgtgtcagagagaaggaggcttcctccacggccttgcacccaggacatcgggcacagggggctttcgcccaggtctgcttgggacttagatctggtttccccagccctctgcctgtccacagacctctgctcacttagggaagcttttggtaagactggcttgtcctgaatccctgtgccaggccccagccccacctccccaaccccaccctcctttctctctggcaggctttggggtggcctgccaccttggcgtccttacagacctgccgtgtgttggggtggccaagaaacttctgcaggtggatgggctggagaacaacgccctgcacaaggagaaggtgaggaggggcctgctgcaggccatgcccggcagctcagtggcggggctgtggtggccctgggcatgaggacacttctggaccagcccttgcctgctgacgctgccctcctcatccctggcttgtggcctggagtaagaaagacctgctttcctctgggtgctgcattgcctgtctcagctgagggcgctctgagctcctctcctgcctcctgggtgtgcctgcctctctggtcccccttgcctctgagccaccgtggcacaccaagtagggctaagtcctccagttactggggacaggacgggcttccaggctgtcccgggcgcacttggtgctttccccaccccgccttgccccagcccctgtctcctcccctgcatgctcaggtaccacagcctccaggcccccctcccgccaagacctgcctggagctgccacccacactcttcctacctcaccttcccctgcatcttcctcctctgggaccccatgttggcactgggagtgagacactcacaatggagggagctgttgacacccccagctgtttcactggatggcagattctgagagcagagactgtgtctctcattcctcctagctctcaggtgcctgcatggagaagttgcttaataaaaatctgttgagttgatggggaccttagacccactcaatgagccagtccaccgccgccagaaataccagcctgttgagctgtgtcagatgtgcccaaagcaggagagaagccacaggaaggaagcgggctcagcacccatcactgggcagtggcggcacctgtgtggctgccagcctggcacagcggccctgggcagattgttgcccttgttctaagccccatcatcaggtttgaacagggtcttgtgggcagcaccctcagctcagggacaagaccacttcaccgcctgcacgctcagtgtcgtctcaggtggtgtggctttgcctgggctgtggctcacctccaagatcagtccccttccctttcctggcccagtgactgggttttaaaaataaagagacctgggccggttgcggtggctcactcctgtaatcccagcactttgggaggccgaagtgggtggatcacgcgattaggagatcgagaccatcctggctagcatggtgaaaccccatctctactaaaaatacaaaaaattagccgggcgtggtggcacatgcctgtagtcccagctactcaggaggctgaggtgggagaatcgcttgaacacgggaggcagaggttgcagtgagctgagatcgcgccactgtacttcagcctgggcaacagtgcgacactccgtctcaaaaaatagagacttgccttcagcccttcaccaagaagagaggggtttttttccccatttttccctccattttccagatccgactcctgcagactcgaggagactcattccctctgctgggagactctgggactgtcctgggaatggtgagtagctagggccctgagctcctccaaagccccggggtaggggatcctttgcaggcagacacaggtgcatgcagacacgcgtgcactcacacttgcccacatcaaccccccgcctgcccgtccatccatcctcctgcctctgactgagtccagggtgtgatgtttgtgtttctttcctccagccgtgctgagggagcccaccctcccccagggacaagcagcaggaaggcgccctgagggtgggcaggccctggcccctgagagcactgccccttcagcttcccccttgcccccaggacattttgtcagagctccagctgctgaggctgtcctgaccctggtcccggtggcccagcccacaggacagccctcgccttccttgtcacaggccctgaggagccacgaccgcagcaccaggcccctctacatctccgtgggccacaggatgagcctggaggccgctgtgcgcctgacttgctgctgctgcaggttccggatcccagagcccgtgcgccaggtgggtgtgctggggatgcggggaggcagcacaggctcctctgcttcctgccacctgctgttcagggctccccagcagctcagctggggtcagagtgcagtgacatgaggacgggggttcctgggccgaggacaggtcacagacatcttgctggagagcttgctgggccctgcagtcaggacagtagactggggggtgcagggctcccaagagttcatccccaggccctgcaccccatgcactcagcctcccagcctctctgagcctcctgcacccagatacaggccagcttggagaatcagtgatgttagctcaggtggtgaggtgtcctgccagttcccagccagcccctcaggtcccagagggagcagctgaacttgagccaggaggctcctgcaggaaagctgtgcaggccccagagacgccagtctggggacttgggtatgcccgccccaggacccagcacaaaactggtgttcggtcccccaggaagggtgagaactctgctgaagccatcagctcagctgagaaaggactcagcctgtgggccagggagagacagctggcacgagatgcccacagacagcctcgataggaccaggggaccacaagacacgggtggatgctgtcccagagaagcccacagagtgagggttcaagaaaagtcagtcttaggaagagacccgctggaggaaggggaaggacagccctgggcaggaaggagtttgatgtgctcaagaaatggggggcccggagggtggctcacgcctgtaaccccaacactttgggagacagaggtgggaggatcacttgagcccaggagtttgagggcgccctaggcaacatagaccccgtctctacaaaaaaaacgtaaaaacaaattagccaagtgtggtggtgcgtgcctgtggtctctgctacttaggaggctgaggcgggaggatcacctgagcccaggaggtcgaggctgtagtgtgccctgattgggccactgcactccagcctgggtgacagagcaagaccttatctcaaaaaaactttaaaaaacaaaaactcagcaggaaggtgtggccggagccagatggcagtgaagtacagagtgggtgggagcccgtgagcatcttggggtgcgccagggtttcagacgtcacccacagggacttggatggctgtgagttggcagcggggcgcccgcagattggcctttttaggtggccgctgtgcgtgctgtggaggctgtggacgcaggtctgcacaagccatgctgcttccagcagcccagcccctgagcctccctggtgtctgccccttccccatcttaccccaccgcttgccctgcagcctgccctggggcagccgcagcaccggtggaaaacccccaggccaccaccttcgggccggggccttccggctgctggcgcgcagtgtggcctccagggggcagcagcagcccacataccacaatggccctcgccctggggagctgtgctcagtggtggcgtctgagagcgggctccacagccttgcagggctttgctcagggcacaggtgtgtggactctcaagcctgtgagctgtgtccccagcccccaggaaagaggcctttcttcctccattccaactcagccgtgtggtcttccgagagagaacccaagaaactgtcccccaggccttcagccacaggaactttaggtcgtgctgctgctgcagacagcacagttcctggagctcctgtacctttttctgcctcagcgcgccccagagtaggacagtggcccatccttgcaagggaggggacacctggcctgtgagtaccttaagcatctagaaatagagcaaggatctgtgcctagcaccagcaaagagcctgccaaatcctgggcccaccctccagaggaaggaaagccgcaaccagttgggatatgcagccaccccgtaccaggagcccgcagcttcttactgttgggcgtgagccgaggatcgtgtcctgcagggctggctctgtctctcggtccattttcttcctgagctcactcacctctcaacaggttcacctcctgctctgttccagaaggtcctgggagagcacagacggggttagtgttggtctgctctctccctggctccgcgccgggccgtcttggtggccccatggtcacaggcgctgcggcgctcctggttgccaggtccaggctctcctgccaggccaggctgggccgctccaggggaaggtgagaggtgctggccccgcctaccgctgccccacttcccccatgaatggaagcaggagcaggctgggggattagccgttgctttccatgagtcgtgcagccctgaagctaatctaagctcatctgagctgggatcagggggacttcccagggccagaccccccatgcccccgggggttcccactcagacctgagccctgttcagtgtccctccctgctagggtctgcccccatcccagcctgtggcccaccgccctcttttatcttggtgattctggagacgggacaggggttactgctgatctagtcagggagaggacagaccagctgggctcagagcccccagagaagcaagtgttagcagggaagcctcggcttgcgcagagcctacagggaagcacagactggaaaccagtgaaggctgagcagctccaactgccactggtggggaggagacccaggaccccctcactcagcctgtccactcaccagctactcaggcccttcagggactgcccagctcggtttgagagctgccattgcggggctttgaccccaaagtcccaggcatgcctgtcccacactcgctgacagggccgcggctcctgagcctgaagaactggctgtgacctgtgtgtcctgagtgggcttctgtgggggatggaggcattgccagcagcagctcctggtgggaaactggtctagagaccagctcagcacccagcagcacgtctgtctcccccaggctgacatctgctcccgagagcacatccgcaagtcgctgggactccccgggccacccacaccgaggtgagcacccagggaggctggggcactaaaggggcatctcacagacacctgcatgggctgtttccggtggctcagcctctccttgttgcaatattgtggctcaggacagacagtgcagggccagggaaggcaggggacacaggagaggtcttcaaagagggaggagagtggagtggggtagactcctattctcgtgggaactctccagaaacaccactgcctccacgcaaagccctggaactacggccctgtctggtccaagccctacctcccaatagggctatccccagccttcctcagtccacttagcctgtgaggtaccaggacgtgggctctgcagaaaaggcgtggcctcggagtcagacatgatccagccctgcatagccagctgtggcgtttgcactcttcgagcctcagcttcctcatcgtcgggataggctctgtaattcttgtcccactggttcttgtaagttagagtgacagtgtgcctggcacagtcaccgctaacagtgcaaggcattgtcttaaaaccattgcagatggtttgatcctgctagcaaccttgatgtgagacaagtactgtgaccccactttacagatgaggaggctgggacactgagtgttgataaggagtaaagcagaattcagtctggctacttcctcttctctcagtgtgggcagtttggattccaggccctgcatctgagcctccaggctgagaggacacccccactccctaggcaaagatcgcaggaggccccaggcctgggattcgccctgccctcgcccacgattagttactgaagggctgcggttccttcgtgctcattttccctctaagccaggggctgttcccaggcctccctaggctgctttgagaactgagggagcaggtggcggggaccccccaagctctcccagagttggaggccggcccgcttgaatgcaagctgcgtgtctgagcagcgtgctctgccctgccctctgccctgggctgtagcaggtcctgagtgtccaggccaagcgcagttcccagaccccatctggggtgtgagggggtgtcaggtaggcgctagcatctgatgctgtccctttctcaatgtcatcaccaggagcccgaaggcgcagaggccagtggcatgccccaaaggagactccggagagtcctcaggtgagggccagcccccacaggaccacagcccaggccccaggacagccccaaggccaggctcccaggagcaggcgggcaaggactggcagtagggtggaactgggcaccatgaagacaagaaggccaccggccaccccgttctggcctcaggacactgaccacccctgggggtggtctagggacttaggggaacctcatctcagccgcaggtggagcacccagtccccaaagacaggctgaccgcaccaccccagggggacgccgcagcacagcccagcaccaggtggggcagaggtgaccacggcccctctttgctccgtcatcggctggtcagctgtggtcacggtgcctcagaggacagatctctatgggggcaagtgccagatcctgagagcgcatgagacgctttcccggagccgacgaaggggactcggagctgcagcctgcacgacccctgcagcctgtgctttgcccacccctttcaatagatggaacttgcttgctcttttttattcttctcaggattcattttttatttcacatatttgtttgtttgtttatttatttccattgatctctttaccctgaggtttacttgcaaaatcagggttcatttttaaagcaggtcctcagccccagccacactgaaccacctctgccctgacacgggaggggtcctagctggggtagctgggctttagcacctgctcactgcctgccatgacccctgaccccagtcctggccatcctccagcctgtcccaggaagagggagcagagagcctcatctcagcctggagggggccgaggacgggggcagcacacgggcagtctgggctgtggggcaggaggccagacagggtggcactggtgcctgaggggttgggtgccaggctctgtgcccggcgggggctaggatcgggggtggcaccgtccccacaggctctgaaagttgatcactgtcctctgtccttgcctgccttgccccagaggcacagcctcaaaactgtctccactgtgggaaagcagccctaggcccctgtctggccacttcatcttctcttggtgtgggctagaggcgccagctgaggagtgggggcaaaggggatggcccacctgcagcccagccccagcccctgggcaccttgcaagcaccccccagcccttgacatgccggctggcctccagatcccaggccccctgaggatgctggaatctgccacagagcatgaagaagtccctggaatcctttcttgccattcacctgacctctacaagaaggggccggtgatcatgatttgacagcttgggacaagaatccagggaggccgggtctctggcgcgcctccatgccccttcaagaaggtgctatcctggtgttcctgaggagcagggcgagcctgggcctgagggaacaggtacacaggcagcagcactcagggccggggagtgctggccccacccgcctgcgctcactcgaaagctgctttggagggctgggctgcaggggcagaggctctggaaaagaggcccaggctgtgtagctgcccttccttgatggagcagactctattctagaaatttctataagaagtagactcactccaggacaagtggggctggggggagcggatgccgaggggctctgcgggcaccttgtgcctaaagtcacggggggcacaggagagagcgggaactaggtggactgttgtggctgccatccatcggcaacgctggccggaaccagatgagcagtgtggggcgagagggagccccagtgcggcccctcaggccctccatgcttcagggtgtcagtggccccggactggcctcactcagccctgggcacttgggcctgtcggggatctagctttcagtgaggaccccaccggtggactgaggctcccctcaccgtggcagaggaatctctgcccttcccaccgaaaggggcaggagctagtggatggggacggctcacggccctccctttccacttgccttggaaagggagaggcagcagacaggaagggccttggaactcaggccagtgtggggagagtgtccccagagagtccttggggtgggagaggggtggagttgacagccggtgaggccggctttgaggttgtgtggaccctgtctgcctctagctcaagttgggaggggtgtcagctgtggagctgtgtgagcctcggggacagccacatgtggggtgcagaccggtctagatgtgcctgtctggtgggcgctgaaggtccccttgggagagtccagggcagcacctgataagccgagagctgcagccgtgtccacctggaacctgtttcctcaccgggaacatgaacacctgcttcagaagctttgggggttaaaggtggggatacacataggtctcttgcccagcggtggacactcggtacactcctaataaatggggcatggggtggtggagtccagcacctggctgggcccaggaatgaggcatcagtggtcggagggaagggcgtctgcccacctagcatctttggcaaggatctgcctcccagcacccctgtggagtcctgtctggatgggagggagagcagggccgtggacagcctccagaggtgttcccctgaaacctctgaatgtcaccagcacaagcaggctgggctgggctctcccggcagtaacaccaaccgagcacagccgttgtcctggggcatgccgtccaggttgggggacagggaggcagaggtcccgtgtcattgcccgtgagtccggggcttaggcaccgctctggggacccctcatgctggcccccaggcccactgaggcataggtgagaccattgcatggtccttggaagaacagggctcctcaggcagggagtggacagagccaatgctggcgatgggggaccttgcctcaagcagagtcgtgggagatggagtcatgggggcgtgtgggggtctaggcaggggagctgctgactgcaggtggcccagcagtacccaggtttctgctcgctcccattccacctccccgagggcactcgtgggaaagggaaacatggcacccagctggtgcctcattccacctacctcctgagtcaaagggctccaccaccccagacacacccagagcctggtgtccaggatgccatgtgtgtgccccaagccagtaggacccttgggaggctcagcaccccctgccccaaacaaatgcctctcccctctccacactcactggcattcccacagaatgccctcctgacttctagagctttccctgtccagagctccgggagcacaggtggcagggaattagaggcattagaagcacagtgtggaagctgggcagagctggctgagatcccactgtctcttccaggctggccttgagcaaagctcaaaacgcatcccacaggggtcagtacctgcccatgtggtgggggatattccaccaggtgaagtgtgtaagggctcagcagggagccttggcacatggtgagtccttggtgagggaaggctgttggtttggagaggtgaggcccacaaggccgtcagtccgccatgctgtgccaaccccagtgatgagaggatgaagccaggtcagggaggtctcatctaccaggctcccacctgagctggcagctcctcacgccatcccaagccatcagaactcaggtcctcgaagggaggcctggctgcccccttcctctggagccagacaggaccacacctcctgcgccctggggcttcactccaacaggggagcttcccagggggccgggagactcagaagaaatgcccacaactgcctggcatgtggtaggctttgcacaaagagcagtagcttcaaccccaatgacccacctctgtgaggggggcagagatggctctgggctcctctggggctggaggtcaggctctgcttaaaaccgttggttcctcaaggaccatgggtgtcaggtgggcctccccagctgagggcctggccaggacctggtcagggggtccttcattttcccctccccttgcaagaaggagcaggccagagcctggagataagtttgcagacaatttttacgtgagtagtttatgtttgttttgagataaaagtcatcatttccactacaactcattgacttttggtatattcacaatcatgtgcaaccatcattactgtttagttccagaacggttttttaccccaaagggaaaccccatatccattagtagtcactccccgttctcccttccccagaccctggcacccagcaagggcttcctgtctctggacaggcctgttgtgggcaccatgccgacgtggaatcaccgtgtgtctctggacaggcctgctgtgggcgccatgcaggcgtggaatcaccgtgtagtcttttctgtctggcttccttctcttggcataatgttttcaagatgcacctgtgtcgtgccaggtgtcaggacctcattcttctttatggctgagtcatattccatcatatggatcagtataaacattttgttaatcctggtggatatttgggttttttccattcagggcttttgtgaataatgctgcaatgaagactgatgtacacgcttttgtgtaaacatgttttcagttgccttgggtatatatacctaggagtagaatttctgggtcatgtggtgaccctgtgtttaactttctgagaaactgccagacttttccatagcagctacatcagttcacatccccaccagcaatgcccaagggttccaggttctgcacaccctcaccaccacttgctattatctgccgcttagattctagccattccttggagtagaaactggtgtttcggctgggcacagtgagtggttcatgcctgtaatcccagcactttggaaggctgtgacaggaggatcacttgagcccaggagtttgagaccagcctgggcaacatagtgagacctcatctctacagaaaactaaaaaattaaccaggcatggtgatgcactcctataatcacagctactcgggaggttgaggtgggaggatcacttaagcccaggaggttgaggttgcagtgaaccgtgattgtgccactgcattccagcctgggtgacaatgagaccctgcctcaaaaaaaaagtggtatttcattgtgcatttgatttgcatttcctgatggctaatggtggtgagcgccttctcatgtctagtaaccatttgtatatcctcgtgagcaaagcatctattcaaatcctttgcccattttaaaaattgggttgtcatcttgttgagttgcagaagttctttatatgttctgaatcctagatattgatcacttctttagtttacaaatattttttcctgtgggttgtcattattttcttgttagtgtcctttgatgcatgaaagtttttaaatttgatgaagtccatctattttgttgcttatgcttttgatgttagatttaagaagccattgactaattcaaggccatgaaaatttacacctacatttccttctaagaaatgtatagttttagtgcttcttacctttaagtctttgatccattttgacttaaatttgtgtatggtgtaagggagcaggtcccatgtcatacctgtgagtagccagttgtcccagaccattttgctttgttgttgagacagggtctcgctctgttgccaagactggagtgcaggggtgtgatcatggctcactgcagcctcgacctcttgggctcaagcaatcctcctggctcagcctccagagtagctgggactacaagcatgtgccaccatgcctggctaatttttttttttgagacagagtctcgctgtgtcgcccaggctggtgtgcggtggcgtgatctcggctcactgcaagctccgcctcccgggttcacgccattctcctgcctcagcctcctgagtagctgggactacaggcgcccgccaccacgcccagctaatttttttttttttttcagtagagacggggtttcaccgtgttagccaggatggtctcgatctcctgacctcgtgatccacctgcctcagcctcccaaagtgctgggattacaggcgtgagccattgtgtccggcctagtttttcaagatttttttgtaaagacagggtctcaccatgttacccaggctggtctccaactcctgggctcaagctttcctcccacctcggcctccccaagtgctgagattacaggcgcgagccactgcacctggcccatttccacttcctcctttccactctgaacgccttttatttctttttcttgcctcattgctctggctggaacgtctagcactttgttgaacgtggtggtgagagcacacgtcctcgtctcattcctgatcgaacgcggtggtgagagcacacgtcctcgtctcgttcctgatcgaacgcggtggtgagagcacacatcctcgtctcgttcctgatcgaacgcggtggtgagagcacacgtcctcgtctcgttcctgatcgaacgtggtggtgagagcacacgtccttgtcttgttcctgatcttaagggaacgtttgcagtctttcaccactagatgtgatgtgagctgttagattttcaaggatgctcttcatccagctgaagacggtcccttctagtcctaatttgttaagtgtttttatccttaaagggtactggattttgtcaaatgcttttctggcctctattgaaaagatcctgtgttcttctgtgaatatgaggtgttacattgattgattttcatatgttgagccagtttccatttgtggaatacatctaactcggtcatggtgtataatccatttactctgctgctgaatgtgatttgcttgtattttggtgcggatttttacatctgtatttataagggatattggtctggtgttttcttatgatgtcttcctttggttttgatatcaggataatattagcctcatagattgggttaggaaatgttctctcctccgttttttttggaagagagagattggtgttaattcttgctagaacctttggtagaatttgccagtaagcctatctggtcttgggtctttgggaggattttgattcgattcaatctatgtatttgttatagatcgttcggattgtccatccttgagtcagttgctagcttgtgtgtttcttggagtttttccgtttcgtccatgttatctcatctgttggcataccgtcgttcacgggattttattgatgtgtgtgaggtctctgagaacgtccctgccttcactcctgcttttagtcactggcatcttcttttaacttgggccatctggccgtgcatggttttgggagagtcctccttgactctgcagatgctgagcagtgatctggctgggaaaggggaccaggagtgcagggcacctgctgaggactcacctaagcccaagagtcagagagtcggagctccaaccacatctgcctgcatgcctttcccaggctctccccaggcggacagccagcaccccctccccaaagaccgggcagttcctgaccagcaccccaccaagtcctcagtaaggcctgtctttgggggagcagggtttcaggaggacagtgggggtggtgtagaactcatggctggcggttccgggcctctcaggaagctttgccactgggcttggggttaagtgggtgtggggctccgaaccctaaatgggtgagagttgaaatgaaagcggcacctgtagtccgtttggggtgcaggtgtgtgccaggggtcttcagccccggctgatggccacatgaaccacatgaggagaggcagggcgtgtcagcagcaaacctaagtgtgtgctcatttctgtgggcccttactctgtgacactgcagctctccagagagacgctttgaaaacaaaacaggaaagaacacacggccccgcgtctgttgcctgagtcactgtattccttaaaaggtgaaggaccctggtccttggcttttcgtgcacatgagaaaatgttggccaaggttagcgattatgcttctgtaatctgtaaccagaagtgctcttatgcccaaaccttgatgtgattctgctgtaatgtaacttcggagccagctggatggatgtgactgtgcaggtcctgagccccggcccccgtaaccaagcagtgggccgagacactgagccgggcagtcaaacaggagctctctaaggctgctcccgggctgggacctgggtctaggattctcagtaagacctttgaataaaactaacttgaattcttcaaaa

SEQ ID NO: 160 - DNA, 9963 bp, Homo Sapiens
gtacggcctgtccggcgctcgacgttccacccccctctctctgctctcaggttggttcagcccccgtctacactggggtggtgcttagccggcgccagaccgaccctcgacttcggagaggcagcgcggttcctctgggtgcttccgcctccccttctcctgcttctccagcctcttcggcctcctcgcccgccgcgggaacccgagaccccagtgtatgccccacccctgaccccgctcgcgacatgtccaccccggctcggcggcgcctcatgcgggacttcaagaggtaaaccgaggggacggccgaggccgggggttgcgagctggggcacagggcgggtcccgaggcgcgccgggcggggagggctggggagcggccgggagcgggcgccagtgccggcctagggggacccctgtctgtcttcccgaaggttgcaggaggatcctccagccggagtcagcggggctccgtccgagaacaacataatggtgtggaacgcggtcattttcgggtgagtctgcgttcgtggcggtggcgagaaaactggggacgcgagcagcttcggtctgcgctccggggcgggccccccgcggaggccgagcgggtaggggaaaatgtttgggtctggctgggcctaggcgcctccccggagcctgtgcctcgattagctcagttcccgctgccagggggaaccgcttggggttctaggggggcggggcggggagtggtggcggttaggcgcggcggcttgccctgtgtctctgagcccgggacatccatttgtagtggcttccgaccccggtagcggtgctggagatggcagagctcgggatagccatctcagatgaagcagggagaagggggccccttaagtgggaactgaccatttttctctgtgttgcaggcctgaagggaccccgtttgaggatggtaagagagagtttctttacccacttttcaggagcctggtcatctggggaaagggttcccagtcatcctggaagtgtctcctgcttaggaacctgcctctgcctagcctctgtctgctaaaggcttgagtggaatgcagtgtgtggctggtggttctggatattgtatgcttgactagaactgcacctttcttcttgctttcttaaaaaaaaaatctgtgtaaggcagtcactttttaaaaggagcaatcatagcactggtattaaggatttttgaggcttgggctgtaattctgctaaattcagccctccatcactgaattagtataaacccaaccagttgctgataggcagcagagaccccagagaccatctggttcagaattctaccccaagggcaggagttgtgttcagcaggtgcttggtagatgtgtgttggatgttgagtggatgcgagaatcccttgcgtacaactgtctggtttctacaatctgacattgaatgcctgtcagcctcactgctctaagatggtcttaaatgcctcatttgagtacagtattctttcttatttttaagtgaatttgcagtgtgtgctttcatcaagacgttatgatgagtaatttcaaagcagcttcacaattgaagttagccttaatgtacccttttgatcagtgtcctgcctacctgaaagtactacatgtaccagtaggtacataatttttaattgatttaggtttaacttttaaaaacacgtgtaaattgctttttaaaaactttctgattttagataattatagattcatatgcagttgcaagaaataatagagacaccctttatacccttaacccagtcctctacccaaaccctcccatttggtaacatcttgaatgactagaccctatcacaaccggaaaaatgacactgatagttctacactcagttgtgtgtgtgtgtggttgttttttgaaagtttaatacatttaaaggatgattaaagtatttgaactcatgaaattctttaatatttgaggttttaaaaaaaaggaaaaggatctttctgttatttttttcctcaatgatttccttcggtcacatagcatttatacacacacacacacacacacacacttcagtttgaaggtgggaacaaaaacatttctgcaaactacttaatacatacttatgttgctgagccggattgctttttgatgctaccagtccacaaaatgttgtgaggtaagtcaatttcaactaagtctgtaattcatctcaagtacttagatttccccaggaaactgtggacagtcacctgaatatttttagcttcctctttacctttaccccctgggtaaatatcattactcttcagggctgcaaagaaaagaaatgacagcaggaaacagtgattgtaagggcatactactttggcgcagttaatcatttgaactgatttgtagcaaaaaactatagctagacttaattttcttctaccagattggcactagtttttttgtttgtttgttttttgtttttgtttttttgagacggagttgcgccctgtcacccaggctggagtgcgatggtgtgatctcggctcactgcaacctccgcctcccaggttcaagcgattctcctgcctcagcctcctgagtagctgggattacaggtgtgcgacaccgcgcccggctaattttttgtatctttagtagagacggggtttcaccatgttggccaggctggtctcaaactcctgaccttgggatccacccgccttggcctcccaaagtgctgggactacaggcttgagccaccgcacccggcgagcactagttctttatacctgagctttaaatgtacagattaactgtgtttgctttagctctagtaggccttgttttcattggcttcttttttcctcgttttactctgttttatgctgggcacagctttattaatagtacatcactttgctggggattggctacctaaatatttcaagggtgcttctcttaagtggtatgaattgaaaaggtacttacagagtccattatctaccaggactgtcacctttgacattactggttctatttttgatgatgtgtatctccatcctagcattactgaaaggaattactcaggctgatttgttctgttgaacagtctgctaccgatggatgcttcctcaggtgtctggaacactgtggcctgtggttcccccacaaaaaaaattttagcttttttttttttttttttttttgagatggagttttgctcttgtcacccaggctggagtgcagtggcacgagctcagctcactgcagcctctgcctcccaggttcaagcaattcttctgcctcagcctcccaagtagctgggattgcaggcacctaccaccatgcccagctaatttttgtattttttagtaaagagggggtttcactatgttgggcaggctggtctcgaactcctgacctgaggtgatccgcccacctcggcctcccaaagtgctatgattacaggcatgagcagccgtgcccagccttaaccattttttgaataccctttatttatagttggggaatttacagttagagaaaagactgattagggataagtggcatagttgattttgctgtttccaatgtattatgttattaattaagaaccccaaaactacttttgcttctttgttgtaaaccgttcgttatggaagtttctggaacaaccaggtcctagttagagtgatgaaatcttaagacaagcaacacttaagggtattttggtttaacttcacacactcgaagtaagaggaatatattctcaagagcttacactaccaaaacattggggagaaatgcttcctcatcagaatatcttggtatacatgctaaatacaaaggttatggaatataatcttcatcacataatctaaaaattgttaatagacatggtaaggtactggtatttgcttttcataatagatgtgttctttagaattggggtataaatcgtttttatttttttttaatttttggaaatgtttctgagtcataaaatctttttcaaaatgaatctctaaagtccactaagagtgttttaaatataaataaatcctatgatgaagagttttggatattacttgaaaaatcgattttcagtcatcaaaaataattttgaagttatatgtattttgctttcttctcaggggtcacaaactggtggccaaatggcagaaaacacctgcaggtgtgttttctttggccaacacagtattttccaaaacttgactttgtgagtgtctttaggcagaacatataccccctctagttcaaccatatcactccttattgccatacaccagtcacttaacacgtttatgtaattttggtggtctccctgtatagatggattaattgatactttccttacgatgtcttagcctcctcgggaagatgaacaaaattagtatacattatgtacaacaatggtgaggcttaaattttcagttattttaaagcctagccttctaaatattcagagggtaagctgtagtctcaagactgcataatactaattctgggattttaaattcccttaacatttgttttagagcttagaaattacattgaaggttatactaaacaggttctgattagtgtgactaaaagtgtgaagtttttaccctctttttaatgtgtaccttgaataagatttgggttgtcttaatttatattcaagtagacataaataggttgcttcacttctcaagatattaagtgaactgttttaaaagacttgcgattaacttctttggtagctaggtaatcacttagttgaacttctgggcaagtgtatgcagaaagctcaagtcaaggaacttgtgagccaccaatataggtactcaacttgctttgaactgtgagtgtttgatgtagacctaaaagtactgtttaatatctgaatgccttaattgtatatttcttactgatagttctgatttttgggttttgcctccttcagctgagtctagagatgtgaaactttagaattattatagcaaaaatagttgctcatggttttggagcacttaactttgtggaactatgcatattcctctcatttaaacctcacaacaatgctatatggtgggtactatgattaatctcattttacaaatgaggaacttaaggtttagtcaaggagaacaccttccccaaagtctcacagctagtaagtaccaaagcaaggacttgggcccagacctgtctgactgcagagctcatgctcttagcagtgtgttttactgtttttgcttatggcttccctatgtcttgctttactacctttagataccatatttagtgatggttttgaagtagctgggatctccatgtgctattacatctgcccagttttagagcagtgtctcttacccataatttagtcagattgcaacattgatccaaatgtgtttacacttgagatcataatacataaggaaactcaaagttttgaactctaacacattcccactttttcttgcatattatagtgtcaataaatactgaaaaggaagaactgtgctttcttcctcagaaagaggaagatttatgaccaggtggtgataaaggtgaagtatgttctgatggacatacttccatacttctaatgggcatatgtttgtccattccataagattttactttcttagttataatacatagtatcttcaggtctggctttgaaaagaaaatagggagtaacaataatttgaggaatataatgtctctgtatgttgcattttatattattttgaagctttgagacacttgttcatagtaagggcagctttgttagcaaattgtttccaatgagcttgctaaaaacaaactttttgatactgttttgtcacagatctagtcctagaatgattatagtcttctctctttcttaagcagtgataaaccttttaatgagaacaaaaaggaaataaattgctaactctgaaggaaccagtaagaaatacactgaagtatggtctgttgttttagaataatttgttaaatggaccagagtaatatagtggaacatgcatcaccttataccatatagtaactgattcttctaagtttacttgaacagatttcagtcaggaaaaaacattgctcaattgtgttcttcaatttattcaacaaacaattgaaaataatattttaaaggacataatctcttcatatcacatcttaacaattcttgaatgagatccagtttgtccatgccttgtaagtaagtttataacctactatgctttagggcctcctgctaccttaggttgacatatatttaagaaaaataatttcatttcaatagtagcataaacattagaaaaataaatttgctggaaacatgaatgcaatctaaaccaaatgtgattttaaaattatttctgccattaattccctccatatgtgtgaataattgagttgattttatagtgaagtaccttatgagccatacttaagggtttctgagagggactatgaagtttttcctggcttaaattcaattaagttttcattatagggtcactatgacatgaaaaggaaccagtatgaacacttttatacttattcccttctattttaaaaataacttgattatggatttgtattctggcattggtttttgaaccattgtgctttcattctttctagtctgtctaaaaatcactggagcgtttaagatggcagctgactaacataggcctttgaggtcttttggtcttctaaaggaagaaggccaaattttgggcccagtttcttaaggatgttttcaaaatgtacagtggctaaaatcttgtaagcagtaattttgtgtttatgatggctgtctccaagtttgggggaaaataatggcaaaacaaaaaatcacatttgagtagttcttagagcaattcctagagatgtatttcttacctggcctttcctctctaccctgtatctttgcattatttaatacttggaaaaacccacatagcattaaaaacaaagtactactgaacaaagtgataaatacattttcttaaatctttcttttctaaccacaggaacatttaaacttacaatagaattcactgaagaatatccaaataaaccacctacagttagatttgtctctaagatgttccatccaaatggcaagtatcacttttagtacagtgttttaaactactatagtgtttattatggagtattccacatttcctgtgtattttgtggtgcctgagtatttgtttaggcagcttgctgcttcttgaaagctgaacttgttcttggttgtctgtggctgtcttgtcctagaactgaagcagtggaggtattttccctttgcttggagtctgggagcctcctgattttgatgacctttgtcatttacttattaaacaaaatgaaggatgctcttgaggtttccttttaatgctaggccagattgggatagtcttgtgttgtaattattttcactagcgtttagaaaagtagttttcattggacgcatatcagaattactgtggaacattttaaaaacacagatgccttcgccccactccaaacctaatgaataggattctgttgttgaaggccaggcatacggtattgtcagaaaagcaccacaggtgattctaacttaaccactttgcactttttaaaatagtagtaagcctagaacagcttgccttttatttaggttaatgaagtatttttcagggtatcagatatgtttatctttatgccaaaatgaaatcttgtgaactctgagtgatcttttgttatttcagataggggatacagcctacaaatttggtggaatgaatttcccacatgtctgtggatagctagggaccctgttcaaaaatgtttctgatttcctggataatagggcagccttttccaaaggatgaacactaaatatcttccagttttatactgatcacatctgacattctctgatcatcctgattatttcactagtggtggttatgacttatctttttaggcagttaactgggaagcaacataggaatctttaaacttcaaaagcaaagtattcttgactatttttgttttgtctataatgttaaaaccttagtggtcttgttacgtttaatgtacctacttctttgttcttagtctatgcagatggtagtatatgtctggacatacttcagaaccgttggagtccaacctatgatgtgtcttccattctaacatccatacaggtgaatttttccttaatgtgacgaactataacttttaatatgtttatattagcaattgaattgtttttgaaagtcataatgtaatagatctttttatttttggtcaaagcttgtttgttttatagatgaaaagtagaccattaagacccaagtcagctgggtacagtcgctcacacctgtaacctcagcactttggcaggccaaggtgggaggattgcttgagttcaggagtttgagaccagcctgggcaacatagtgagactcttctcccttaaaaaaaaaaaaagccgcatatattttcctagctactagcagattcacataactctgggtttgtatgctaaagacaagaaatgtagctgtacttaggacaattcaattgagtgtcactaccttataaaatagttgttttgcattaaggaactgacattttaaaaattgtctctttagtctctgttggatgaacccaatcccaatagtccagcaaacagccaggctgctcagctgtaccaggagaacaaacgggaatatgaaaagcgtgtttctgcaatagtagaacaaagctggcgtgattgttgaccccgggtacagtttaaagaagctggccataagaaaaatatatattgatgtgtttgtcacctccctactcctgtcattacatttactttattaaaagcaaaataactgttgtgctgtttccatcttccttgccaagttttcctaccccttctaccctctccttaaacatcagaaaacaccctctatgaaatcaaatgtactgtacctgggttacttgcaaaaattactaatgcttcagtttttctgttgtatttcatttccagttttcaggcagttatttttattattgtactttaagcttttaagatgaattgttatacaagaggtgcttatgcttagcttgatgaccaggatgttatttttaacaaaatgattgctgaagtgtttcatcctggctggtccttcacttgtgttggatttagaagtgaatgtgtttggaatatggcctacagagaatagaaacaaatccatgtaaacaattttgaaggaggcatgggagctaaaaatcctgtgatactaagatctcagtcatatgaattacaacgtagtatttactggcaagaaggagaaagttgaaggactcagctaaaggagtacagcaattgtagtaactgacacatcctctctttgcaagctgctgactgggcacactcatgccaagtttcagaattattggtcttctgggtttttgctttttaaaagaggtgtgggagcagaggaatggaaacaatcgtgagtttttgagctagggaaagttggagctcctttaatctttttaaaggatcagtgctgccctaagtgaataaactcaattgtccatctttattttagagttttaatgaattcaaggaagggagcatagcatatctgtggcaaactattttccactcaaatcctgagttattgctgcatgctttaatttcttccctttcagcatctgagaaccttaaagccaatgtctgcgatctttttttggatatttatacttttagatatatagtacctttaagtagcagtatgggacaaggcttgtaaatgttttgtctaatgttctattgtcaccttttatgcatttatcacttccaaatctaactttgcacaagtaacccatgtaaaaaaaaatgtacatttttcaaaagttgtaaataaaaataaccttaaaatttcatagtca

SEQ ID NO: 161 - DNA, 20933 bp, Homo Sapiens
atgcgtccctctttctccaccccgccgagcctaaactagtgacggggagggagacgggatagtgtttctgtttcgtggtctttgaatccacaacctctagtctgaacacagagaacacaaatttgtctattacttcaggaagcccagggggaaccgcgccccgctgaagggctcggggaaggcgcgctcccgcgtcccgccccctcctcccccagcactcacactgtggtagcggcggagggcggagggatccggaggcggcggagggagacgtcattgcagggttgtttgtcagtctcggcggcggcggcggcggcggcggcggcggcgatccacagtgattcggccgccgcgccggggggtgggggggctgcgcgggactttttttttttcagactgaccgcggggcagctgcggagcatgtcgaccccggcccggaggaggctcatgcgggatttcaagcggtaagggccttcaccttcgcctagatgacggcccctcaaagctgcggggctgcagggcgtggatcccagacaccttcccctttgtgaccctcagagggccggctgtgggcccagcgggactggcggaagccgggtcctagcctcggccctactcccataagctttgccgctcgttctggcgcccgaagaaattttgatactgcttcccctccccacaaaaagtaaaacggtgtcgatcgactggtctagggttccctgctgcccatttcggccagctgcccggcgtctcgcccaggcgatcagacattatccgcccgcccctgcaccctgcggcgcccccttcttgtcccctcaaagtgagctcctgcgggagcttgttcctctccggcagcaccagtcagctttgtttcacggccccgccgtcttctccgaggagccgtgttggggcgaacccctctcccgactcctgccaatcctttccatttgtgccctgagggtggggtccagtgcgtgaggcccggaggttaacccatcccccgaaacccgactctgtccccgcccgcctgaaaggaccttgggaactgacttagagatctgggaccttagagctggccaccccggctgccagtgctttctggaactcagctctggctggtgaagaaagcccctatctatagcctcccgagtctggaaaaatgccttcccttagactggcgctaatctgatactccctgggcctcctttggtaaataaaatagggttttgttaggaggtattggggttgtgagatagaaaatgattattccgttgtttaccttttattggatacttagagacatagaaaaaataagtgagaaaacatcattttgatactctgcacatttttcttaacattttttctggggacacctgccctaattgaacaaaatatctagcataaaaacttagatttgtcgctcaggaagtcacctctcagctattataaagcctatgtgaggcacttggatttggccaacttatttaattcattcgtagcttctcttagccatttaaaggtaggcgtcaagcagtgcagttcttctaaggcttctgttcgtggtggcctaatttgcttgagattgactaaaaaccatttttttaatgtggactagttgcaaattatgatgccccatgaaaaacaactgcatatgtatttgtgtgtgtatataatgtagcatttttaattgaggttacagtctctgaaaggagatgccctttttggtgcaaaagtcatctttctaaagcttgaaatcagcgtatttgattagcactcatgacaaattcagatagtaaactagttcatgtcattgtcgccctggctccttactgtaatgctctgcttaattctgagttgaatgcatggcaccttttgtagtttccagagatctgcaggttacaagaatttgactatgacgaatgttggaaagccttgtgttgagtctcctgatctgagaggtggatttggtgttagtgcagagcctttaaaatagggactggcagaaaacctactaattactttttaaagccattgctgtttgaagcaaaaggaatagagtaaatctgctgcctaatactagtttcctagttaaatttaatgtgttttcagtcattttgtgtttacactgaggtttgctttttttttttttcttgtagccattttgcagaagtagcctggttaggatacacagtctttgcatgtttagagcagcaaaatcaatggttctgtaaaaatattacttgcttttgaggttttaaactttttttggtataagaggacagtctatatacatcaattctttttttttaaatatattttaattatactttaagttctagggtacatgtgcacaacgtgcaggtttgttacatatgtatacacatgtgccatgttggtgtgctgcacccattaactcgtcacttgcattaggtatatctcctaatggtatccctcctttctcctcccgccccacaacaggcccctgtgtgtgatgttccctttcctgtgtccaagtgttctcattgttcaattcccacctatgagtgagaacacgtggtgtttggttttttgtccttgcggtagtttgctgagaatgatggtttccagcttcatccatgtccctacaaaggacatgaactcatccttttttatggctgcatagtattccatggtgtatatgtgccacattttcttaggctagtctatcattgttggacatttgggttggttccaagtctttgctattgtgagtagtgccgcaataaacatacgtgtgcatgtgtctttatagcagcatgatttatattcctttgggtatatacccagtaatgggatggctgggtcaaatggtatttctagttctagatccctgaggaatcgccatactgtcttccacaatggttgaactagtttacagtcccaccaacagtgtaaaagtgttcctatgcatcaattcttgaagagataatattgaaagagggatgattctcaagccctttcaatttttagataatttggagaggtatttaataagtatatatacctggttaatatatttaagtcatatggttcattttagttcacaataacaaggaaatggagttagtctgtgtctcaaaatagatggtatagtgtctgtaggtgtttacgtggcctccttagtggccttaatgttcaactttttaaattaccacgctggatttccaggttacaagaggacccacctgtgggtgtcagtggcgcaccatctgaaaacaacatcatgcagtggaatgcagttatatttgggtgagttgaaaggtttaacaaataataggtgtgtgctgaatctttaagaaaagtaaacatataacaactgtctaggaaaagaaactgaggtggaatgagagatcttaaggactaaaactgcaagataaattagaaaaaaaaaatatttcaattagagttttggcccagcacagtagtagctcaacgcctgggaggatcgctggagcccaggagttcaccagcctgggcgatatagtgagacagtgagactctgtcccctccccaccaaaaaaagttttggcccagtctgggcaacatagtgagcccttgtctctacaaaaagtataaaactagctgagcatggtggtgcatacctgtggtcccagctacttggaaggctgaggcaggaggatcacttgagcccagaagtttgaggctgcagtgtgccatgattgtgccactgccctccaacatgggcagccagcagagccaagatcctgtatcaaaaaaaaaaaggaaaaagtttcagcagttatataaagtttatttgctctttgatgttattacatatggttttataatctcttggggttttacttttaaaatactattcaaaactaaatggaatggaataataaaggagaaacaataagttactttatataaaacatatcacgcaaatgctctcattctgttggagctgttaaaaggtttggaaccaaaaatattaagaacttccactgtggcaagaatttaagcgaaaatgattcacagcccagtgtgaaataacagaatgcagccatttgagaagcagttgtaaattttacctactatgtatattgcgtatatgctttttaatttaaaatttccttatgctttttctttggtttttctagacttgatctattttttctttcattcctttgaaactagagttttgcattaaaaagtaaaaggagtatgttgataaacagaattctgacactacagaatcagctacaagagtctacatttaaagactagtggaaaatgagtgaagttcatcctcataaagtacttctgaatttgagttgaatacatggcaccttcaggatattatcctgctgctttgagatcctgaatatgccttgcaagtaataattaaactttatgctccatcctggctaacacggtgaaaccccgtctctactgaaaatacaaaaaaaaattagccgggcgaggtggcgggcgcctgtagtcccagctactcgggaggctgaggcaggagaatggcgtgaaccccagggggcggaggctgcagtgagccgagattgcgccactgcactccagcctgggcgacagcgagactccgtctcaaaaaaaaaaaaaaaaaaaaaaaaaaaaactttatgctgctgcttaggaaagatgaaattgggatgtggggacaaggatctgagcaaacaaatctggctttttggtgacaactatgcttagcctatttgaacaagagttatggctccattggaaagcaggacacttgggtttagcatcataactagagtattgctttacatcatattgctgtaaaatgaaaagatgtcttttcctcttaagaatatacatatgggccaggtgcggtggctcacgcctctaaatcccagcactttgggaggctgcgatgagtggatcacctgaggtcaggagttcgaaaccagcctggccaatatggtgaaaccccgtttctactaaaaatacaaaaattagccaggcatctgtaatcccacctactcgggaggttgaggtaggagaatcacttgaatccaggagaaggaggttgcagtgagctgagatcatgccattgcactccagcctgggggacaagagcaaaactccgtctcaaaaaaaaaaaaaaaaaaaaaaaaaaatatatatatatatatacacatatgtacaaaatgactggtcagtattaatgaaagtttttttgtgctaaaattatgggcaagtttttttgtttggtttggtaaaaccaccctaaaaagaaagcttagaatgaaagttaatactttatgcctgggtctatgaaaatccagggctaaggtgttactaaactctatcttaaaactccacaaatcatcagaatgagtccctctttttctgttgaagtttatcctttccattcttgaaaatcaagaaaaagcagaatgagaaacttcttttaatcagaaatcttcttgttttcagaccagaagggacaccttttgaagatggtaagtcatactcattatgttttctatagtgttatgaggttactttttagtagaaaattgtaacaccaacatatctacttgaagccattttctatggttaataggccaagttaaaagtaaagctatggaaaatttatacttcataagggacttcttcccacagcagcttggtcacctccattggtaaccaatattaaaggttactttaatattttcctgtataactgtaagcctggatggcagtgtttatgttgagaatagtttaaatttaggtggccttaaagatatctctgaggtgaacaccagaagagtaaatcatgcttttttactttgttatctttgatattgacagggtgttgagctgaaatttttcataaacatacatagctgccagtagtttcaagtactactagcatttaacacccataagtagttatcattttgcataatctttggcatctcaagttgggtattttcatcaggggctaggaaaatgggaaactagttctaataccgaatttataattgaacttatcaaactgattttaaccaggaacttagacttttcccaattgtagtgttggattttaagaaattattaaacatctttgttatcattaacaaaatgacttcagaattaatccatcaaaaatatttatccgagaatactgactgcagcagtttgtaaggacgtaacctgaatgtccagtaggagaaatggttaagcaaattatgatgtatctggattctggaatatgtacctgttaaagaataaggtagatttggacatactgtcttaagaggacaaaaaaactgcacgataatgtttgtcgtagcatcacatttttagcaaatacatatatgcatgtgtgtctatgttaaagggttatatatcaaactgttaccagtgattatctgtggggggggtaaggagttgaaggaggtacttaaggacgttaccttttttctctacatcaagggttctcaagtgtgtgatccataaaccccttggggtcttggagaccctctcgggggacccatacgatcaaatctcatcatactaagactgttgacctttgcattgatggtacaaaaccaatggtggctataactacacctaagtagtttcgtatcttagaacaaatcaaggcattagacagtggcaccaaaccatactaatagtgattatattctttgcattttaaaagatgccagttggccaggggcagtagctcacacctgtatagccagcactttgggaggcttaggcaggtggatcatggatcacttgagcccaggagtttgagaccagcctgggggagcccttctctacaaaaaattagccaggcatggtggtacatgcctttagtcccagctacttgggaggattacctgagcccaagaggtcaaggctgcagtgagccctggtggagccactgagctccagcctgggtgacagagtgagaccttgtctttaaaaaagttaccaatttttcttaatttcttaatttaaagacatttttattagtattaggaagctctggacccttgagtatctatgtgggttttttttgtttgttttttgttttttgtctcgctctctcacccaggctggagtgcagaggcgcaatcttggctcactgaagcctccgcctccgaggttcaagtgattctcgtgcctcagccttccaagtagctgggattacagacatgtgctaccatgcccggctaatttttgtatttttagtagagatggggtttcaccatgttggccaggctggggccttaaactcctgacctcaggtgatctgcccaccttggccacccgaagtgctgaggcatgagccacacccagccgagtatctgtctttttaatattctgtatgatatgaagtagaatgtatgaacaaagcacttctgcatgtcatagtatgatagttgtctggaagaaaagcacttctacagttgtttgagttgcaatttgaatgactttttttcatggaacattttttacttgaaaatacagacaagctgtggttattcaggtttgaatatatggcagacatattctcagaagtaatgtaataagctcggtgtggtggcgggcacctgtaatcccagctactcgggagactgaggcaggagaattgcttgaacctgggaggcagaggttgcagtgcgccaagatcgcaccattgcaccctagcctggacaacagagcaagactccatctcaaaaaaaaaaaaaaaaaacagtggggggatctaagtgggttgttaggttaaggatagcaactgaagatatttgttgctgttgataaaataacagcttcctgatacttactttttgatgagattagtgggtagtgttacctgttgtgatttttttgatagtatataatggaatatggcaacatttggaggatctgtaaactcgagtcacccaatattttgcagatgtcccatgaataataatacaaaaccatgaatgggtaaaacacgtatgtgaagtgaacagattttaatgtaactgagtacaaaaagttgactaataatttcagattctatattgcagcaaacctttaaaagaactaccatttcttctttggtataatatcaaaacagaatagctacagtcacctgaaaaagctattcaaatactactttttttgctgggtgcagtggttcatgcctgtaatcccagcactttgggaggccaaggtgggcagatcacctgaggtcaggagttcaagaccagcctggccaacatggtgaaacgtcgtctctactaaaaatacaaaaatgagccaggcgggatggcacgtgcctgtaatctcagctaccccagaggctgaggcaggagaattgcttgaacccaggagacggaggctgcagtaagctgagatggtgccattgcactccagcctgggcaacagtgagactctgtctcaacaaaaaaaaaaaaaaaaaaggaagaaagaaagaaagtactccttttttcaagtacatatttgtgtgaggccagattttcttcatgtacttaaactaaacggtattgtaatagatggagtgcagaagcagataagagaatccagctatcttctgttaagccagtcattaaagagacagttgcaaatatgtaaaacattgcttacacttatcaccaacttggggagaaatataattttaatttatattctgtgtaatgggtttgcagtttaacctaccttttttttttggagacagagtcttgctcttgtcacccagactagagtgcaatggcgcgatctctgctcacagcaacctccgcctcccaggttcaagcaattctcttgcctcaccctcctgagtagctgagattacaggcacccccatacccagctcatttttgtacttttagtagaggtggagtttgaccacgttggccaggctagtctcaactcctgacctcaggtgatccgcccaccttagcctcccaaagtgctggaattacaggcgtgagccaccccacctggctacagttatttttaatgaagattttctgagttaaagtttttttgtgtgtgtgagacggagtcttgctttgtcacccatgccagagcatagcggcatgatctgggctcactgcaacctccacctcctgggagggtcctttgccatgtggtagtcagaccctctcaaaatcctttaaccaactcccattctaagctataataaactatttgtagttcttcaaatatgcattttaaatcttggtagctagggcctagttgccttccaaaaatatgacagttaacactcccaccaatagcaacatgaatgtgcttgttccccaaccgcttgccaatgctgcgtgttaccattctaacataaatagagtatatttaggatgttttgtatgccgaaccaacgttgacatactaacttttatgtggttgtacaaaaaccagtatgcagttgagaactgatgaagagattaaaaagtcgtgcttgtctttactataattattttgttttctctctaggtacttttaaactagtaatagaattttctgaagaatatccaaataaaccaccaactgttaggtttttatccaaaatgtttcatccaaatggtaagtagcattttatagattttgcagatgatagtggggaaaagagttgtttccctccttttagctctttcaccttactttttactgttagggctcacttgtaggtgttgcttccatgtccatgtgagccacgtattttgttgtggatttttttttttttttttttttttttttttgagacggagtctcgctctgtcgcccaggctggagtgcagtggcgcgatctcggctcactgcaagctccgcctcccgggttcacgccattctcctgcctcagccttgtgagtagctgggactacaggcgtccaccaccacgcctggctaattttttatatttttagtagagacggggtttcaccatgttagccaggatggtctcgatctcctgaccttgtgatctgcccaccttggcctcccaaagtgctgggtttgttgtggatttttggtttgtttcttatttcttcagagacaaagttatactctgtcacccctgctggagtgcagtggtacagtcacagttcactgttacctcaaactcctgggttcaagtaatcctcctgcctcagactcctaactagctgggacgacaggtgtggaccaccatgcccagctaatttttttgtttgttttctttttcttttttgtagacacaaagtctctgtgtgttgcccaggctggtccttgaactcctagcctcaagcagtcctcccactttgacctcccaaagcactgtgattacaggaatgggccattttttccagcctttagctatgtttctgtagctagactcttacaaagcttccaaatttgaggtcaagttgttttaataactcctgaattaaaagtaatacatggtcgggcatggtggctcatacctataaactcagcactttgggaggccaaggtgggcggatcacctgaggtcaggagtttgagaccagcccggccaacatggtgaaaccccatcactactaaaaatacaaaaattagtcaggcatgatggtgggcacctgtaatctcagctactcaggaggctgagacaggagaatcacttgaacctgggagacggaggttgcagtgagctgagctcacaacactgcacttcagcctgggtgacaaaccaagactctgtctccaaaaaaacaaaggtaatatgtaagccaggcacagtggtgcacacctgtagtcccagctactccagaggctaaggcaggagggtggcttgaggccagcctaggtaacatagtaagatcctgtctctactaaaagaaatagataaaagtattatctatttatttgtggaattgtgaaaaataagaaaaatctgttggctaaaattaagcttttcaaaaatacaattttggccaggcgtggtggttcatacctataatcccagcaccttgggaggccaaggtgggaaggttgcttgagaccaggagtcagagaccagcctgggcaacatagcgaggtcccatccctataaaaaacaaaaaaaatatcaaggcatggtggcgcacacctgtagtctcagctacttatggaggctgaggtgagaggatcacttgagcccaggaggtcaaggctgcagtgagccatgactgtgccactgcactctagcctgggcaacagagcaagattctatctcaaaagtacaattttgcatatacaaagttggagtcaatgaccacacacagtggttcatgcctattaattccagcactttggaaggctgaggagggtggattgcttgagcccaggagttcaagaccagcttaggcaacatggtgaaaccctgtctctacaaaaaatacaaaaattagctgggcacagtggtgcgtacctgtattcccagctactagggaggccgaggtgggagaattgctggagcctgggaggttgaggctgtagcaagccatgattgtgccaccgctctccatcctgggtgacaaagcaagaccctatctcaaaaaaaaaaaagaaaattgggatgttatatataaaataaggtgttttttttggtttgtttgtttttgtttttttaatatactgtgaacattttccttaataaatattctgggctgagtgcagtggctcacgcctgtaatcctagcactttgggaggccaaggcaggtggatcatgaggtcaagagatcaagaccatcctggtcaacgtggtgaaacctcatctctaccaaaaatacaaaaattagctgggcatggtggcgcatgcctgtggtcccagctactcgggaggctgaggcgggagaattgcttgaacccgggaggcggaggtttcagtgagccaagatcgcgccactgcactccagcctggcaacagagcaagactccatctcaaaaaaataaatattctgatacatcatttttaatggcaaaatgttctgttacatagatttatcatatttttaaccagtgtccaattgttgatagttttcagttgtttacaattttaaatagcactttgaacattcttaaaaatcttaaaaatttttttgttgttgagaaaaacacttgctgtgtcacacaggctggagtacagtcgtgtgatctcgactcatcgcaaccattacctcccgggttcaagtgattctcttgcctcagcctcctgagtagctgggactgcagatgtgtgccaccatacccagctttttttttttttttttttttttttttgagacagagtcttgctctatcggccaggctggagtgcagtggcatgatctcggctcacggcaacctctgcctgttgggttcaagtgattctcttgcctcagcctcccaaagctgtatatccagctaatttttatatttttagtagagacggggtttcaccatgttggccaggctggttttgaactcctgacctcaggtgatccgcctgccttggcctcccaaatgttgggattacaggtgtgagccaccgtgcccggcctcaaaataaatcttttcagatactaattattattttgattgagttttttgtttgtttttttaattgctgcataacaactagactaagttttttaaacgtggggattactgggtcagaggcttgtgtgtttttaaagcttttaatgtcattttccatttttttccttcagtggaattgttctcattttcacttcatagagtagtttgttactattcttcactaaacgatggctaattcctttgtaataaatttggtcttccttgacatcttgctgtttacatctattacatttatatttctgtattataaattaccatgtgaaagacttctccaaattcttgaagctcctcttcagtctcacagcctttgctcatttaaatgtggcgttccccatcagccaactcactttcaggaagaacattttcagaggtcctcttggtcgtgtctctagtactgcagaatacattatagagctccctacccagaggagagatgtgtttcgtttgtgtctggaatcaaggtgactttccagtaatagatactacctttggcacttcatttctgtgaagttgctttttccttctagctgccttttttgcttttttttttgtccaagacaggtttaattttattttctgtttctctttttggggaagttcccaggtcatttaccatttattccactgtagctttatcttgcttagacttgttattgagtcaaaccaaaccaattatgataagggggtctttaaataaaggtgggaaagactgtagaatgagtaagggatataaatatagggttatcacttaagcaaatttttaagaaaccacagtgtatttggttttcacatctcttcatatttatagcatggtttcccttttattctgctgagtacttttttataatttaactttctggtttatttttttaaaaacatttattgaaatataatttacacaccaagctgttgacccacttaaattgtacaactcaaatggtttttagcataatcataaccatcaccatgaccactttaaaaacaacaaaaagccccataactattatcttagcagtcaactctgtttgtcttaaccctccccgcttcagtcctaggtaagtgttacccctaacgtgttttccctctagatttgactattctggatatttcatataaatggaatcttatactatgtggtcctttgtgactgacttctgtcacccagcataaagttttcaaggctcatctatgttgtgatataatagtatctgtgattcattttttattgttgaataatattccactgtatggatattctgtattttgttcattagttgataagatatttgagttctgatttacttttggattctcagaaatagttactcagaactttaaaattgttttacacttttatgggttttacagagttactaatttttgctttgggcagctaagtttgatgtttctgtgggatggacagtaagttggctttgaagctgagagatagatctaggctaaggccaatgattgggaatactgagcacatggatggtaactgaggccacaggagtcaataggattgcccagtgtgtgtgtaaagggtaagaaggaaaagggcttaggatagagtctggaagaatcacagtgtttaagtgtgatttgctccccactctctgttatggtttgctccatgaaatggtatctgtaacatttaaatgaatttactctttgttttacatagcagttcacttctagaaattttttctacagatagtctcacaattgggcaaatacttaacgttcattgcttgtattttcacagaatcagtctaaaaagggaagaaccctcccagatgttcaggacttttgatacctgttagtcacttgatttttttttttaatgaaaggaatatgtatactcattgcacaaataaatcataaacacaaggaaggataaagaaaataagataggccaggcacggtggcccacgcctgtagtcccagcactttgggaggctgaggcaggtggatcacgaggtcaggacttcgagactagcctggccagcatagtgaaaccccgtctttactaaaaatataaaaaattatccaagcatggtgatgtgtgcctgtaatcccacctacttgggaggctgaggcaggagaattgcttgaacccaggaggcggaggttgcagtgagccgagatcacgccactgcactccagcctgggtgacagagcgagactccatctcaaaaaaaaagaaaaagaaaagaggatcatctgctgggggcgctgtggctcacacctgtaatcccagcactttgggagaccgaggtgggcagatcacctgaggtcaggaattcgagactagcctggccaacatggtaaaaccccatctctactaaaaatacaaaaattagctgggtcgtggttgtacatgcctgtgatcccagctactcgggaggctgaggcaggagtattgcttgaacccaggaggtggaggttgcagtgagccgagttctcaccactgcactccagcctggacaacagactgagaatccatctcaaaaaaagaaaaaaaaaaagggccgggcacagtggctcatgcttgtaatcccagcactttgggaggccgaggcaggtggatcacctgaggtcaggagttcgagaccagcctggccaacatatggcaaaaccccgtctctactaaaaatgcaaaaattagctgggcgtggtggtgggcacctgtaatcccaactacgtgggaggctgaggcagcagaatcccttgaacctgggaggcggagcttgcagtgagttgagattgcaccattgcactccatcctgggcaacaagagcgaaactccatctcaaaaaaaaaaaaggaaaagaaaataagatcatccataaccctactattacaaatatccactacttacattttgacattcggtcttagaaatgttttttgactacatatactttaaatgaatttatataaaactttttaatcaaaataggaaattataaataattaaaaacttatttttaaggtaatagtctgtggatgtcttactctataaacagtagatatgtatcatttctggtgattgtgttgctattgcttatatgaatgtatcagttgtttatttagccagttccctcttttatggaccacaaggtagaattagtttttcacttttttttttttttttttaagatagagtctcgctctgtcgcccaggctggagtgcagtggcgtgatctgagctcactgcaacctctgcctcctgggttcaagcaattcttctgcctcagcctcctgagtagctgggactacacgcatgcactaccatgcctggctaatttttgtatttttagtagagacagggtttcaccatgctggccaggctggtctcgaactcatgacctcatgatccacccgcctcggcctcccaaagtgctgggattatgggtgtgagccactgcgcctggccttctactcttataagtagtattatagtgaacatcctgtaagtaaatctttgtgcatgtccacgtttatttccttaatttctaggagtgtaattgctatgtcaaaaataagcagttttttaaaagctttaagaatatttagaaatacggaatttaaatagattgctaaatgatgtgtgttgaagaaatttaactcaaagcctcctgatcataacatgctgtcttagttcattttctgctacaacagaatagcagggactgataatttgtaaatttgtaaataatagtagtttgtttggctcatggttctggagactgggcagtccaagagcatggcgccagcacctaagcaaggtccttggtgctgtgacatcccatggtggaaggcagaatgacaagtgagcacacaagacataagaaaaggtgccaaactcatccttttatctggagtacactcctgccctgagcactcatgacctaagcacttcttaaaggtcccacttctcaacagtgttacaatggcaattaatttttttttatttaatttttttacttttatttttttgagacaggttcttaccctgtcatccaggctggagtgcagtggtgtgatctcagctcactgcaacccctgcctcctgggttcaagcgattctcctgcctcagccttccaagtagctgggattacaggcatgtgccaccatgcccggctaatttttataattttagtagagatggggtttcactgtgttggcccgactggtctcagactcctgacctcaagcaatcctgcctgcctcggcctcccaaagtgttcaggactggcgtgagccaccgtgcccagcctccagcaattacatttcaacatgagatttggagggaacattcaaaccatagcaggtgcaaaataagagaccttagttttaagacaggttatcctgtgatacagaagaatttagttattacctaatatttaaaacttctaagccaagcattctgtttggtaaagatttctcttaactgttagatatggcagagtgtgtaactaattttagtattgtctttgcagtgtatgctgatggtagcatatgtttagatatccttcagaatcgatggagtccaacatatgatgtatcttctatcttaacatcaattcaggtaagtgtgtgttaggatgtattataatttgtcagtattctgtaggatatagtcagctccttagcacacaggtaaccaatggcagagcttggacaagaatccatgcttttcagctaacttttctctttcagtagtgcctacttgggatccagtctgcagtccctttcctgattgtgtaagttacatgttctcacaggtcaaacctaatttgtgtccatgaagcatagccaagggttgtggaaaagaaaaaatggcttggaaaaaccataggaacctaaagaaactgccaagtgtagataagcattgagtatgttaccccatccaagaaattctattttaaaaaaagaaaggaaaactaatgtaaccatttgtcgaagcagtctggcagaatatttcagaatagatctttgaatgaaaatttaggaggggtggagtgaggggtgtttcggttttgtggatttgagaggagcagaaataatatgttggtttgtgatgttctttttaaagttttttctctcacacttctttaattgtttttttttttttttttttttttgagacagtgtcttgctctgttgcccagactggagtgcaatggcacaatcttggctcaccgcaacctctgcctcccgggttcaagtgattatcctgcctcagcctcctgagtagctaggactataggcacatgctaccacgcctggctaagtttttgtatttttagtagagatggggtttcacagtgttagccaggatggtctccatctgacctcatgatccgcccgtctgagcctccgaaagtgttgggattacaggcgtgagctactgcaccaggccagttctggtcatcttacaagcgttgtttttcaaccttcctatctcattctcttcctgctaaatgtatatgttttgttgattaaaggaaataagacttatctcccaaatttactgtcaagacatttgcaaagtaactgcagtaatagagtttaaccttggaaaatgttggttactgagaattattgatatcttaaccaaattaagctgtttatttccttggtttaatgagaacgtctcaatatgcttaagaatattcttttctgatttctttcaaattataggtatttttttcttttcttttttcttttttttttttttgagacggaatttcacccttgttgcccaggctggagtacagtggcgcgatctcagctcactgcaacctctgcctcccgggttcaagcaattctcctgcctcagccttccgagtagcggattacgggcatgcgccaccacacccggctaattttgtatttttagaaattacggggttttctccatgttggtcaggctggtctcgaactccctacctcaggtgatctgcccgcctcggcctcccacagtgctgggattacaggcgtgagccaccacacccgacctctttttcttttttaatagaaacagggtctccctatgttgcccaggctgggcttgaactgctgggctcaagggatcctcctgccttggcctcccaaagtgttaggattacaggcacaagccactgtacccagctgaaattataggtcttaaggcaattgagaactttatttcagaagcttaagttccttagcagcaggaaaccccatagtatttatcaaatcatttctaaaagtatttagacccaaaattatatgacatgttaatctctgaagtaatttgttgttttgtataacttttctgtaatatattccatatctgacccctgttggtataaagaacaactatgcaaatctgttttttcttttctttcctcctagtctctgctggatgaaccgaatcctaacagtccagccaatagccaggcagcacagctttatcaggaaaacaaacgagaatatgagaaaagagtttcggccattgttgaacaaagctggaatgattcataatagacaactggtctgttaatctttttcatcattgttgtgtataatttacctctcattagaaaggctaacaaattttaagtgccacaggttttaaggattctgcagaaaaaaaagaaaaaagtccttcagtttagaacctacaaaagcttgtgtatcttgattaatgtactttttattgcatggtgtgaactaagttattgctgcataaatttgtaatatatcctgtttgtatttttttccaagtgtataatgttggtgtggagttttcatgacagaatatacacattttgtaaatctgtacttttttcaaatattgaatgccttatttttgaattctttagatttttaaattggagaaaagcacttaaagttttttatatatgaatattacatgtaaagctgttaaaatacataacttcagtgcaagagactttgtcacttatttccttatgtgtgtaggaggggttaataagtctctagctctccatctattgatagtttcatttacaatttcaaaagaacattcttatattttatcaaggaagtcttcaaatttgattctaaatagcgattataatctccaactttattttgaatgtacctctattagtttcaattgagtaattctagacataactggtttgactctgtccaactctgtatttaggccatttgttacagtttcttcatgcattacttactgttaaaactgtaccttttgcgatttcacagttggcacttctgccatgagcagagaactgatgcgacttgttttgctgcttggtagcactttaaaaaattttttgattaatgaagaaagtaaaaccataaacatttgccaaaaattcatgccccagtattagcaatgaattagttgcattggtttgagaaaggcacatattggagggaaatcttggtgtaacttaaatatttgaaaattacctttaatgcaatgcatatctgtttattctgggaaatgttttaatgccagggcctgctgagttgcttcttcttgtggagattttttttttaatctcctgagttgtataaaagttgtactgcatcttagtttactggataaatttaaaacacagtattgtagaaagctaatacaaaactatcctatgccttcaaatagtatagaaaatggaaaatatacaagtaaattctgttgaaccacctgtgtagtctctctagtagttaaaacagctattttagtaaccccaagagtttcttctcatatccataaaattggattacagtatggcaatatctacagcttctattcattatgcaacgtttaacattgattggataaatgcttataggctgggccaggtggctcccacctgtagtcccagcactttgggaggcaaaggcgggaggatcacttgaggccaggactttgagaccagccagggcaacataataagacttttctctactttaaattttttaaaaaattagttgggcatagtggcacttgcctgtagtctcagctacttaggaggctgaggtggcagaatagcttatgcctaggaggttgaggctgcagtgagctgtgattatgccattgcactccagcctgggtgacagagcaataccctgtctttaaaaataaaagctattacttggcaaattctgaggtaagtgtatgatcttagggaactttgatacaaatgggaattcactcactggaatcgtggctcccaaaaagatgctttaattgtgtggtgcttttatagtttagctcca

SEQ ID NO: 162 - DNA, 92054 bp, Homo Sapiens
ttatagacaatagaaatttatttctcacaggtatggaggctggtaagtccaagatcaaggcactggcagattccgtgtctggtgaggactgctctctgcttccaagatggtgtgttgttgctgagtcctccagagggaacgaagactgtgtcctcatgtggcggaagggatggaaggaaacaaaaccactccctcaagcccttttagaaggaccgtgaccccatctataagagctgtgccctcacgacttaatcacatcctaaagttcccacctcttgttaagtttcaacacatgaattttggggaagacagggataaggaaagaacatggtgattaatgctgtccccctggactgattttcaagctttctatggcaagagtttataggcaaaaacaaaatccgtccattgcatgtttgatagtgccatgaacctctcttttgttgcactcatcacagttgtacattaatctatataattacttaatgctcatcttcccttctgatctacaagctccatcagggcaggaactgtctttgttttgcacattacttgacatatagtcctaatagttgaaggaaggaaggacaggaagagtggaaaggaaagaaaggtaaggggaaagagaaaaaaaagggggtggggaagagaaaagagaaagagtgaaaggggaagagagaggaagcaaatttttgcacaggacgctgtggtccgggtgatagtacactagcaaaccaggaaagcacactcccatttccacttggaacacagcaaggccaagagactgaaatggacaggaaggcagggctgccctagcacttggcaggtttgcatcttggggctatatcggggatggcgtcctaggcaaggtaggactttccagcagggccagccgcagtgcacgtgacagagcagcggtgaggagggcagatgctggtagaagtctgtcggggggagcagcaacatatgcaagcatggacttgtatctgtattctgaatatctgaacctggggatacccagaaatacacagaaggaatggagaaatgccccctttaaggtctcaatgcaggtagggagtataaagtcagtatcatgggtgttaatgtaaatacttgtttacagcctcagatagttgttcttaaggatgtctaaaaacagactaaaaaccaaaaaaaaattactgaaatggtaaaaaatgtaatggttgtggttttccctcttatgttcatactttcataatatgtacataacagacagaagtgtttctcatttgaataattgctactttcttttatcggatgctaagaagtttgaaatccattgtttttgggtttttttccagaaacagttctagccttctctatgttgtctatccctgttgacacatcagtctttaccatgtaattttgtttttaaaggcatacctccctctattatatacatggtcttatgtgtatgaattcttttttcaactagaccagtaatcctcaacatgaggtcgaaaaagaaagacgagagtagaggatgaaaggacggcctggcatactaggccatctaaagtgcatccagcagctcacctgcacccccacaaaccataagcatcactgccattctgagctgatgttgatgggagatgttataactttgaggggagtgaggaggtagaaagagttaataactctgaattactgtaagtttggtgagaaactgtattttcactaaaaggtgaattttagaaccagaagtttatcagtttcaattttggatctattacttactctaagttccttaatctttgtcagatggatatgaacatacatttctttcaatgtatgaatattaaacatatgctaagtgctaacagatagtgctcaataaatgctctttagaccttacttttcaggtagacttgggagttcctttacattacaggtttctcagtcttggcacaactgacatgttagactggataattctttactgtggagtgttgtagtctaaagcgtgccccttaacccctaccactaaatatgttggaagtcttaactgccggtatctcagaatgtgacagtatttagagatagggccctctatctaaaaaagaggtaactgaagtaaaatgaggccatacgcatgggccctgatccaatgactgctgtccctacaagaaatcgggacaccagtcctgcacagtcatgtgcacacagagaaaagaccatgcaaggacaccatgagtggaagccaaggagagaggccgaagaagaaaccctactgatcttggacttccagcctccagaattctgagaatacacatttctgttgtgtaagcttccccgtctgcagtatcttgtgacggcagccctggcaaactaatccatgagggttgggtgtttagcctcatccctggcctccacccattgatactggtagtacccctcaccaccctccacctccaaaagtgtctccacacattgccagctgtctcctggggggcaaaatctttctgcccaccccactgggaaccattgttctagatgatctttggccacctttgtattcccagtgtcagcacagtgacagacatagataaccaaatatttgctgaatgaactcatgtgcctactttcccaatcttgggtctcaccgctccctcacaaactccttttgctgcaattaaagtaataattacttccagtttaatttatagactatataatttgtcatgaaacaaacagttttcattttgacataatttctgacaactcagtgacataaatatatccatgtgagctcctattttgtttgacatgctcacttacctcacatcagttctgccgatagatttggtaagtggtgcttttagtttccttaatgcacccctcaggatttcatgcaaatgaaattattatgacaaatttttctatagccatttctaacacagggaactcataaagaaatcaaatgtctgcacttcactgtgaaaacactaaactctcagccataatgagactccacacattatcagaaaccccaaggcataccaaaaagacaaggtcaacggagacagtctttggaaggggaggtcataaatgttgaatctggcaaatcataaatttcttgtcttaacattgccgcatttactatcatctcatttgaaagctgatgtgtttgggttgggtgatggcagaggggtgggagttgggggatgctggctctgaaatgccagagaggcattaagaactctggaagcatctggctactggtagacattttacacagatagcaatttctgaccaatccatttcaatgatttctaacccatactcaactatccagaggatactgttttaagaacattattgtaaactgatactctctattcatttacaaaattcattcattgcatactttttgtttaatagcttggattcagtgttacagatttgattgacccaagtgaaaaaatactgacactaatcatttttaagtgctatttcagaagaatatgcgcaatgtttctaagttattgtgactttgtgactgtcgtagctttaaattataatactaatatcctactctgagaaatgtgtaagacacaggtctaacaaacaactacattaacctcgggcaacaaccatcatggagctgctgtaacacaggcatggtggtggcgtgcatcggtacttacacacaccaaggatgtgaactgacatcccgcctttccaaaaacaaacatttaactcaactgtttcttgcaataaagaagttgaaagaatccttttgtgaggctggattctccatggaagagaaggagaatggcctaaggacattctgaaatttaattatcaaaccaaaccaaaccaaaccaaatccctgtgccaaagtgccaaagagtctacctcctctgcaaagctggtacctgtgtgaaatgtcagtatttttagagagagatgttttagaggcaggaggcaactgaccaagtaaggatattttgtaacatttttcccctctggaaaagcagaaaagaatgaatatcagctaaccgtaatatttagaatttagcatctttccttgggcatttataaatagaaaatctatctgtggcaaccaaaagtacggtattctaatcaatgcatttgaaaagtcagcaaaagcccacattaattcctattacgcttgtttcttggttcaatctcagcactttcagcggctcttgtgcggcgattctgtcttggacttatttctgtgtcttgaagatcgtttctgaagacagaaaaaggaaatgacatcttggaaagtaatgattattgtacagcagtttctagtttacaagtgttttcacacatattatttcattaaaacctcgaaataatcctctattctgttgatgaattcataattgttattattagtatttccactttatgaattagtgagttagcaaagatcacagatagtaaatgagctctgaacccctttttctgaattaaaatttaggagttttatgcttctgtttagcatgtagagggctgggaaaaaacggcaaacaaaaagctgctcccatcctaacaagaaaaagccagacagtctaacaaaatcttaactctgtttgatccttcagagacctgaggttttaaaggaactaagaaagtaaaattccaaagaaaaatatgcccctccaaagatgggccacacttctctcacttttggcagagtgttggagaacgaggtggctgccatacaaacaggtaagaagaatcagctaagattttcctaatttcttaaatacaggctagtattgcaggcccctgacacaaggagagtctgcacacacttgccagctcttttccacgagcctccgtcaggtgctcacaagaaagactgggagcaggacaggtgaatggagaggggccacttcagtggctacgggggacaggaagaagtcaagtcctgcctgctctcctgaatgcttctctcccatgaagcataagcttttcagttgctgagggaaacacaggaaactccccctggggctctagcaaagacctatggcctctggggaaggaacagaggtgaaatcagtctgcctcaaggggaggcatatgacctcatttgcaggaacgcaggcaaagattcactgctgcagggggaatggtagaaactaaaacctctaccttacaggaggggcagtaaatcatctccagctgatgaccttacactgacaccacgcagaggtttggtcaagtagccagataccatgggaggaggtggaagtgctgagaaaggcccacccctgagactcaggcacacagggcctacctaagactcaggctagactgagataacagtgaaccccggctgtttcccaccatcagcctagcaacaagcaataagcaggagcaggaaatggctgagggagagacacagacatggtgaagatatgcccctatttggtgcaggaaagcaagcatggctgaaaggaaaatgggagcaaaatcaatgagaaaaaccctctggcaatccagccccaacactaagcagaagtcaaagcagccacctgctagagtaacttgaagtggatgcactgaaggtcacattagtcactaggaaactccaatccaggtcaactctgaattacccagctcaactccccacactaatgacccagtagaaggatgtgcatttctaggcacaaacactatcgacctcagtccctatggtccttcactgcatggcccgcattcaaaaagtatgatacacaatgaagcaagggaaaaacccatttcgagatggaaattccttcaataggctttaagtgcaatacacaaagttgataaaaagacttagtgaacttgaaggtatgtcaataaaaaccagattaagatacaaagagaaaaaggagtatgtgagggggtgcacatagaatagagcagccaagagctgtgggacaataaaaatggcataacatgtgtataactgtaatacctggaagaaaggagagaaagaactatggataataaatatgtaaatatatatggctgtggattttctaaaaacgttgaaacacttcaaatcaagatcaaagttggtcaaagaaccccagtcatgagaaataccaaaaataaacaaccaacaaacaagatctctccaggatttgttgttgttgctgtttgctattattgtttagtgacttttctaaaccaatcctataaatatgtattctttgttgtatatggcaactaaaagtgtctgcttgattagctttgtagtccactaatgattgaacagttccttagacatctggaaccaatatcatacagaaactcagcaaaaccagtctttgctggtgggttctgtgtctgtgctggggcatgcaatcaacattcactcaacactcagtggacaactctgccttagcctttacttcctgcttgcacacagcctcatggttaaccagaggtgaaagtttagcgcttccttaggtctttcctaagcatgcacggaagctctatgaatgagagtgaccctctagattcccaggaatattttatagctgttcaaaacccccatggaaatcttattcttcagcttttaccattaggctttttggttagcatatcatttaccccaactgttatctaccacctcagacagctgcaaagctagtcaaatgcctctaattgctttcaacaaacacccttagataaaaggctttttgaattcagcaagctccaagtcaggtaaagtaaagatagtcttgcaagtagagtcttccagggaaccattagacaggctaagtaaaaataaagtaaagatagtcttgcaagtagagtcttccagggaaccattagacaggctaagtaaaaattctctgggaatgtggctttaaaggggctccaaccccgctctgccttctctggggactgtcagcctgctggtcctcaccatgactgcagactgttggctcccaaggccatagaggaactggagagagaaggatgagaacaaagccagtcgaatcaccacaaagctcactgttctcactgagattcagacatttttcttgaataaatgacccctacctaaattgctgctgcttttggttaattttcagagttttcctaaaagttgattctgacaatttttgcagttttgttattgcttttatggagcagagaatttccaccatttttgctatcactcttatcatttttacttttttttcatgttttagtttatgttcttaaaatctctcaactttcaccatgtcaaattttttatcttaatgttttatcatctttacttatttgacttctgactctttttaaggcttaagttttagtgggatgttcctccttacttttaacttctattttatcactctctattctcataccttgtttttaataatcctttaacaattttcagtaatttttctttccatgtttcccctctttgatttgcctttatgatagctggcaacagacacagctattgaggtagtgcaagaagtcatctatacttcttccacttccttagcaggggagttcctggcaaggatctcagcggttctcccagaacaattctctaaaacacctcatcccctaagatgcaagaatcctaatagaataacccagcccacatttttttccatgcatgtaacacattgacttactggaataacacttcataagatctcacaggtacagcaggtttttaaattcttggtctccagcaggtattactaatgaatttcttttagtaaaatttgacaatagcatgttagccagatgggaggatattcctggggagggccacagtgaggcatctatctactgttaaagtgttgaatctactgaatgcaaaaacatgccttaggagatctggccattcatcatcagcctgcttccaatacacattatttccaggatgacctactttccttcttggtaggcccatagaaagaatctcttggtgtgtggctctccttgcctcatgttgattaaagagacagtggtcagatcaaggaccactgtaaacaggcctgagtttccttttattcatttttttaaagatgggattcactgttttcttgctgcaagtactttcaattacagtaattgtatcatttaacaaacatgacaggctcataagtgcatgcaaacaacttcttatgggtttaagatgaaatgtagactattaatagagaaaatgattcttccttttccgattttataagattagagaaagttattttctaaaattttcttttaaaggcactatgagatagagacaaagagttagcaagatttttaagtggtgttagcttaaaaatcaaatttacaactttggaaaggagcctttatttcttataaatgattacagccagaaaggtgaccactctgacaaggctgagaagtgttaactctggcagagcccaaaagacaggcactgtaagggagggaagagggaaaagggatttagggtgaatgtgtggaccaaacatacatattcaacaggttacaggaggagctatgattattcataaagggggatcctaatgcatgtcctaatgcatgcatgcatgtttcacacaacccatgttcattctggggtggagacttaacatttaaatatattacagttaggccttacatgtcaaaaggtctttctaggacataaaggcacccaactgctcagccactataaaactagccagaaccagtccatggtcagtggtctcttatcaggagaaagttattgaaatcagtctcttgtcaaaccaatgctgtagttatagcttgtggaaaagggtgggtcagttagtcagcatctggcagttgtatagatgtgctacaattgttttaacattgtttatctcaaggccagtgcttgtttagctgctagagaaaaagaaaaaccttgtggcaattagaacataattactctttaagtgtggggtgatttacttaacccttgcctggcaaggccttaggtcttgtctataatttggtattttattgccacaaaaaaatctgttctgtcagtcctatgatctctattctaacattaatgttggccagttgttatgtctacactgcaaaagggaggaggtataatgaggcatgtctgacctcctgtgctgtcatggccagggactgtttttaaggtttctatgggtccccttggccaataggggagtctcttcagtcagctgatggcttaaaattttgtttttagtttacagtggtgatccttattcattcacaggttcttgaagccaagtaagaacatagaatctactagtgaatacactcagatcccataaacactgactgactgactgacagacagacacattcattcattcacatatttattgagtgcctatgctgggctgcccaggcacagtgctaggtgctagggatttaaaatccagtgtacttactcactagaaagggtgagagtgctgctggagcaaaatcaggggcttctgaacagagtatgaagaaaggaatgtcaactgctatctagatgaataaaggggaaagggcaatttggacagaagcagcggcgtgtgcaaaggccagaggcaaggcggtgtaactcatgaggcaactgtgagtggtgcagcttggcagcttggccaaagccacagttgtggggtagggaagtgagggaataaaattccatgagccagccaggtaggctggggccagaacacgaaaagccttggatggtggagagctactttaaagtctaagggggaaaatacctgtatgttacgtttcactggcaaaatgaactggtaacagaccaaggcagagagacagctagacagtggttgctgcaagctggaaagtaaagggcctgcaggagtaagcagtggcacaaagggattgagacagtacagaagctgccccagctatacctaggagcttgttaaaatgccaatcattaagccccttcctaaatctactgaatcagaatctctaggggtggagttcactaatctgtagtctaacaagtcctccaggtgattttaagtctgtgaaccacttatttataggactttgcaagtgactgcaggtgagtggtaagggagagtgagaagtttaaaataattgctaggttctggcttgaacagtggggaggactatgatcctaccattcactgagaagaggggacactggaggagacgcagatctggagcaaagggcttagactcactgaagcatatatattttactcacatttatgtgtaaagaaactgagaccccaaaatgtgaagtaacaccaggaccattttctattttcattctgttcaatgtaaatatatcttgtagcttgttgttgttgctttttggttggcgtatcatttgccccaactgttatccgccacctcagacagctgcaaagctagtcaaatgcctctcattactttcaacaaacacccttagagaaaaggctttttgaattgagcaagctccaagtcaagtaaagtaaaagtcttgcaagtagagtcttcagggaaccatcagacaggctaagtaaaaattgtgtgggtgtgtttcctatatattatgatgctttgacatcataatatatagcctttctagctggggagagattgcccctgctggcataaggagaggctggtcaattctcagagacagcaacgggcccagccaggagtatgcctgtgacatgcaaactaaccaatccagagtcacaactcctctatctggccccaacaccctaaaaggcaatagccctctgccttaatcatgccagggccaggttctaggtaactagggaccactcctatagcttggagccactgaaattattcaaactagccagtcctgcactgttcaccccaccctgccttgcctttcctgagaaaaccccaatcagggttctagcctaaagcacttcccttgttcctgtcttctgcctcctgaccacgctagcgtctttcccttgtggacctgcacggtgtgccatgccctgtctctaggacctgtgagtataatgaaacaagttttcctgagcctctcctgtgtctcgtggccacactgactaatcatctcataaaagaatacaaaatgtagatagaagaccccaagaccagtctgcagaaaataagtttcctgctgcttacaaaaaccctgctttatatggagccatgtgttgctaacgaaacctctaaatcatttgtggaattaagagaatgtgtcggaactgatatggtatgttctaagactaacatctcaaatatgccacttgtggtactacaaaaaaatgcctataagcttaagatgggtatttgtagaactgcaacattttgttgaaaagtaaagctctggaggcttttcctgattctgcttttaaaactacatcacagcagaagttcttccttagaaggaactgcggctgtttaaactattctatattctgctgaaatcaggaggcctggattctgatcctggaggtatcactaactagtcctcggaccttgaccaagggtcagtttacctctctggagccgagcttccttctctataaaacaaatgggttgggctagatgagctcttgtatctttctcgctttaaaaactgaaatgataggatttgttttctaagtgctttctggtagtaatcactttaagaagttatcattatcaagagcaggcttgggctcaggaactctgggctcatagtcactggtgtcagggttagttcagtatgaagaggtacaagaggaaagtagttagctaaggagtctcctcctcttccagaactcaaagttaaataatgcttaggtgagagacagtaatgcagccaaaatctcaaacttacataaaatgctactgcttgaaccaccaaatatctcataataaaaccatgtgtgccctggatacaccatacttttccactctcccagtgattcagctatgaaactacaaaatgtcaactgcacagcaagcctctccacctttggaaagatagtagagtttaatggttgagggtgctgacttttgacaattaggttagaatctcatctccatcacttattacttattgctatatgaccttgggctggagacttacccctttgagcctcagtttcctcactgtaaaacagggataatagaacatcataatgttatatttaaatgagatcacacatgtatttactatgagttaggctcatgttgacagtggggttaaaatgcctaacttataagccagtgggagtgatggacaaacaaataatcatataaatgtgctggaaagagatggacacagtgctgtaagcgcctactgtaggaggactggatccaggaagaacttgagctgctgagtaggggtgtaaactagatgaaaaaataaagaacattctgggtagagggacaagttcaaaggctctgtggtgggagagagcttttcatgcaggaggacctaagacatctatatgatgaagcagagagaatatgaagtaaataataagagatgagtctggagaaagagatccaatcatttaggaccttttacgcatattaaagagtcccttcttgaacctaaaaggaacaagaagccattcaagatttttagagcagagggatgagtaacagtgatcagatttgcattttgaaaagatcgctctagctgcattatggcaattacgtaagattataataccatgtttttactgtaccttttccaggtttagatacactaacaggtaccattgtgttacaaatgcctaactgtaaaatgctgtacaggtttgtagcctagcagcaatatgctataccctagagcccagctgtgtggtgggctataccatctaggtaagtatactctgatgttcccacaacaatgaaatcacatttctcaggacgtatccccattgttaagtgatgcatgactgtattaattgcccataagaacaatttatccatacagaaataacatctgatacataactacagttattacataggattccatttcttagcagaaatatatagaaacaagtagtaaactgaaaatctttaccttgcatgaggattactacttctttaaaccagaaagcaaaaatataattttgtttgaaaatcagctgcatagaagtataatttctcaggtcaaagtgcatgcttatttcatgattatgagaactcacttatgtgatgcttcccaggcttcctcttcttctaaaagatctcttatgatgtctgaactggaactaaaaggatatgtacatcagtattgacagacaacaagaagactgtatcgtcccatttatataaaattctagaaaaaaacaaatgagtctatagtgacagaaagcaaaccagtggttaccagtaagaggaaggagggagagtgggggtgggcaaggaaagagagagccaaatgtagtttccattaggagaggaggagcaaaggccaaaggcgctgaaaaacactgaggcagattttaccatctttagtattttccactagccagggaggctgagattccctgccacccctacttcaacagaagttgttctaaacccttctattcacaagaccccagctcctgctactccttaccttggagagaactactccaatttaaacaaagctgaagctgttttaacccaaccttttcattcccttctctctactccagtgtcatccattcttctttacctgatgtgcttaaggtactgtttctcaagcttttaaaactatcatcttcctaagcagcctttttacacttttcccccaatcccatgaaattttaataccacaaatatgatgtctgtttgttcatgtgttgagatacacatacacgcacatgtataaagcatatatatataaaatatatatatatatatatatatctgtgttttatgcatacacacagtaacctttttacccacttcccacccccacgaaaaacaaaattccaccctttgggggtgatactgctcctactgaaaacccacgagctagggaaatgggagctgcggaggatcacgtagttctggggcctggcaggggtcacagagttggagaaagagtaaagtaagcttcttgccaacacccccctgtgctccacaacacacacaattttttttttaaacaggaaggttacaaagcatctctactattctagctaagaaaggaggatggccaagcctgtcaactaacctagtagagtctgtgatcaatttacctaggggctttcaaatcaccagcacaaatcactgatttgttaaaggaaaacatttgcagtacactaatgacataaatctaagaggtttttgctatgctacctcagtgaaaacagatgttagaggtggttaacaaaaaacacatctcagaagttgcctgcaatctcctcttcctctgtgacttcaatgtcactgcccagccaggctgcacagctccctggtgtcttcaattcccattatctttccttctgccccacctcaggcactcacctgaatgataaccaaatcactaaatggactgatacaaaatttgggaggttcagaattttatctaaaatgaagtttcaggattatctgctatatctgctgttccaattctagtcaccactgaaaaacacagttgatgctaatacaattaaaataccagacagaactgctcattcctttttcaagtaatgtgcttattaccatatctgctcaaaaaccacattcctaaaattaaacatagtttcacaaataggattttacaaaaagacacttaggtatagcagtcagtgttactaaaattatcactcagatcgcttccctggggataaaagcaattaatatttttgaagtcttagtcattttaatatgccttgaggatcaaaaattcctttaacattctttcaagacatttaaaaaatcttccaaaggagaaaattaattactcattctgatatttctggggtcagagcatatacaagcctacacaactgcagctttaaagtctagaacgaggaactttttcagcttgtctactatttggtcttgaaacattctggaagaccacgcttcaagaagctggatgaatgtaaggtttggtacatgaacgttacagctcccctatggaagggcattcaaatggccctctctgatgtccctactggtccaggctacagtggatattaatatatagattacacgtgagaaagactcactggcaaagattcaaaatcgaatcttgaattcgatggaattcccaaccttggtccaggaagatattaataggcttatttagaacacctgcaatttatttttcacaccttttagtcagcttttagccttattttcaggtcaaagttgcagaaatgtaagctaattctgtgtgtgtgcatgcacacacacatgcacaccttggccaagctggtttttctgtaatatctcactcttgtcattctctgacggaaagtagcacagcttcttcagcaaagtaaaacactatcttcgcatattccttttgtagcatcttatttcattctactagtaaagaatttactactgaagctgaaaagtaagatgtcaaatacctacggcaaatgtatgactggtaatgttagttagagaaaaaaccctcagatttcggtgtcagacaaagttaagttgaggtcccatttctgttacttactgtgtaattttgggccagttacttaactttcctctgtgtcaatatcctcacatataaaatcaggataatgatacatgtattccttagggctttttaaaagcttattcaatataacacattaaatatttagcatagagcttggtacgcagtaaatgttcaacaaatgtcagttccattttcataaaacagatttgggtctgaattatctgaataattgcctcagcaccatgctccaatttgcccgagaaaacctgattactatgtgctctattttaatctttgatttccactgtttctatgacaccagggtgtaaattcatcagaaccagcatggcaggtacacagggtactgcggggtaggaaaaaacgcaaacatctgctataaaaatcctgaggattaaggattacctacaagtggaatttttctagcatctagtagttacctgcccatatttcttcccttaattgtggcactaatttgaacgtggttgagtatatccaatttaaaacaataactcttcaagggtagatcactggaggatcaatgcaggacaacatgcctaccagacaatggtacttaaataaattctgtcagctaccatgaatcttccctcaaacccctatttttagtaatctgtaagacaaacaatagcttatatgccaaatattttagcagttggctaacgtattagaatagtaaagttccaggttccaaaaaactcattcaattatgacaatgacgaaaattatcatgttctgagcaactacctctacaggccacagtgataattactttgtacacattagcttttttaattttttttttttttttttttttgagacagggtgttgctctgtcactcaggctggagtgcagtggtacaatcacagctactgcagcctcaacctcctgtgctcaaggaatcctcccaccacatctcctgagtagttataggtgcataccaccatgtctggctaatttttaaatattttgtagagatggcatctccctatgttgcccaggctggtttcaaactcccaggctcaagtgatcctcccgccttgcttggcttctcaaagtgctgggattacaggtgtgagccaccacatccagccttcacattagctttaattcacagaagcaccctaagttttctccccacttgacaaaggctgagagaaattaaagtaagtagaaaaacaggaatgggaatgcaaaactcatcttgttttgccacattgtgctgcttcaatagtggtagcagaaaaatcaaatgctattgattttaccagagttaagaatacgctctcctgcctacttatcaataaggtttttgtcgcacaaacatcaacacagttctggaaaaaacaaggctaagagtttcactgctctccactagaactaaagaaagataaaatgaagagagcttaagagaaaataataaaaataacttactaatatatgcaaaatccttaacaagagatgaaaccaagcaacaataagtttacgttctatttacaaagcattcacaatatatgatcatctaatttgctttgtagactcatccagggaagttagagggacaaacaaacaaaaaaagctattattccatttttttcaatgaggaaactgaaactctgggagattaatttaaaattccatgtgccaggcacctttccagagtcataaagccaatggctgagctgacctcccacaatgaaacaaggaagactgactgctaggtacatggatctcaaggagtcatacacatttcaaggacttgatgtcacagtatcttggacaaagatacattcccctaaaacaaatgttccattcatccaaaagatggtctgcctcatgcaccacacccagtttaagcgctttttttttttttttttttgagatggagtctcgctttgtcacccaggctggagtgcagtggcgcgatatcggctcacagcaacctccgcctcccacgttcaagcaattctgctgcctcagcctcccgagtagctgggattacaggcacatgctactgcgcctggctaatttttatatttttagtaaaggccaggtttcaccatgtggccaggctggtcttcctgacttcaggtgatccacctgccttggcctcccaaagtgctgggattacaggtgtgagccactgtgtccggccgaagctctttcaaaaatggaaaagatactgaagaactgtttcatgttctcacattttctctagaaagttccaaaaaaaaaaactcaccacctgaaacagaatgaaccatttagctttcagggtattctaaagttcataaatattcccacaaaaaaggctataataaaatacacacagtaatgaggtttagtagaaaaagattttgtggcaacattacattcatcgaatgtcacatttaagttataaaatgaaatataatgtcaactttccaacagcaattatgaagattttaaaaaatacaaagccatcattgacttacagtaagatacttcacttccaacttaggatattgttccactagtttgatgttttttctctcaatttgaccagaaacataaacacttacttagtagtttttctaataattccaataccctctaaattacaaagtttcattaatatatttgtcttccttactgtctacaccaccaaactttattaaccaatttatgatgacgattaacactgatgagatgatttccaaaactttataaagagtaaggtttaaacagtacttgctctcttttttttttgtttgtttgtttaaagtagattgatatatttacatggttcaaaatcaaatgacataaaagatgtatactgagttggcccacttcctcctttgttcccatccaacctgttttctcatctccaacatgcaatcactttcattagtttgttgtgtagtcttctagtgtttctttatgcaaaaccaaacaaatataagtattcctcccccttttagaaaagaggtcacatgctatacatgctgttccgaacactggactttcccattatccaggaatcctagttgaaatgctgattttaaaatgtttagatctagtcctaaaaaacaacctgcaaaaattctctcttgctatagccatatctgttccctcttttctgaccaccccaacccacacagttcctgtaccctcacatctttcacgtgcaaatcaagtgaactaacccaagcccatctgggcatgctgtcttctggatcctaaaacccccagaaccagggttttctgtccaggagacattcaggactcttattttcagaagaacaaattctaaatctgaaaaacttgtatttaatatgtacactgataatttttaactttaaaaacatgatagattctactctgaaaaacagcattggactgaatctgtcttccattatcctctaaggttctggagctacatgaaaacagtggagtggggaaactcataaacctgtaactttaatatgtcacctgttcatttaacttttaatctggcttcagtgccttctgagatttggagaacagcaaaaaaaagcagaagaaagcattatatctgaattcagaaaactggctttaccattcattaggatcatgagattaagtcacttaatttctttttcgactgactcaatcattgccttacctgccccaaaacaggggcgcttcaaatgctcttgctgtcctttctaccacagaagcaccatgagcctatttgtccatgtatgtcccacctattcaactgttcaacggtgtattcatataataaaagctaagcttcctatttggtgtgttctctccctcacccacggggtagttgtacactaggcattaatccctagcccacagtgagacgcagggtggctgaaacccatggcggcatcatctctttatcctggcatgccacagaaatactatcatttgctatgtgtgctgaagaaaagggttaggaaacattgtattaaagatagaagaaaaagagagagaaagaatacattccttttagtcaatcactttaaattcttataaaaagtaaactgctgtatttttttaaggaaaaaaaaaataagaacattaggttagttccaaatattggagttctcatggatgtctacaaaaattcaagttcaaaaaagaattaaacatttgtgcttacatttaacttacaagcttaagaaacaaaagattatcctctctgagagtctaatgcaaaggaaattcttttttttaattagcaaaatatccactgctacaactagacactaaaccaaactctgaagttaaatgggcagggaaacaaaataaggatgcttcattctgtttttattctttcaactgtcagcagtataaatgactgacacaaataaaaatcaaataataaaatgtagggggataatagaaatcgcttacaacactgaaccccacaaggaaaaatgaagtgaaagacaaggaacatccccaaaatgaaaatttcctctaccacttaagcttcaatttgattacaagcgtccttgataacagaatctgaggggttgagtatgaagctggtgacaagactggcatgtcttcagcacagcaaggccaaatctatgtaatatactcattaaccccaccctgagaacgcccagttggaccagataaataaataccacatagtatgatgctactaaaggaatttggtcttgactggtagtcccttctaagtttgaatcttttcctgatttctatggtatcagttaccagaatcaaatgggtgtctctcttgactaagtttcagcgtcattaaataacactggcaataagcaatgattctgataggtaggcattttaaatcagtacaattcattcagagggcaatgcctacatatcagaataataaagataagtggccaggtacggtggctcatgcctgtaattccagcactttgggaggccgaggtgggtggatcacttgaggtcaggagtttgagaccagcctggccaacacggtgaaaccctgtctctactaaatgtacaaaaaaaaaaattagccaggcgtggtggcacaggcctgtaatcccagccacttgggaagctgaggtaggagaaatgcttgaacctgggaggtggaggttgcagtgagccgaaatcgcaccaccgcactccaggctgggcaacagagtgagactccgtctcaaaaaaatgaaaaaaaaagtattcaatagaaacaaaggaagagctttaccatagcatcaggtacataagtagaacactgggaaaaatgtagagctctaacagaaactgaagggtctggtaaattatagcgcagagacataacagaatactgtactcattaaaaaataacaattataaacataagctattatgttggtgcaaaagtaactgtggtttcaattacttttgtgccaacctatagaaacgtaacatttatgacataacattaagtgaaagaccggaacaaaaactggtatgtgtgtgtgcatgcgtgtgtgtgtgtgtgtgtgtgtgtgtgtgtgtaaaataaaccctatatattttttaaaatatcttttcaaaatgactcattaccaaacttctcatttttaaagtttccccatctattctatttactcagttaaatttttcatttcttaaccctcctatgcgccatgtctttctgatcatttctgttttccaatatagttgtttttatctcctttactcatcgtcttgacaaaaatttcactgtctatcatgctttcttttccaacggtaggaaaagtatctacataaaggctatagagtagagaccaaactcaccctgtgatccctgcactaccttcccaaatcctgccttgttatcactgtgaagaagacccagcagtaaaaggggactgaaatgtaagagtgacacaccatgccatgcctcaaagctacattctaattatttctgcctatctatctacatgtgcatatgaagtagatatttaaaataatcaactactgcatgtttcttacctattgcatgaatctgattctgatgaagaaagaacttcttgaatatcaatacagctagaagaatcctcttctctgtcaggttccaattcctctggggagtccagctttgattgagaaaagtggtttgttactgaggtcatattatcttcctgtcctaggaaaaaataaatttaagagtaccttaaaatctacaacttctgtatgcctattacttctgcaacacttaatactgccatgtgcacttagtaaagttgaagtatatgtcacatagattccagaactctagtgacagccagagagcaagaattaacactacaatggtgctatctaattatactgtccagcccatgtttttccaagattaattagtttaaaaataaaatttattttaaaaccagaagcaggaagaatcttgtaattctaatgaggcctctattaacatatcactaaggaattcttgcatatttcatagatcagagaacactgacaaaccaacataagaagtataaccaaaaaaagactacagattcaactaataagacaaccacaatatttgctactattatatgatagtgaatctatctggacatttttctaaacatttttctaggttaactagaatctaattattctctatggaaaaggacaactaaacagacataaggaatatttccatttgatccaatacacatcacatttccgtgcattctttgtcatattctcagatttcaaggtctcttattgcagataaaaataaagaccccaaaaagctggaaggatgcagtgtttacaaaaatgtggcatatgggtatggccaattttctacaaatatgagtggaagaatatctgtgaaagattctttagtgcccaggattctcccactcatcatgaacgctgctgggattttcatctgtgctgtccttaactttcaggaactgaggaggtacctcacatgcaagctacatgtgctaataatactacagagctcctttcatgtgtttcctcacagagaaacagagctttcacacatcactcatcaagcacttgtagaggcaagtggtcttcaacaaagcacactaaaaatacaattgtcaaggtttgattatacagagagaatttatggggaaagaacataacaaattcttcaaaaaaccttgccaagttcatacagttaaatttttttcagaaatagttctaagtttttgttacactgagagaacagcatacttcacaagagtgtaattcctaaaaatatgctcctaatgtcatctggctgtcaataaactatcattagcaaaacaaaacagcaccctctaatgtatatctggaaaagggaaaaagaatttagccaggatgaccatcctgaacctctaggaactcctcttgtaaacagataccagaatcacattaagaggagccaatcccccagtcaactcggttcacccagggactatattactcaactagtgaggtgcatgcaagcaagctagcaaaccagggaacaggaattcaacttaaaacaatcttttatttttgcacattgtctgtattcttttcttacttcttccactcttacatacacttctagaagatatattccctcttgggaacaaacagcattcaataatctgtgggcataaaaaataagttatccttcctacttgcccttagatctcagaatgcaggactccaaaatagagccccgaagagtgaggctcagacatcagagctccccagagacacacaacaaaaacaggctaagttttcacttgagagaatatgcaacttgttcacttacatgagcacttcaatgttctaaagagcaacaattatattggttgtatgatgctatacaaaatccatcttttcagtcagtctgtgtctgtcttcatctctctcacataccttaccctctcagacatctcattcatgcacagcaatctaaaagcagcaatcacctctgaaccccggaaagagtaatattgatgttcataaatacatacaagccatcaatgatattcaagagaggttcaactaattaaaaaaacttttcttaatgggaaatattcagtcagattttctcaagtgctaaactagtttctagaaatatcctttaacaactgcatgaacaagttcgagttgttcaatgaccatgagttacatactgaggcagcactttatgcacaaattgtttattagtcactagggaaatgcaaatcaaaaccacaatgacataccacttcacatctacaatttttaaaaaatttaaaaatcagaaaataacaagcattgatgaggatgtgaagaaattggaaccctcatgcttcgctggtgggaatgtaagataatgcagccactatggaaaagtttaacgattcctcaaaaggttctaaacatagaaccagcatatgaatcagaaatcgcactctaagctgaaacttaaatatctgaccaccaatgctcatagcagcattatttataagaaccaaaaggtggaaataaccatagcagataaatggataaacaaaatatgacatatacatactatggaatactgtttaatcaaaaattttaaaatattttaaaattttaaaatgtgctacaacattgaaggactctgaaaacattatgcttagagaaagaagccaacacacaaagacaaatattatacaattccatttatatgaggtacctggaatgggcaaactcatagacacagaaagtggaattgttattaccagggctatgaggcagaggggacggaagagttgctatttcatgagtgcaaagtttgtgctgggaatgatgaaaatgttttggatatagacagtggtgatagttacacaatattgtgaatgtacttaatgccaatgacttgtacatttatgaagggttaaaaagataaacattgtgttatgtatattttaccacaatatagaaaaacataataagcaattttcttgcgcactttcccccattatgattcttttttgttcactggtccaaagcccaggcaatagaattaaaatatcaatttcaaattttaaaatggatcaaagttaaggaacgtgctctgtattagcctaccaggtatgttaactttagactgtttggcagaacatttcatccaaagtaaacaccagtgttctatcacaaaaataattcactctctttacaggatctccaccaataaattctatatctagaaaacatcctgaagcttaaataacaaagaaatttatgatttatcattaactgaaaggacgatagacaaaaagagattgtttcttcaggacattcttccaaccactttccccatagtaataaatctagtttacaaactgctacatgaagtttgtctaaaaatactttttctcatttcaaagaactaagaactccaaagtaaatttctttggtttaattttttcatattaaaagtaaataatgaaattcgacatatgtctgtttttaattatagtctcttacccatgcatacagaagatagcttttctgtagattcatcttcttttgttattgttactgttttttgtgacattccagcaattttcttgtatccttttctagcctgatccaccagaagctgaaattcactcttatgttttttacctgaaattcaaaagatcttctcagtaaagctaggactatgaaagttaaccatctacaactgacaaactgaatatcaagaggtgtacaagggatgggcatggtggcttacgcctgtaatcccagcacttcaggagcctgaagtgaatggatcacttgtcaggagttcgaaaccagcgtggccagcatggtgaaaccccatctctactaaaaatacaaaaaaaattagccaggtgtggtatcacatgcctgtaatcccagcactttgggaggccgaagtaggtggaccatttgtcaggagttcgagaccagcctggccaacatggtgaaaccctatctctactaaaagtacaaaaaaattagccaggtgtggtattgtgtgcctataatcccagctacttaggaggctgaggcacaagagtcacttgaacctgggaggcagaggtttcagtgacccgagattgcaccactgcactccagcctgggcaacagggcaagactctgtctcaaaaaaaaaaaacaaaaaacaaaaaacagaggtgtacaagcttgctcaagaacagcatccttaggaatcacttgcaataaatttaaaagctgccaagcataagaatacaaagggctggagtgtcatggaaccttctttttatcttctcccttcctcaaatacaaatatggaaacatgatattcctagttagctactctaggtttcttcccaaactccattctctagaaaggcttttacataatcataagagcatgaaagatgcccgctttcttaaatatatacaaatgataccattctaacttccaagatacaagagaactaagagtatttgctgaatctaaaatagaagcttctaggaaagttgaatcatcataacaaaggaatgtccgtctactccagctctcctttttttcttcacatttccggccggtttcccagtagagcccctttaagattctaagatctctcccaaccaattctaccttatcttacgatactatactaactctaatctttatttactaccattttaacacctttgaatataattaaccctgacctcaagatcatcattattaatgtaccaatctgttcaataaagagcagccagtcatcattactgtatggactttagggcatgtatttgtgattctgaaccatgcagctgaggtcacagtttacttatctagcaacgttaaatacttaggccacagtccaaagtaatgtcataaatcctataaaatttttagggagaaccatactacaaatggttaaaacaaaattttgacactgttttcatacaaaaatcaacaatgtacttgttatcacttggtttcttccattttccttagcataatactaaggcatagggaatttactgggtgtagggaaaaaattgtgcttcagttgaactatggcattgtctaaatctactctcccaagattccagccattcactgcctttgagctatggtataactctgtatgttgtagataactgagagcaatggaaaataattcttgtctatagatatgcaaaatcctgttgggtggaggttcaattgactttcctcctccaatgtggaagaagccagttttttgctcattatacattcatttcaatgttcctcatctgtaaatgtgatgattctttggctccttctttgatcacctcataatatcagtcttctctctactaatgagtttaaatctttaataaaaacacatgttcattttacatccatatgagaatgatgttagttgtttttgaaaattatcttttaacgcaaaaagagaaaacactaaattgtgacgcacaaggaagaaaatagttggattcctatacatgaatattgacaggcacagcaaagacattcaggaaagaatgctcctaattacaatatttttatgtgtatggtacatgtatgaaaacttctagtgaaactaatgttgggctataaaatgtatggcatattttaaataaaagaccaattaaagtgtcagcaaaagaaatatatgctggccgtaaagatcactggaaaaaactaactctttacaaacaagtgagatcctatctaggacacaagctaggtgatttctttgaggtcctatttcactctacgcacttgaggataattatcttgtatttctctggctgcttagaatcaatgggctaacactaccatcatcattatgtagtttctattaggcgagggtgacacagtactatgggatctacataatttagttagaccaggtctaagctattttcctactaaggccattccactgtacacataaagactggagatttaagaattagtcaagaaatttgctaaagtaatcacattaacagttaaggagacttaatgacttattatcttctgaagtaataaaatcccagatttaaatctaattaccccacagctaggctggaaaccaaaagtaaatggcagccactactctggctttagccagagaattccaataacccctactcagaaaatgaaaaatgtcaacagatcaagactagtaacattgttcccacttacttctttacttcattttagaagatctgccatttggcaaggaatactgcagagtttaaaatctcagttctggtgggcatgtgtcctggattttcctcttaaaagttttaagtggctcagctagtcgtgggagtgtccatgactaagtacacgttcaatcaactcattttcttccagattttgaatacctgaatcataccatcctttgtgcctctctaagtttaaatgtaatcttttttagaacgaaatcaagccctttactccctgatcactttaactactcttctttagaccagcccttacagtcagagtgtctctgggtctgcccaagaacccagaacccagtggtacaaaagactaaaaacaggctctctcaagagtagaaaagactcacacccttctacagtgatgccactgagatacttcttctactttaaatcaagaaatgagtttggagtcagtgttttccaaagtaaaatcccatatatttctttcaccatcatatcacctatgatagccaaccagctaaatgtggatgaagaacagagtttaacagttatggctaatgttcactacaggcttattcatctagccctgaactgactagtgacactttaatttcatgatcataattctcaaatgggcattcaatactgctataaaactcttgcacctttctctagtaaagtttgctctactattctccaaaatatctatctcacactttcttctcttcattcaaatattcgacactccccatgtggcccctcttagttggcctcacactactttgaaaaatatagaatcattctaacagaaactctgtcatcttccaagcaccaatataccttgtctgtgcacttatgatctatttcccttgttcttaccatgaaacaactgtccttgctataattaaaggctaacctctaacttatgctcaggattccatcatgaagctgtgaacagagagactgtgcctttgaacctagagtgtgaattatgaaaataactcagtaaatccagaccagcatttttttcttaatgaaataataaagagaatagaaagtatcagaatgcgttaaaaatggaaaaggtaaataccattttgtgaagcttttgtttcagtcatgtgtatgtatacagttagtagtaatataaaatttatctctcactgtgggttgtagtcaaaaaggtcagaaagccactgagttaaatatctcccaatttaaataacaaactttaaaaaacaagcaaacaaaaccctcccttgacccaacacccccctccagctatgaccctatttttttgctctccttaacacagtaaaacctcccccgaaaagttgtctaccttaatggtctcatttcctcacctccaatttggtctcaatcaactctaaacacttctgacctctctaataaggctggtcttgtcaaggtttgctgcttccaagctgtgaaactcctgttcccttctatctctgtgaaatgtaatgttgtctgttcacagcaacgtttggcctaagtcatgatttgttttctctctatctcagagatcacagtcctgtgctacctgtttcccattatctgaaaaaccattcaacattcacctcgttttctagatttttttttttttcatggaggagagtaaatatagtctctgttattccatctgggctaatagaaatctctatttctattttttggagagggggaaacagtttttttttttttaatcaaaatatgttatttatgctaacatgtaatgggtttattgttaatatttttgaaatttcttggttttaatttcttctttgacctatgggttatttcgaaatggattatttaatttccaaatatttggtgactttcccaagggctttgttactgatttctaatttaatttcactgtggtcagagaacgtattttgcatgccaaatgaatactcaaggtgaactctctgcagatcactgggtttctccttccagtactatgtcctgcaaactctaactcctttggttcctctgatctctcagctctttctccttaacttagagtctccaggctttgcctggaatacccacttgcccatactacagccaggaaactgtattataaggctcatcgcattttttgcttacctctcaaggatccctgtcctttgtggccagtatcttgaaaattgctatttcatatgttttgtacattcattttgcttgttttaggtaggagaataaatgaagttattccatggctggaaacagacaccctctaagttttaattgataatgtgatacatatcaacagatatgacccacataaacaaaggctctttggtgtccttgagatacagaatggctgggctcctggctaaactccacccttaacctgggaccttggccctaagtgaaaacagctgaccccatctcaccgcccaaatattgcctttttggtctgccatgcccctatcctttgcccataaaaacacttcagctggcagagcaacacaagcggctgatgcaagcggtcagggatgcaagctgctgagcgtcagggatacaagcagctgagcatcagagactacagacagatgcagctaacttcagatggtgcagcttcagggaaagatcaccttcttcccgcatcatcccctttccaactcccatccgctgccagccatcacccaataaaatcctccacatacactacccactatcggtttgtgcaacctcaattttctaagacgctggacaagaacccacatgctgaaagggcaggggctaggacactgctacggggcctgcacagagcctgctcccaccagagaggagcatctggctggttccagcattcgttccctcttgcaaggagtggccagcagtgcgctgagtgaaaggatctactccagttcccacccacaaagggggtcaaggtccagggaactatcccataatacgggggctcatccaggatatgacaaagggtgagttaaaatgtggaattgttggatccgtctcttttccaagaccctgccacctctctctttcctttgggttaaaggaatgttggttctgtttcccttcatggaggtctagctgatctgaattgaggtagacatagagtgattaaaggaacccatttccagagagcaagaggctcttcccccaggcccccaacccccaactattcactttaagcatttttttttttcttttctaagtgagagagtttttttcctacctcaggactctgcttataatagggaaatgacagaggagccacccctgaggtcattaggatgagccctaatccaatatgactgatatgtttataaaagggggaaatttggacacagagacaacatagagggaagacgatgtcaagagacatagggagaagatggccatctatagccaagaagagagacctagaacagatccttcctgcatggccctgagaagctcgggacaccttgatcttagacttctagcctccagaaccctgctgacatcttgatcttggacttctagcttccagaaccacaagacaataaatttgttatttaagccatgcggtctgcatgcagtattttgttttggcaaccctagcacactaataaaaacacataattagaaattaattagaaataagtaattaattgcacaataaataatgattatgaccattatactcttccttgctttattttttcacttatcacttcctaaaatactagaaagatataaactccaacagagtaggcttcttgtctgtcttgttcattcctatatccccagctccgagcacagtgtctggcacgtgctaagtacttgacaaacttgtgatggctgaatgaatggaatagtactacgaaaaaacacaagataatgtaagtgcacatagaaagaaaatcttaccttgtcctagagatcacaatgggtttcccagggaaactacagttgagctggttgagagtggggagtatagataggggggtcagaggcaattagagaaagagatagttccagacaaagagagaagagggtaacaaatgccctaaaacagtgaaggacttggtaaagtaggtaaaagataaccagagtgattggaatacaaggagtaaggggaggagaagaggcaaggctagagaggtaggcaggtccagatacaggaaataacagactttacaaactgtagcttaagagaaatcgaaagcccactgaagagttctttacaatggcaggagggcagcaaggcagaaatggcatgatgtgaagactcagcagttttggaagacagttttggcttctgagtattaggaaggggcaagagtagatgggggatgactagagagcaaagtgatacataagaagtgtacggactcgggggatatttagaagatagagactgacagaacttggtggtgaactgaacatgggcagataaaaaaaaaaagtaacaaatgaaagataaagaatcagaatggcaagctagttattagcaacagtgatggaaagtagaaaacagcggaagaatacctttgaaaatttggagaaaagtatctttttaacctaaagttctacaaacagccaaattatcaatcaataataaacgggttatttcctgttatgtatggaatgttatatatctcaagaaattcctctataccaggggtgtccaatcttttggcttccctgggccacactggaagaagaattgtcttgggccacacataaaatacactaacactaacaatagctgatgagagaaaaaaaattatcataatgtttaataaagtttacaaattcgttttgggctgcattcaaaggccatcctaggccgcagtttagacaagcttgcatacaccgtttctcaggaagtttcctggcaaatgtattctaccaaaacaaggcaagagaagagggagacttggaacttggaagaagtgaaccaacacaggaaggaggagagcagaattcccagaaagttggtgacaagaaattccagaagagcagccatgtattaacagaaggcaaaaaggacaagcatagtagactggaacaggacaacagaggctaggggtggccctaggagagacgttcttgagaaaataatgagttataatcaatgtgtgtaaatgtattggaaagtgatttacacttctgttggaaggtttagagatatattagtactaggtaaatagttaaacaaacaaaagagaattattagttataagaaaaacaaggccaggtgcagtggctcacgcctgtaatcccagcactttgggaggctgaggcgggcggatcacgaggtcaggagatcgagaccatcctggctaacacggtgaaaccccgtctctactaaaaatacaaaaaactagccaggcgtggtggcaggcgcctgtactcaggaggcgccagctactcaggaggctgaggcaggagaatggcgtgaacccaggaggcagagcttgcagtgagccaagatagcgccactgcactcctggacagagcgagcctccatctcaaaaaaaaaaaaaagaacaacagaatgttttgatgaaaggaattataaccatcttatgcaaattgtctggcttgagccataaacaatgtatctaactaaatactgagcttacaaaaacttatgacataatatttaaaggatggaagggaagcaaaggtagggctcaggatatataaatgagctaaatctccatctttcatattagcacatcaatagttaatgtgaaattgaaaaacttcaagaagtagcagaaaaaatacttttttataaattgtaaggtaattaccaaaagtagcaccaaatggcttgatagttgttacctctagggaatgggaatagaggcaggttgttggaggatgcaagagactgctcttttatatgataaggctcataaaaagtaaatgattttttaaaaactacatgtaaaacattaataaaatgtttaaagatgaagatatatcaatagtatagttagaacctgacactaaatcaaaatgtatgaataaactaaaaggctaagcatctaagctttgtgaagcacttgacttttgaggtttattttaaggctaaataaattaataccacctatttagtaaagttacactttttagatatctaaatggtgggcaatgaatatttacttgactgaatatagtccaaatttttcttaatatgggaggattattagataccaccctttcagttatttaaattactttctcccaatgcaagttttctggtttccttattttcacaggccttagtgatccttatttttccaggccaattcactgatcatttgatattctcttttgttctcctttctaaagaaaaatcactctgacatcctacaagttgatcaaagaggttcacatcatacttatctgtccagcaacagaacaatggtgacttttgttgttcagtccataatccaagactcctctagggtccttttcctactctagcaaggcacaggcaatcacacctacatccagcgcaggtgtgcttcatcctccctcccacaatacatcactacagaacctggcccttcagagtttaagaaatgaagagagaaaaaaattatcttacctcaattaaaacataccatgcctgggaatactgattcaatgaacatctattaactatctactgttcgtcaggcacttaaatttaaactaaaatccaaccaccacacaaagagtaacagctatctgacaaaacagtaatgtgttagccctgggaaagatatacacgaagaccatttaaggaaaaggaagtgataaagttgggaggttgctaacaagcaataaaatgaaaactatttttggcacaaatttgcaagctatagaagcattgaaatcctatacagaagtattgttactgagtggcctgaggacaggatagagtcccgaatgtttccattttaatcccagcttcttttcacagaaatgctttgagagcagctaattaatatttgcaaagtgcttagtgataagctcaaagtagaatgctagtcataaaaatcaaaaagcaggcatataaaatacaaaaaaagtcactaagtaaacacccaattaaaattcaatctcttaagtaatgttaacaaaagtttgaattgaaccttaatataaaacattattctgaaaaattacttaagatgaaaaacagcaactgaagctctttacaaattaaataaagtcgtgcaacttacgatatttactgtggatttcatctatttccttttctgtttggtcctttgtaaaaaccattacctaaaataatcaaaaaaagaccttaataaaaatctccccaaaatgacaaaaagggaaatattacaaaccttcaaatctcaaatgtgagtgtttaaaatagaggaaaatgatctctcatctgttttatatagacctaggaagaatcattcctatgtacttcccttaaataccagaaatggtatacattttactcattattttttctcatcagtagaaaatgcaacatgattcaattatatattaacaaaataataaattttctattttcaatatttaatatcccacattcattaatacaacaggcaatatttgaaaccagaagactaacgacacttagctgactattagtaaggctgatcttcttgtctgccttctctcctttccaatctaacttctccaggtcattatagaaaagcagtatgtatagaaaatgcaataatacaaaacacagtaagttaagcctctaggtccactttttaaacctcagacttaaaagatcagaaatctgcttccatgattcactgcagttcccatcttacagttagcacacaggtaataatagggtcaatgtaaatcccatttttttcctacttatttggttacaaacttactttcttaaggtaaccattgctttctccttacaaacacactacaaatggcctagaaaaaaaaaaagtctacttggaagagaccaaaacactttctccagtgtcacaggacacaatgactattttcttcactggtatcctgtcttcaagtttggggcatcaagctagtggaaggcaacagtgaagaattttaggtctctgattccctccaaagctcaagagaatattccatcctcaaattacttaatttatcctcttataattacttaacatttccataagtataatcatagaattgcagaatgccagagctaaaaagggatcatagaggtccctagcagtagcttagaggtccttagaggtagcttatcaaacacaaccagcagagaaaggaccaatatcaaagctgcctgatgcacaggcacaggcattttctatagaactctagctcatgaacaaactctactttggattgcattttgtgctagaagactgctaagtacaatcaaatattgtcctaaaatgagttgcaagtaaatcataatacactaagtggaaatgtgttagtaaatgaataaatttaataatggcttgctttaatttttgtagggtattaaactttcttcatttctatccatatactgaaatagcccattaacatacactttcattgagtttactagcttcaagacgcatcctagtcttctctatattttcgatttctcgaactatttcagcagctgttaaaataagaaaataaccactaggttaatcacatgtcttttttaatcactgtacaataattatttaagttgttaacattagaagaagatgggtgatgggtatatgtgaactccctgatctatttttacaatttttctgtgaatcaattaccatttcaaaacaaaaggttaaaaaaataacatggagttaaaacactgaactcttacacatgcacatgctgttcaacgtataaccacaagagtcaagtcattttgctttctcctttgaatatacaggtctaaacagaagtctcagtgaaatatgaaaattaattttttagtgtgagttcaattattaggggatgtctgctcaaattccaatgtactaaatgcagtacaacaggctactgttcaaggagagaaaaaggtctacaaataccaggaaaaatgtccttgcctccagaacctttgtctgtaggtatgttaccaatccaattacatacataaaagagatctggaatacaccctgtcaaacattaaatgcctttgaatgcaaacagcacagaatttgcaaatgctatctttctgcatccaaagtcaatacattaaaactgaaatgcatatggtaggaaataaaaatctacaatccctaaccctcatttatacttaaaaattatatctggaatttgcttcaaaataatccatggaagaaaaaggggtgtaaatggtagataaaacaacattcagacagtgtgataattgtttaagctgggtagtaggcatatggggaaatcagtaaactcttttctctatttctgtatatgtttgaaataatccccattaaagttttattttttttaaaccacagaccttatgacgatcatttaagaatgcaactgtctcaatacaaagtttacgttttctgagcactgagaggtaccttttgcctccttgatattgtaaaatcagtagaaacaatgtaaacaatctctctgtgaagatgaccagctagtggttctctcctttccaaaatgagtcatggaataacatgaaaaacacagggaccatttgcattctatccaatccattaatacaagtatcactaaagacagagaacatctggcatgtcctcttgtaagatattaagaaaactaggccaggcgcagtggctcacgcctctaatcccagcactttgagaggccgaagcgggtggatcacgaggtcaggagatcgagaccatcctggctaacacgatgaaaccccgtctccactaaaaataaaaaaaaattttttaaaattagccgggtgtggtggggggcgcctatagtcccagctacctgggaggctgaggcaggagaatggcgtgaacccgggaggcggagcttgcagtgaactgagatggcaccactgcactccagcccagcgacaaagcgagactccgtctcaaaaaaaaaaaaaaaaagaaaactatattaggattgggtagaatttagtggcttaaatcttcttcagggagatttctgattctgtttaggttgtagagagctataaataatgtcactctcaccctaatgacgagaaaaagcgggataacttataaaactataatttttcttgaatccatcagagctaaagtaagagggcaatcaactagcctgaaacctaaacaaagatgagtgccttagaagagagagggatcatgagcactggttgacataggacagtacaccagagaaaaattggtaccaccctatctctgggtaagatctcagctaaactttttgatgaactgcaaaagaccaagggtgagctaccatgaaaatataaaaattttgggtggcttggacacagcgggcatcacatccatttgcaggctattttccttttttttttttttttgagactgagtctcgctctgtcacccaggacggagtgcagtggcgcgatctcggctcactgcaagctctgccttccgggttcacgccattctcctgcctcagcctcccgagtagctgggactacaggtgcctgccaccacgctcagctaattttctgtatttttagtagagacagggtttcaccatgttagccaggatggtctcgatctcctgacctcgtgatccacccgcctcggcctcccaaagtgctgggattacaggcgtgagccaccgcacctggccttgcaggctattttctacagacctcagtgggcacccacaagagtcctcagtctctctgtagctcactggggaagggcagcaaattagaaaagatcttcctccagatccattcctggcaaaagagaaccacccccactgcaggatggacatgaagccccaatcacatctttatccctgaagaaaaaaagcattaagccactgacgaaaggtcagcaaaaatgttatccccagagcatcggttgctgagggaagtaaacaaaaacaaacaaaaaaccccctctacccttcaggaggatcaggaaaccattctgggccctgacccatagaggacccctgcccctggcagtgagagaggggcaggatcgctgaaaaagccccagctctgagatgcaggattgaaagacctgcctaagactgaagctaaatcagagtaacagagaaccctccttttctgcctgccacaaacctagcatgatccaagtgatacgtaacagcaatctacttctaggagagaaatgaacatggagagagaccctctctgaggcacaggctcatagggaaaacctaagttgtgagtgatatatagctacattttaaaaaaaagtctggcacctcagactcttacctacactgtctggctttcaatcaaaacttaaacatgaaaaagcagcaaattatgattaagatgatacaggatctagtagaaaagatgaacaacatacatgaacagatggggcatttctgtagaaattacttcaatggaaatacttttttttagaaagaataaaatagaaatgttagatatatagatatagacacataaaaccaacacagtaacagataacttgactcagctaaggaaagaatcagtgaacctaaaattggattggtattatccaatctgaaacacagagagagaaaaaaaggaaaaagaaaaaaaattgtaacagaacagagcctctaagagctatgggacaatatcaagaaatatacacataatagaaatcacagaagaagaaaaaagggaggagaagaaatcgttgaagaactgtctagaatttgccaaatataagaaagacaccaaaccacaaatgcaagaatttcaaagatcaagcaacacagatataaaaacaaacccaaaatgacaacaacatgcatatagacacaaagacaaaatcatgtggccatcagaggaaaaagacacattatataaagaaaaatcaagaattacattacacttctcatcagaaattattcaagccagataacaatagagtgacatctttaaagcattagaaaaaagcccgccaatccagaattctaataaaaatatctttcaaaagtgaaacacaaaaactttctgaggaaatcataagctgagagaaagtattattagcagccctccattacaaaaagtattaaaacaagttcttcaattagaagaaccagagagaaacttacctaagaagaaatgaaaactggtgaaaatggtaaacatgaagataagtataaaatatacttttttctcgtttttaactactctaaaagataactgtttaatggacaaacaatagcaatgtaatggtttaacagtatatgtaaaaggaattcatgacaataacaatacaaagaattaggagttgggagtatgctgttaaaagtttcttacaagtgaggctgtataattacttgactgtaactaatgaaagatgtacactgcaaaccctagagagaacactaaaattttttgaaaaagaggtaaagtaataagacaataatagaaataaaatataataataaaaatgctcaatccaaaaaacagcaaaaaaagataacaaaaaggagacggaacaaaggaaaaaacagcaagatattaaattcaaagccaactgcaccagtatttacattaaagaaagggttttaaaacaccaattaagagacagaggatgtcagattggataaaaaagcaagaccaaactatatactatcaaaaataacccattttaaataaaaagataggttaaaaataaaagtatggaaagagatgtctcatgtaaacagtcatgaaaagaaacctggaggagctttattaatatgaggcgcaataggctccagaacaatgaatgttatcagggataaagagtgaaattaggggccgggcgcagtgggtcatgcctgtaatcccagcactttgggaggccgaggcgagtggatcacctgaggtcaggagttcgagaccagcctgaccaacatggtgaaatcccgtccctactgaaaatacaaaaattagcacggcatggtggctcatgcctgtagtcccagctacttgggaggctgaggcaggagaatcgcttgaatccaggaggaggaggttgtagtgagctgagatggtgccattgcactccagcctgggcaactagagtgaaactccatctcaaaaaaaaaaaaaaaaaaaaaagggaaattatatcgtgataaaagggtcaatttaccaagaagacataatcttaaatgtgtttgcccctaaaacagaaatttaaaatacattaaaaagtatttcttcttccaaacaagatggattagactcatttctccgctaagtacaactaaaaaccctgatatataacagacaactataagagaactctggaaagtagaaagaggaagatggactggctaagatctcagcatgtgaggaatgacactgtgtgtcaccctggggtgtctttgtattctgtatcttatagactatgctctggagaagtccagagccatcaagagaaacagacaaaaaagcctcaagaaaaatctactctttataagcaaaggactgaaaaagagggtacccagaaaccttgataatacttgacctacccaagcaaaacactgctgatgctccctgccctgtgcagtattatcagagagcaagtggggagcatggacttctacccatcaaccagaggtggaaggggtcctagtgcaggatgtcctcccatagcaacaatgtcagtggaagcctagtgaggagctcagacttctacaccccatccaatgatggcagctgacaactgcaccctctcaactaataactgagaagagaatatcaaagagaaggaaactggagaaaagaattccttcagcctgtgcagggcatccccgaccaacatgtgaaattgtttacaattaatatgccaaaaggtttgaaaactgaaccacagtgtggaatatcaggtattcacaacagtctctaggtagcaattaaataaagtagaccaaaataacatttcaagggatctgggaactaaatcatcattagaaccacagcctacaaaaataggccaggatctgcatgctaaacttaaacaagatgacttcctgctaaattagaatatttaaatagaacctagaatgtcattagaatataaaaaatactcagaatacaatttaaaaaaaaacttgacatattaagaaccaggaaaatcacgactcgaatgaaaaaagacaagatgccaatacctgagacaacccagttgctggaattatctgacaagaattttaaagctaccatcataaaaatgatccaacaggcaattaatgctctggagacaaaacaaaactgctacagtatgaaatacttttgagagccttgaaacatgtaagtgtacatggatttacatgtatatatatgcatacatgcatgtgtatgtatatatgtatccacgtgtgcgtatgtatatatatgcacatatatgcatatatttcccagcttcatctgctcaaatagcctagaagcaaagacaccaagtagcaatgagcatagctggtagccatatcttggtttcaccaataaaaaggaccagcgctcctcaaagaaatggctgatttcagggctggggcatggaagagcaagaaaagtctgcaatatcttgttatgttagaaataagaagacggtaatgaaaataatgggggtgtatgtcatgaggacaggaattagaatgaagacactcctgctggccaaatgtggaaaaatacaaacacgaaaataattaagagaagtaatgagttaaaaatctgtgaatccatattcataagagacaaataagaaaataacaaggcaggccgggcgcagtggctcacgcctgtaatcccagcactttgggaggccaaggcagacagatcacgaggtcaggagattgagaccttcctggctaacacggtgaaatgccatctttactaaaaatacaaaacattagccaggcatggcatgcgcctgtagtcccagctactcgggaggctgaggcaggagaatggcgtgaacctgggaggcggagcttgcagtgagccgagatcgtgccactgcactccagcctggacgacagagcgagactccgtctcaaaaaaaaaaaaaaaaaaaagaaaaagaaaataataataaggcagagggaagggctcttgttttcagaatcatgccaagtatcaattagcaactgtgaaaccaatgctaaagttgaaaaatcatcattttgcaactatcacagaaaagaatagtttagagaaaaattaccaaaggatgctaaatataggggtgaaatcttaatgaggtatagaatagctacatagtgttgaagtgtctctgcagacttcttattagtagcaaggcagcggatgtaaagtataaaccagagagaaactggccaggtgatcaggcctgatatcacaaatgaggggtacacagatgtcaaatggctctagatgtaatattccgaagacaaaacatcacttatatagtattctggccaggaaggcataatctgaattttctgccagaatgagaagattttacttgaaaaacacacacacacaacaaagactgtattcttttaaaaggccagtgtcataaaagacaaagaaaggctgaggaattattctagattgaaagagattgaaaagatattaccacgaaatgcaatatgtgatccaaaactggatcatgtactgcaggaaaaaaaatctacaaaggttattattgggtccactaacaaaactggatagatgaataaaagtattataacaaagttaaatctactacaagtactaactacagtggcaataaaagagaatctttttttcttaagaaataatacaaggacatatttaggggtaaagggtaaacactatataacttattttcaggcagttaaagaagaaaatatgtgtgtaattatatggacacatacacacattcacagaaaaagagagaaagaggaacagagtaattcataaagcaaatgaggcaaaatgctaacaataggtggatctgtacaaagggtacagtctatgcattcactatgatagtctttcaactttcctataaacttccaaataaaaagttttttaaaagaatgcaaaattaagactttttcagacaaacagaagctgagagaatctgtctcaacagcacatctgcactacaagaaatattgaataatccaggcacaatgttcatgcctgtaatccctgcactttggggggctaaagcaggggaatctcttgaggctaggagttcaacatcagcctgggcaacacagtgagaccctgtctctacaaaacaaacaaacaaaaattagctgggcatgcgcttgtagtcctagctacctggcaggctgaaacaggaggattcctggagtccgaggctgcggtgaactatcattgcgccactgcactccaacctgggtgacagagcaagaccctatctttaaaaaaaaacaagacagaatgaacaaataaagtttttcaggaaatgtccaaacactgtggaaatccaggaaaaaatgaagttttttcaggcaaaagaaaatgacaccagatgaacacccagatctacacaaagaaacaaagaatgctgaaaatggtaaatgtgtaggtaaacacagaccttcttttccattttttatttatcttttccatttttatttagtttaaagcaaaaatagtaacaaggtattatagagtgtttaaaatacatagaagaaaaatctatgacaaaaatagtacaaagaatgaaagtcaggggcagttccaagatggccgaataggaacagctccagtctacagctctcagcatgagcgacgcagaagacggatgatttctgcatttccaactgaggtaccaggttcatctcactggggattttcggacagtgggtgcaggacagtgggagcggtgcaccgggagtgagctgaagcagggcgaggcatcgcctcaccggggaagcacaaggggtcagggaattccctttcctagccaaggaaagggatgacagatggcacctggaaaattgggtcactcccaccctactactgcacttctccaacggtcttagcaaacagcgcaccaggagattatatcccgtgcctggctcggagggtcctacgcccacagagcctcgctcattgctagcacagcagtctgagatcaaactgcaaggtggcagtgaggctgggggaggggtgcctgccattgctggaggctgggaagctcaaactgggtggagcccaccacagctcaaggaggcctgcctgcctctgtagactccacctctgggggcagggcatagccaaacaaaaggcagcagaaacctctgcaggcttaaatgtccctgtctgacagcttggaagacagcagtggttcttccagcatgcagctttagatctgagaatggacagactgcctcttcaagtgggtccctgaaccccaagtagcctaactgggaggcacctcccagtaggggcagactgacacctcacacggccaggtacccctctgaaacaaaacttccagaggaacaatcaggcagcaacatttgctgttcaccaatatttgctgttctgcagcctccgctggtgatacccaggcaaacagggtctggagtggacctctggcaaactccaacagacctgcagctgagggtcctgactgttagaaggaaaactaacaaacagaaaggtcatccacaccaaaaccccatctgtacgtcaccatcatcaaagacaaaaggtagataaaaccacaaagatggggaaaaaacagcagaaaagctgaaaattctaaaaatcagagcgcctctcttcctccaaaggaatgcagctcctcaccagcaacagaacacagctggacagagaatgacttcgacgagttgagagaagaacgcttcagatgatcaaacttccccgagctaaaggaggaagttcaaacccatggcaaagaagttaagaaccttgaaaaaagattagacgaatggctaactagaataaccaatgcagagaagtccttaaatgacctgatggagctgaaaaccatggcacaaaaactacgtgacgaatgcacaagcctcagtagccgattcgatcaattggaagaaagggtatcagtgatggaagatcaaatgaatgaaatgaagcaagaagagaagtttagagaacaaagaataaaaagaaatgaacaaagcctccaagaaatatggcactatatgaaaagaccaaatctacgtctcactggtgtacctgaaagtgacggggagaatggaaccaagttggaaaacactctgcaggatattatccaggagaacttccccagtctagcaaggcagcccaacattcacattcaggaaatacagagaacgccacagagatactcctcgagaagagcaactccaagacacataattgacagattcaccaaagttgaaatgaaggaaaaaacgttaagggcagccagagagaaaggtcgggttacccacaaagggaagcccatcagactaacagctgatctcctggcagaaactttacaagccagaagaaagtgggggccaatattcagcattcttaaagaaaagaattttcaacccagaatttcatatccagccaaactaagcttcgtaagtgaaggagaaataaaatactttacagacaagcaaatgctgggagattctgttaccaccaggcctgccctaaaagagctcctgaaggaagcactaaacgtggaaaggaacaaccagtaccagccactgcaaaaacatgccaaattgtaaagaccatcaaggctaggaagaaactgcatcaactaacaagcaaaataaccagctaacatcataatgacagaatcaaattcacacataatattaactttaaatgtaaatgggctaaatgctccaattaaaagacacagactggcaaattggataaagagtcaagacccatcagtgtgctgtattcaggaaactcatctcacatgcagagacacacataggctcaaaataaagggatggaggaagatctaccaagcaaatggaaaacaaaaaaaggcaggggttgcaatcctagtctctgataaaacagactttaaacccacaaagatcaaaagagacaaagtaggccattacataatggtaaagggatcaattcaacaagaagagctaactatcctaaatatatatgcacccaatacaggagcacccagattcataaagcaagtccttagagacctacaaagagacttagactcccacacaataataatgggagactttaacaccccactgtcaacattagacagatcaacgagacagaaagttaacaaggatatccaggaattgaactcagctctgcaccaagcagacctaatagacatctacagaactctccaccccaaatcaacagaatatacactcttctcagcaccacatcacacttattccaaaattgaccatagttggaagtaaagcactcttcagcaaatgtaaaagaacagaaattataacaaactatctctcagaccacagtgcaatcaaactagaactcaggattaagaaactcactcaaaaccgctcaactacatggaaactgaacaacctgctcctgaatgactactgggtacataacgaaatgaaggcagaaataaagatgttctttgaaaccaatgagaacaaagacacaacataccagaatctctgggacacatttaaagcagtgtgtagggggaaatttatagcactaaatgcccacaagagaaagcaggaaagatctaaaattgacatcctaacatcacaattaaaagaactagagaagcaagagcaaacacattcaaaagctagcagaaggcaagaaataactaagatcagagcagaactgaaggaaatagagacacaaaaaacccttcaaaaaatcaatgaatccaggagctggttttttgaaaaaatcaagaaaattaatagactgctagcaagactaataaagaagaaaagagagaagaatcaaatagacgcaataaaaaatgataaaggggatatcaccaccgatcccacagaaatacaaattaccatcagagaatactataaacacctctacacaaataaactagaaaatctagaagaaatggataaattcctcgacacatacacactcccaagactaaaccaggaagaagttgaatctctgaataaaccaataacaggctctgaaattgaggcaataattaatagcctaccaaccaaaaaaagtccaggaccagacagattcacagccgaattccaccagaggtacaaggaggagctggtaccattccttctgaaactattccaatcaatagaaaaaaagagaatcctccctaactcattttatgagaccagcatcatcctgataccaaagcctggcaaagacacaacaaaaaaagagaattttagaccaatacccctgatgaacatcgatgcaaaaatcctcaataaaatattggcaaaccgaatccagcagcacatcaaaaagcttatccaccatgatcaagtgggcttcatccctgggatgcaaggctggttcaacatatgcaaatcaataaatgtaatccagcatataaacagaaccaatgacaaaaaccacatgattatctcaatagatgcagaaaaggcatttgacaaaattcaacagcccttcatgctaaaaactctcaataaattaggtattcatgggacgtacctcaaaataagaagagctatttatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgactgtatatctagaaaaccccatcgtctcagcccaaaatctccttaagctgataagcaacttcagcaaagactcaggatacaaaatcaatgtgcaaaaatcacaagcattcttatacaccaataacagacagagagccaaatcatgagtgaactcccattcacaattgcttcaaagagaataaaatacctaggaacccaacttacaaaggatgtgaaggacctcttcaaggagaactacaaaccattgctcaatgaaataaaacaggatacaaacaaatggaagaacattccatgcttatgggtaggaagaatcaatatcatgaaaatggccatactgcccaaggtaatttatagattctatgccatccccattaagctaccaatgactttcttcacagaattggaaaaaactactttaaagttcatatggaatcaaaaaggaacccgcattgccaagtcaatcctaagccaagagaacaaagctggaggcatcatgctacttgacttcaaactatactacaaggctacagtaaccaaaacagcatggtactggtaccaaaacagagatatagaccaatggaacagaacagagccctcagaaataatgccgcatatctacgactatctgatctttgacaaacctgacaaaaacaagaaatggggaaaggattccctatttaataaatggtgctgggaaaactggctagccatatgtagaaagctgaaactggatcccttccttataccttatacaaaaattaattcaagatggattaaagacttaaatgttagacctataaccataaaaaccctagaagaaaacctaggcaataccattcaggacataggcatgggcaaggacttcatgtctaaaacaccaaaagcaatggcaacaaaagccaaaaatgacaaatgggatctaattaaactaaagagcttctgcacagcaaaagaaactaccatcagagtgagcaggcaacctacagaatgggagaaaatttttgcaatctactcatctgacaaagggctaatatccagaatctacaatgaactccaacaaatttacaagaaaaacacaaacaaacccatcaaaaagtgggtgaaggatacgaacagacacttctcaaaagaagacatttatgcagccaaaagacacatgaaaaaatgctcaccatcactggccatcagagaaatgcaaatcaaaaccacaatgagataccatctcacaccagttagaatggcagtcattaaaaagtcaggaaacaacaggtgctggagaggatgtggagaaataggaacacttttacactgttggtgggactgtaaactagttcaaccattgtagaagtcagtgtggcaattcctcagggatctacagctagaaataccatttgacccagccatcccattactgggtatatacccaaaggattataaaccatgctgctattaagacacatgcacacatatgtttattgtggcactattcacaatggcaaagactaggaaccaacccaaatgtccaacaatgatagactgggttaagaaaatgtggcacgtatataccatggaatactatgcagccataaaaaatgatgagttcatgtcctttgtagggacatggatgaagctggaaaccatcattctcagcaaactgtcgcaaggacagaaagccaaacaccgcatgttctcactcataggtgggaactgaacaatgacaacacttggacacaggaagaggaacatcacacactggggcctgttttggggtggggggagtggggagggatagcattaggagatatacctaatgtaaatgacgagttagtgggggcagcacaccaacatggcacatgtatacatatgtaacaaacctgcacgttgtgcacatgtaccctaaaacttaaaaaaaaaaaaaaaaaagaatgaaagtcttaaggtccttccattatacatgaagtagtgtactattcattgaaggtagactgagataagttaaaaatgcatatagtaaactagaacaatcacccctacaaaaaaacaaaaagaagtatagctcgtaaaatgaagataacataaaaaactaaaaaatactcagttaatccaaaaaaaagcaggaaatgaagaaaaaacaaaagaatgatagaacagcaaacaagcaagatggcagatataaacccaaccaaatagaataaatgaaattaaaatagtttaaaccctacaatttaatggtagagcttgtcaaattaaattataaaataaaatccaaaccatatacggcttacaataaaacacagcttaaacataatggtataataggtttaaagaaaaatgaaataaagtagctgctatactcatatcagatagatttttgaggcaaggaatattaccagagacaaagacatatatgccataataataaacaggctaactaatcaagaagatacataataatactaagagattcaaaatataacaaaactgaaaatattgacagggaaaatgaaaaatctataaatatagttggatatttcaaaaagcttctcagtaattgatagaatcagtaaacagaatatcagcaaggatgctgaagacttgaatatactatcaagtaaatttacatagcatttacagatcactgcacaaaaaagcaaacttttcaagtatttatgcaatattcaccaggaagacctaacacctaagttatgaagcatgtctcagtaaatgtgaaaggtctgaaatgatacagaacaggttctttggccaacattgaattaaattagaaatgaataataaaaaggtatctaagaaataaccaaaatctttaaaaattaaacaatacttctatttaacatatgaatcaaagaagaatacacaacaaaaattagaaaatattttaactggatgggaaggtaaatacaacctatcaatgtctgtgaatagaggtaaaatagcacttagacaaaaatctgtattttaaatacatcgagaacaatctgaaattatctaaacttccaccataataagctaaaaaaagaagagcaaattaaacctaaagtaagtagaaagaaggaaatcataaaagactggaattcaatgaaataggaaaacagacaaaaactgagaaaaagcaatttgagaaaaatgaagctgaaggatgattctttagaaaaacgagaaaaattaataacttataggtagaacaatcaggaaaaaagaagacacattttcagtatagaaaatgaaagacagtaaatcaccacaaaccccatagatattaaaaggttaacaagaaaatgttacttaaaaaaacaaaaacaaaaagaaccctctggctatagattcaacaacttagatgaaatgaacacattccttgctaaagatgaatggttagtttaatattcaaaaattaatcactgtaatgtaaatcaataccacacccactaggaaaaagacagactaacaggtgttggcaaggacatggagcaactggaattaattttttttttttttttgagacggagtctcactctgttgcccagactgtagtgcaatggcacgatctcagctcactgcaacctccgcctcctgggttcacccaattctcctgtctcagcctcctgagtagctgggattacaggcgcctgccaccacgcccagctaattttttgtattttaagtagagacggggtttcaccctgttggccaggctggtctccaaatcctgacctcaggtgatccacctgcctcggcctcccaaacaaagtgctgggattacaggcatgagccactgcgcccggcacagctggaactcttatacactgctagtaggatgtaaaatggtgtagccactttggacaatagtctagcaattcctcaaaatgttaaaatagaattaccatactactcagcaattctactcttaggtaaagacacaatagaaatgaaaacatatgtcgacataaaaatttgtacataaatgttcataacagcattatttataatagccaaaaagtggaaaaatgtcagatttgaactaatgaacagacacaaagatgtgacatattcatacaatggaatattatttggcaatgaaaaataagtgagtattgaccacagataaaccttgaaaacattatactaagtgaaagaagttagtttataaaaggccacatgctatatggttccacttaaatggaatatccagaatagacaactctatagagacagaagtaaattagtggctatctagggctggaagggttggtagataatgatgctaatggatactgggctcttttcagggtaacaaaatgttctaaaatttaatatgatagttgtacaactctgtgaatatactgaaaaccactgaactgtatgtacacttcaggtgggtatgaattatatctcagtattatatgaattatatttcaataaactgattaatactcaatgttataaatcatatcacaaaataaataaaaatataataatctcaatagatgtagaataaggaaatgacaattcaacacgccttcataataataaactaggaagggaagaaatgtcctcaacctcataaaaggcatctatgaaaacctatcacacttaatagtgaaagactaaatgttttacctataagttggggtattccagaattaaaagaacatatattgatgcaatagtactgtcactcaaatgatttttgaaggcaattattcttccttctggggagacagacccttgaaaaatcagatgaaagtcagagatcctttcttaagaaattcatttaaaaaaaagattggagaaaggaaaggatgtttgcccacaccacttttattccacatcacactggaggttctaaccaatgcaactaaccaagggtagaaagataaataaaaggcatatcgactgaaaaaaataaataaataaaactgtttttattggcatgtaacttgattgtgtatataaaaatcctatgaaatctataaaaaagcaattagaaatgagtttcactagttaatagtatacaagtaaatatacaaaaataaatgtcaaaatgactctttaaaatagtaataaacaatgagaaataaaaattttaaaactactcacaatagcaccaaaagacatgaaatatttaaggatacatttaacaaaatacatggaacacacacacataaaaaagtagacagcactactgagagaaagtaaaggaggcctaaagagccataccacgactgtgcattaaaagtcttaatattgttaagatatcatttctaagctgatctatgtaatctcactcaaaatcccaaaaggtacacactaataaactgactgccctgcagatgctgtcctggacctgccagctgcacagatgcagatgctctgctatgcctgtaacatcggggcgaagtgaaagtggctatttctacactcagtgttcagaaaacactgaacaacaagaatggataatagcctgacatttcttaggggaacaacaacaacaaaactgagtctaacatttatgtgggattgcaaaggacctagaacaattttgagaacacagttgaaggacttatactacctgataattttaagacttactataaagttacagaaatcaagagtgtgtcatgagtgaaaggacagatatatagatcagtggaacagaatagattctagatagattcacatgctatatacatggccgttaggatttgacaatgagggcaaagtaattcaatggggaaaggatagtctttttaacaaatggtgctgaaaaactagatatacatattttttaaataaactttgacatttgacatttaccttccaccatacagaaaaactaaatgaaaatggatcatagatttaaatataaaagcgaaaattataaaactcctagaaaataacacaggagaaattttttgtgatcttaggataagcaaatattttgttgacatgcaacacaattgtatacataaaaaatcatgaaatgatacacaagaagcataaatcataaaaaaagtaaattaaatttcgtcaaaattaaaactctctgctcttcaaagacatcattaagaaaatgacaaggtaagccacatacaaagataaaatattcacaacacatatattttaaaaattcagtatccagaatatataaataacttacaaatcaataaaaagagttaaggggcagaatatttcaaccaagcctttatcaaagaaaatatacaaatagcaaataaaactatcaaaagacagcagacaccactagtcacaggaaaatgcaaattaaaaccatcatgagataccactactacacattgactagaatggctaaaattaagaagaatgaaaataccaagtgttagcaagggtgtggcaaaagtgggactctctcacaatgcaaaatgattcagtcatttgaaaaactgtatggcaggttcttatagttacatttaccatatgaccagcaattccactccacccaagagaaatgaaaacatatggttacataaagacctgtgaacccatgttcataacagctttactgataataaaaaaactggacacagtccagttgtccatcaacaggtgaagggatatacaaattgtggcatggctataaagcagaacactgcttggcaataaaaaataaatgcactggctgggcacgggggctcatgcctgtaatcccagcattttgggaggcagaggcgggcagatcacaaggtcaggaattcaagactagcctggccaatatggtgaaaccccatctctactaaaaatacaaaaattagccgggcgtgctggcaggcacctgtagtcccagctactcgggaggctgaggcaggagaatcgcttcaacctgggagacggaggttacagtgagccgagatcgcgccattgcactccagcctggccgacagagagagactctgtctcaaaaataaataaataaataaaataaaataaaaaataaatgcactactggtaaaagcaacaacatggaaaaatctcaaaagtattatgctaagtgacagataccatatgtaaaatgctacatactatacaatttgtgtaattccacttatgtgacagtctagaaaaggtaaaattatagggacaaaaaaagagatcagtgtttcctgaggtcttagagtaaaagagagggaatatacagcaaaggggcactggaacttttgctgatgaaggaaatgttctacatttcagttagagcaatggctaaatgacaatatacatttgcctaaattcatctaactatacactttcaaaggatgtattacatgtgagtaagttatacatcaataaaaagggcacatacaaaaagcgacaagccattggatataaggaaactatagaaaaaccagttgtatttttgtgtacaagcaactaataaaaattgacattttagaataaaacatcgtgtaccactgcatcaaaaatatcagagaataactctttaaaaagatgtgtgagaccttcacactgaaaattgcaaaacattactgacaaaaatcaaagacaaaaaaggggacaaaccatattcatgaattggaagactcaaatactatacagatatcaactatctcaaaattgatctataaattcaatgtaatcccaatttaaaaacttatatggaaatacaaaaggcctagaaaaaacaagtcaacctcaataaacaaaactggaagaactatattaccagacagcaagacctattataaattactcataaagtacttaagacacacattatttatcctgctcaacggtaaataatagcccaatggaacaaaacaatgtccaggcctacacatgtacaattagctgattctcagccaagacttctggcaattcagtgggagaagggatggcatttcaatgagtggtgctgcatcaattggttattcatatggaaagaaaacaagacaatcttgtcctctacctcacaacatatgctaaaatcaattccagataaaccgtacatcaaaatttaggagcaagaacaataaagttttaaaagaaaacaagagaagatccacatgatcttgaagtaggctaaggcaaagcactgatcaaaaggaaaaatgtaatgaattggactattttaggaacttctactcttcaatgatgccattaagagagtgaaaaggtgaaattagaaatgtacatacatccagcaaaagatttttatccaggaaatttcaattactcccacaaataagaataaaaataggcccacagaacagaagaattggacatagatttaaacaggtatttcactacagaggacatccagatggccaacaagcatataaaatttataagtcattaaggaaatgcaaattaaaataacaaggtactaccatggacccactagaatggctaaaatggagagttaacagtggtgatgttgtcaagggtgcagaacaactgacaccctcacaccctcctgatgaaagtgtacatgactactgaatttggggctgtatccatgaaagctgaatatctgcaaatatataacaccaattccattcctgtatatatatatccaacagcaacatgcacctatgtgcaccacaagatatataaaagattatttgtagcagcattattaatagaggaaaagtgggaacaaaatgaaatgtttattaaacactgaatggataagatgatacgtttatacaatggaataccatatagcaacaaaaatgaaaaaaacatgaccatataaaaaaacatgaatgaatcttataatgttgcacaaatgagggcaggcacaaaagaatacataagctattggccctttatttaaagatcaaacataggcaaaatgaacatatggggttagaagtcaagacagtggtcaaatgtgagaatgaaggagtgaatgggagggggcagatagggcttttgggacgctggtagtgatctcagtactggctacaatgacatttcactttatgaaatttagtttgtgataattcaccaaacaatacacttataatttgtgtgttttaatgtttgcatgttattctccaagtttttaaaaattaggcaattctatatgttaatagaaagaactccaatgtatgtgtgtggtttaatgaaaagaaccaaccactaaatagtgcactacacagaatactatcattttgtaaaaacagtaatgaaaaggatatatgtttgtgtacaataatcataatggcaacatttactgaaagctaactacttgctaaggtactgtgttaggcacttttcatgccttttatcatttatttcactcaacattatgaagtgggtagttattataacccttattttatgaaggagaaaactgaggtacagagatatcaagtaacgtgcccacagtcaccaagccacaaagctgaaaaacgggcactgtaacccaggctctccagatccactcttccccaccacattctccctagataggcacatgagaaactggcaatggggtgcctctgagaagggatctggggattggaaggcaggctgagaggaaggctggcttatcatagcatactctaggtaccttttgaaggaacacatttgcacgtcttatctatcaaaaatgtatttatttacaatatttttctatggtttataatttctgagctacacaaaattgctttatccagaaagtaagcataactcactgttttattactttacctgatttaggatgcaaagcatcgcattgggcattgtacatgtgtacaaattcttggtgccttttaatgagctgttgtttatttccttgaatagataatccatgctcttttagctttttctttaaatcacgatcagagagcaaattatatacagttttgggcagcggcttccttttgtgaacagaactgaaaaggggggaagatacctgatgattattgtgaattatcaaatgcttttcatgtaaaatggcaaataaattctgattcaacacctgggtgaccgggaaaatagtagaaccattagattaaaaaggggagagaaaaatcaagtttgtggataaagttgagtgtctgacatgatgtatctgaggtgctggtaagacattcagacacaggggcctaggtggcaccagaagtgagagacttgggtctcaaaaagaggtcagacctaaagaggcacacttagaagacatatatgtaacgcttgtggaatatgctgtgaggacttcacttagaatcacacttacatagacctattcaattttccacctctttaaagcatgctagaaattctagtgggctaaaattcaagctacataaaagtaccaatgacttaagcaattccataaacaggaacttcttagtgagttttaattcatttcacctgattatagcaggttctctacctggctcagctttatggcaattagatgcttaacaaaaatgtgctcaaggaggtcattacacttgctatcatttcaaaataagaatagcaaagattcaggtgaaaattaacagaaacttgaaataataggtttatccaaaaaacaagtttttacaaaggatttgcatataactagctcacacaaggctgtcccaaacgttagtgtacctaagaagcacctaaagagtttatttaaaacgcagattctccatccccttctccacaccatccaccaattagggttcaggtctgaagtggagctctaaaatctctattttcaacaaggttctccagagtaaatctgatataaacggtccaataatcaaacagagaaatattacagtcaggtatagactgaaaacaatcaaaaatttctctattaaccaacagagccattccccaaataaattatgtcttttatgctgtattaacaaagtctaaaagccagaaataactaattaactgtgaaaagacctgcaaactctcaatagattatatttttctgaaaattgctcttcttacaatgacaacccatctgactctacaaggttgataaaattatggcaaaatgaaatctcagtaggtagcaacagctgaatcattttgtgtttacagaagcacacagggagagatgattcattacgtctgtatctaaaatatttgttttatcaaggacagatgattaaactgtgactgtgaaattccagtgaagaactgtactgttcactggcatttacaataaaaagcaccaccagagatcaacaatttctatcaggaattttaaaacatgaaacctgataaatgtttccccaaacacgaaaatgacattgatttttcttccatgatttagtggaactgagtaatacatttaaggggcctcagaatctgaggcagttctgacatggttttatatagaagggttaagggctgccactcacattcagcagatggcctgtcagaatattgtggaggagacaggaaaactcacagggccttttctctatgacctgactccgtggccaagatacaactaaagaagaacatggcccagtgttgtcttcagaatctccacaaacaccagttttgtaagatggaagtgatgagaacagaaaggcttggcggtcaaataaatttaggattactaaattaaacaaaacctaacagtaacccttaatgtaggacttctcaaagcctttaacacactaagagggggatccaggaggtagtgcttataagttcactacagagcactggcaggactatagtgttctttgaagcaggaatttaaaccactattagaacttaattacacatggacgagtatgtcttcaaacaaactgacagcatcagaaatgatgtatcagaaatgtattcgaactgatggatggatctagaaaaaggggagtccatgcaagataatcagtgcagattccttactcttccaaaagaatatactcagcttctatattcccaactcatgcatttctaaagagaaaagcagttcatcaaactctcgtggcttatgggaaataatccttaggactattcatttactccaaatcaccactaagcaacctaaaaatctaaattttattctcattaacaaacttacccactaggtgggagtactgtgcatgtaaaactgccccaggtttggactcaagtatgtctaccttaataaagcaccattgtgtcttatatgttagcttttgtaagttgtaacagtatgaatctgaccctcagaatctgcattcactccaaatttactcataaaaattaagtgatgtattttctttaatcacaaaaaataatactatggctctgtcttattaacatggtttttggaaaatactcttcaaagtccttcaaaacagactgaacatagaagcaaatcattctttcatccccacttctcagataccattaatttcttcagcttccctcctcttcttttccaaatctctctgaattatcacctattatcttgcccttgcctcctgtttcagaagggtcctttctgcatgtcaaggataacctcattactgggctcttgtgctcctcactttcttccatttatcctctgctctctccctggaaatagtggaaggaaagagactgaaggcttaaactcctatttttaaaaagaacaacccttgatctttatgccactcactgcttctccaaactaccatctcatctttctcccttcatcaccagactcatctaaattgtgtcttctgcttattatccactgattccgtaatgccttgcaatttaagtttgactagtatttcattcctgaacaacttatatgtgtaacaatagtggactagcatgagaaattacagttattttcatgtacaagggaggtagaacagcacagttgtttagatgtaaatactgagctgacaatttattagctacaatacctggaggatgggggggtggtgtggggtatgacattacatttcatatatgcatttttgtacctttttatatcatatatatttatataatttcctagtcaaaattttttgaaaaattcaattttaaattttaaaacttctgagcatcctaaagatcagagaaaggttttttatatcttatattcagagtctaaccttgctttctttggccaagaggctttttggtagtttttaaaatctaagagaaaaaaacaagtttaaaaagaattgaatttgaagtcactaatttcttattaagtcaaaatttagtagcagttcaaatattcaatatagctaatcatatttggcaaagtgggagttgaagaaagaacagaggagagggattggaagaagtggccaacaggagtaaagaagaaagcaagtaagagcaggaaatacggtcaccaggataaaaggaatactgtaattttcccccaagtaagcacaagaggcacccagctaaagtagctcaatggttctgctcaacttccttaccttctgaggctttccttcttctcttcgcgtgataaacagctgtctaaatgcttattaatgtgactttctggaatgttaaccccgcaaacaggacaatccactgtattttttaaaaagaaaaagagagactttattaattgtagaaggggcaaaagtatgtaaactggcatcttttcagcaagtaaagtaaaaaagaatcccaacttaacatgcacttagaaaagcagaaaagaaaaagaatggcccatcgggacaacaggagtgggacagactggttactgggtaatggctaaattgtgggaagtcacaaaattgaagtcctggtcccagagaaagagactgcaaataagcttgaaagttcatttattaaaaatgtttcggttacatcttttctaccaaggtatgaccaaactatagaactcatcttaaattttcccaacccttaggagctatccatgtttagcccagaagcaatagtaacgacttaagtaagacacacctggcccaagggccgagtgaaggaaaggtagtttaataatttattgagttcaattttgtcaatggttacaaatttgttaatttagctctcactgatgattccatatataatgttaaaattaaggaacacagtcattctcaaactatttcataaagttgcagggatctgtgggggtatctcggggcctacagaccaccatggataataggcagaaggaggtcaggtggaacagaacaatctgttttatctattttatacgttatggtttatcgtaaaatttcatttgggaaaaaaggttccgctaggggaaaaacagttaaccatcaagctaaaaaatactacaataagaactgtcaattggtaaaaagactaaggatagacatagtagaaaatataagtgaaatttatatatctttaaaagatgtaaacacgttaagtactaataaactaatttcaatctaagtttaatacacactcacatctctgcactacgtgtggtatgggtataccaaagatgtctaagagtttctgcctaaaaggtgctctaaacttcactggaaagaagatacagaaacaaaaagttaaacaagctgacatattcatcaaacagttaagcaaatgggatacaaaacagtccagaaaacaagtgctatagcacttttgtgatgtgagacagtgttttctaacataacaaatgaatagtgaggatctggatagagtctggaaaggtatagaacaggggccggcaaacattcttagtgaagggccaggtagaatttagactttacggatcctatggcctctgtcacaaccatgcaactctgccactgtagaatgaaagcagtcacagagaatagggtgggtatgtgaacttttatttacaaaaacaggtggcaagccagattagatctgccagttgtagtttgccaattcctcagtgtactggaggaacagtggggaggctagagcaggacttctgagacagagaggtgagcaataaggcgggatgactaggttaggcctcaaattgtcacaggctttatatggcaggcagaacagtgaggaggcattcaagtggtggtaaaataagataaaaagagcttttcaagattaaatgggaactgatatgttgaatgaggggaagaaagattaaaagctgaaaacagaaagctactgccatacttgaaggctgaactaattaaaattgtttcctttttgtagcagtcagcctgaattcctgtttctgagagagaaagagaacaaacatatctacaacaatgtctgaggtttgtgatatggtaaaatctggtttgtcctttaccattccttccccctcaaagatgctgcctatttattcttatgtcatgtggatgaaaagatgtccatatttccacatatgaaaataacttcctacctttagtaacttgtttcaaagtggatgtcgagggtggctcaggacgcttagcctctgagggatctggagcgatctcttctacagaacgtgtctctttggtctttgcagcagggctcgcctctttttgagggctgaatttgcttttattttcttttatcaacaactctgatgtagaaccactcatttctctgatcaagaaattatccattaacctgctcccctgctttaaagactgtctggaggctacaggagtatatactttgacagcaagattctttgaagaggaagaagcaggagatttggctggtgactctaaagcaaactgcagcagatgattccttgaagcacaaagaacacaacagacaattaagagatccaattttacatcataaattaactgacataagctgttttcccaattaaccttgttttctgaaatacaggacctatactataatgacaaccaaaccaaagtttcttctagtataactcaaagcaataaatctaacgtaaaaggcagttaatgtgtcaataaaacaaaatgaaaggaaatcagctttaggccacagagaacagcttatatgagacctaatctccaaccataagtaactttaaaatccgaacaaaatatactgatatagtctggatgtcgtctccaccaaatctcacactgaaatgtgattcccagtgttggaggtgggacctggtggaaggtgactggatcatgagggcgaatttctcatgaatggtttagcaccattcccttagtgctgtccttgtaacagtgagtgagttctcatgagatctgttttaaaagggtgtggcacctcccactctgtctctcttgctcccactctcaccacatgacatgctgcccgtcttttgttttccactgtgactgtaagcagcccaagacctcactagaagccgagcagatggcttgtacagctgcagaaccatgagccaattaaacctcttttctttgtaaattacccagcctcaagtttactttatagcaatgtaagaatggcctaacttgcataaaaaacaactctttgtaggcactggactgaaatcaacacaaggctgcaatccctgaaaaagaagaaaacatgaagtagtccaacatttcccccaagacttactttaccctgggagcattttctaggaatgggtactaaagtgaagtctaaacaggaaacattgatcttacttgttagagaaaataagagatcagagttctgaacaaaactggccaggattgaggggtcagagtgctttgacacgtggtagctactgaaagggaaccccaccagtctgcttagaaattcacatccattcctgctcatttccagggctgcacatgattagacaaaaacacaggagacccactaggaagctgatactggtaaattaaaatcccaaacgtcagtgctggaaagttagttgttcgcattggagcccagccaaagctgagaaatcttggtaagatcatggacattcaagtgacaccccacaaagaccacaccttagaaaaatggaccacactgaagaaatataaacaaagctcaaacagacctaacctaagaaaacattataccaggccttgacagaacaaagatgaagagctgataatttaactgcctcttagaacaaaatgtgacatctttcaaaagaagacaattcacagcttctacaacgtttcaaccacaatgttcagcacatattttaaaattattgaacatgcaaagaagcaagaaaaagtagccactaatcaagagataaaatattcaatagaagcagacccagaggtaatccaaagaatagcatctctaggtaaggacttcaaactatgataaacatgttaaagaaaaaaaaagaaaagggataaaaagatagtgtattatgagaaataaaatccataaaaaagaataaaatgaacattctacaactgcaaaataccatatctaaattggatgagtataacaacacacaatacaaacttgaaggcaggtcaatagaaaatatccaaaccaagcacagagagaaaaatgaatgaaaaagacaaacacaaaaaagtatgagatattgggcataattaaaagcccagaaggaacagaaagaaagaatgggaaatcagcaatactagaaaaaccaatggctgagaattttcaaatctgatagaaaaaaaaaatcaacccatagattccaccactaccgaatttacatgaaacgcaacaacagaaaaataactagaaaatctccaaatgttaagaaataaagcaccacacttctaaataaccccgcatgtcaaatcacaatgaaaactagaaaaatattctaaactgaacgatagcatgaagggttgccaaaactgtccctggagggaaaattattgaaaatagaaaaagtaaaaaccaccactctaagcttccaacttaaaaggttaggaaatgaacagcaaactaaacccaaagaagagagaaactaataacagatactagtgaaatagaagagataacaagagaaaacaagcaaagccaaacattggttctttgaaaaaattaacaaaactgttaatccctactaagactgaacaagaaataaatgagagaaaatacaaattaccaaaacaaagaattaaaagaagacctcgttacaaatcctataaagaagataattagaggatattatgaacactttaaaacaacaaattttaaattttagataaaatggacaaattctttgaaaagcactattcatcaaaactgacaaagaaacagaaaacctgaagagcccttattatctgttaaagaaacagaagctataatttaaaacttttccacaaagaaaactccaagcccagatggcttcactggtaaattctaccacatatttaaggaagctttgtttatttcttcagtgtggacatggtggcacatacccatagtcctagctaattgggaggcagaggcaggaggatcccttgagcccaagagttcgaggttacagtgaaccatgatcatgccactgcactgcagtctgggcaacagagcaagaagaagagaggaaagggaggaagggaaggaaagggagggaggaatagacgggggagggaggaatagagaggggaaggagaaaggaggagggagggagaaaggaaaggagggaggaagaaaggaaagcagagagggagggagggagggaggaaggaaggaaggaaggaaaagtcttgtccatctgttaactatacaataaccttacctcttcagaatggggctaagaatcaagagtcaaaataggcctttgggtagacatgggcagccattaaatctatgcaatcaattccatggacttctgtaactaaagtcctgcaatgcttgttctgatcagaaacatgtaaacagcagtctagaaccatttggctaaacaataaactgtagtcggcccttcccatccaccagctctgcatctgtggattcaactaatcacagagcaaaaatgttcaaaaaataataaaagtaacaatacaacaatgaaaaataatataaattttaaaaacacagtatgacaacgatttatatagcattgtattaggactataagtaacctagaggtgatttaaagtataagggaggatgtgcatatgcaaatactatgccattttatgtcagggacttcagcatccacagattttggtattctcaggggtcctgggaccaatcccctttactgagagacaactgtactaaatttgatcgtttttagaatgcaaaccaataaagaaatgtgtaattctattgaaagaaatctgtttatatttttaaaagcaacataaggtacctcatagaatgttccaacatgctttgttcaacaagagaccaaatacacagtggtggtttcattagacgataatggagctgaaaaattcccattgctaagtgacatcttgataatcctaaccctgtgtgggcctaggctaatgtgtgtgtttccatcttcttttttttttttttttttttttgagacggagtcttactctgtcgccaggctggagtgcagtggcgtgatctcggctcactgcaacctccaactccctggttcaagcgattctcctgcctcagcctcccaagtagctgggattacaggtgtgtgccaccatgcccagctaatttttgtatttttagtagagacagggtttcaccatgttggccaggatggtctcgatctcctgacctcgtgatccacccacctcggcctccgaaagtgctgggattacaggcgtcagccaccaagcccggcctccatcttcatttttaagaaaaagtttaaaaaggaaaaaataataacaatttttaaaaacagaaaaaacctcacagaataaggatataaagaaagatgcttatacagctatacgatgtgtttgtgttttaagctaagtgttattacaaaagagtcaaaaagttaaaaaaatataaaagtttacaaagtgtaaaagttacagtaaggttaattattgaagaaacttttttataaatttagtgtgtagtctaagtgtacagtgtttataaagtctacagtagtgtatggtaagggccttaggccttcacattcacttatcactcactcattgactcatcaagagtaactttcagtcctgaaagctccattcatagtaaatgccctataaagatgtaccattttttatcttttataccatattttccctgtactttttctatgtttagatacactaataggtaccattgtgttgcaactgcctaccgtattagctatagtaacatgctgtacaggttttgttaccaaggagcaataggccctgccatatagaataggagtgtagtaggctataccatgttggtttgtgtaagtacaccgtatgatgttcacacagcaaccaaattgcctaatgacacatttctcagaacacatccctgttaagcaacacatgattacacttaactacaggggcacctgaccactatctaaaccagtacgtccttcataaaaattcttgtttgacttgcatgattaaaactaaaagtaatccaagatattgaaacatgccttttcatatccctttgggtgaccaaactcactttcacacattcatgcatttgacaggaagtaaagttgcatatctgagctttataaagtacaagcaattacatatttcaaatgccataccatttaatacatgctgaataaatccgattaagaattaacagattaatatatagcagacagaatcaattatagatatgtgtatatacatgagttagtacatacatatatataacatacatatattacttagctctgtccattgagagggcctagaagcaatgacaccccagtagcaacaagcatacccagcaccagatcctggtctctaaatactattctccaagaagaggagctccttggagaaatggctgattctagggcttgggcaggaaaaggagtatcttcagagcacccaaaagtaaggaagtcctcaaatctgcgttttaactcttaattattctatactacaggagaatttctgttaagtaaaggaagaaaatcttactctagtaaattttccatgtgtgaataatgactgttacttcccttctttgactataaaatatgcaaccctgcattccctaatccaaaggtgcacaaagtaaagagagaacacatataaaaggcaaaagtagttagaggttagtcacaaaattaaatcataccgtgcaaaattcaagctttttaccagttcatctaatatgcggttatttttcagatccggctctgtgacagtctagaaaaaacaaacaacagatggaaaaaggtcaaaaacaataatcaacttgtcataatcttgtttttgaaaatgtctgacccatcctcctgaggttctccatcccactaagtcttctaaggcagcctcaaaataaagttcatttatctcatgctaatatgaaattttaaaacagtgaatcagtatctgctgactggaagtctgataaaagctctccagagcttctcttataatcatatatactctgtactgactacaatcaaacctaatataagcaagaatctttcttcaaaatgccagcactcagctttctcagaaatttctccggaaaaacagaagagaaatgttcttttaagttctaacactgggagaggcactaagtgttcaaggagaattttaaagtaagattggttttcaggaatgcaagagaaaagtgacaaacccagtacttatttggcatgaatggtacacagtttatctcagcgatgagaccatcttgtcaaaagcagtgtaacatatcgtaaagatcttagacttaagagccaaatcacaaaatttcttacatagagaaatagttcgaaatgttcagtgacaccctgacaccacatacctaccagagaggcaaaactaaccaaactccttacctagtcctagtgtcggctctgtcagacctcacttgtctcttctttctttattcccacttatgtttaattacccttttagtctacttttccacctgttcccactacttgaaaagtttcagaaacaataacaacaaactttctagggttttccctgaagctctggtaggggaaagatgtaagggaacagataggccggattaagcccaacagccatgcatatttaccttctgcacaaatacttagacagttctttgcaaatgaataatcataccaccagagtttctaccaaagtgagaaattattaaaaatgagaagccataaaaacatgggtcataagaattaaagagtgctacttcctaaaatacatttaggttttcagaaatcttaacaaaaaaactgaacaaagcccagctcttcttacatgtactttagaggtcctttctgaaaatgtctttcatatagcttaattcagtaactacacatcaccctatatatacacaggcttttacgtatacacaaagcagaaatatttgcagcagtcagtaagttttaaaaaaaggaaacaaaaactcaccacacagcaagttggacactgagttttataggacagaaattttcttatacagagagagcagtctgcaaaacacaaagtgcaacataatgttaattaagctatattaataatacaggaatatgacttctaacaaaatcttaagccctagactatttccgtcatctaaggtatatcatcataagcttaaatttctagtacctctactctatgcacacttacacatgtgattaaacagcattttaaggaaaggaaaacataaatattgtaagtctttaggataccacaactacacaagcaacatacatcactctgtgtcctccatctgcaaaacacaggaaacatacacttgggctgggtactgtataaacctgccagatatctctactgcttatcatttgaaaatataaattttgaaataatatatatacacatattaagaaaaaatatatatccaggttatcacattagggacttctatatcttaattctgtaaataatgtcctctgtcccacatttaacaagcacttttgtggcaggcactaagaacaatatatataaaggaaggttcttgacctcaaggagctaataaaatagtgaagcaattacagcataattccgcataatatatcctaacaatttaagcaggaaatgggcacaaactaaattcaccacactcaaggcagtgtaaatgttctcccagtcaaagacaaagcagatgtgactaacagaatggtaccttactaattacctaagctaatttactagtagcccaaattcagctggattctgtttagttgaggaggagacagtacaatttcagtacactgtataaattcaggattcgtttagttgaggaggagacagcataatttcaatggtatggatatccaggaaataagcaagtcttgccagcctaagtaagagcaccccaggaggaaaaacaaagaaacatattatgaaaaggataaaacagacaacaggttgagttcttttaggaagcaaagatgaatacaggggaccgattcagcatgtaaggggcttggaagtcaccactctgtcctaacaagtaaaaagctgaacaaactgaaaaaccaacaacttttcgtagatccagcagaaaagcagggtcacagggcaaactgctctccccgaactggagagagagaggggggtaatacagacaatcacaacttactggaacagaaacccacaaacagaaacctccatgggaaccagaggagaaacctgtgctggaaccagtgctggggtgggagaacctgagctgtaattgacgaattgctggcggctcagtgtgggcaagtctgagagtcaaaaactccagggaaccctgtcattgcaggcatggagaggatgtcctcacacttctgtgagttttagttccaggagttcttcaaagttctcacagtgaatattggagaaaaaccccccagtccttccaggagtaggagggtaaaagtaaccatttctaaataagccagagtagtctgttttttttgttttgttttgttttttccccttcaagatggagtctaattctgtcacccaggctggagtacagtggcgcaatctcggctcaatgcaacctccgcctcctgggttcaagtgattctcccgcctcagcctcccgagtagctgggattacaggtgtgcgccaccacaccacacccagctaatttttgtatttttagtagagatggggtttcgccatattggccaggctggtctcaaactcctgaccataggtgaccgcccacctcggcctcccagagggctgggattacaggtctgagccactgcactggcccagagtagtctgttctcaacaaagccctccctcagaagaaactattttacagagcctaatctactggagttttatcagagcccagctgactctggaaaaaggaaatacacaactctagccctctagccatcctgtcccatctaaggaggggaaaactgaggagcgttagtaacattcacagtccaggggcaaagttcgctaaaagacctaatcataggactatagaatgtgtcccctctgcccatacctaaaggcctatttactgcagttccttttacccaggacatcatttccagttattaacaaaaaaaccacaaggaaaaacacacagtttgaagaaactgagcaagcatcagaaccaaagtcagatataccagaaatgttgaaattatcggaccagcaatttttaaaaattatatgctaagggctctaatggaaaaagtagacaacatgcaagaacagatgggaacataagcagagaggtggaaattctaaggaagaatcaaaaaggaatgctagcgataaaaagaaccgctataacagaatgcctttgataggttcattaatagattgaacacggctgaggaatctctgagctttaggacatgtcaatggaaacctccaaaactgaaaagcaaagagaaaaaaagacaggaaaaatggaatagaataaccaagaactgcaggatgactacaaaagatgtaacatacacataatgggaataccagaaagggaagaatgaaaggagcagaagaaataataatggctaagaatttctccaaattaatgttaaacactaaactacttatcctggaagatcggagaacactaaccaggataaatgcaaaaacaaaacaaatagacacctcagccaatcatattgaaactacataaaatcaaagataacgaaaaaatattgaaagaagctgtagtgggggccttacctacagagaagcaaagaatgacacctgacttctcacaaaccacagagagtgcaccgaaatatttagtgttgagagaaaatcatcaccaacctaaaactatatcctgagaaattatccctcaaaagtgaaagagaaataaggactttctcagacaaacacaaattgaaggaatctgttttcagtagacttcccttgcaagaaatgctaaaagaaattcttcagagaggaggaaaataatttaggtcagaaactccaatctacgtaaagaaaggaagagtactggagaaggaatatgtgaaactgtaataaaaactttttcttgttaatttaacagataacactttgtacaaaaataataacgaagtattcaattatagatgcttattatgtatatgcgtataaaaatgcacgcttatgaatgcttatgcataagtgaaatgaatgacagcaatggtacaaaagactacaggaaagcatttcttagcttgagctgccataacaaaataccacagactgggcaggttaaacaacagaaattgttttctcatggttctggaggctaaaagtccaagatcaaggtgccaatatggtaagtttatgctgaaagctctctttctggcctatagacaaccacctgctcactgcgtcctcccatgagggggtgaggagtgaccataagctccggtatctcttctcatacggacactaatcccatcactagggctccactgtcaggacctaatttaaacctaattatctcccaaaggcctcatcttcaaacaccaacacattggggttggggcttcgacataggactttaggggggataaaattcactccaggcattccacctttaacctcccaaattcatgttcttctcaaatgcaaaatacatccatcccatctcaacagccccaaaagtcttaacttattccagtaccaactctaaagtctaaaatctaaagtctcatctaaatatcacctaaatcagatatggatgagactcaaggtatgaatcatcctgaggcaaaaattcctgtccagactcattctcttaattatcaatgctgttctctttatactataagaagtctcctgagcaatactgtaagtcaagaaatcctaaaacctagctgctcagctcagtcacctagggagatttatgctggttttaacttagtttcccaggctgtatccccagtcatagtgattcaatggattttggtcagtaaatcacattcttaatatgtaatattgattcaacaatggcaacaatttttaaaaaattaataagttgtcactattaagttgaattatatgaaactgacatttttggttaagtcaaaaatggacaaatattggcaatttcatgtggttcaaataaacactgcacttagtatgtgctctgttctaagcactttacatgtattaactctttcgatcctcacagcaaccctgaggttggtaccaatgttagtcacatttgacaagaagaaaaatgaagcacagggctcagccaacttgccaaagataatggaactaatatgtggcaaaggaaagcaccagagtccagactcttaatatattaattattaaaaattacagatgctccttgacttaacatgggattacatcccgataaacccatcataaattgaaaatatcataagccaaaatgtatttaatatacctatctctagcctgggaaaagatcaaaattcaaaattcaaagtatggtttctactgaatgtgtatcgctttcacaccatcgtaaagttgaaaaatcctaagtcaaatcatggtaagtcagggactgactatatctataaacatttgtttataataaatatatactgtacatttatactataatgtatacttatataaatatgtactatgtatagttatataatgtatacttatacaatatagtgtatacattattatatatgtaattgtacctatataagtatacattatatatattatgtatacatcaataaataacatttaattaataaggtcacatgtaccttttaaattagtatttataataaggctactgctttctcttctgcataatcttgtatatctttcctcttcttttcttttgaaatgaggagaaccagatatggagtcctaagtagatcaagccctaggcttaatttcactctactagactactaccaaatatgtactggtaagctgcagaccagcataatttattctctagtgggcaactatgacaacccttccattcaaagaagaacagctgaagagttttgaattcatgtattcccagagggcttcatttaaatcacctatgaaatttgtctttccatccaagagagcccaaaaaagatgtgtgggcagagtggaggaaggtacaataacaacaatgaattaaagagtagtttcacagaaatatccaagccttgggagagggggcatctctaatcccaagcaagatcctagataaaataattggcttgtggacactgataaattaccactattttaaagcttggccagcaatcttttttttttttccttttgtggattttgactcaaaaaaaattaatcaaagcttgtgtagaagtaaaaagcaattttatttcattttttaaaacaaactgaaatatgaaatgttccccttacgaaacctttgctaattcaagagacaacataagattctattaggcaaataataaacgtgtttatcttcttttatattctcatgaagtagcactgtgaaacaaggcagaggagaagagaaatagctacacacacaaaagggagatataattatgcagagctgcacttctggaaattctgaaatgctagtctttagttggagggatgttattctcttaccaactaactgtcccttaacattagaactggaggcagatgccaaccttttcagctttcttggacctcctgttcttttcacactggtttttgcttttaactggacactttagatgtttctttctaaaaagttccttctttcataaagtccttaagatttcacatgacaaggattcatttaagttttagaaatttcctttttactattaagatgctagactcttttgatgtttgaaagccagccaattgctaaatattttgatcatcttccattatgaagtgagaaaaattatagcaagtgcaaagaaaattggcacttgggcatattagtctattagcaagaccatttctcacttaatggtgttttatgggttggagtaagtctgctccctctcgcccccaaaatactctttaatagcacaaatttggatcaatttaattgacctgcattctgccaaggcaccccactcacacctttgtacctgcagaactacaaatgtagtgtttattactcatatccaaaaacctaaacagaacaaaacaaaataaagtgatttaaaaatgataaatcatgaaaaatctaagaagcaacaataaatacctaggattctggatcaccaattctagtcaatccaagatgataccagaacatgacagacctggcttccactacagccctgggggttttgtgtcattaaaacactaaagacccagagcaaattttagacatgacgggacttgtgacaactggtgtttagtagaagaggcctactgaatactgagacttcacaagtgaaaaaaaagtgctcataaaataaaaaatcatcattactgaaacttccctccactgacttcctcttaaagaatggcataagtgacagctataagtcatgaagaagtgagcaaacaacatgtatccctagggagagaaacagaagactagcacttacattgcgggggctacttgagaaactggtttctgagctgcctgaatctatacactgacagaaaagggaaccaggttgagggccactgagaacaaaagcaaaggtctggactagtaccacactcactggccagtgtgcctcccccaggctcagcaaggaagagaaacccccaactttctgcctggggagagaaagaagggaaacacggtccaatgttctagcttttccaagagctggccagaggactggcttctgtctcaccccactaagcatgaaccctgcatgttctaggtgactggggactgctaagaataaaaaaaagctgggttgcttgctactgatccacaggacccatagagcagacagaggctgatatagctctgcggcttatcttgggaggggaggctgggagagaatagtggagtgtgtgaccaacatttgaacttttcaaaggactgcctaagggaatggtttctgtctcactcaacttggggtgctttggatcagcatactttagatgcttgagggcagctgaaaacaaaaaaagaggctgatggcttacagcaactctggagaacctgcaataccatggacagacacatgagagagaaaaacagcagctaatgaaaaaactgaccaaatctctcggcttggaaatttataatcacaagtccagggaagacacatccacagaaaaggcttacgaagcccctagaatctgcagtcaagctgactagtaaagatctttctctatatggtagtgcccccttatacacaggcgagacattccataaagcgcagtggatgcctaaaaccacaggtagtactgaatcctatttatactatgttttttcctatacatacttacctatgataaagtttaatttattaataagacacagtaagagattaggaacaataacaataacatagaattaaaacaatatactataacaaaagttatgtaaatgtggtctttctctcaaaatatcttgtgctgtactgtagatggtactgtagatcttagcaacctcagcatacaattttctttcctttccttgttaagaactttcaccttttcacttaaaggaagcattttatggtttctctttgtcatatccgaattgccagcatcattactcttgtgctttggggctactattaagtaaaataagcgctacttgacacaattactgtgttctgcaacacagtgacaattactgccatgctgcaacagtcaatctggtaaccaggatggtcactaaacgattaacggtagatagcatatgtaacatcaacacacttgacaaagggatgattcccatcctgggcaggacggcacaagatttcatcagtgctttacttagaacagagtgcaatttaaaacttatgaattatttatttccagaatttcccatttagtattttcagaatgcagttgaccacaggtaactgaaatcacagataaggggggactacagtacaaagccagtctgtaacaaagccactgtgagggagtgaggccctgtctcccaaacaaaacaaaacaaaaacaacgttattagctatgtcacaaaataaaggaagaaaatcatatgagcatctccataactgcagaaaatacttgacaaaattcaacacccattcatgatttaaaaaaaaaaatcctctcgcctaaccaggggtagagaagtgcctcaacttggtaggtttatgaaaacatattaagaatataaaaaaaacttacagctaacatcatacttaatggtaaaagactgaatgctttccccaaaaaattaagagtaaggacaggatgtccctccacaccactttcaacactgtagttgaggtaccagcctgtgtaacaaaaagaaacataaaggcatatagatcagaaaggaatgagtaaaactgtctttatccacaaatgacatgattgtgtatgcaaaaatttctaaggaatcaacaaaaaagatgctggaattaaagtgaatttactgcagtcagaagacgaaaggtcaatataagttatatttctttgtgcaaggtctgtgcaatgaaaatcaaacaacactgttgagagaaataaagatagagaagtgtatcatattcatacactgaagactcggcattgttaagatgtcaattctcccaaattgatctctagattcaatacaattccagtgaacatcccagcaggcttttggtagaaattgacaacctgattttaagttatacatggaaatgcatttaaaatgcaacgatcctaaaaaaaacgaagaaaaaaaagttggaggacttacaatgcctgacttcaagacttactacaaagccacagtaatcaagatagtgtggtactggcacaaggatagacatatatgagtctagcatataagcattttaaaatattgtaccttgaggtatttactgcaataggggttatcctatcattgttcaggagttagacaaacagtttacagattatttaggttcatgctctttcctgttctctattttcaagttgatttatcttggaaagctaaagcaacagtaaacttaggcctaaacaattggttttagtgggcagtagttttggtgaaaaactactaagtttctaagatcaatggaatagaagagtccagaaatagactacagatggctagctgaggtcatactgactgagatggggagaaatttatcagataatgaaaatgttcagtatcttaattgcagtagtaacacagcatacacatttgtcaaaattcatgaacacttttataccttaatgtgcacttaaaatggatgtattttattgtatgtaaattacacccaaataaagatgatgttaaaatatattttaaaacaatctccaaaacttatcttggtttttaatgtgaatcttgtctggaagaaaactaacattgttaaggactcataatgtgccggacagtgagttctgcacatttaattctcacaaacattttctaaagtagtaaattctcacccgattttcaagagtcaagcccaagggcatctgcaatgcccgtgctgccgtcactgctaccctcttactatgtcttctccacagaaacttttccaccaaagctactaccaactaaaaccaatttcttaggcctaagttgactgtttttaactttccaagataaatcaacttgaaaatagaggacaagaaagatcatgaacctgaataacccataaactgtatgtctagctcctcaacaatgatagggtaacccctatgcactaaatatcttaaggtacgatatttttaaatgcttatatactagactcttaaagagaagtacaaacaaattccaacatgagtctttccagcgtcacatagcagttaaggtataaaactgtctgtaataaagtcagtggtagaattctcccactggggcaatattcttattgttacagatttttaaactttgaaattctatatcaagtactacttggtggaaccacctatctgttatcctgttaaaaacaaaaattctgaaacttaacgtcaaaaaacacttggcaaataaagaaccacttattgtgaccaaaaattttactgccataaatgctataagaatcataaaaatatcaaagaggaacgaggtagaaaatatagaagccttgtaaaaaccttcaatattcaagaggaaggcagtgaaaaagaccttctgaaaaactacaagatagaagagctaaaggtgaaacataaatatgtgcacatatctttggtgttaaattaacactacctcatgtaaaaatcgcaatttactaactcacaggaacaaaacatacttacagttatgtgaacactgaggtattatcattgcaatgttgaaatactcgaagcaaattccacaccgcagcaaatcatctattgtctgaaatgcaaatatgcatatatacatatcagaaagacatcaaaattggaagtcctgtcacaaaactttttctctatcccctaaaaaaaaaatcaaactctttgtcaaatacacaaattcaaaagctaactccagataaactgcaagggatcttgacaaataaataaaaacttctctcatatgactcttatacattcagtctcaggttgcccaaattgctttagacagctaaagatgatggcacaccgattcttgtgccatattgtcatcccttcacataagggctactgtacttctgttccacttctaatgcgcttccagctcttactccaagcctcctcctcttcagactccaacacctagcctatagtcactattgggtgaaaggtggccattgccaccacacaagttaagaatcaaatcaaagaatgttaaagccaaactccagaaactgtctagtcaaaagaggaaactggtatcaaaagcaggcacacaatagtaggcatcagtcaagccaagaccaaaattcctgtctcccgtctggcagtccagtgctttcggcatggtactacacatgcagccaaatgaggaagcctggaaagagctggggcagtgaaagcagaggaagggaaagtggacaacttggaaagagagatgtgtgccaacctggaatgcaatccaaacaggaacggaactactctggcaacctaaaatctttcaaattgtttaaaataaaatattattccattcaacagaaatattttttaaaaggaggaagctctcgacgggaggatcgcttgagtccaggaggcgtaggttgcagtgagcccacatcgcaccactatactccagcctgcatgaccgagtgaaactgtctcaaaaaaaaaaaaaaaaaagaggaagctctccatcatactgatatgaaaagattgccaagataagtgaaaaaaggaaataaggtatagacagtacatatactatgctacggtttgtttaaaaggaagaggtgagtaagaatgtattctaataggcctagcatggtggctctgtaatcctagcactttgggaggccaaggcaggagaactgcttgagtccaggagtttgagaccagcctggcaaaataacaaaaatccatgtctataaaaaatttaaaaattcgttgggagtagtggcgcatgcctgtagtcccagctactcaggaggctgaggcggaaggattgctttagcccaggagttcaaggctgcagtgagccgtgattgccactgcattccagtctgggcgacagtgagaccctatctcaaaaaagaaaaaaaggaaaaaagaatgcattctattttcattgtaaatgtaaataatgagaagataaacaagaagtcataaataatgatcagggccaggaacatggtaagaaggagacttttactttttattttatgtgtattttgaaccatgtgaacctattacctgaattttaaaaatgtaaacaaaaaaggactaatgtcgctaatggtccatatgatgaaatattatgcagccattaaaaaacatgctttcaaagaataattaatgccctaggaaaataaaaatcagaaaacaaacctatgccaataatacataataataacaactctgtagtttaatcttcatagcaatcttatgaagtccacagcatcagtatcccaattttaaaaataaagtctacagagttcctaagttggctggatcaaacccaagaagttgactccacagtgatcccaaattttaaatgcacaaaaaccaaaggaaaataaggtaaaatgttaaacactggttctctgggtggtagaattatggatggttttatttttctcctttatcttattctgaattttaatttttttctaccgtgtacacatattacatttacaatatgccaaaaacagtaaatttttgttaaagtaaaaccagggaaataataaaatgccaaaatcttccattattgtggatggtaagctgtcacagacacaaaaatctaaagggttatgttcaagatcaattaagagcagaggcaggcccagaagccagaaccagtctattatatcacactttcttatctatgccatcctcttctggtggaggaatgattctgaaagatctgcagagcacaattgtggaagttgacactacatcagatgagccatttctggttcaaatttcttgtcatgtcactccaagacagtaacatgcatatcacatgcgcctcaaccaactaaacaaaaaatgatgcctgaatagagagtggtcagcagactccccaaaatttctttagtttagagagagagaaagtgaaagggagaagtagaaaatgggtggaaaaacgtaataattacaaaaatactcttaagtttttggggttacagatccctttgaaaaatggatgacaactatggactctctgctcagaaaaacatacatgcaaaaattttacaaataacttgagactccaaagtctttctgtgaatcctaagttagcaaccatggattctgagtcagacttctattcaataaaagaagtaacttcagtcagatctgcttctgggatctgatagttctttgtgcctggaagagttcaagcaaaaattaggtgagaaattggcagatgtgttataaaggagattaaaatactgaaaggggctggttttctaaccttaagattccatgattccaatgtgagcaaaaaaatacgggctcaatcaactctctggttgaacactcactgaacgctctgtggtgccaaactctacattcagtgctgtggtgagataccaaagtcagagaagacatggaacccgcctctaaagaacactgaaattgtgggaatatgtaaagtgtgcttaaatctacaaagcaggagctttacaggttacagagctcttttactttccttatccaagtcaagcttcatgacaacaaattaaaaggggaaagaagcacttaacacagtgctaataataataaaatatattcattgaatgcttactacattccagatactttcaatcaagcagcaaataatatttgagcacccacttggtgtcaggcactgcagtaagcacagtgaatacacagcagaatctgtgcccacatacatcaactaatttatttaatcaatcctatgaactgttatttttgtctctaatttatagttgaagaaattcaggctcagagaggttaagttactaaccgaaggtcatacagtcaagaggcagacaggagatttcacccaggaccactggaactcaaatctgtgctcttctccactgcatcctggtgccaagcccacaactccaaaactacagctttcctggatcatttcacaatgtcagcttctcatcatgcagatatctcaagtccccaagcactctagacgtcactgatgacagcaggaagaacaaggccttctacttactttagccttcacttaattctaaagtcaaatttatgagtcagtgggacaggtattataatccccaagtctacaaaactgagggagaagaaggctatcttagccactgtgagaaacggaaataatcacagagcaagaagaaacaccaagcaactgatctttatccagcacagcaaagtgcatctgctcttgagcaaatccagggcccaccactactgtaaatggaaactggtatgccttgccaaaacagaaagtggccacaaaaataaatgttatttaagtgaaataatcagacgcaatgcaagatcagcgctgagcctgagtcctgatctctgtttaagagacatgagcaattgttagagaagagtgaaggtgtgttagagaggagttggggcagtatgtcagaacaaacgagcactacgtttattgagaataatcagaagaaatgaaagagcctgtaaaggagactacctgcttggctacgtgattacatacatgttatctgataaagtgtccacccaaaatcatgtccggtgtcactgtttagtgcttgacacaaagtaagctttcagtaaagaacagctgtcgatgtcattgtttggaataactgtttttctccatgttattgttgggattggatcgcagaatagctggtgccataagactgccaacctcagctcaccaggcttgtccttgtcacttatcagaggagtaaactgagacccagagccacgcggtcggctagtggcagggcagagccggatacccgggcccagtgcgacgctcgcgcctcatcctttctccttaaggcgaggacatcctcctcaaagggagggacctccccccgcagacacccgggagctcccaaactccccgaagcactcaccttcatgactgccaggcccggaggccaccgagactcggccagggagtccatggtcgctcccgaggatgctgggggtcagccacccactagcctccggcgctccaacaccactcgaaattccccgcgctaccgcattacgtcagcagcccgcgacgcgccagaggcgggcgcggagcctgccggaagttgtagtagtatgtgggcggggcgccgcttaagggcttgtactgcgcatgcgccaggcttctgccgcacttaccttgaagaaagtgaatggttaaaaagcgtagagccagttgaatattaagaaaagatagccaggaatcaaaccaaatccagacctcaccagatctgtcaaggtccaggctcatgacccccctccgggtcgcccaccctaatcgcagtgactatccgtccttgctctgaacagaagtttttatatccattactttatgtctcccgtatcacaacactgggaggtagatgttatcattgtcagtttacacaagagaagcctacgcccgaaaaagtggatagagtttcgagtcagattccaaacaggacctctgggctttaaatgggagctgttgcttttattcatattaaaattttaatgcacggtttttctttttcttcggagagaagcaccattaactttggcatatagccttctagatatttcctatgcagattgacgaagattctttgcttgagcaaactttagtcaggctcctgaaccttctcctaggccaatctgtgtacttcctgtaaaaatccagttttagcaaaaaaccctgctaaatcaagttaccaagaatccccacctttgatatgtgatcactcttgatatctgatgtgttcctcatcctccaccatcccccagttgatgtctgatcaccctggcctcttcagcaagaatctactgttacctctgatgtttcctcttagtaatttttcatgcactgctccccaccctgcttcctggctataaatttccatttgcccatgttgtattcagagttgagcccagttttcaccaattgcaagacacagttccagtggtctctatacctacttgaattgtcctgattaagtcttccttattgtgctttaacaagtatcattgaacaatttttttcttaaacgagatataaatatagatactttttttcatacatgttatattaaatgcatgaggaatggaggtttacggtgtccacccccgccccccactttgtatcagccaatcatagaacggcatgcaaatgaacgcaaatgaatgccaggctgagctggaaaatgtcggatagttctggatgtggaggaagtggggtcttggagagacaaaggaaaagcatttaagaccaggtccgtggcctgagtgaaccagtaattgtttttttcacactactagttggacaaggtaattaggtttaaggtgacaaatggctgggaaggtgagagaggaagagagaggagatgagaaaaaagagaaagaatgggtaaggagaaagggagagagagaaaagacagggacaggaatgtactttttgcattcaaccatggagacagatttggaaggaggcagtacttgttagtcctggggccaaaatacatttccctatctatggagagcctccaggacaggatgcggtgccattcatctctgagtgtctgccaatagctggtgggtgaggctgaatgaatggatgaatcaccgactaagcccacattcccataaatcttttcctcccaggctgagcatttctcttcctgccatcttcagcagcaccagggtgatagatcccatcaagcccacctctaggcccaggaaggaaagttcaagaacaagcgcactttgagctcaggaaaaggcgtttgtcttgggtgtttatctaaccctgggagccattctcctcttaacaagctgctgtttgtatggactttctccttctgttagatcaataaagagattgtacttccttattcaggactaaaaacaaaatgttccatgtaaaataaaagcaggctagtgtttagtggaatcttctgtggcacatagcacacagcgagaagccagaataggatggccagataaaatacaagttgcccagtaaatctgaatttcagatgaaccgcacacaacattttagtgtaaacctgccccaaatattgcacacaacctattaaccaattatttgttgtttaaccagaaattcaaatatttaactgggcatcctgtatttttatttgccaaatctgacaaccctaattagagaagcattctcccaactgagtgtggggcctgccctggattaacctggggatgtcctgtggcccctgagctcctttccaggttctcttcatcctgttcctctctgcccagcactctctcttcctctaggccccatcttcctcattctagttatgggagaggggatattaaaggagctccctccctccctttccttccttcctttcttcctcccttccttcgttccttctttccttccttccttccttattttttttcttccttcctccctgcctccatctctcccttcctccattcattttaacaaatgtttattgagccactctccacttgtaccaggtgctagaatacagaggtgagtaagacagatatggcctctgttctccaggagctggcagcctgggggtgagcatggagccaggataaaaaaaaagagagtttgtaaaaaaatgagtaagataattgcataaaacagtaactgatgtaaaaacaataaaaaagggtgataaaatggacagaggaggggacactgtaaattgtatgatctgggaggctccctctgaggaagtgatatatgggcagagacccaactgatagagagaggcagccatgcaaagacccaaagaccccagaagtggagagttccatgccttagtaaaaagttcagattttaatccatgttaacttgggtaagttgttgacctctctgtgcctcaattttctcatctgcaaaatggggataatattagtatttgccttgtagggataattaaaggagttattctaggtttaatgcctagaagggtgcctggcaactactaagccctgtgtgagtgtcagctgtcattaatattatgttgctataagcacaggggggaagtccttagaggctttaggcaggggtgtaatttacattttccaaaggtcattctagctgctgggtgaagaagggatcaaagtggaaagtgtacagtagaagaaggtgacagggactgaaccttggtggcacagtccgggtgaggtaaaagtgctgtggacctcacacttactgtggaccccagttctaggaagcaggccctgctgtgtccttgtgaccaggcccctatcttgactcctcccagacatggaccctgccttattctctccctcccagccctgggacagctaggtcttgtttacacttacagactgtgcccattaccccgtccacctgcctgtcagaccaccatcacctctgggagcttctcactgaggccagctacctgtctgtcaccaaagcctcttcttaggaggagtcccaacccctcctattgatccttcaaacaagtgtttgctgagcacctactatatgcccaagcagaggtgacaagtacactagacagaggaatgcccagtccaagtcaaggtctgcagatgggaagagctttgagatcagacaggaagaacttttaagggagggaactgtattaggactttttggttcaaagtgctgaattagaaagctaactcaaaatggcctaagcaagaaaggcagtgtgttagctcatgtaactgaaaagacctgaggtaggtattcaggtatggcttgatccaggtggtctctcttcttccctctcaattactctttcttctttttttttttttttttttgagacggagtctaactgtgtcgcccatgctggagtgcagtggtgtaatctcagctcactgcaacctctgtctcctgggttcaagcgattatcctgcttcagcctccctactgggacaacaggcgtgtgccaccatgcccaactaattcttgtgtatttttagtagagacggggtttcaccatattggttaggctggtcttgaactcctgacctcgtgaactcccagcctcagccttccaaagtgctgggattacaggcgtgagccaccgcgcctggccataatcactctttcttaatgccttatatcttcttccctcactgtcgacttaacgctcatgcaggctccccccatgagaggcaaacatggctccagaagctccaggcctgcattctattagcacagctgcctcagcagaaaggacggacctcattcccaacagttctcagcaaaagtaccaggagcaagtctcactggccagaattgggtcacatgcccatccttgaaccaatcgctgtgcctcagattatctaagtgtgagtttgggagtgggagtgatgccccaaatgaacaacagggtgtgacatacagaaaaagagggaatgggcgcctgcaagtaagcaggttgcaaaaatgcttataaatttttcccctgcctatccacactttgtttccatgggactccttccagcaacaggtgggtctgtggctccactccttgaatctggggttgatcttgtgatttgctttggccaacaggacattaacaaaggtgacccaagcagaggcttgtgcactaatagccaccatgtgaataagccccagcttgtgatcctcctgggtgatcagagacagacagccaagttaccttgccaccccagccaacatcaaaccacctacaatacataagtgaggtcatcctagactatccagccccagccaaagcacctgcttactgcagagatcagctcagccagccctgaccagaaaactgctcaacatacccacgggatcatggcaaataataaatgtttattctcttaagcctctaactgtgggcatgggttgttccacagcaatggtttactgatgcaatgattaaaaaccatggtgaccctgtacaggagtcttccacttgcccggagcctggctcaggagcccccagatacagagtggctggagccccagtcctgctggtccttcatctttcccatagccaactcccagcatcctctcctgctctgttagacccctgtgcctgtctctgctctgcttccattctggtgcataattccgattacgggtgccaggggctggcccgtgcaactcctcctgcctccataggctcctagccattcttccttacaaagaggcagccaccaacctgcaaccatttgaaaggtgtgtggctgagtcctgtaccagaaaatctctcccaccatctgtcatggcatctggacgccctacttttttggttgttaaagcttatttggtttcccagagccccagaggagagctgactgctcctctgggagagtgaaagcaggttacacctcatgttatagcacaaacacactaatagcaactgtttagtctccctcactaaaccatgggttcctggaggagacagaaccagcctttctcttcccaactcctctgtgccctagcacagctgtgagtgacctggatagaccccacaaatgtagcggggacccaacaaatgttctctgggtgagttacccagaaagacaccaaacacatgcctgagcctggggccctgggacataggagtgccagggctcagggagccaagcaaagaaccgttgaaaggagacagaattgtcaccaattgatatagtttacagcaacgaagggaacatgatgtagagtcacacagacagaaatctgaatccatgctctgtcacttaccatctggtctcggataagacactcatttctctgagccttattttcctcttctgtaagattgaa

SEQ ID NO: 163 - DNA, 106599 bp, Homo Sapiens
ttttgcttgcaagaagtgcacttttactcaaccataagaaatcaatcaacacaattaaaacgtgtttacaatatttgcacagaccttccaccaaagatacatggatggcaaagaagcatatgatatgacatacaatatcattagttatagggaaatgcaaatcaaaaccacaatgtgataccactatagccctagtagaatgtctaaaattaaggaatgactatactaagagttggtgaggatgtgaagaaatgggaacattcatacttttttgtgtgtggaaatttaaaacggtatggagtttggaaaacagtttagcaatttcttaaaaaggtcaccacacctaccatataatccagtcattctactcctatgaatttacctaagggggcaaaagcttatgtttacacaaagacttattcatgtatgctcatagccattttatttgtaatagtcagaaactgaaaagaacataaacatcaacagatgaatgaataaatatattgtggtgtggccataaatggaaagttacttagcaatataatttttaaaaaagatttatatatgaaacaatttggatgaatcttaaaataaatatacttactgaaaaaagccataccaaaaaaagtgcatgttgtttgattccatttatatagacttctagaaaatgtaaaataatctccagtgataaaaagcagatctggttgggaagaggggaatgagtagaggaaaacaagggagagagggattacaaagaagcatgaggaaactttttggggtaatgaatatgttcactatcttgactgtggtgatggtttcatggatgtcaaaacttatcaaatttaacattttaaatatgtgctgttgatgaaatgtgaatcatacctcagtaaaacttaaaacaacgatggttttctgctgagcctttcttcctcttcaatattcaataaatgtgtcacagaactacagaaaccttaaaggctcaaaatgctaatgccggatgaaagaataatctggcatactttcaacaggcatagagaactggagtgatatggtactttagatttcacggctcttcatgactgggcggatagaaatggacttacttgtggttgatcttgactttgcttttctcattagtctgtatttttatgtaattcataccatattaaaatgatagtttgatattaacaaatatacttttaattattatggactaagtattctagatagtataaaaaatacaatgcatgcaaaacaacccaaaacttttccttgggagatctttgtatgtacatgtacttatagatgatcagataaaaacaaaatgtatgtctaaccaattttgaagaaatgaatcccaattttaaattgagtagaatgctaacaatgcaatctcacccaattaacctgtgatattaattgtaattttctctggaagtttagttgttacatgtctctaattgatctgtatttattttagaaagtgttaaactgttcaaatgttcaaatgattgataaatcattgatttttatttagtatggcactaggcatcaattaaagattttatagttcaattgcacattgaactatacatcattattatgttcagaataacttatccatgtagacaaatcgatgagtggagatattgacagcaaatcagaaataaaattgtctgctttacaaaaggtaatgttagaatgcatcaatttcaaataatgaaataaatttgtaatgccaaaacaaagaaataaaacagcaaccattgtaaaagtcacagatcaagcagcagcaagacttcagttagaatgagtaaatgatagtgaaaatttactgaatttgcttctaaattatgttgtttctgattccaaaccaatgtaaaaagttgtgaagctgttgtaacaatacccaagcagctttgtgggctgtagataccataatgaaaaagagtagcagaatgtgttggaatggcaagaagaggagaaagtgctttgggacttaaattgaattctctctctgttctttctgagtggcaaatgtgagtatgttttacagatacattaatggtgtctaaggtgggtttttgtttaacctatattagtctctagacaacaattagctttttataatctaaatttgaattttatatgaatataattgcctatactgctaacatcattttgaaacaggcatttatagttaatgaattaaaagtgtatttcttacaactatcatactcaatggtgaaaacctgaaagttttttctctaagacctggaaaaaggcaaggatgtcctctctcaccacatctattcaatatagtattgaaagtcctagcaaaagcaatccagaaaggaaaagtaaaactatcttatatcatgcacataacatgaccttacatgtagaaaatcctaaaggtgccacaaaaaaactgttagaactaataagtgaactcagtaaagttacattacagaacacaaaattaatatgcaaaaatttgttgtgtttctacacactaaacaacctatccataaagaaaatttaaaaaatatttataatagcatctaaaagaataaagtacttagaaataaactcaaccaagtaagtgaaagacttgtacattgaaaactacaaaacattgatgaaataaaatttaaaagatacaaataaatagaaggacattctgtgttcatggatttgaagaactgatattgttaaaatgtccatacttccccaaacaatctacagattcaatgcaatctttatcaaaatcccactggcagttttccagaaatagaaaaaagaatcctaaaatttacttgaaactacaaaagactccaaatagccaaagaaattttgagcactaagaacaaaaccagaggtatcacattctattacatcaaaacatattataaagctacagtaatcaaaacagtatggtactggaataaaaacagatatatgggacaatgaaacagaatagagagcccagaaataaacccacacatatattgccaactgatctttgacaaggatgccaagaatatacaatgaggaaaagataatctattcagtaaatggtgtcgggaaaattgaatatccacatgtaaagcatgaaagtgggccctatatacaaaaattaactcgaaatggattaaatacttacatgtagaactggaaacaataaaagtctttaaatagaggaaaaagtttgcagacattggactgggcaatgatttctgggatatcacaccaaaaacacaggtaaaaaacaaaaaataaacaagtaggattacataaaatgtaaagcctttgcacagtaaagaaaacaattaacaaaatgaaaaggcaacctagggaatgggggaaaatgtttgtagactttaatacctacaactcaatagaaaacaacaacaaataatttgatttaaaaatgggcaaaggacctgaaccaacatttatctaaagaagacatacaaaatgaccaataggtatatgaaaatgtgtacaacattactagtcattagtgaaatgtaaacgaaaactacagtgagatatcacctcatacatgctagactggctattatcaaaaaaaaaaaaggagaacaagtgttggtgagaatgtagagaaaaggaattctgtacactgttggtgggaatgtaaattggtacagccactatggaaaacaatatggagatttatcaaaaaattaaaaatagaattgccatttgatccagcaatcccacttctgggtatatatccaaagtaaattaaatcagtatcttgaagagatatccatcctcccatattcgttgcagcattattcacagtagccaagatatggaaacaacctgtgttcattgacaaatgaatcgacaaagaaaacattatatacatgtatgtatacatatacacacccacatacatggatatagatgtaaatgtagacacacacacatacacacagtgggatattattcagcccataaaaaggaggaaattctcctatctgtgataatatggatgaacctggaagacagtatattaagtgaaataagccagacgcagaaagacaaacacagcatgatctcactgatatgtaaaatctaaaatagtcatacaaatagcagcagagagtagaatggcagttgtcagggaccaggggtgggagaatggggtgatgttggtcaaaggttgcaaagtttcatttatgtaggatgagtagattttggagatctactgtacaaaaatggggcctatgaataacaatactgtattgtatattttaaaatttgctaagatggtagagcttgtgttaaatgctcttaccaaaaagaaggccgggcacggtggctcacgcctgtaatctcagcactttgggaggccgaggcaggcggatcacgaggtcaggagattgagaccatggtgaaaccccgtttctactaaaaatacaaaaaaaaaaattagccgggcgcggtggcgggtgcctgtagtcccagctactcgggaggctgaggcaggagaatggcgtgaacccgggaggcggagcttgcagtgagccgagactccgtctcaacaaaacaaaacaaaacaaaacaaaaaaacaaaaacaacaacaacaaaaaacaaaaagaaaaaacaaaacaacaaaaatggaggaggaagaaacttttggaggtgttggttaagtttatagcattgattttggtaacagtttcatgggagtatacttttccccaaacatagcaagtttacataatggcaaatattgtgtcttgtttttacgttcacagcattttgcacagagcttggcagttacatagtagatgttgaacaatttcttctgtgtttcagctgtcaaactgttctgaatgtgtgaggtactgtatttatctttgaaacagtattttcatgtctgtgaagtgcagtttcctgtgtaatactaataaaggggtataatccttattttcctattttttaaatcaaattctcataagtgtcttagaaaaccctctcacatgcaaggtataaggttacttcttttttctggattttagaactaggtaggcacgatgtattattagtctttgtattcccaatgtctgacacatagtatatgctcagtttattttagttgaaagattaaatgaatgattaagagcaaattgtgtagtgtccaatgtcactggacaggagtttgaatctaaggatatcatgtattgaacaacaattatgtatgagaccctgtgctagagctgaggatacaaaggtgaatacaggaatctatccagcctgaaagaggcagctatgcaaaaagatcaattatatatctcattggaagtgctgtaccccaagtatgaatgaagatctatggaattactagtaaaggagactagatgatacttgtggtgagacttgaaaatgagagacgtgattgccaatgatttgatttaagctaatcaaggacaaaaaatctttagaataacatgttgaacttaaccaagcctgcttgcaaaagggtagacataaataagatcaggtttccaaaggaatggatggataaatgcagatatattgcaatgtatttcctgagtttaagttgcatagctccttcaacaaacaactattttaagtgatctggataagattgacagtggtaatttgtcattttgcaatagcccatgttattaagacaaagaggaaggagagcattctgagtaaaaagaacagcttatgcaaaggtgcacagaagttgagaggacagtgagcttaatgtgaccagagtttttaggggagagtgtctgagatggactgggctagttaataaaggacaaatttttgcctctttaggagttcaggacgtggtcaatgtcaaagaggggccagtaaaggtttgtaattagggaagagacatgatcaaagtgttttcgagagggtaaatttcacaagcagcatcttctggcggctgcttcctactgtccttagtaattcattaaggagctggctgtcagaaagcaggactgagactcggtaggatataagtcaatgaagaattatgattattcatagtgtattactagcaaattgttgctaaatagattttgttaaaatatcttgtgatatgtgcatatctattatttatccacataagtaatttgcatcatgtgagtgtctggcttgtgctgtggtcccaggaaacctgcaaagcaaaccatcatatataaacttacatttctttatgtgagtgctttattatttcatcttgttgacaaattagatcacttcccctctccttgtcgtatgaccataacttaagacaaatctcttaggtctatcatctatattctcacttcctcatttctttattcttcatgtttcacaattccttaatttagaccctaatttgggtttcttaatgtttattccttacagacatgtattactgaataagccccataatttttacttgtgcaaaacatctctaaattgaaaaagatgataaaaaacaaatcaaaaaatttttaaagtaaataaaaaacaactcacaaatcaccaaatctctcaactgtagaatggcagttgtcagggaccaggggtgggagaatggggtgatgtcatgaaaacaaaataacgcctgttcctcaaaaaacctgtggaaataaaaaattaaaaattaaaaaataaaaaataaaaacagcaacaacaaaacaataaagcctcttggaaagaggctgtatttagcaatctggtacaaagaaagaaatttttttttttttttttttgggtaagccacttagcttatgaacaaaataatagcccatgaattaaattttaaaatgtttggagaataaagctaaggttaaaaaaaaagagaaactgcattctttccaagtaaaaagcccaaagggatcaaagtttgatgatgccctagattctgtgacagtctacactgaaataattatttgttccttttgaattgccacgttttaggtcattagtagtgagcaaatgtattaatgccactatcattttttgctaatgttcttctttcttcagcctagtaatttgaaactatcaaataaaatttataaacacacacactcacacacacacacacacacacacacacacacacactttgagaccgtggtgcctttctatttatttctagtatggaacattcagaaacataaattgtaacatttttgtaaactgctataatttcattatttggattgaacatcttcttgcccataattgtgaccatctcaggtacctggcttaagcctgttagttagttcacatattggcattgctatagatggaattatttccccatgcaaattcaactattgaagtcctaacccctaatgttatgacgtttagagatggggcctttgggagatattagatttagatgagattatgaaggtggagccctcatggtgagattagtgccattataaagagataccagagagctttcactttctctttcccatgtgaggacatagaagtagatgaaaagatggttgctaaaaagagttctcaccagaacccaaccatgtgacatcctgatcttggactgccagcctccagaactgtgtgaaaatggatgaataaatgaatgaacgaataaaatctattgtttccactgagtctatggtattttgttatggcagcctgagctgactaagacaggtggcctttgaccctgtttaggagattcctgtcaggatttagaagcagacgtttaatttccatcacagttcaagctactagtccagctgcaataagaagcaacatgcatttgagtaagttctgaagcgggcttcatttcaggagctgtgcctcagtatgggcagaggcccgggcaatctctccaagagttgggttcagctgcatcttggcttactggctgcctcagtgagaatttctaaacaaagcagaatagcaggaaacctctgaccagtttaccttttatgctttcatttcctattttttttcttttttggtaactttctttgacttaaggtgacaaaagagcaccttttgcagaagctaggacaatgtggtagagtgaaacaaacctgaatttggtgtcagaaagtctgagattcacatccaggccctatttggaaatctatgcatttatgcatccttcctctggtgatctgattccatggagctattttacaactctttgttaaacttacctggtagtcacacaaattctgtcctgtgcaccacaagctctattgacttccctcttcctcacctttatccccaagggggaaaaacagttgctttcatttgccattaatttcaatattcttttatgccatataaatttgtgcttcttgacttcttttttgaaatggttgtaacatctgtctgcttccctcattgaatgtgttaaacaaaatctttaacgtctattcatttttatatctgtatgaaagtcacactttaacctttttctgaaaattattttttaacacccagcttcctcatttggaaaatggggataataataactctcttatcctcctttctacatttctgggattaaacgagttataattaactggattgaaatgatcattaagggttgaaaatgtgtcttatctacttttgttttcctaacaccttggaaagagaatctgcacatcaaagtgctctttatgataaaatacaagacaaacaggacgtggttttatcattatcagacattattagcagcatgagtggcagcaacctctgacctccttttgcaagtggccagagggttcatgtcaggtggcattcaaagagccaaaggtgtagaagtctcacgctgggccaacagggacgtagatacttgacagtggtttccaattccagggaggaggccacttatggaagagaaggcttaaaggagactggaagatttgcttcttgagttctgggtcctttgccaccagagattcagggaacaaaagtgttttctccacacaaacattagcttgtctagtacacaatcacttgtcacttctggcctttgcctgtgctgattgatgggggaaggtagacagagaggggacaggggcaacatttctggtatgcaaaaatcttacagtgaatataaagatttgtcaacacacttcaaggttgccaacagattggccagatctgtattctattatttatattaaaaacacttcagttccagcatataaaatctaaaacttttaaatgggaagttaaagctcaaatttgaggtcactataggggaaatattctctgctattttttaactgtttcagtatttttagtttcacttttctactcttcgtcactctctgatctcagaaagaacaggtgcactaaacatcttgttcatgaacattaccaactcaaggttcacaggaaggcaacttgcattcattagatgagtatccaaattcatccctctatcacactgtagtagactgattaatgacccccaaaataccaggtcttaatccctccctgtacatgttatcttatatggaaaaatgactcttataaaaggaattaagcaaagaatttgagatgggggagattatcctggattaacctggtggaccctccatgcagtcacaggtgtcactacaagagagaggcaaaatgaaacaggaggatcacttgagtccgggaggctgaagctgcagtgggctgtgattgcactgctgaacgtgaacctgggcaacagagtcacacgctgtcttcaaaaaagaatatatatatatatatatatatatatatatatagagagagagagagagagagagagagagagagagagagagaggtgaaggaagatttgacacagacagaagagaaaaggcactataaccacagaggtagtttggagtatgtcaccattagcaccagaagctgccctggcaacactttgattttatcccagaaaaactgatttcagtttctgctctccagaactgagagaattaattcctgcggttctaagccactcagttcatggaaatttgttacaacactcacaggaattaaatacagatacctccacaaaaactctcttctagactaaaaacaaaacaaaacaactttgccaagtgcattagtttgctagggctgccataacaaagtaccacaaactgggtggcttaaacaacagaaattgtttttctcacaattctagaggctagaagtttgaggtcaagttgatttattttgggttgatttcttctgaggcctctttccttagcttatagatggtgccttcttcctgtgttctgacatagttttccctctgtacctgtctgtgtccaaagctcctcttcttgtaagagtggcagtccaattggattagggtccaccaatatgacctcattatacctaaattacctctttaaaggcattgtctcaaaacacagtcatattctaaggccctgggggttaggacctcaacgtacaacttttttgaagtggagatacaattcatcccataatgccaagtaacatcatctctgtttctacacatgaggaatgaccaaagcccacaactctgcttaatatcacacagctgataagttgtgaagcttggatttaaacccaagttgctctgagttctaaaaaaatgtatttgggggtagaattaacttttgttgaatgttattttttattaggaagttttaataggtcacttgttttcagtccggctaagatgaggttatcagtgttaaggtacgacacaggaagacagtcaatgaaaattaaagaatcaagagaagataatctagctttcttagaagagtactgttttttatacttcatccctctagtcttttgcttagtatattcaatctgaagctgaagaaggatgtacagcctcagccgtcaattgttgcaatataacaaagaagtctactgtgaaacaatcattctgatagctgatttcttgaaatgtcatttttgggacaaatgtaaacatctacaatgaactatttgttatttttaggaaaaagttaaaaatattgaattataattgtttgctttattattcttaaataataatgcctctcatatttatttcatgagatatgagtatgtttagtttcataagaaactgctagactgtcttccaaagtggctgtaccattttgcattcccactaacaatgaatgctttacatcctcaccagcgtttattattgtcagtgttttagattttggccattccagtaggtgtgtatcaatatcttgtttcaatctgcatttccccgatgcattcaccatctatttccttttttgagatacctgttaaggtctttggctcattttaaatcaagttgtttattttcttattgttgagctttaagtatttttatgtatttggataacagttccttatcagatatgcgttttgaaaatattttctcccattctgtagcttgtcttttcattcacttgacagtggcatttgcagagcagaaattagtttgaatgaagtatagcttatcaattctgttttggattgtgcctcgggtagtgtagtcaaaaagtcattgccaaacccaaggcgatctagattttcttctatgttattttcaaggagtgttataattctgcattttaaatttaagcctgtgattcattttgagttaatttttgtgaagggtatagatccagtgatttgtgtgtggatgtccatttgttccagaaccattctttgagaagacaatctttgcttcattttattgcctttgctgttttatcaaagattagttggctatatttatgtgggtctatttatgggttttctattccttccattgatctagttgtcctttcctttacaaataccacactgtcttgattactatagctttatagtaagtcttgaagttagatactatcagtcttctgactttgttcttctccttcaatattgttttggctaccttggtttttcttttcttttttttttttttgcctctccatataaactttaaaattagtttgttcatagtcacaaaataatgtgttgggattttactagggattacgctgagcctatagatcaggttgggaagaactaaggtcttgagaatattgagccttgctatccacaaacatggactatctcttcatttatttagttattctttgattttttttcttcagtgttttgtagtttttctcatgtagatattgtatgtattttgctagatttatacctaagtatttcatttttggggggtgctaaagtaaatggtattacatttttaattttaaattctacttgttcattgctggtatatagaaaagcaatagaattgtatatattagtcttctcttacaacctttctataatctcttattagttccagaagggtttttttgtcaatcgtttcagattttttttttttttttttttgagatggagtctcactctgtcgcccaggctggagtgcagtggtgcaatcttggctcactgcaagctctgcctcccgggttcacaccattctcctgcctcagcctcctgagtagctgggactacaggcacccaccaccacacccagctaatttttttgtatttttagtagagatgaggtttcaccatgttagccaggatagtcttgatctcctgaccttgtgatccacccgcctcagcctcccaaagtgctgggattacaggcttgagccactgcgcctggcctcagattttctacatacatgatcatgtcatctgtgaacaaagacagtttcatttcttttttcccagtctgtataccttttatttccttttgttgtgtagcattagctaggacttcaagaacaatgttgaaaaggactggtaagagggagtatccttgctttgttcctgatctgagagggaaactttcaagtttctcaccattaaatatgatgttagctgtagggtttttgtagatatcctttatcaggttgaggaagttcctctttatttgtaatttactaagagtgtttattaagaatgggtgttggattttgtaaaatgctttctttttgcacctactgatatgttcatgtgatttttcttcttaggctcttcattcgatgtacaaaaaccacaagattatctaaatagatgcagaaaaggccttcgataaaaatcctcattccttcatgttaaaaactctcaataaactaggtattgaaggaacatacctcaaaataataagagccatttatgacaaactcacagccagtgtccttactgaatgggcaaaagctgaaagcattccccttgaaaaccagcacaagacaagtttgccctctctcccaacccctattcaatatagtattggaagttatggccacggcaatcgggcaagagaaaaaaatgaagagtatttaaatgggaaaagaggaagtcaaactatctttttttgcaggtgacataatcctatatctagaaaacccattgtctcaacccaaaagcttcttaagctgataagcaacttcagcaaagtctcaggataaaaaatcaaagtgcaaaaattgctatacaccaacaacaggcaagccaagagccaaatcatgaatgagctttgattcacaattgctacaaaaagaacaaaatacctaggaatacagctaacaagggaagtgaaggacctcttcaaggagaactacaaagcactgctcaaagaaatcagagatgatgcaaacaaatggaaaaacgttccatgctcatggataggaagaatcaatattatgtaaatggtcatactgcccaaagcaacttataaattcaatgttattcccattaaattaccactgacattcttcacataattagaaaaaactattttgaaatttatatggaaccaaaaaagagcctgaatactgaaagcaatccttagcaaaaagaacaaaggtggaggcatcaggctagctgacttcaaactatacgatagggctacagtaaccaaaatagcacggtactggtacaaaaacagagacatagaccaatggaaaagaatagagaatacagaaataagactgcacacctacaactgtctcatctttgacaaacctgacaaaaacaagcaatggagaaaggattccctatttaataaatggtgctgggagaactagctagccatatgcaggatattgaaactggcaccttccttacgccttacacaaaaatcaactcaagatggattaaagacttacatgtaaaaccccaaactataaaaacactagaagaaaacctgggcaataccatttaggatataggcattggcaaagatttcatgatgaaaacactaaaagcaattgcaacaaaagcaaaaattagcaaatgggtctaattaaactaaagagcttctgcacagcaaaaggaactattaacagagtaaacagacaacctacagaacgggcgaaaattgttgcaatctatgtatctgacaaagccctaatatccagaatctataaggaacttaaacaaatttacaaaaaaaagcaaccccattaaaaagtgggcaaaggacatgaacagacacttctcaaaagaagacatacatgtggctaacaaacatgaaaaaagccttcacatcactaattattagataaatgcaaatcaaaaccaaatgagataccatcttacatcattcaggatggtgattattaaaaagtcaaaaaatgacagatgctgatgaggatgtgaagaaaaaggaacactttaatactgttggtgggagtgtaaattagttcaaccattgtggaaaacagtctggtgattcttcaaagacaaagaggcagaaataccattctacccagcaatctcattactggttatatactcaaaggaatataaatcattttcttataaagacacatgcacatatatgtttattgcagcactattcacaatagcagacatagaatcaacctaaatgcctatcagtgatagattggataaagaaaatgtacatatacaacatggaatactatgcaggcataaaaaggaatcaggtcatgtgcttcgcagggacatggatggagctggaggccatcatccttagcaaacttacacaggaacagaaaaccaaatactgcatgttctcacttacaagtgggagcaaaatgatgagaatacatggacacatggcggggaacaacacacactagggtgtgttggagagtagggagaggatcaggaagaataactattggataatgggcttaatacctgggtgataggatgatctgtgtagcaaaccaccatggcacacatttacctatgtaacaaacctgcatatcctgcacatgtatccctgaacttaaaataaaagttggaaataaaaaaaaaagagtgattatgtcagggactaggtggtagctgtggagatgatgaaaagtggtcagagtctagatgcattttgagggtgggcttgattggctggtggattagatgtgaaggatgagagaagaaaaaggtactaggatgactctagagtttttgccttgaacaagaaaaaaggatgaatgccatttaccaagattatagaaaatagccagtctgtttattcttacactatcaattgacacaacttccagttaataagttcactttattttctgaaagttacaggagaagactttactggttatgaccttatactgctttaatggtcatctgtagccaaaatcatggacataaattctgaggagggttcctggtaagcctcccattcctgctatgagaagaaaccagcatgcccatgcttcccagcagcatactgtaattgctaagtgtcaatgatgatgtcagttttagtgtctcagtaacagttgctagaggaaggaaggaaggaaggaagggagggagggagggagggagggagggagaggatgaagaaaaagaacgaaaagttagaaactatgtagtcccagcctctagaagccagaggcatgaggtctacttagggtcctcttgagacaggtgaagacttttcagtgtcacaaaattaatatcacaaagtgatattatgttagtattatgacatcaaaatgtgtgggcaggctgggcacagtggctcacgcctgtaatcccagcactttgggagtctgaggcaggtggatcacctgaggtcaggagttcaagaccagcctggccaacatggggaaaccccgtctctattaaaaatacaaaattagcggcgcatggtggagcaagcctgtaatcccagctacttgggaggctgaggcaggagaatcacttgaattcaggaagaggaggttgcagtgagccgagatcgtgccattgcactccagtctgggcaacaagagtgaaactccatctcaaaaataataaaataataataataataataataataataatgtgtgggcagatgtcatctacaccatagtttcagaatgcaataaattcacatttaaaaaccttgaagtacaccgtatcaaaactttacttcatctttcattcttatgtgattcagttgataggctggaagaacaatgaaagtgagttccatcatgctgcctggtgtccgtgtccttaatgataaagactttgagtgtatttgcaaactctctgttaatgacagcatttttttttattctgagctttattaaggtataattgacatacaaaaattgtacatatttaaggtgtataatgtaatgttttgatatacatatacattctgaaatgattaccaaaatcaagataattaacacatccatcacctcatagttatccatttagcaaatcctttactaggtggcaaaattgattttaaaatcacatttttatccccttgaagttttttcatctgtaaattttcaagggcagtcttttaatagaatacaaacagctcattccttatgtggctccaagctggcatttcagcattgggtttaaactttagagcaacatatgaaaatctcctgaataaacttgtcaatgattatggtcatcaaaacttagtatgatcaaggaaactggtttttgcataatattctgaatatttaaactccacagagcttgaataaatgaagtacaaattaaacatatcgatttttttcttttggtacatggtctatgttattgcagattagcatcccaaatcccaaaatcccaaatttgaaatgcttcaaaactgaaaccttttgagcactgatataagtctcaagggaaatgcattttggatttcagatgctcaaccagtaagcacataatgcaaatattaaaaaatctgaaatccaaaacacttctggtcccaagatatgggatactcatcctgtaccatggtaaatggttagttcttccttggcttatgccagtggttcttgatttaagccccaggagatattggaaatttctggaaacatttttggttgtcaaagcttgggggtggagtatgtttctggcatctaatgggtagaggccagggatgctgctcaatcttataatgcataggacaggccccagaagaaagaattgcctggcccaaaatgtcaatcactagtgctgaggttgagaattcttgacttaggccatagccgttccacagctcaagtcacagttgcattcctttagttgaaccttacagttcagttgttctactcaatatttgaatgctgaaggaagactggccctctagggttgtatttctagaacagggagaatgtagtactttgaggttgcatgctttagaattagtcattatgtgagttggaagaccatttgattctttattagaagttagcaagtgtgccagattagaccttcacccaagaacgtcatgagggttaatgagaggtttttaaaagataatagttatctttgtttcatgtttaacaactttatgcattggctggtcattccagctccacagaaagctcttcagttgagtttcaattacagcccgcaattccagatgctacaacattttaactgtggctgccagatatcagtgagattcacaggcctggagtacaacattctttacaatgtgtgcttcatattttgaaggccatctgtctcattttcatctacaattggctctgccgaagttttgcatgccaaatgatattttttaaaataagcttttgtgctactttaaaaatgtttcaaaaatatcttcgagatacaattcacacaccatgaaattcagccatttaaagtgtacaagtcagtggtttttagtagattcacaaagttgtgcaactatcactacagtctaaatttagaacactttcattactccataaagaaaccccatgcccattagcagtcactccagttcctctcctagtcctgggcaaccactaatgtaatttctgtctctaaagatttgcctgttcttatgaggagtggcggtgtacacctgtagtcccagctacttgaggaggccaaggcaggaggatcatttaagcccaggagtttcaggctgcagtgaattatgatactgctactgcactcccatctgggtgacagagtgagaacccatcctctaaaaaaaataaagatttgcctattctagacatttcttataaacagaaatatacagtattttgggactgctttttttcacttagcataatgtttttaaggttcatccatgttgtagcatgtataagtatttcatttcttttttgtccaaatcatattccattagaagtataaccatatttgatttatccatttatcgtttgataggcatttgggttgtttccacatttgcctactataaataatgctgctataaatattcacatacaagtttttctgtgaacacatgttttcatttctctccattattattataggctgaactgtggctccaccaaattcataatttgaagtcccaacccctagtatctcaggatgtaactgtatttaaagataaggtgtgtatagaggtggttatgctaaagtaaagctgctaggatgggggctctaatcccgtatgaatagtgtccttataaaaagccatcaggggcctgtccgcacagggaaacaccatgtgaggatacagaaaacaaccatctgcaagaaaggagagagatcttagaagaaaacagacctgccagcactgtaatcttcaactgccaggctccaaaactgtaataaataaatttctgttgtttaatttactcagtctgtggtattttgttatggcagctctagcagactattacaggtaaatacctaggagtagaaatgttgggtcatgtggtaactccatttaacactccaggtacctgccagactgttcatatgagtttttgtatgaatatatgttttattttctcttaagtacataggagtggcatagctgctaggtgtacatttaactatttaagacacggataaatggttttccaaagcagctgtaccattttacattcctaccagcaatgtttgagggttccaattttctgtatccttaacaaaacttgttattgtctatcttttgactatagttcagggactaagctctgatttttatcttgcccaaattcctacctaagaggtctggggagtcatgtcctacaaaccatggatcctcatcagatggcttttatttgaccatgtatattgtgacttgcttttcaatctgactctggcgtgacattatgagacaaggaaataatatttagccccataatatatttccttgccatgcctcgaaattgccctgcaaagtctcttgtgggaaaaatccacattccatagaaaatctccttccccttttattttctttcctttctttgcagatccagtggataatcaactaagagctaggcatccttttagatttgataagaaacattttacaacctaccctctctctgaagtctgccatctgagagattcttctgaacaataaaactggttctccacaatcctttatcttaacctgaacattcctttctattgatcccaagtctttagacaaattcaaccaactgtccacccgaaaatgtttaaatttacctatagcctggaaggccccactttgagttgtctcacctttctgaaccaaaccaatgtatttcttaaatgtatttgattgatgttttatgcctctctaaaatatataaaaccaagctgcaccccgaccaccttgggcacatgttctcaggaccacctgagggctgtgtcacgggccaaggttgttcatatttgactcagaataaatctcttcaaatattttacagagtttgactcttttcatctacaagtcatgtggtgtaaagtgatagctcattgttttctaatagactattttctacgaaagttttaggttcacagcaaaattgagcagaaagtacacagagttctcatatacccctgcctccccccaaccccatgcacaacctttcctactatcaatatcccacatcacagttgtacatttgtttcaaattatgacacatcattatccaaagtccacagtttatattagggtccatttttggtgttgtacattctatgggtccagcaaatgtgtaatgacatatatccacccgtgtagtagcatacagaaggctcactgtcctaaaaatcccgttttgtttattcattccttcctcctctccaaaccttcatatttcggttttgatatctactttcccagctgctaaagctgttgatcatcttttcatgtgcttattggtcacttacatattatcttctttggagaaatgtctattcaaatcctttgcccagttttaaattgggttatttgtctttctgttgttgactatcactttttaaggttgagtttgctccctgccaaggaggaaaacccatgacttttgtctactatgagaaaaacgctaatactttattattctggagaatggcttcctcaggaatttcactgttcctttctacttgagattcactaaatgttaatacagccactttgtggtttcggagcagagccatcatttttcttggcagccagatttataggactccaaaagaaacaaccagcattaggcagtattaaataaaatttggagataaaagctaatcagtgtgtataacaattactgatatcaaaatcaaggaataagaatcaaatagcacttcttactgttcatggacttcaaaagatttatatgaatttggtactattaaaacttcctctaaatttaaatatgaaacagatgggaataatacagttacatgagaaatattagtcatttctcagtgcttatgagctgggtccctttggtggacagtatttgtgcaaatgttttagtaactacatgactctgctctgttgtgagccatagttatcatatttttatttattctaaccagttaaattactatttactgaacacccactgcctcttgtactgaagtcattaaattctttgatacattttaaaaaagaaatagttgctttttctctgtttactaactttaaaaaaaaagaaaataacaccccccattcctccttgtatttcttagttggctgaagatattctggaacttaacaccatatattttgggagaaagaaaaacaaacctaaaacagaaaataccatagttatttaaatataggacttaaactcttgaagtttatctgcacttaaaaaaattctttccttttcttaaaatttttcagaaaggatttcactatctcctttgatagtttattctgcattctaaaactctcttttctcatggataatcaaaaccgatcctataggcgcctcttctgtattcagtagaaaaggtgactagcagccgggtgtggtggctcatgcctgtaatcccagcactttgggaggccaaggcaggtggatctcctgaggtcaggagttcgagaccagcctggccaacatggtgaaaccccgtgtttactaaaaatacaaacattatctgggcatggtggtgggtgccttgtaatgccagctactcgggaggctgaggcaggagaattgctggaacccgggagtaggaggttgtggtgagccaagatcgcaccattgcactccagcctgggtaacgagtgaaactcaatctcaaaaaaaaaaaaaaaaaaaaaaggaaaaaagaaaaaaagaaatggtgactagcttccccccaccatcttgatataatgatgaaattcttcacgccttctctacccaatgagggagaaaacaaacatgaaaatattgcaagacacaagactaagtactaacatttgttgacaatattaattttctcaatgtttaggtttctgaaaacagaacatttactgttgactttttccctcatgttaccaggtgtatctccaaacattctagaaacttcatgagataataaattattattaagcctaaattaggtgctttatctactttttgactgaaaaaattgaaacatggaataaattcattatttaatattaacataggtctacatttcctctgcaaaattcttgacccataactgccaattttaagattaaaaatacaggctgagtgcagtggctcatgcctgtaatcttagcactttgggaggctgaggcaggaggatcacttgagcccaggagtttgagaccagcttgggcaacatggagaaaccctgtctctacaaaaactacaaaaatcatcctagtgtggtggcatgtgcctgcagttccagatacctgggagattgaggtgggaagatcaccagaccctgggaggttgaggctgcagtgagtcatgatcatgccaatgcactccaacgtgggtaacacagtgagatcttgtctcaaagaaaaaaaaaaaaagttgaaaaggaaagaaaaaaacttttcaggaagggtacacatgcaaagcaagcctggcacgtaatgagtataaattagaaactatataaaatatatacattacaaaatataataagttaatgtatataaaatagaaaatatacttttttggttaataaaacaaaatgatgtgaggttatgaagaaattgtataatttcttaattggctttgaaagcaatttcaagcatcctaaaagagtttcgagtgataaaaacttaactagaataaaagcttctcacattcgtaagagcaacaattacttctcttccagtgatctccaaacttatttaattacatatctcaccagtaaaaggtttgtgcaactatatatccagtgcacatttatttaaaatgtaaataggttattagctatttctattttaaagcacgcataaattatagttggagtaaaacaatgtaaaagattgtgtttttacttactaatgggacagaatctttttgctgttattaaaacatagatttttagtttttaaataaaaacaggctatggaatatatttcattatttaaattctttgttgttgtttgtattagtccattttcatactcttatgaagaaatccccaagactgggtaatttataatgaaaaagaggttgaattaacttacagttcctcatggctggggaggcctcacaattagggttgaaggtgaaggaggagcaaaggcatgtcttacatggtggcaggcaagagacttgtgttgagcatgttgtttttgttgacacatatgaagaaaatcctagggcccttcagactccttggtcttggagatccctaaggaccacacttggaaactgatggtctatggcaatgggtccttttaggccttgaatccctttaagaatctgacaatatgaaactctgtctctaggaagctgctggaaggtacacatcttgggagtttgccctttgaagctcacctgtggaccttttttcctttcgtaagtccactgactccagttaggaatgcttggtctgataagcgtcctttttatgtaatgatggtggataaactgctttttccaatacctacacatacagtttcaaaaccaaggaggaaataagattgaaaaaaaggaagtaaggaataatggaagaaaggaagggaaaaaaagagagaattaaaaggtggtttactgtaatcccagcacgttgggaggccgaggcaggtggatcgcttgaacccaggagttcgagaccagcctgggcaacatagcgaaacgctgtctctacaaaaaattaaccaggtgtggtggtgcatgtctgtagtaccagctacctgggaggttgaggtgaggagatcacctcagcctgagaagttgaggctgcagtgagcggtcatggcaccactacacttcaccctgggtaacagagactgtgtctcaaaaaaaaaaaaaaggtggtttactcagtagagatctttatcttgcttgaaaggccaaagccattttaagaaggaaacttgctaaatcttctcctgtatgcgtaaatagtaatcccttaaaaataaatcactgcataaacgagatgactgcttgagtcatcattaacaacttatgaaaaagacagaagtgcctcttacagaggtgtaaagtatttatttgcaccctatcatgctggcagaaaatctgggaaggcaaatctgagtgcagggtagaaaatggtcagttgcagaatataaacattaacatgattataattacggacttgagaagtgaaaagcactggggaagttttaggtaaatacaacattccacactgatgctttcacagtttaatagcggattcacttataaacattctgataaagatcagaaactaaaatgcattcctgtttaaaacacagatttgcatttaccaaagaagacataattctgtgacaaaggaaaatacactcaacattatcaacaggcaatgatgctctcagtcaatggaaatttttacaaaggctctggaaaaataactggagatagcagttgtttgattatgggaagccaagagatcagaagaggcatgaggtgccttacggttctgggtaaagaattagggacatgatgcagtaaatgttaattaaatagtcttggcagaaaatgaccacaggtaatttcagtaagtatatcctaaataaataataaaatatgcagaaacgatttctaaggaaatttgagcacaaatgtttgctcattagaacactggaagggtcagtaatcagaactgtgtgcatatacaaatcacaggtctgggaagatcccataggtcgaaaatgtgtccttggacaaatggctcctctaataggctatctacgggggtgtggagcattaagagcaggtttactggagagacaaagataacaatagggtttggaaaggcagaccatttaaaaaaggctgattttttgataagcagggaaaaagttattaattttagtaatagtagtgacctatataaagatcattatacagataatggaggctgttttttaatttctattttgcaggaaaagaagcataagctgcaataaaaatttggtttcaagataacaaagtcagtccccaaaaatcagtattgagagtcactgacattaaatgatgaagatacgaggatggtgtggggacctttactcttcgaagatgagctatacatgcccctgaaaaggctgtctgaagacaggggaaggctggagatggcaactttggcctctgccaagtactcgtgctattttctgtatgtgatactatctgttttgtaactcagaggcaacaccacatacctagcataaggcttgaactccctttggggttatcaattacttacatagccttcctctaagggaaggcttgcaagtggttcatattcgacccttccatgtgataagcattcatgtgggcttcacaatgtaacagaggtacacagagattcttgtaaacagaaaattttataaaactgttaactgatctcactttgaagaagtcttactgactagatgtcatttatcagagtagacaggcttaaaatgcattgcttgtactagactgttgtaatgcatttttttgtttttgcattggtttttaattcatttaattggtttacactcatttttttttttacattccatttttgcatttgtatgccagttaaaaattatgaaatggcacattgtgggattttgtttagctaaattctagaaaaattgaaagataccttttattcgacttaagcctgaggttattcagcacggtgatctctgcatttttgaaaggttgtctcgtcgtttaataaacgtaaataacttaagcacattggaagagctattaaatgagagcaggagattaaaaagacatgatttcttactttatccacctgacaggatagcttgcattggtgattaaccttgcattgttaaattcatttcctaaatatttaggtaagtagttggtttgatcattatttgtaaagtattagtagttgcatgttgaattatcatgttaagatttttagtttgttgttcatgtgatatgaaagataacaattcctaaaactgaatgcatgcatggcttattcagctcaggtcacatacaaagagaaatgtgacgctgcaataaacatagcagagctatctgggtttgaagcaaaaaggctatgacgttaggtatatgcactttacattgtatgtatctttttagttctagtgaactcatctggaatcatgttacagaaaatgattctccaggtccaaacacatttaagtttaatgactgggactactctaacaattgcggctatctcattttgtctcattggttcattagcatagcacccatttaagaacaactacttctaaacacagtaatatttcagaggctataaaataatagagaaagaaaacttaaaaaatcctttgtttgcagccaagaaaatgtgaggatcagatttgtacttgttttgaacaattggaaactgtcacaattgtttttaagatgtaataaatgtatataaaatatgggattctatagtattagccattttgatatcttttgttgaaagaaaaaaccaaaaaaccccatatgttctaagtctcagaaatcaaagaattccacaattttcatttccactaaaatatttatttaatggatatcttacagaaataaataaaaacagtttttgtctaatacagataggtttttttatatatatgtaatttgattttacaaaattgaagcatatcaaattgttttctctaaaacatagctcagaaaggaatagtagaaaacaaacacaaagaaatactgaaatagtctcatttttaaattataagcatgggccttctgaatctcagcatgacatgttattagtaaaagaatgtaagatatggagtcaggggacctgggctccactgtttacttgctacatgtcctaagaaagtttcaatatatctgaacttcagttctctacctttaaaacagtaaagatattaattatatcaacttcacaagattgttgggtaaattaaacacgtaaatgtacatgaaagctctttttaatatgtgaagagctataaaaataacagtttgatttaatttcatataaaagaatcaatggatacctccttttaactgaagaataagcaccaaaagcatgtgtgtgttttcttcagttgaattacatcactctataaacctagagtaagaaaatgcaccttaactaagcaccaaagcctctcggacaaatgggatctagggaatggttctatgagttttccaggcagctaactgggagctaataagtcctgagggtcaaagagggtcctttaaaactctgaaggctcaaagaaaaggaagccaaataagaacatttgtattacatcaaatggctaggatgtaacaagctactccttattcagcaatttcaaagtccattaattcctcacagaagaagaaacacttcgttattatcacttgcaacgatttgcttatgtgaacatggcattctcttgttcaaaaggtcaaagactcgtgcttaagggaggaacaactggagtgaaataacaactctaccatgaattcagatatcactggctaaaaagtctagttacacaagaacatgggaaagaaaaagaatccaagacatcagtataataatgattaaaaaaaaaaccctgccatatttccatgttataataaaacaaaatcataaaaactgcaatatttacagatacatcaatcttacaacatataaaaactttaacaataagaaaaattaagagtagggaaagcagataattttaaggtaatcattaatacattaaaaaatctatttggagttaactgtttacactaacaccactttacacataatagaaatatgaatattttcattgtttttgttttcagtagcaagatgcagaagaaacaaataactgtctaacattaacttattgtaaggagttgtattactgcaaaattactaggtgtaaagttatggtataagcctactcaaaaaatgggttaatataattcaccatctacttaaaatattactaacaagatattggtgaatcatgtgctaaagatactgaaggcccttccaaaactgagatctatgtttgttcaatataccaggtcatataaaactagactagtttactttcttattccaactgttttatgagtgatcttatcataagaaaagtacacattacctctcttaattcccttgcatcatcagatatagatactatttgggacaaaaaataaatgttttattaggagtgtaaaattaagaatctttatagatcttttggaaacagtatattgaaaaggactcaataagtactaagccactgtataaccagaacaataaacaaattcattcaactaggaacagtgttactgttatctactgggtttttaaaacttgtaactttgctctacagctatgaaagtttattaatacactaaagtccatggaatgaatcaagtgtagttcattcaagctcttcagtttctttggtaaataggtctgccaggtcagccacagtcaagacagaggcctctgaatgctttgctgatgagttcgtgtgactgcaaggtttcccaaatgagcacagtcagaaagaaaccccaagccatcagcgattatatttgtagtaatacgaactagacacatattttttcttaagtttttgtaattgggatataagaaactcccagaggaaagcaagtgataaaatctttgttataccttgtcaaagtgaagatttctatatattacttttagtgtttgtcaaagtgttttttctctgtgcaattaatagaacaaagaataaaactcttgactactgctactaaggctctcaccttacaaattaccttcttaccacctgaagttaatttgtttcaagagaatttcaaacaactcataactgctattttattaaaacaacctaaataaaaatcactgaagtctgatacacaaggaaaacaagaactttaaaaagccttcatgttttaggtaaaaaggcccttgtggaagcctctttccttcccagaaaccatcaatggaagaaaatttctagtttcaaattgcttctttgctatgtgacaatcccttctaaggcaataatctcttccttgggtaccatccaatcctacctacctcctaaagatgtagaaagatttatgttttcaaaaagatttaaataaattataccataaatattagaaagttctatgattccagagtcaagcttttaaaattaagactggtttagtctctctgcttttgttttgtctttggattgacaccacaattaaccttaacaagtttgttttttttttttttttttttgagacacagactcgttctgttgcccaggctggagtgcagtggcacgatcttggctcactgcaacctccacctccggggttcaagcgattctcctgcttcagcctcccgactagctaagactatggtgcgtgtcaccatgcctggctaatttttgtgtttttagtagagatggggtttcaccatgttggccaggctggtttcgaactcccagcctcagaaagtgatccaatgtggcaaaggaatgtagtatagtttatatttacatgttacaattaataaattaattcaaatatacaaagtctggagcactgactgggaaacagtgaaaaggcaaaacgtcagactttgcttttaaaaacgtatttgtgctatatttttcgttgtcatctaagtgaagaagttctaaagatacaaacttttaacaggaaaaccttcccccttctacttgtggtaaattattacctaccttctctcagcagttttcagcattgcctgcattctttcttctattgttgctttaattaagaatctgtgtacaatagtaggtctaaaaggtacagaagaattttaagcttaaaaacatagtaaaacaaatcagtacaaaccgacttcacattttatatgctatattcatcagtcagttggtgcccacttgtggcaggtgctgggaggggttcagcagcgaataaaatgaactatttaatctccatgagctgacattctaatgagagacagacaataaacacataaaagagtaagacggtttcaggtaaatataatgctgggagaacaggctgacatgcaaactgaaaaaagagtgatgggaatgaggccagtaggcaaaggaggagtaggaagaatatccaaacagaagaaacagcacatacatacacagtccccgggaagggaatatgcctggaacaagcctaacatgttcaagaggccaaaagaaggctggcatggcagaagcatcctgtaagcgagggagagaggtgaaaataagggtggagagatgtgcaggggccaggtcacacagggccttccaggatgtgaccaagcatttgaattttatcgtggttataatgggaagcccttggtgggtttgtatgcatgatttgatgtatacctgactgtactttagaaatccctttggcaaccgtgtggaggatgtacttcttgctcagcaagaagagcaccagagaagccagttaagaagtcctgtagtcatctgggtaagtaagggtggatgcactatggttgtgtcagtggagatagcagtcaagtagatttggaatatcttttggaggtagagctgacaaaacttaaaagatgactggcatgtgagatgtgaaaagaaaaatatagaagagtccgagatttctgatctgggcaggaacagatgacagtgccacattataagatggggaaagctcagggtgggagtgagagtgcagaagcaacacagttttgttttgtccatgtgaaacctatcagatacctattagacaggtatccaaggtgagtccagagatatgtgtgcagagctagaactggatatatgcacctgggacaggagctatatgggcatgtctgggctgggggatatacacctgagagtcatcaacctgtaaaagctacctaaagccctaagactggaaaaattcatcgaaggggtgtagacaaagaaccctcagaccactggcaagaagtaggtcactagaaatgttataagtctcacttcagtgatatggtggggagaaaatcaaccagacaggttgacagagaatgggggataaaaaagtagagatggaggtaggatgtatcagagtgtttttttctttctaaagatggataatattaagacatatttatggggtaatatatgacaggttgagtatccctaaccaaaaacccaaaatccaaaactttttgagtgccaacgtgacaagtggaggattcaacacctgacttcacgtgatgagtcacagtcaaaacacattaaaaacgttgttttgtgcacaaaattatttaaaatattatataaaatcaccttcaggctatgagtagaatttgtatatgaaacataaataaatttcatgtttagactggggtttcattcctaagatatctcactatgtatatgcaaatattctaaaatctgaaaaaatcctacaggcaaaacacttgaagcatttcagttaagggatgctcaacctgtacaagggaaatgtacacctgtccttgaaaaatgagaaagaatggagtccaggacaaatgaatggatggcttttgaaagaaaagggacacttctgctgtaataaaagggaaggcatatgaggtactttcctgcttattactggatgacatatccatgcttctgcctactaccaaccccttcctccacttcagtgtttgatcccatatcctcttgcctactcaaggacattgtcaagcattctccctgttctccttcactagtttttgttgtctctaatgaatcattttcttactaattctcccatttgaaaggaaaacaaaaacctctcttgatctcattctcttccttttctctgcagcaaaactcctcaaaatactggccttaccagccacacagaagcagcagtgcactgtggttaaagcttgtactgtgaaggcagaatggctgtgcctgaaatctgccactgcttctactagctgcctgactatgggcaagttacctaacctctctttgttatacaaatatttgttaaataagaaatacacaaaatcccattttctccaaaactaaagtcaggctgtcacctctaccacttaacctggttttgatctccatgttgctaaatctaatgatcaattctcaatccttatcttccttgacatttttcatagcacttgaaacaggtgaccataacctcttctttgaggtacatttttcacttggttcctaggacactcctgtcttctggttttcttcctaactcactgtttgatctttatttgttacctttgctgcttccttctcctctcctagaacagctgaactttggtgccctggagttcagtccatggtcctctatctaaactctgtctctatctaaactcactcctaggtaatctcattcagtctcgtgacttaatggacttgtacatctagttacagaatagaaatctccatttggatgtctgttcttcccttaccaaatctgctctaccctgtagacttctccagctcagttgaaggttacttcatccttctagttgtccaagccaaaacccatggtgttatccttgaccctctcataccccatgtctagtctgtccaaaagtactatcagttctatcttcaaaatatatccagaacctgaccactcctcatcatgtgcactgctactgccatggtcaggtcaccttcagctctcaccaggatgactgcaatagcctccaagactctccctgcttctactcttccttgctccccttcactcccaccctatcacagcactcagaatgattcttttaaaacttaagtgagatatgccaagcctctgttcaaagccttccaatggctcccgatttcacacagggcaaaagcaccatcctcacagtggcttcctgggcccaatgtaatccctctccccactgagcccattcacttcaactcctgcttctctcccttttagcaactgtagctccttgctattcttctaacataccacactcctgatttagggcctttgcaccgaaagcactgtttacttgaacattctttcacaagatagctgcatgactaactttcccattttcccatttctttcaagtccttgctcagactttctcaataaggccttgcatgccttcctgcccaaacattgcacttttacttcctcaccctgctctacttttccagctcctaacatagtccagattgtacttagtttattgtttaccacctttctgtctaccaaccccattacagctagaatcgcactccatgaggacatctcatgttcctaaaacagtgcctggcacacagaagatactcaataaaaatctaccaaaaagtatgtgagtactgatgcaggcagactgttcaagttgatgatggaaagatgaggtacttctaatctgattgtatatgtttcccctgtatgaggcaagatcgccatggggaggaagaagacacacttaagacagactcctcagaaagtagaaaaaaacatattgacttgcgaggcatagtaagattgttgggtaatgctgaatggccttttggactcgtggttttaaatatgagactagtccagcctatgctttaaaagaacattggtaggacaaaaaatcaatatttaaaaacacagaagaaaaccaacaaaaaacaagtaagacatgactgcattttaaatgccacttggtggtatgttagaacaagcccgcatttattacagttactttgccctatttgttaagaggtttaataaacatgtctctttcctgttttcaagtaagccctttattttctctccccgctacttcttacggggcagtctacatttctgagtatgacacagaagacttcatctcctgccgatgatctctttctcatactttatactgcaacaattccaaactccttacagtccctagaaatgtcatgtcatttcccaccattgtatttttgcatatataactctctttggctgtgtgaatacccttttccagccaactttgaaataattattccttcaagacttaacaccataaagtctttcctgactctgtagggcccgagtgatcattatcttcttttgttaacacagtccttttattattatacttttgcacattctaccccaacactttaagtcatgcttcctgtactacacagtgacctccttggggaaataaattatgtatcattcaatttgaatcttcagtatttagaataatgcctgacatacagtaggtgctcaataaatactgatttagtaagtgcttattatggatgtgtttttttttccttttttaaacatcaaagacttctaacatccagaaggtaatacatttagcaggccttatcaaagataactgtctattctgatatatgaataaaggtaatacatgccatataataatattcattattaggtttgctttgggccttaaactgaatctaatgatctcttggagctgacctagggggtgtcttttcctaatgttaagaattttaaaaggagccatttattttcagtcatgtacaaggtatgtcttcttttaaacacgggactactttagacaatcaaaactccattctcctcaaaggcatgatggatgccttcaactttgtagctgtcttaagtatttctaacaagcttttttttggataaagtgataaggtttttgtgggagggaagaaaaaaattgggacaatttgggggtttgcttcttggagagaagggagggttggaaatctcatgcctttcaattaaataattaaaaagttataaataaataagttataaaataaataattaaaaaatgtagtatctaaggaagtaattaaaaacaagtacgctatgatgaacataaatgaagagtttaaatactgatttggtttctcagaaaactgaagcaaatgtgactgattctaattttagtccttactttgtctgtccaattcggtgcaccctccctatggcctgaagctcatgggcagggttcaatatgggctccaccaagagaacatgagttgcttcaatgatagttaatccattagaacctgtgtgcaggggcagcagcaaaatattgatttggggatcacgtttaaatgctgaaaggttctcctaaaaaagaaaggtacattttaattttagctcgatcagttaaaataagagcagtatgtaatagctcactttaaagatgtctaatgctatctattactattgtgaaaggtaacagctaagaaacttaaatgcaaaattaccaactttagaaaatgtaaacttgtcgcttgattttaattatgaagaaaagtatcatataagctctcttgttcttcgtaatatctagaggaatcacaagacagatgcatgtaatgcatgcaaattaaactacatgaggttagaggaaaaagagaaaaagaatgtgctagagtgaatgtgagataagagacatgaatctgctaaattttcatttggtctctgtgtgtgcctgaggtcatacgcctgtcactgtgctgagcatgatgtaaggataactgtgaccacatgcagttctgcctgacagtgactttagaaactaatccttggggtgtgaggcccctgtccattcaaaaggtatatcataggcaatcttttcctgtactaaaaaaaaaaaagaacctcaagttgggagatctttaaaaaaccaatggtcttgttatatactgaaaatacctgcagtctctgcttttaaatgttcactttataattaatcaagaactcagaccctgtttatgtggcttatatggcatgagacaataaatgtaagtaagctagttaacagcagtttaaatttgcaactgtatccactacaaaaaccggagtaaaatcttaacatacctgaaatgtcttaacacgactgatttgtgcaaattccatgttgttgtcagtaagagcttttgaaataatatctaatacatcttgccactagaacacataaaacaataagaaaaccaatatttacacgtagcctttatctaagggtatctgaaaaggaaataaatcaaaatgacttttatactggagttaagaaaataaaaccaaaaccaaaaccctcaaatgtagtaccatccatattatttagctctatctgaaatagtaattttgtttgtttttttttttttgcatcaaatgctggttttgaaaatgtaattaagataaacaaacagtagaaaatacataatggagtgcatactggaatatagttacttagttttcgaaaatgaaaactaagggttttactcaacactttataaagtagattgtctttttcaacccaaatttttgtgaaatgagactttcaaagtcagaaattccaattttaaaaatattaaactaagaaaatccttaaatgaaactaataaaaagtcatgaaatatagctatacaaattgccttgtgaaacatcatcacatttctctaaaaataattctatcttctctaaaaataattctatcttatggatttgggaaaaaaaatctaagagtaaacatcaaaaattagttctcagctgtaaactgattagagagggaaaatcagttcgaattaatattgaggatgaaaatgttgattataccgttgagaaaacgagtgctttggcccctggatctctaagctgtattttcatcagagttctgaccacagcttccacttttgtagaatggctgccctttgaacacacacacaaaatacacattactactaaaaaatctagttaagaacagaatagaaaagcaatacaaagtactttttattatcaaaactataaatgcatcaaaacaaattatcaggtgcatatgtgtttactctttttcattttgtgtttgctggaaattttctttagcctcgaaatgtagaagtcattaaatttacacccagacatttgaatgtaaaagcatgccagaaagtcattaagtgctatgaccctgaacataggatcttttagttaagtagtcaggttttatagttacaaaattttgttacattagattagcagaaatgatattttaaaacactcttcatttattctccctttcttcagatattatgtcattagaaatgttaagaatacaatgaatcaaaactcccaatgtaagcaaacagtgaaggatccaaccaatggagaatgttttcttgcaagggtattaccaaaaacaatgacagaggtacaaatgatgctcacttagaatgaggcagattcatacaaagctagacacttaaaactgtgtgtttttttttttttgcatcttccataaccatttctatcagatgaggatgaaagtgaaaaaatgatttttaaaatggagaaataagaaaatgaggaaaatagtgcaagtatttctgtagccctcaatgagaaagttttccttctggagtgctcttggagatggtatgacagagaaattaaggttatgggattttgaatgagacaaatttaagttcaactcatagttctacaactcactagttatagtttctaatcctgtgtttcctcatctatccaatagggctgaatgataattatatctctttccaaaggtggctgtgatgattgaatgagaaaatgtatacgaagcatttagcctaacatctggtaaggagtaaacactcaagaacttattatctttctgagatattaaatatgagcactataatgacctagattataccacaagggggagcagatttaaccaaaaagaaggaaaaatatttccacagcagcataaaccctctccctcaatcctctcaacacacttttacatgaagaaacattcaaaggtaaaaatataaacaaaacaagaaagaaagctgtactaattttaagccagcaagatagaataatggaaaaagttttaaaatcctcatgctaaaatcatgattctacacttattttctctgggtatgtagactttcaagtgtacttgcaagattagaaatgtactacaaagaacctatttcagtctaataattatctcaaacaagagcgaagagaaaataggaaattagtgtaaaggtgatcatttcagaatttagacaaaaacatccatgttccttgcaaggtcttacttttaaaactatttcaagtgaaataccaggaaaactatgaatccttccactgattaatacgtttcttactaaaagttcaaaaaaaatgtagaataaattttttataatcaacatttctagtaccgtagtgctaactctacgtaggaaaagaacagagcatttgcttttatcaaagactggccagttcagtggtagtgctcaatgatcccttccaaccactacagttctgaaccattttgtcccaatctagttacttcctactttcctagcagaatatgttaggatacaaaacaagtccgaaatcaagactgaaattacatcaagtatcttctctgacaatggaatgaaactagaaacccataataggaggaattttggaattaacaaaaatatagaaattaaataacatgctcttgaacattcattgggtcaatgaagcaattaaaaggaaaaattaaaaatatcttgagacaaatgaaaatggaaatacaacataacaaaaggtatgggaattcagcaaaagcagttctaataatgaagcttatagaaataaacaactacataaaaaaagagaaatgttctaaataaacaactaatgttgcaccacaaggaactggaaaaagaagagcaaagtaagccgaaagtcagcagaaggaaagatataataaaaatcagagcagaaataaataaaatagagatcagaaaaaaaattacagaaaagactaatgaaattcttagttggttatttgaaaacataaacacaatggacaaccctttaggtagactaagaaaaaataagagtaaaatttaaaaaattataaatgaaagtagagacattaaaactgataccacagaaatacagagaatcatgagacttatgaacaactatacgccaagaaatcagaaaatctagaagaaatggataaattcccagaaacatacaatctaccaagactgaatcacaaagaaacagaaaatctgaaaagaccagtatgtagtaacaagattgagtcagtaataaaaagtctcccctcaaagaaaagcataggaactagtggtttcactggtaaagttaaacaatcatttaaagaagaactaataccaatctttcttgaacttttataaaaaactgaagagaaaatattcttaattcattttacaagaccagaagtactctgatatcaaaatcagacaagaacactataagaaaacaattacaggccagtgtctctgatgaaaacatgcaaaaatcctcaacaaaatactaggaagccaaattccacaacacattaaaagggatcactcaccatgatcaacagggatttacctctggcatgcaaggatggtttaacgtatgcaaaccaataaatgtgatacaccacagaataaaggaaaaaaatgatcatctcaatatatgcagaaaaaatatctgataaaattcaacatacttcaataaactctcaacaacttaggtatagaaggaatgtacctcaacacagtaaaggccataaatgacaagcctaccagatagcatcatattcaatggtgaaaagctcaaagcttttcctttaagatcagcaaaacacaaatgcccactcttgccactgttattcaacatagtattggaagtcttagctagagcaattaggcaagaaaaagaaataaaaggcattcaaattgcaaaggaggaagttaaactgtttgcagatgacatgatcttatatatacaaaatcctaaagattccaccaaaaatctgttaaaagcaatgaatttagtgaagtttcaggatacaatagaaacacaaaaatcagtagcatttctatacctaacaatcaattatccaaaaaggacgtcaagaaaaaatattttataatgtcataaaaaaatgcttaggagtaaatttaatcaaggtgagagacctgtacactgaaaactatgaaacattaataaaaaaattaaagagaacacaaatggaaagacatatgttcatgaactgaactaatattgttacataaatattatataacataatctatagactcaatgcaatccctattaaaattctgatgacatttttcacagaaatagtgctatgatttgagtttgtcctcagcaatactcatgctgaaatttgatacccagcgtggaggttttgggaagtggggcctagtggcaggtgttctgagtcatgggggtggatcctttatgaatgacttggtgccattctcttggtagtgagtaaattctctcttgtgcaagatgaattggctcctatgagggcaggctgttataagtttcctcctcctttttgttgctctctctttgtacctgtctgctacccctatgacctccgccatgttatcatgcaacaaggaagccctcaccagaagggccatctccttgaacttccctgcctacagaaaaaggagttaaataatcctcttttttctttttgagacagggtcttgtgctgtcgccctagttggagtgcagtggtgtaattacagctcactgcaaccctgaactcctgggcgcaagtgatcctcccacctcagtctcccgagtagctgggactacaggtgtgcaccaccacacctggctacttttaaattttttttggtaaagacagagtcttattatgttgcccaggctggtcttgaactcctggcctcgagtgatcctcctgccttggcctcccaaggcactgagattataggcatgagtcactgcatctggccgtaactccttttatttataaattacccagcctcaaatattctgttacggcaacataaaacagacaaagaaaaataggaaaaacaattctaaaactcatatggaaccacaaaagaccttggataaccaaagcaatcttgagcaaaaagctagagataccacactccctgattctaaaacacattttaaaactacagtaataaaaatagtacgctactgaaataaaaacagacatacagaccaatggaacaggagagagcccagaaataaacccacacatacacagtcaaccaatctttaacaaagataagaagatcacacaatggggaaaaaacagtctcttcaataaactgtgctgaaaaaactagttatccacatgcaaaagaataaaactggacccttatctcaccgcatatacaaaaatcatctcaaaatggattaaagacttaaatataagacccaaaactacaaactacttgacaatgatcttggtaaagactttttggatatgacccaaaaaactcaggcaagaaaagcaaaaagataaataggatcgcattaaagttaacaagcttctgcacagcaaaggaaataatcaacaaagacaatctacagcaaaggagaaaatatctgcaaaccacacatgtgataaggagttattatccaaaatataccagaaactcaaacaactcaacagcaagaaaacaacctgagtaaaaaatgggcaaaggacctgaaaagatattactcaaaagaagacatacaaataggtaacaggtctaggaaaaggtgctcaacgaccctaatcatcagggaaatacaaattaaaaccacactgagatacaccacctcattcctgttagaatgactattataaaaaagacaagagataagtattggtgagaaggtggagaaaaaggaaacccttgtacaccattggtggcaatacaaattagtagagccattttggaaaatagtaaagaggtttctcaatatattaaaaatagaactaccacacaatccagcagttctatttctgggtatatatccaggggaaattaaatcagcatgtggaagagatatctgcaatctcaagttaatttcagcattattcatggtagccaagacatggaatcaatgtaagtgtccatccattgatgaataaattttaaaacaggttatatatacaccacggaatatgtttttacctgacagtaaatcaatcctgtcaggtgagataacatctatgtacctgaaagacaccatgctaactgaaataaaccaggcacagaaaagacagatactgcatgatctcacttatatgggatatctaaaaacatttaactcacagaagcagagagcagaatggcggttaccagaggctggagtttgtgggggaagggagtgggttaaatggtgcaaagttttagttagacagaaggaacagatctaaagatctattatacagcatggtgactacagtacataataatgtattgtataccattgtcccttggtattcatggggagttctaggatccccattggatatcaagatctgcagatgctaagtgccttacataaaatgatagtatttacatatagcctacacacatccttctgtatactttaaaatcatctctgtattacttacaatactgaatacaatgtaaatcttacgtaaattattatagtgtcttttaaaaatttgtgttttttaaatatgctgtattgtgattttttattgttgctgggtttttcttgagtattttttatccgtggttaactgaatctgctgatgcagaatctgcaaatgtggggggccaactatacttgaaaactgctaagagggcagattttaaattttcttatcacaaaaattggttaagtatgtgaagtgatgggtatgttaattagcttgattcaatccttccataatatctacatatattaaaacatcatgttgtatactaccataaatatatacaatatttcatttgacagttaacaaagaaccatatgaggaactggatatacaaagatgaaaaaatacactcccttgtctccaaatacataacactctaacgcgtgttgcagaatatggagaaaaacataaaaggatggtttatctgctggtttggcaattgaaatgaatgttttataccgccttaatgagcactacacacattctactgctctttttcatgtttcttctatcttaaatatgtaaataaacttgggttcaaatctgccagcttctgagaagactattcaatgtagttactgctatagaaagcaaatattcacattgttaaaaaaagataagattaaaacaggaaaaagggaatgggttacatataggcaaggctgcttgcaaaaaagcaaaaaagtaacaaaaggaaatgtggataccaatctattcctgtgcaagctgttaacacagtatgaacattctcaagacaggtaaactggtagcctctggcaaactcattatttagctacagcagtaaacagatgcaaagttaagctggaatgttatgcattagggaagactgtacatgggaacagaaatcccatacaactgctagataatctcttaatatattaggttgataaagttgtacttaactataagcacctctgtcctcttctgacattactgtccctttccttactcccatcctttctccttagtctcttcagcacacacacacaccctaatcctaactttgtgcttattgcttggttttccttcatgtttctgaaacattaatgaccaaggtccagctttggaataacgacacagcttctgtcctttaccctcactgactgtatctttgccattcttctctctaaggcactaattctctctaaggtcaactagagaactcggatgggagacatacaaagtgttaccagtcagcgcaaggctgttatctctcctggttttctgctcaagtcagcagccaggagaattaaaatgtttaaaaataaagaagtgaagtaaagtgaagtcttccactttctggaaaataaagtacaaagttaaaagctccagaatttggggcaggaagtcaacacactgaaaaaagagtagagacccactagcaccaaaggccaataaagaatatttctaatgaagtttggcctggaagtcacttagtaacacaactcaagatcagaaatgtcatgtggcttatctgctctaacaggtgccactaacttatttttatcacagagttaaatctgattggaataaggtgttctatagttgcagcctcctgttgtaaaatgtggagaacctaaactttgaattacaagttgttaaatgtgttaaaatgacagaaaattcagttttgtttctttgccataaattcagtagactgaaaaaaattcttctaataaaccaaccaagtagcatctgatctagattttaatcctctcccctccagaatgagatgacctattttaccgatgtaatttcagagggaggaagtgcttttcatgcactgaagacttattattggggaaaaaagagggcgcaatattaatggtaaaaatctgagtattggtgtagaaagatacactgtagcttggctttactctagactattcaattgtttacacagactattcaattgttatccatccatgcattcaaatacttactgagtgcctattatatgccaggtattgttccaaatgcctcatacaaaatagtgaataaaacaacatccctacctcatgaacaagtcctctaccttttaatggagtttacactcaacaaatgattttttcataaagataagttttagtttatatcttagaagtctctactgtgtgttcaatttactgcaagctatggctaactttaacatgaggctaacagttcagaattacaagtattaacttggccggtgaacagaaatagaaatggtattttttttgcaattatatttagtcatgacatattttaacaaaaaatatacaactgcattccaaatttaccagttaatgttcatgttatataaaacttatataagaatatttagataaatatatttaaatataatcacttctggattatatttaccaaattattttattcctattttaaactcagaatttcataatcagtttttttcactcagatgtttattttaattatattttaaaagtgtgagacagatgtcacaaatgatctttaaattaaatgaacaaaaattcaaataaaaaaaaaacagaatagaattccacatgtagaattctacacatagtatggctaggcttctctgtgagttggaatgtagagatacagagtttttttctctacaaaaaggctgtataagatatctctattatcaagagatatgcttgctaaaaatgcagatttctggaccacatcccaggtctaatgagtcaaagtttatggagacagagcctgaacaaaaatatttattttaaaaagcaggccagttgatggtcacatacttaaaagtttgacaaaaaaagcaattgtgtagcatgtggtgggtgggaagggtactgtattgctgtcactatatctatgtagtggctgtatctattttctcccggacagaaatttcttattatctaagactcttgaccagtatatagggtcagggtttccactggcaaaatgctttgtataaaacctagccaaatgtaagacacagggaacaagacatgtgggccatatgttctgccaggaggcctacttcaccatccaaaatgcctggcagttgtcagaacttgcaaggggaattttgtttactttgtgagatgcccagtaggttccaaaggtcatttaggaataccatcacactgttgctagggaagaaatggtcttcaacttaagtgcatccaccgaacaggacatttgtgatcccagtattcattttatatctatggtcaatcaacagcattccttacattgtaaaatctcttatttccaagaaatactacttaaaaatgtctactactaataaataatagttttatgctttccaaatatcttttatccacaaaaaagctatatgattaagcattctgtacgatatatggtttgctatgtctgagaatcttgacataaatacagtgaaataatcatttcagaaataaattttatatttcagataatataaacatttcaattaaataaaaaattacttgtcagtattgcttgttaaagaacaacgatttgataatcaacagtaatataaagaaaaaaactaggtttagaaataattggaactagtagtttctaaaatttgaaaataatgccttaattatttacacaaagccatctttatttacatactaatccaaaataggcaatatgatcatttatgtggaagtttcaaagagtcacaagagaggggtgaagtctcagaatacaataagctgatgtttcaaggaggaagtgacagacagcaggccagaaatgtgacagaagtcagaagaagagacaggaagcacaaggcaaatgtggcagacacaaatggtaacagaaaaagcagtgaagagccaacctaaacatggcgtgaagcagtgtgacaacgtcgaggagggataaaatttgcccgcacaatggtacaatagtcttatgtttaagaaaaggaaatgtaattacatgtgcatctatgataaaaagggaaattatctttagtaaattctataaacttaattttttttaaaagatgcttcagttaattcacgtgttaatcaatactcatgaaagacagcgagaagtgagagcacaataaacagtatttatataccgatatccctgctccaacagcacagcacatgtaactgtgccaatctctatcctgggtgtctaggaaagctgccataaaatgaacaggtgtttggatttgatgggctcaatgactcagtttcgtagaggctgtgctgtttaccagtagctagagcaatcacttccttaacctctctgcgcaaaacctgacacagcagttctttcttatgccagttccttgtactgtgatgcatgctgtcacctaagggtgagccacctcttcttagccacaaaggccatctgtggcccttgagatgctgtggccagaggaagagaaagaagagaaaaaaggaagggctaagaaagactatctttatggaaaggaaaggagaaactataggagtgggaagaaagggagagagggactgggaagcagcatagctcctaagtgcaggcaggataaagaataactgtcaaatgcctcagggctgcaccataagtcacctacttcttccttcaataactctttggtatttgctttaaaaatatagtcctccctcagtatctgtgagggactgactgcttccaaaacccctgtggataccaaaatcccaggatgctcaaggcccttatataaaatgatgtcatatttgcatataacatacacacatcctcctgtatactttaaatcatctctagattacctcatataatccctacacatcattgcatttgcgtggattcaatgtaaactcagcatgctgcaaattcaagttctgctctttagaacttcatggaatttttctttttccaagtatttttgatctatggttggctatatccacagatacacagggctgactgtaaaatgtattcaggggattcacagagagggaacaggactagatgatccttaggtcatgatgctctcatcacgtatccttgcctgttctgttattcccatactgtcctgcacttccttcctgcttgtttaccctctaatttttctcctttcactcctggacctttcactggcgccccctggaacccgtattttatgaaacaaattgtttcatattttctacctcttgtagaaatactgctcttcacttccctgctttaattagaacctggctatcttctaagcatactggtctctcagcagcccttttgagtgaaggatttgactgttgcatttgagtgctggtccacaaatgcaggtttcagagcattagttctcatttgtgtaacaacttccattttttgagccccctgaagcccagttatcccaactctaccctttgctataatttattgaaccctaccctacattcactaaagaactttggtgcctaatttactctatacctcaactctagatattacatactgtctgcttggacagctcatccaaaattcaggtctcactgtttcatcttctagcatcttttcttctccacctcacttgagtcacctacttctacagtcacatctggcaggcctgtcctctctggaatgactatgatctcccattctcagataagaacacctatgcttatatcttttgtgctcaatagcccaatttatacctgttatttgacttcaatgaaactctactttctatacatcaacattctccttcttttcaagaaacttgtattacaaattatcctttctcctatatcttcagtctatccttttttcactggagactaaacatgctcaagaatcttttgtcttaaacagaacaacaacaaaaaagtgatgtctttctgttttcataggttctggttacaattctgattctatctcacagttaagtttatgaaacagttgggcattttttctacttgttgacttcctgctcatcccgcaatccctcccaatctgctttctgcctctacatttgtattaaaagagctccttctaaagtcatcagtgacctcattagacaaattagtccacattgtagttgatccaccttcagcactactgtctcctcaccgaagcagagcttccctgtggtctttgttgccagcgtacctgcctggattgcctgtccctagttgctccttctcattttccagccctcccaacttgattcaatcttttaaagttatggacttcataggactcaatctgaagcaaacttttctattagtgactccgaattttgtatctccagctccacatatcaacacttttctggatagttctacttggatgtcttaggcaccttaaatatgatatgtctaaatgtattcctcttccaaatatcttgtatcattagctataccattacccacctgcttattcacatcagaaaccaggggtgatctatgaaatttccttcactaatgctgccaacattctctaactttattctaaacatgtctagaatatacccacttctctccatttctaccgccatcagccaaatcaaagccaccattactcctgctgtagcctcctaagctgctctctccaaatttcttctgctctattctgttcctcatcatctgttttccacacaagagagatctttttgaaatccaaatttgatcatgatacatccctgcttataatatttaatggctttctccttaaataaaaataaaattctcaaatgttcaggtggcccttcaacatctggtcccctagttaggtctccaggcttattcaactgctttctccttgctttctacacttcagccactcagatccatttgagtccttgtcttaggcttttccatgcactggctctcttctggttttctttttctctgtctgggagccaacctattctctcctcaggctgactaattcatcattcatcctttagatacctgcttaactgtcattccctcagagactttttttcctttttctccttaaaaaacaaaacaaaacaaaacaaaacaaaaaaacaggatacatgtacagaatatgcaggcttgttacacaggtatccatgtgccatggtagtttgctgcacctatttatctgccctcttagttccctctccttactcccctgccccaacaagccctggtgtgtgtgttgttcccttctttgtgtccatgtgttctcagtgttcaactcccacttacgagtgagaacatgtggtggttttttgttcctgtgttagtttgctgaggatgatggcttccagcttcatccatgtccctgcaaaggacatgatctcattcctttttatggatgcatagtattacatggtgcatatgtactatattttctttatctagtctatcattgatgggcatttggattggttccatatatttgttattgtaaatagtgctgcagtaaacatttgtgtgtatatgtctttatagcagaatgatttatattcctttgggtatatatgcagtaatgggattgctgggtcctatgggatttctgtttctagatccttgaggaatcgccatactgtcttccacaatggttgcactaatttatattcctaccaacagtgtaaaaacgttcctatttcttcacagccttgccagcatctattgtttgttgactttttaataatcgccattctgactggtgtgagatggtatctcattgtggttctgatttgcatttctccgatgatcagtgatgaactttttttcatgtttgttggccacgtaaatatcttcttttgagaagtgtctgttcatgtcctttgtccaatttttgatggggttgtttttttcttataaatatgttcacattccttgtaaattctggatattagacctctgtcagatgggttgattgcaaaaattttctcccgttctgtaggatgcctgtttaccgacgataatttcttttgctctgcagaagctctttaattagattccctttgtcaattttggcttttgttgcaattgcttttggcatttttgtcatgaagtctttgtccatgcctacgtcctgaatggtactgcctaggttttcttctcggatttttagggttttgggttttacatttaagtctttaatctatcttgagttaatttttgtgtaaggtgtaaggaaggggtccggtttcagttttctgcatatggctagccagtttttccagccccatttacccaataggatcctttccccattgtttgtttttgtcgggtctgtcaaagatcagttgtagatgtgtggtattatttctgaggtctctgttctgctccattcgcctatatgtctgttttggtaccattctgttttggttactgtagccttgtagtatagtttgaaatcaggtagcatgatgcctccagctttgttcttttgtagtgcttatcacaattataacacattatttattaacatctgtgcttcctgccccaactcaaactccttcaccaatctccacaaaagtagtaaccatatctgttttatttatgtgtatgctgtgtctatgaggcctagcacactgcctgtgtgctagtacgtgtccaatatatatgtgtggaatgaatggatgaatgcttattctaactgtggaattctgtttatcccaacagactaaagagcaatataactgatattttcaggttttactcaaataacagtgaaaaaagagcaattaaaagttctttaatgcagctacagttttcttgggagaagggtaccctaataactgcttaactactggtagtgaatttcaacttgtagctgattctacttaaaaaacacattacttaaaagtgaggagtatcaaaaactcagaaggaattaataaagaatacttcatcttgcttaagagtcaaccccatcattctctaattctcattctctattccttaaagcccacatttgctactaaatttagataccgatgtgtcctttgttcaagtttggttagaaaaaaaatattaaaaaagcatatttaaggaaaagaaagagcaaaatagtcttggctttttattaaataccccttaaaagcagtaaatccaattacagatccagtctggatatcacattatagtaattttcttaaaattctgaatgaagcatggaaaaaaattaggaaaataaagccaaaatttggctttatcctggaatatcaatctatgctgtttaaaaagcacattaccctctttcttgtagctgtcttcattagccaatttattttatccttctgtttagttagacacatccttttttccttacattcagggatgtgtaaaagaatgaggaaaactctttctttaaataaatctctaatgtaaccagacctctgtctacttgtggtggatagaaatattatagaggataggaaactgtaattttaagatgttacattttagtcacagtgtacatgactatcgctaaccatgtttgaataagtgttctgtgttcctcctacaattaaaaattacatggttaagctgaggctttcaggcagtgtatctacagacaacagtggcgtctacctattcactgtcaagcttgttctgatgttcatgctttcttaatcagatactgcttcctatattatattgccttacctatgcttctatgtgttcctgacctactttaccttcacagggatgtcctcctcctggtttgctttctctgaggtaaagacatacgagatttctttgtgagatgtggtctggcggcagattgcacacttaatggagcttctgtgagatcccacgctgtattgttcaataattatagaaatgcattcattacagaaacagtgaccacaggtcagtaccgcccactaaaaagaaaacagaacaagccttagtgctatcaaagatgccttacaatttataagcatattaaaaagagattcgcaatttttcctcctaaagatttcataacattaatattctttgtcataaagccaagttgtgccttcaaattaattttttattccaaagtaagttttcataatctttagttctgtttatcctaaaagtgagtatgatagtcagtcaccactactttgtagaaaggtggtgttctcatttctgtatttgggaagaatgtaaattagtccttcagcactctaacaacagatataacagagggacttagaatattaatttggagataatatcatactcgatatgttccatttaatttaaaaaacagatttatattttcacacattaaagcacttatatagaaaataatatgggatagtatctcaaatttattttgaaaatggttctggttatttaaaaaattacaaacaaaaagaaattattattattactattattttttagacattcttgctctgtcgcccagactggagtgcaaatgatgcggtcttggctcactgcaaccttgcaacctccacctccaggattcaagcaattttcctgcctcagcctcttgagtagctgggattacaagcacctgctgccacgaccagctaatttttgtatttttagtagagaggggtttcaccacactgaccagactggtctcgaactcctgacctcatgatccatccacttcggcctgggattacaggtgtgagccaccgcgcccagccaaaaagaaatgtttaagaaaccccttgtcctattcgggaaaaataaaataatcctctctgaatctctgcaacataccatggagacttttgccctctttggcaacgagagacgtaagaacaatagatttagtctaggtgtaagttctaaaagctatggcatcttacaaatgtagttttaaccgttttcatctggtaaaaacaataagaaaaactgagtgtcttttgagtgacaaagcttctaaatccttaagctatgttttttttaagatttggacatgtatggaaagaaagtgcgtacctggcccacttgagattctttgctggatcatctaagatgctctttggaaaagaactcacattgaaagaagagaaaactgaggtatataagcttggttttcaaaccactattttgcctattaacagctaatactattcctactgttctctagctgcacctctgccagagtccacaggagttgagactaatgaaattgaagagctgttttactagcatttttgtatgacacagagcagcactatattgtactttatgtacctctagtgccactggggtactctactggaaaggagttttgtgactcactagagctcaaaatggaccaactaaacatcaagacaggtccacctacatgtgcaatggagaagaagcaacgagatacctggcacctgaccattaggagtgacaggaagctgactgacccaaacagaagagacaaatggcaatgcctccaggtgcatcagctggtacatatgggttaactctgatagattctaatttaatagccctaaattagaaggggggagaactggggatccaaaaaggaaaaaaaaatacggctactatatattgtaagtatgaacagagcttgaaaagtatttttattactattattgaaatccaatatggtcttccaagtgcaggaaacctaggttatgctagaattaaatgaactaatgtatatgaaagaactttaaaaactgaaaatgtttaagacaaaatgaaatatctgagacagtccagttgtataaatcttatcaaaactaaaagcaaaaaatactactttatgtcatgatttcttccatttttatcacaacttttatcagtttcatcactgacttttgtcagaagtaaccagcatttgtacagtactattttgctcagtttccaatgtagtatctctccctttaagatgtattagcaaataaagtattcttgtgatctcaccttctccaccaatcttagaaaccaaaaggtactttcttcttgattattactggtcagaatatggaatgcatatatttacctttcaactctcagttccatagaaaaaaacagccaagactatttctacttcttcaacagtaataggcttatctttcaaattttcaagagcaatgaatagtctgatatatatatatatagatttatcatagaaagcagaaacttgtattttcataaattgcagttctcctagaggagaatatggttctaccatgtttatagacattatgtatactaatatccacaaaggaatatatttaatatagtggtctaccaaaatcacatctaaatttccctaggagagattaatttgtactctgaagaacaagtattatgagacattaatactggcaagtaagaactacgattctatactaatgtaataccttaagtaaatctatgtgtgttatattacatttctgtataattattgaataactatgttaacctgacgaagtcaaattactggacacaaccttgtgactggaaacaatgttcaaaactgtgcatctttaatgaaaaagatggcgtcattctagaaatattttttcacttcccatttaagaaaagcattgctcaaacatctaatcctaagcacgtcacctaacctctagtgctatctttaagataatggtaatacttgcctttcatagaaactagtggtgagaaaaacgagagaaagattttatgtagaaacctttgaaaactgtaaggtattttataaatgcatgtgatgtttatcataattttacctgttttcctagctgtcgagcacagattgggcaaggttctggattaacacctcccgatgttttatcttgagactatccaaaaaagaattaaaaaatatattagttacgtttttacatataaaacctgatatatgttttgcaactcatttatggaagtgaatactggcaattacaatttacataatctaacaatttagatgacccatcgatctctatattacctaacaagattattcctgagacttccttacaaatatcatttattcaaggagtgaacaaaaaaatgaaaacaattttaatcacacaggttgaatatccctaatccaaaatctgaaatctgaaatgctccaaaatccaaactttttgagtgctgacatgacaatcaaggtaaatgttcactggagcatttcaggtaacagattttcagattaggcatttaaacaaattgaaccaatgaattattcttttcctctgttaattattgatttttataagtaaatcaataatgtatgtatatatttgcagttctataatgtccatttgatcttaccatatagattccaattcattttactatgttgtccacttttcctttttacatataataaatcacctacaaatttagtggcttaaaacaaacatatgattcccaagattctacaggtgatttggggatgggctgagttggctggggttggatggtctatgatggcctcatgctcatgtttggcagttggtaggctatctggtctgcagggagggctgggctgagctgagggctctgctgctcaagaaagtaaactaggctttttgagatagtctcatggagttccaaagagcaacaagaatgggagggtcattgctgtagcactttgtaaacaatctatcataattcacaacagctcttcttttccaatatgtcaataaagagttgacatttatataaatggtgagattataaatattttaggccttgtgggccatatgatctgtgttgtaacaactcaattccactaatgtggcatgaatgcagccacagacaatacgtaaatgaatgagtgtgaccatattccaataaaactttacttacgaaaaaaggcagcgggctgaatttttcccatgcatggtaatttgcagatccttaagttaaagaagttataaattttcctctaagcactgtcacatatttttactttcactcagttcagagtattttctaatttccattttgacttcttctttgacccatgggttattcagaagtatcctgtcaatttctattaaacttttagggatttatccagttatctttccattactgatttctggtttaaattcctcttcagtcagaaaacatactctcacatacttttaagagcggctttttgaattagcataaggtctattttgataaatgttccacgtacacctaaaaaatatgtattctgaagctgttgggtgtaatggtctgtgtcagttgggtcatatttgttcattagtgttcaaatgttcaatatccttacggactttcttgtccattcctctgaaggaatcttaaaatagattaaattatcttaaaataattacattattttaataaattttataaattttaataaacttataaataaatttataataaaatataattataaatatattttggcagaattataaatatataattataaatataaatattataatacaattataataaaataaattttaataaatttaaataaattaaattaaatcttaataatcctctgcttacctctttcctttgtgctactgacatatattttagttctatataagttgtataacccataagacagcattgttgcttttaaatagtcaatatccttgcatatttatctacatatttaagcttttgttcttcattccttactgtagttgcatccttcaatctgaaataattttccttccatccaaagaagttcctttaatatttattgtgatgtgtgtttactggagatgaattcttccagtttatgtttgtctgaaaatatccttatttcactttttttaaaaaaaggaaattttctttaagtatagaactctaggttggctgtttttttcttttagcattttgaagatgttccaatgtcaactggttacatagagaaactatggaaaataccgaaacatctttaaaggtgaaaagaaaaacatctctatgtagccaccagttttattagtgttcctttgtaagtattaaatgttttatctctcaactttttttatttctatttttcattatttttggtttccagcagtttgactatgatgtatctaggcagtattttgtttttttctttacttattctgcttagtgtttctgaacttcttgaatctttaagatatttgtcataattttatgagttttagaaaattctcagctattatctcttcaagcttctgtcctattctcttttcttcttgaacttcaattacaagtatgctagatctatgaaattacaagtatgctagatcaaacaactgtgtctcaaatctcttttgccctattttgttctttttctatctatgccacttcaaattgggtattttcatttgtactgtacttgagttcatgaatcccatctttttctgtgtctggtctccaatgagtttttgatttcagatactgtatttctgcagttctataatgttcatttaatcctactgtatagattccagttcatcttatgttgtccagttttccttttcctttctttcacatacaggttgagcattccaaatccaaaaatctgtaatctaaaacgctctaaaatcataaactttttgagtgctgatgcaatgctcacaggaaatgctcactggagcatttccagttttggatttgagatgttcaacctacataaaattgttgacagatattgttaaagtgcttttaagaaaagcttatataaatttatatttccattggtaatgcataaaatgtatccattccctgtcctttttcaccactggggtgtgtaatcatttaaaaaatctgtgcctaattgttggcagaaaatagcacctgtgtaatttgattttccatcattatagattaaatgctttttcttttattaacagccaaattggattttcttaggtagaatatttatatccttaaaattttaggttttaaaaaatattttaacatataaacaatgacgtacaagataactgtctttttattttgactatcatatttaaagtatagaaatcttacatttaaaaaacttatgttcaggaatgttgagacatttttcctgttatcttttttttttgagatggaatctcgctctgtcgcctaggctggagtgcaatggcgcaatctcagctcactgcaacctctgtctcccaggttcaagcgattctcctgcctcagcctcctgggaactggattacaggcgtgtgctaccattccagctaattttttgtatctttagtagagacagggtttcaccatgttggccaggctggtctcaaactcctcggcctctcaaagtgctgggattacaggcgtgagccaccatgcccagcctgtgttatcttcttaatgttagcaatttgcatgaaactttttaatttttttcttctttttatctttcagaataagtgttggtaatcataacagtaataatgatcttaataatattaatagcagcaaaaacctagaaagtgcttaatagatcagaaactactctagcattttacatgtattaattcacacaatcctcaagacagccctatactataaagtagtgttgacatcattctcattttactgatgatgcgaggaaaggtgaataacttaaataaagtcacatatctagaaaacagttgagtcacgattcaaaattgggctgtccagttccaaagtctaccttcttagtcgccatgctatatctataatgaatgtctaacttttcattttgtctgagatttactgattcacttaagtatatgttataccagtttccagaagaattcaaatctatatcttgtcctcacttgccctatccaaatatttactactatatcttgcccctagaaggttctctgccaactagcaaaatatgattcctgcaataaaatgaaattatatttaatcaatgacccaccaattcatcagtgtccagtataatactcagatcataactcagaacatgtgttttgaattacttaatatttgaagtctacctttattaccatgtactctgatttagtagctttcgaaacacacttcagtttcaaataacaaattacaacatatttttgtattgatgaatgaatgcatgtgtataaattgcattatgccagtttcaccgagatatgttttaatacttttactattcaaggctttgaactacagtccatttacattgttctctactatcgagtgcatgccttctatatcatctgcataataaatttctatagatacaatattcttttgtgatctctgaagctattgtagagacataggtagtgttctgactcatataacaccaaatactaattacaacaatttgcaccattaattatgaaaggagtcactaaagtggtttatgataatgcagcataggaaaaagtagcatgtcttagaaacaataccttctccaaattagttaggtaaagaagctgcccaagttttttctgaagctgtgatgtagcaacagctttatcatttagtagttttattcggttttgttctacctaaagaaaataaaaataaaaacttctttattctttcagaaagacagttaaattatattaaatatggacaattctccagtaatacaaatgtattgtttttaaaaaaaacctatttacattctaaaacacaagttttcaaaatggatactagataatatatttcaaatgatttttttttttttttgctttatgaaaggcacaattcaatgcagagttcttttaaacaggaagtgtccctatgtacctgaagtcagataaaaataaactcaaattctattatgtaccatttttttcagtaatacatacacgggataaagaaaagttaaatgatctgttgctctggcctcagtgatttcatgaaatccaggaaagaatttctctgcccttctttcctctgtccccctggtagaatacagcagacagagaaggaacactcaaacaagacgaatttattttctcagaaaaacttcttcagaattcacatttaagtgagatagtatataatgaatatatctacatttttccaagttacagtctccaagctgtacagaaacagacttaaggcactaaacaaataaggaataaaaatgaattataaaggaaataatatcttttaatggagaataaaagagattggtggagtaatgcttttaaacctgagttacaaagacaaagttattagaaggtaagttgttaatattagttcatcattagcaaaagaaacactgcaaaagaaaaggtttcagttgtttttaaggaagatttttctagttctgataaaactgaggtgacaaaaatgtctaaaaagtgactgagaatatctattggtcttaagcacatacaaggttttaaactcaaaaacagatgaatgcgcaacctggagagaaacaagatgccccaaaatagtgaacactaagcatgtaatagatatgaaattgctcatctttgaccatttttggtctataaagacaattttctatgggtcaaattaaaaatggagattaaatacacacttacagtagagctcagtgccctgattctgccttttctatgggtcttagatatctgtgacatctgcttgctgttcccttttctgtgatttacttgccaattacctcatgtggttcaatgatatgaagaacaggcggattaggctttggctccctaggatcacgcactcttagtcgttctgtagccattgcaagttcatcaacagcagacacacgattcctcagagccatccaatattcatgaagcaactgaaggaatagaaaagacaaacacagtggtaaagcatgtaattaaaactggttaaaaccaccaagatgtgccttaagcaaaagtcttcaatgagatcttacactttttcgctatgtgtctaacgtacaagtagttcctggggtcatttttaggatgaaatgtgaatgaaaaaaatctctataggacactgcctctttagattctcagtaacagaatataaagatttcttgctaagaccaaaaatctttataaagtccagttttaggctgacagaatctcttgttttattttttaaaaatagttttattataacatatttcacatattcaactatgtataaatggcaacaagaatactaaaatatacaatcaagtactcatcatttaattgaagaaagaataatatgaattccttggaaaggctctgtgtgttctttctcaactgtatcactctttcctcacatattcctccttcagtacccaaccatggggcaaccactattctgaattgtacttatcctgctacacttttcattgaacttatactatgtgaaacatattcttaataattcagttatatatgtttctgaaattcacagaaatggtatcaatcagtatacattttttgacaggctctcttcactgactttacattttgaggtagatctggtagatatgtacagcaggagctcattcaattgctcttctgtgaaaaggtctgcaaagttatgcagaaaatatgtaccaagacctgggagaactgcacagtaagctctcttctggacaaagggtatgtggccaaactgagtcgaaaggaagaatacaggggcaactgaacatcataagtaacacttcttccaaggcttactgtaattaactgtgttaacgtgctttgtattcacatgagtaatgtgtgagaaaaacattattataaaccaatgattttgatgttataaatgtattccccaatttatgacatatgaactgatagtacaaataactatctctctgcataaaaatttttatcctactttaaaaagcaagactttttaaaaaagaaattgaataaaaatgtcattataaaaaaacacttctttccttcctctacctatgtcacctgtaaagcagtacaatggataactaatccaaataaaacaataattgaaaattaatgaattgtgaaatctcaagtacagaggtataatatgatggaatcattaaagtacaaatatgaaagggcatatcgggctttatttattggaatggtttccaaacttataggataagaagtatttactatgttccccaatctttaaggtagctgatgcttgcttgttattcacagaacaaaaacaaaactctaatttcatataatagcagtggaagatcaagctaataatagaatgaacacactttcacggctaaacaaaaagtttcatataagttccagtttaataatgattttcttttagtaatttaataaatagaatgtctttgagtattatggtatttgctatcctttattacaacagttacatttcaggcaaagagaaattatgccacctcaatctcaaaagaagattttaaaaaactggagagagaaaaaagtagcagttaaaattgatgtaaaaaagaagaatttttaattttggaaggaagttttaaaatactataccttatattccttcttccatgcttcaaagagatccattgaagtgcttccttcatcaacaaattcaacatcaaacctatgtgattttgcaaatgatagtattgctttcatagatcgctctgtctcacttattgcccagagaccccgggtggtggtaggtgctcgatcatccaccagtccttcttcatcttctatcatctcctcaaatattgcagtctggcctttgactctgaaaacataccagaacaaaacaacagtaactggtatcagtgagtgaaaagcaaccttcaatgtgagttctaaaagaacatgtttgcaagtctttggaaaaaccaaagcaaccttgaaaaagctgaaaacatcataaatttggccagtttttttttttttaaattctattatatccactgtaataaacagaaagctactgattcatttgccataacaacacaaaaatcttgttttcttccttgacatgcagaagtgaacgtttggcaaggaaatatgtgaggaaaatttctattttagagaagttatatctgttggagataaataaacagaatttggacagaaacatgaagaaatgtattatttacttcagtaataacagaaaaagatttgacctaaaatagaatagtaatacacctggatgaaagtggacacatttattgttctaacaagcttccctctgagaatccaggtgtttgtgacaatgtttacttatggtttcattaaagtaataacatatttgattgtgtcattctttattcttgaagaagttatgccggacattatgagttctaccttgaatagcagtaaaatgctagcaaaatctgtataattcaaatccactggattctagagtctgggattttaccactccacaaaactgcatctcaattaattatatattactacactatgaacatttaggggataacttctggataggtaaaactgggcatattaaacaatcaaataccaaaggtgtactaatcaatttaattaaagaaacaatataataaaggttactgtgggggaaaacatagtcttatatcacataactgagtcttgcaaaatgtttcattttcttgatgggtaataatcaaatagagaacttacgtgttggaaaatagctttgattcatactctgtgaacaattcatcagctttacaaaagacacagctgaaaaaaaagagattaacagaaatattcacaaacataaccagcaatctggtaattttaaggagaagcttaatattttgacttcatttttctttccactagatatgccattttagaaaaaacaaatcacatggtttttcataccttgtccttgagactttatttttctttaaattagattaatacatctctttctacttctgtctcaattaaaatgaaaaaacctttactatatgagtcaattgtttcttctctaagaaatctagcttaaagaaatggtaccatttcattgtatgatttcttctattacctaccagttgagaggaagtctggctggtcggaggtgacagactgttgcagactcaataacattacgagatggaggtccctccaggttttttacagcctctcttactagcttctggcatttatttagctcttccatttgtgttgtaagtaagaactgaagacctctgcaatcacggaacctgattcccacaccagcaccacacacaatacaaagaaaagaataataggtcaatttcctcaaattcagagaatggttgccaaacaaagtgttaaagaaactgtttgctgttttttttttttttaacagcaacatttgagtgagttttccttcagaatgtattcaaagtataatattgggctgtctaccgtaaaagataccaaaaaaatttgatagtcctgtgctcaggaactgaaaaagagcatgaaaaatgtatgtctgtctcagatatctttgaaagtgtacgactgccacattcttccgttttaagcctgactacagatagccttcctgacatccttgctctatatgaggaggtgcctgcaggatgaaacataaaagcagaatattgggaagaaagaagaaaaatggctaagagttatattccttggttgaatatatatatatatgtatatatacttaattaaatctgtaattatgcactatatacgaggcactttgccaagcacttttcctgtataatttcaatagttactaatgtgctcacattatgaagtgtaaaatattaaagtaactaaagtaacaaaggtaggtcgcagttaggagttaaacccaattatagtacctataaccattttgataaactgtgaataaaaaaggctgcaaaaaagaagtatgaatgtgtctgtataggtttatgaatggagaaaaaaagccggtaataatgagaaattagaaactagaaaatacaaggatttctttgcttttaaaattatgagtagatactttttcttcctgttttcttacttctctgacatagaaagcttgccagtttgttgcttgtagttgctggttatttcatttcgcactcgctgaactagctcctcatcaatagtaaattctattgctctgtggatcacatttagccaccaaggagaattagaatgaatctgtaaaaaaggtagcagttaatcaattaatacattttttttagtactcactaagcttccatcactgggcagggtgatgccaaaattcaaagaaagtaataaatgctattctcaaagggactatcacagaggggagacgagtatacatattccatgtacaatgctcgcttcctcttttgaaaatataattaaagagaaacccctatttcctaactactctggataaatgggaatttattgaatgcatttatataacaaagctgtaactaaaaaaactgtttacgccaaatgaaaattcaatactcaatctatatgtgtgaaaaggtcacaggtctctttatcagcataagaaagaaagccttcattctaatctttaactaactgaaccagattctacttaatgaataatccacaataactcacaaaattatatcccagaatactaaataatgaatgaattagaaagacaaaaatttgcaacacctgatttaaaaactgaaaataaaagtgtatttgtgtaacctctttagattttgctgctgatttcataaaactgaaattttagaaatgacaagtggtatatattctgcaggaaaaatacctgtggttctaatgtattaacattttaaaacatctcagaaacaagataaaaaggaggttatagaagtctttactttcttcaaaagacaactgttatatactcatggtaagagaaaacccatgagttcaaaagaaagagaactcaaaatagttgacttatttatgcatctgttcactcaaccaataaatcattgctaacagtaaaataaacttgtattgtgggtcaggcaatgtgctaggtgctaaggatttcaaaatgtataagaaattcaagtttctccccaccaaaaaaccaaaactcaaaatgatatctggaggcaaatacaagtaagaaacactgcattttggcatacctttctttgaagctcatggatggtctgctgcacaggatataaagcttgctgggcttcagcaacttctgtattacacttgctcatgtagtgctctcgcagctgtttggcctgtgttgaaacagagaatataaactttcactcccaatctagaatataattcagtatgatgtttcaagaagaatgggtcattttatacatttaaagctacttaactgcatttaaacataaaagtccaagtatactgtagagaacataaaagtcacgctaaaaattccttatatatggaagttaacaaaatttacttgtccaagtaacaaaatttcagaaacaccgaatatttgtttgccaatttcttatttaatttttttttttagttagaataagcaaagaggggaaaaaaagaacagtaatatttcaaatgataggcaaagcaaagacacctttctaaaatttggctaatttagttattaaaattccttagttactgcagtttaaaaataatccttgagaatacacagtaacacaggtgttaggaactgaattttgtttccccaaaattcatatgctgaagccctaagaaagtagattttaaatgttctcactacacacacacacacacacacacacacacatgcatgcaataaaaataaagaggtaattgatttagtttgatttagctattctagtgtctacatacatcaaaacatcagtctctactcatgaatagataaaatttttgttaattaaaatagtttaccagggcacctccgcccccaaaacaaccagtgcaaaaaggctgtgcttatttatataatctcattttttatcctgttgactcaaataaagcctccacttacaggttcaatacatttcaaacatacctactcttttgattttagctctttaatgtttaacaacagcaaaaatccctggaagaatctgcataataagctattaacaatttatagtaaaataatttataatatcactcttttcgatgtcattcttttcaaaaagaggcgacactttttgtagaggaaacttctttgggagaactaccaccaaaaatttgactttatttacccccttaaaaaatacacagaaatgtggagaaagtgcaaaagtttgtatatttactaagctacctcttttgtagatctgccatgagatcaaagtttcttttttaaaactcatttatttacatcccattctgttggctaccaacagccatatctacaacaagcatttatcacataactgcaggtagatcagcagagaagccaaataatacgtactgctgccattctctgctacccaaaatcacaacaaaattcgaaacatcaaagtaacaggaaaacatgattacatttatttgtatgttgtatgtcctaggatatatcaactatatggagcataaagtttgaagaaaatatacttttatagacagaatgaaaaaaataattacctcttcctcaagtcggccatcacgcaaggtaggtggtatccctgggtgcctggctatcaacaattccatcaagttatgggtagcatgaagtctctacaaacatatcaaaggcagtaattatgacagtcaatgcagaagactctgaagagaacctaatattaatatggcacacagaacactaacaccacattaagatcatatcaccaaatacttttcctataaaaaaatctgagtactactactttgttttctttactcaagggcagggtgttaaggtctaggacctgccttttgtaacccttatccatgcagaatatcagatttatatttaatttttcctctccctccacttttccatatgttcctctaaatatccactctggtacttgtgaacatgttagtcagtcccaaggtcaatattgtgaatggtaatgacatcttacctgggactcaaacctaaacttgccaaaattaataaacccatttctacttcttatttagctagagagccttgtctatatgagtcaatgacagatccaagaagggaaagagaaataagtgttataattaaaatatccaaatctccctaaagacctctaaaaattatcattagatagattttattgcttagttccttttctttttaatgaaaaccatgtgaataaatatgttgatattcatatgtcaaagtgataaaactgacctactcttggaagtacaagtactttgagctatttttaactgtagcttatatagacttaccttgtcaggcttgtgcccaaaacttccctgaatggaatagtagtgattctcaaatgttagtgtacatacaaatcatctaaaatgcttattgagaagactgaatcccaagtttcacccagtgattatgactgtttgttaccatttatcctcttaaacattcagaaaaattattttgttaaaaaaacaaacagaatacctatgaaactgtttagtctttacttacttgaagtgaatcagttttgagttttcctttgtgttcctccgaggagcgcaacacttctctgtacaattctgctgccaaggcatactcacctaaagaattaaaatgtatttaaagcatacgagagtcacatatttagttcccaatgtcatctagttgtccattatttaagaatactgtaaaaataaaatgtaatgattataactttttttaagtaaagaaatttgacttggtattaatatgattgcccaagttttaaaaaaggctgagtacagttccttttttaattccatggaatataatgttcttatattacatttataatattttaaaattatactgaaatatgtttataatcaaacgtttgtaatgttttgagattatgctattggataaacttttaatttagacaaaaaaatttcctcttgctgaagttaaaaggtggcaatcagtagtcattatgatgtttgaaattaaggataaacttaaggtaattatagattatttattaaaaaaaaaatttaagacactccaaccaacccacacatagcgatcagaaaaatatagtattcttggtagctattattgttcttggtattaggccaaataatttgcaattaaaaacttcatgtcagaaactcagggatctccctcttcttctggtcacacaaatcatggtctgagatgtatgctgttttctactgttcataatcagcacctcattcaaataaagcaattcaaaaagtatcgattaaagcacagtctggcaaagtatggcccatgggtcatttctaccctctgcctatctgttgggcacatcagcttagaatgaattttacattcttaaatagttgaaaaaaattcaaaaaaaatatttcgtgacatgtgaaaattaaatttcagggtccatagttttattagaacctagctctgctcatttgtttttatactgcctgtggctgctgttgtactacaacagccaagctgatagttgcgcagagatcttatggcttgcaatgcctatgtattatctgcttctttacacagaaagtttgatgatatctcaataaagtaagagatgaacatttttaatggcttgaataatagaatctatcttaactgctgcttgtaaaattcaagacaggtaaattataaatactattaaagtaaaaacctaacactggcaaaaccatgcaatccataccaaaaaaaggtacaagatgttctagcttttatttgctgagaaagtttttttcctaagtatcacacatactttcttttaaaaaaaaacttcaagctggttttatgaatatcatgtaattaggaccatgttcatagttacaatgagatatatatatatatgcaaacctttgtaaattttgaagttggttctgtttttagctcatatataagtttacatacatatcttgattttggtaaaatatacataaaatttaccatctcagccctttttaagtgtgtagttcagtggcattatgtatattcagtgttgtgcaaaacacctaatttaaaataaattttgcaacaatagctcttataccattgctttatatctagttctattagttagctaatacaaagctttctaaaacacacattatcaaagaactgtagtcagccaatttctattccctttaaataagggagaagattattttcacaataataaagttactttataacgtaggcattaacattcaattatcttcacagtgagttctctttttttagttaagagtcttgattaaagcttttcaaaggacattatgaattctatcagtatttatactaccatttgtagagaataattcaattaacaattttctcttcataattaccataccttttaaagaaggtatagtgattaaactataatgtaaagcagctgaattttatctattcgttataatacctggttttgcatgtttatttttaaaaagacatgctttctgaggaagattaaaaaaaaacccatattcaatgttataaaggtttaagtcaaatttggaaatacccattctcagccacttgatggcgctaacatttctaagaaaactggtggatttgatattgtcaagctaattttctccgaaaatcatctgcagaaaacacaatgttcaaaattggaataataaaatgtgtttaataccagtcaaggagaatctcagaatatgtattaatgtatcatacgtatttatttacatataatataagcaaatctttttagagtttgaaattaattttagatttcttttaaaagtcagaccttcactgtctgatcttcacattagaagaatctaatttatgtaagttatatatgtaatgttactttaaaaaatgaatattgtttaacacattactatgaagttaataaaaactaaaagcagcaaatctattacaattaagttgaaaattacaattcagaaggaacatatcctctattaatggactttctggtggcggatttctcttaataatcaacaatacactgctagctaaattgaggactttctagggaatgccctagagggaagatttgcacacaaagttacgtgtactatatgtgaacaatttaacacgaatatataataataggcccttttctattagatattgataacagaatttacattgtgagcaggttgaaagtggtaagaatctgaggtaaccttcatattaccataaccaataacatcattcttcatctctgtttttataacgttttcaatgtgcttctacattttgtattaagaacaatagttgaggtaagtaaagcacctgtaatattttattgacaaagacactgaagttcggaaatcttgaacaatatataccatttcacagggttccaactgcagcatgtaagtaggcccaccctattcagttcttgtctagagctatttctgctcagcttctgagaatccttataactctacccaagtatctagcacaataagagacactttccatttctggttctattatgctaaagagctaacaactacagacgggctactcaaagaggcttaatgtaagaagatttatattctacaaaaagcacacatttctttgggcaactgatttctttgtacttcatttgctctttttttttaaatttcttaaggtagcagctgaagtctccgatatgaaacttttttcttttctagtacatgtttaatgctatgaatttctttttaataactgatttgctgcatcccacaaattttgatatttcatttttattcacttcaaagtatctcctactttcccttttattttttaacccaaaggtttagaagtgtgttatttaattcacagcatttgcggactttccagttttccttctgttattggtatctaccactgtgggcatagaacacactctgtaagcatgaatcctttgaaatttactgccttgttttacagcccagaatatgccctatcttcatatacatttaatgtgtacttgaaaacaatgtatattcctctttggttgggtagtcaataaacactgattaggtcaactggttgacagcggtgtttgaactatgtatgccctcacttattttttacttattctatacataactgagagagggatgtagaaatctctgacaataattacgcacttgtttatttctcgttataattctatcagtttttagtatttattttgaaactcttgttttaggtacgttaatatttagaatttttttctctagtgataaagtaacaccctttatccttggtaatattctttgctctgaaatctactttataagttccagtggtacaatcagttagcaggcagtattaataagaaatctgttttacttgatagaaatatagtggctttatcgttcttttgattagtgttaacatatcttttttcatcctcttacatttgcatctttaaatataaagtaggtttcttatagagaacatattgatggttattgtttgtttttaatccagtctgacaatccaggcctcttaattgggatatttagaccatttcagtttacgtgatcactgataagcttgtttttaaatctaccatcttgctgtttgttttctaatcatctcatttgttttttgcacccttttttcttttttttgaagatttttaatttattatttatttatttacttattattatttttgagatggagtcctgctctgtagcccagtctggggtgcagtggtgcaatctcagctcactgcaacctccgcctccggggttcaagtgattctcctgtctcagcctcccaagtagctgggactacaggcgcatgccaccacacccagctagtagagacggggtttcaccatgttggccaggatggtctccatctcctaaccttgtgatctgcctgcctcggcttcccaaagtactgggattacaggcacaagccaccgtgcctggcctgattttttattttttctttttatctattcttttggattattacctctaactccttgttgtatgttgaagtggtggctgtagggtgcacattctttgccttgtcacacacagtctaccttcatataatattatacctcttcatatataggataataatcttacaatattatacatccacgtctccccacacagactttgtatcattgcttttacacattgtacatttacatgatataaaacccacaatatatttcttttttttttttttcctttggggactccaatacatttatattaggccatgtgaagttgtccacaacctcactgaggctcttttcaaaattttcagtcttcttcgtttttcatgttggagagtttctattgctattctatactttgactttattgatttttttcttaggcggtgtctaatcttctatttattaagtgaattttctatattagacattgaaattttgatttccagaagtttgattgcatgttttcaaggtttctacttaacatgtttcatcttcactcttgaatctatggaatacagttttaatgtttctcatatttatatggaaaggtgtgtctatatggtgcttattaaaagtgccagttatataactttgcttccagccaagatagagtaacagacaatggatttactcttccctgcaaaaactacaataacaggcaaaatatacaaaatgacagtttgtaagatattagacctaatgcaaaaaaagtgatccgtgagagatggagaagccactaatactcttccatgtaaatataagatgctctttctaacctgctttaattttgtgcataatatataacactataactttacacatatacgttctgtgtgtgtgtgtgggagggtgtgtgtgtacttgtcaccctctgtaagaatttaaggtctgcaagatcagagttactttatttaccatatcatcgttacctagatcagatgtggcacacaaatatttgctgaaaaaatgatcccacaaactattatttttaaaccaatgaacaataattcctttaatgtgtcaaaatttaaccatttttctatttctaatcattttgactgtttacagttgtttactattaaactattaaagtctaagattaacaacttcaagggaaatctgtgtatcctcatttccttaaaaaagaactaaaaatggaaatgtttggttaaatcatatgtaaactttgaaggttttcaaaacgttctatgaaactgctctatattaagttgaacctatttaaactatattcagtagtgtgtgagagtatctttttgggggaaaaatcccccccccaaaaatcaaaatctattttttctataattaaccttcctcaggaagtgtttgaaagaatcagagataaagcaatcaccttctacctttaataatatgaatgcctgctaagccattgagagcacaaactagctgtcgatgtgcttcttcacattcagttccacatttcttctgcaaagatgtcagcagctcttccattgtcatggtgctaaaagaaaaggtagactgttcaaaactagaaagaaaatcccaagtgtgacttcagtgggagtgttatatctcacatgatcaagagtgtatgagactcgcagtttttgtggtatctctagcattttttttcgcctcaatttttaccattattttttcccacataagtacctttatttgatcacatccttctttaagtttttcccatttcagtaaagggagaatgaaactagaaaaatcttcctcaagtacaaagtacagcatgacatatttgaaacattacaggtattaacatgtaagactgactctgaatcccagcactgcaacttaattagaaaacctctttgagcctgaatatttttttaatcagtaaaaaatgaagatcctctaaggttaaatgccattccttcaaaaggctgtctaaccttaaccattcatatataaattgttttcggactctaactgtacacagcaatttgttcatatatcttttgaaatttactatgttcacttcatattttagaaatctataattttcatcatttcccttatttgtctataacctgcttaaaagcaaagacaaaactgaatcctctttctatctcttatagccaaaggccagttcctgagttgcagtctgattcacaaaaactttctgggacaatagagtattatgaacacaaatttcttaatgttctcagaatgaataatcagagagatagaaaatatttaacggtaatctaactccctgatgtgggaactatgaaataaaataagagcaaaagcctttcatatctggagtacagccaaaaccctaaataacaaaataattttaaaaaaaacctcaacaataatcctaattttaaaagaagtgttcaaggccaggtgtggtggttcatgcctgtcatcccaacagtttgagagggtgagacaggaggactgcttggggccaggtgttcaggatcagctcaggcaacatagcgaggccctgtctctacaaaaacataaaacaggccgggcgtggtggctcacgcctgtaatcccagcacgaggctgagaggggtggattacctgaggtctggagttcaagaccagcctgaccaacatgatgaaaccccgtctctactaaaaatacaaaattagccaggcttggtggcacatgtctgtaatcccaggtacttggaggggtggggcaggagaattgctggaacccaggaggcagagattgcagtgagctgagattgtgccactgcactccagcctgggcaacaagagcgaaactccatctcaaaaaataaataaaataaaataaaataaaataaaataaaataaaaagtagctggctgtagcagtgtgcacttgtagtcttagctacttgagaggctgaggcaggaggatcacttgagcccaggaatttgaggctgccactgtgagctatgatcacaccactgcactccagcctgggaaagagtgagaccccgtctcaaaacaaaaaaaaacaaacaacaacaaaaaaacaccatacccactgcaaaagagaaatgcttaaaaccatgaaaataattctggtaattctccgttgcaaatgagcttccataccaaagaaaaccctctacaccattaaagataactgacaactcagttacatgtctctgaatgaaaccgtgggcctgaaatattgtctattatgatataccaactgcaattaaaaaaaagttgataataaaaccttttttggagtggcaagaactctccacgaacagcctgtgggtgacagcaggcctgtctgagcctcagcaatggatacaggatagaggtgacagtccttctgtctaggctgctgagcttcagagcccagtcagaaatcttcctgagttttaccaccacatcctggcagcacacctcatgctgacggtgatagaaatgcctttccactggagaaaagtggagccagtgtatttcttcggtttgtggtggtatttggatctgtgaaaaggagcagaaaaaaaaaaaaagatatcatctaaaaatttatctttccatcccaattgtttcttttctcttatagtacctttatcaataaaaacttattgtactgacttggtcaatcacatctttctttgcagacctccacagtatcttggcaataaagctgtagagatgctgaggattcttcttgcagtaaggccgatagagaagtcgaacccaccagtgtttgacacagtaaggttcaataccaagaaagaccactaacccaaaaagatctgaaaagaaaaaataaaatacattgaggataactctattacttcattactagtttgcagaagcttttctacagacattacacagcacatagaactttccatgaattaaaatacaggctgtataggctcttaaatctgaaattcaattccaattccatttatacttattgagcatctattctgccctaggttttgggctaggtgctaaaataatgttagatttatgcaaccattcattacatacagcttatacttaattcaaaaatctgaaactgttatcagaagttaaaccaaaaaaccactcaactgaatgtacttggtaagacatatataagaaataccatgctctgaaaccaatagatgcaagatttgctggattggaaaaaagaatttctaagcacacagatgacatgaagaatattctctgatgcaatatttctcataccctttatctaataattctcctagaaaagaagcctaagagagtaataaaaatatagataagatttacttacacagtgatattcatagcaacaatatgtagaaaaatgactcaaataaataaattatagtaatcccacaaaatagaactatttttcttttctgattcagcatgccttgtatttgttagctttagagcatgggacttcttgtttatctctttactgggcacagtcaattttatattctattcccctccacctgcccacttaacataccctaaacagttttccatatatttatttgtgaggacttaatgaaaaactgctttggatatgaagtggaaaaaaaaaaaggaatataaaattgtgcatgcagaataagctcaaatatataaacatctatatagaaaagatcttcaaatgaagactatgagtgtaattttgtaattttctttttgtttttttgagacaaggtcttgctgttgcccaggctcgagtgcagtggcaccatcttagctcactgcagcctcaacttcctgggctcaagtgatcctacctcagcctcccaagtagctgagatcataggtgtgtgccaccatgcctggctaatttttttattttctgtagagacagggcttccctatgttgcccaggctgatcttgaactcctgggctcaagtgatcctcccacctcagcctcccaaagtgctgggattacaggtgtgagccaccatgtccgggttgtaattttctttatacttttatgtacagttcaaattttttcacaatgggcatatattctcttcagaagccataaaataataataaaaatatccttcccacacctacaacacttattctgaagatgatcaacaaatatttagattgaattaagttaccttgatggttgctgggagttagcaacatctgaaagaaccaatgcatcactgctatgcaaaggtccacagatttatatttttagctcaaatcaattcaattgctatatgttacctcttttttgaggtcccaaagccgtctcaaactcaacttgccgaaatctcaaattcataatctttttgcacacatgcttcatctttttttttttttttttttttttgagacagagtcttgctctgtcgcccaggctggagggcaacggtgcaatctcagctcactgcaacttctgcctcccaggttcaagcgattctcctgcctcagcctcccgactagctgggattacaggcgtctgccaccatgtccagctaatttttgtatttttagtagagacgaggcttcatcatgttggccaggctggtctcaaactcctgacctcagatgatccacccgcctcagcctcccaaagtgctgggattagaagtgtgagccactggcccatgcttcttttctggtagtattcactggggaaaccagtcaccattcatggatttatgcaagtcagaaatcttggtatctcctgatctgtcactgaggcttgttaattttgccttatccacttttttctgttatctttaggacaaacctagtccaaatcaaaagtgccagcaccacttgcctagattacttcttatagacaatcaattaatatcctaacatccactcttaccctcttctaagccactctccacactgcaactagagtgatcttttgaaatacaaatctaaccacaaaatgacccccaaccactgtgtttaaatcgtttcaatagctcctactactcttaagaaaaaaaataaaattctttaacaaggcaaataacatcctccatggtcccatctctacctacctagtctctctatccaccatcatctccctagctctttacattctagccacgctatttctgccacatgatctatttacattaatattttctgtttcctctacaatagaggatttttccttttcctctttacctagctcatgttaatgtttcagatcacagctcagttgtcagcatcccaattgtatgatgttatagaacaaactatttttttaatgaaacctgttatagttagaattttcctttttttcatttgtgaaagttatctcaattgcaatttaatatttatctaagtatttaagaaacattttaagaaatgtatgttctcctctaagctgtaagctcaatagataagggatcgtatgtacttttgctcatcatctgctatggtttgaatgtatcccccaaaagttcacgtgttagaagcttaaactccagtgaataatattaggaggtggggcctaattatatgtgactcagtcatgagggtggaaccctcatgagtggattaattgtcattattgcaggagcgggttagttatctcaagggttggttgttacaaagcgagtccagcccctggtgcttctctctatctcatgtactcccttccaccttccaccatgagatgatcctcgccagttgccagtgtcatgctcttagatgcgccagcctctagaattgcgagttaaacagacttcccttctttgtagttatccagtctgtggtatcctaacagcaaaaatctgactgagattctatcctacctcacaaagaaataaatcaaatacataaataataacaaatgaaataataaatgcatcacaaagtacttgttaaagtcaatactttcgaagacattaaaataaataaatgactacataaatggaaaataaaaacaacaaaaggagaagtagaggcagctatcattcattgaatatttaatatttgttaggtactgtgctaaatcctttgtatacttcatcataattcatctttaaaacaccttattttatagataagaaaaataaggacttaaatgtttaaggaatttgtttatggacatacaactaataagtccggatgtaaaccccagtttttatattccccaaagccaatgctttctatattatacaaatgaatacattatgtagacatagggtgtggcgggtggaaggagttaggaagcattcttccatatttgacatcccaagtagatgacattatttcagtctggcaatttctgaagacatttctgggtgtcagaattgtaggagtgctaccagcatctagtgggtagaagctaaacatcctaaagcatacaggacaattcccaaagaagaattatctggccccaaatgtcaatatggccaatgttgagaaaccctagtttagcacaaaaagaaaacaaatgagacttccatgtccaaatacaacagagtaagtcatgagcaggctaacattcctagtgtgacaactagaaaaaaaacatttaattgcaagaatcagaaagataccagagagatatggaagtgaggaagaaagacaaaattctagaaagtctggaaaagctcttttggagctgacttggaacacgacgaaacttgccttattgtgcacatatattcatggctacaaatacatgtcaaaacttttcaaatgtggtattttaaacatttagttatatgtcatttatatctcaatgaagtccaaatagctcattaaagttggtttttaaaaaattaggaatttgttgaatggtgacaggtgctcaaaacacttgccaacatcttgtatctccaaaaaaaccgacccaggaactaagaaattattgctcatactctctcaacattaaaatgagaaaaagtaactctgatagtcatgtactcttttctgtaccctctcagctaacttttgagctgggtaagatctcagaccttattaacgcctaaacatttacaatttcgacagtttccaaacatgaaaggagaccactaaatgtggtcctttactgaacgtaatattattctataaatatgtatctaaatgtaacatttaagtgatgcaaatatttaaatatatactagaaaatattactagaaaaccttttcctcctaaaaataatcattggaaaacactgcttttaaaggtcaaagtaatggatactgagatttttgttttagcagagtgagttatgctgctgaaaacatacgaaaacttggattttcagaaagataagttttgaagatgagtatttactacagaactccaagtatgtttaaattttgtaatttaactacactttaataacaacttttagggaaatacataaaacaagatttaaacttttcattttagatattcacaacttgaataaaggttttagaaatgcagtgtccgttctactgtgatattgaataagattaaggtagaaggatcatttcaatgcacgtgtggagaggaggaaaaaactagacacaatctaaatgctcaagtaaaggaatggtagaaacaataacggtatatacatatagtgtgacattataagactactaataacttatataattactaaaattatggccctagtattcctgggttcacacaataaaaattatagtctccattttcatagacacagttaattgaaattaattccctttctctctttttctgcctctccccaccccccccaccctttgtttctttttgggttagattctttgttttctacctatgactttggaactctaattttaattcagacctatatctatgctgtttaggcaggtacaataattgttcaacttaaggcaatgagacctcttaatatatatcggtcctcatatacataaacagaaaaatcacctgagtcccatttaaaaagataaatgcttgaaactattaggagtcaactataaagacatgaatcatcacttcaatagggactgcagcaaaggttaagcataacaatacttttctctctaaaaaatgaagcttttcaaatgcatgcaatatgtgaggaaaccatacattaccctctaatcctctctgtactggagtgccactgatacaccatcgattaatcccactcaaacgctgggccatttctgcagcctgatgagagggaaaaatgaaataaaaatgaaatccagaaaaccacagaaagaacacagaagtcaggcatactcatgaaaaacagcccattaaaagctacacttctggtgagatgtacctacttttatttaacagttatcacactcaatgttgaatgtcatattcaatggaccatcttccagtacagtggttctcattagtgggaggctgccacgcagtcccctaaaacagaggggtagttcaaatacgtacaaaatgaaaaagccccctgaataactgatccatgccctgcatcactctatcctccagatatactaacagacatgattcatacattcagttcaggttacagactggccaaagacaacagaataaagacatatgacattcaaaggctgaatcaaaattctgtcctctaaagtagtattttctgttaccatttggcctctgatttaaaagactgtcaaagtcaactttggttcaaagctatcagaggctacacgatgagctcccagttagcagaaatgcttacagaagttcctaaacacagtttactttgatctgcatcatatataaacagacatcttactgaaaaatatatatttcatatagagcaatgagtcacagagtacagaactaatttcaaagggttatgtagttcaaagcacaagagaaaagcacaagtagtgtttaataacaaacttttgaccaatatcagtactacaggttaactatgcttaaactattaaactactcaaggtcccctaattccttttcacccttcttccccagccctcaaaagattttgcagaaactctcacttttactgtgggacactcaaccatctgagcttcatcaaggcagatcctccaccactccacagctaccagggggctcgggatagccatatagcgcttctggttccgtaggcgacgcccatcctcactattgctatgtgggatatcgacataatttaattctgaacgcagtacatcataggtaatgataactatatcctgttctgccaaaaaatgaggttgtaaaaagccatctttcttcactccttgatatacctaggaaataatcaatacaggcagttattgcaaaaaggctcactaaaggcaatgaaatattcactcatttatacccttactaagtcctctctattttcttaggagcattcatgctatgagacagatcccatacctgtttggagaaagacatgttttagtgtggaagatgaattacataactgatgtgcaacaaactgtaataaatgtgaacatgacagcatcacagtggaaagaccaattctgtagcggagaaggtaaaatcacagaggagttaaaacctgaggtatatcttaaaggttctcataggtggcaaaaagagaaaagggctatatgtaggtaggaggatggaatcaatagcatatgtgaaagcacaatggtatgaaaaagtagaacaataagagctattatttatgaaatgccttttatgtttcagatactgtgctaagcattatctccaaacttcaacaataattctgttggtggttgttaatattcctatcccacacataagaaaaataaagtgacttgctcaaaactgatggaactaagactcaaagctttgcctacccacacagaatagagcttcttaacagcaaaaattgttttgcttattacagtattctccatgcctatgtaaagtggatgaaatacaaaaaccttcagtaacacttgcatggaaagaaggaagaatgaaattagtgaagggtattaatattaggaaacaataacattactatgtgcccagtacttgacaaaatcatatcttcacaaatgactggatactatttttaaaactcagcagttcctggcacataataagtggtcaataaagatttgctgtataagtaaattcttattttacagctgaggtaactgaagctttagaggatgattttggagctaagagatggcagatcagataagtagctcctattacacagtgctgcctttggattgcatttctctctgaagactataaatgcttataccaagaatttctcatttacatactcaagaatttttaaaaagcttccacatctttatactcaaaatgctttaattggtgaaattctgatgttagaaaagaataacattgtactgttctagttcttagtctcaatttttttctttaagctttgatttaacattactattaaatcattcagttagttttgaggataaaccacaaagaaacaaagattaggaaactatcatgaagaagcaaaactttacattttcctctccctctttagtccaagtggccttaccaagactcgaagagatgacgacctcacatgcctgttgatctcatccacccactggtgacagatggaacttggagagatgatcagagttgctcttgttgacactggttccattgcaacaaggcagtgggggcagtaaaaaggcttgatcttcagatttttctcatcataattcacacactttgcatgttgccacaggtgacacttcaggcattgaacacgaggcttacgatctatctgatcaagttcaccacatatacactcaaagcggtaatcagaggtgttaaagggactcatggtattagaaggtggtacatcactatcagcatgatttagagattcagcacagtcctctgtttcatgttcttggttgaattcagagatacatgtacttttagacatagcaacatcagttattccagagtcgctagtagctggacagtgaccttgtgaatcgggattgataaatggttgactttttcctttttttgtggatggaacaagctttttcctcaatttactgcgatttctcctggacttataataataatagtaaggatcatcatcatcatcagaggtgtctgatggcaagtattcagaatctgtgtccttgttccctgattttctagtttctttctgaattttccttggactccctactgcctatgaaaaaaatatttaattaattgattgcaactagttgcatttctgaaattaaactcctgactttatgtaagtacttcatataattatgtagcagccagtctttgctacccttttccctgaggagaatcactcctgataagtggcttccaatctgccctctgtaaggaccctcacttcatctcaaaacaaaaggaaggctctacaagtgtcagatttggagagatgaaaaattagaaagataaaggaagctactgatattttgttatttacctactatgatttagtctacctaaatcaatacaagactagtacttttcgagtacataaatatacaaatcagggcaactacaaaaacaccaagtactaaaatatagcatccaaagaaagtaaaagataatccactggttactgcaattagcaaattgattccttctttccttcccttttctacatatgtcctctcttacaattacttattaaatgccaattctgtgccagtagttgtgttagatgctagggacacaaatatgaacaatatttggcccccggtttcaaaggggtctactggaaaagtgagaacagtaaaaagtaaaatgatgctatgggaatacctaagagggttgtacaacatagtgggagtatgataggcaggtagttaatagggacagcttcctccaaggcatatcagggctgaggtcgaacaggggagttaagacacaacatgtaatcaatggcattaactgagggaaatcttctagttttggtggtagcaggattaccaaaagcacagttcactgctgtcttcagtgctacccaaggataatatagactccctactccagaaaataaattttttgtctttttcttggtggccgagctggtagctccacattttgacttgttgtcattaatctttatttatgattgcaaatattataactattttcctaaaagcaaattgaaattactggcccaacagaagcagttttctaacaaaatgcagaaattgtataagataataatataaagaaaatgagaatttagaagttccagacctgcctgggcaacatagtgagaaccccgtctctacaaaaaaacaagaaaaattaaccaggcatggtgacatgagcctgtactcacaactacttgggaagctaaggcaagatgacagcttggcacaggagttcaaggctgcagctagctatgaccactgcattctagccagggcaatagatgccctgtgtcttaaaaaaataataaaaataaataatacagaagatgctttatactctataatacgcttagccaactagttttttaattcactcaataaatatctgagtatttgttacgtgccaagcattattctctaggtttaatgatagccaaagtaaagttactctcacggagtttatatccacaaagtagaaagtagaagttacagatataagtacttttcctatttttttatcttcagatcgtaagagtttcagtttcaaggtgggatctgtcaatgtactcagtaaggtatcacatacgtgtacttaatatagagctgaacttaagctctgttacctgcttttttgttttatcacatatatcctcttccttgtaattctttcccaatgtaaaagtcccagaaaaaccatggcctttgatctgtttcacgagaccttcaaaaattaaacatttcagcatccgtttcaaaagactcctgttccgttgaacatcgtatctatatatagaactgacatacttatagatggaaaggatggacactcctttttttccattcatttctttcacagctgtcagtatcatcacacgtgtagctaaatgtaaaaggatatgctaaatcagtcaaaataattaaaatgaaaagaaagtaaaacttggttaatcttaatctgcatgaggactgagttaagaaagaaataaatcaaagatttattacagcagagtgccattttgaaaaaatatgtaataaaaatgtatctcagcatattaagaaacaaattactgtaataaaaataatcaaaggaagaattactcatattgaattgttaatactataaaacaatcattcaaaattataaaagaaaactctcacaattatttaagtatacgctaccattagtatgcgaaacattcatttcctaaaagataaataaagcctggtttaaactgtaagctaaagagatttaaatataacagactgagcaagaactacctgggccaagtcaaacaaaataatacatctttacttttgttaagatattatgacttgtaattgaattcatttatcaaaagcatatataactgtaaaaacaattgtttataacaattacaagatatctctaaggattgcaagaactctagcaaagatcactataagaaggtatttcctttaagagatgtcttacttacgagggcattgaactttttcttttggttcaaattcgatattctggatttctgtctttttcagttttcctccaaaataatgtgacggaataaaataattcaccacttttccctgatacaaacaacagtcagtagttacacagtgttttgctttcagtattctgaattgcttattgaaattaactttccttctttatggaaatgcaaaacagttctaaaaaaattgcaagagaaagggccaaatagctgtagatacatacacagttttatttctgagtttacagctagctatcacttaaaaaattgtgcatattatcttaaattacctaaatgttatgtgtggaacctctgaaattaacttttaaaggtatatttaaatataaaattaacccattgaatttataataatatgaaaataacttggaattaaaatagtaatgagtaggaaatctcagaaagaagttactgatagttaagtcaatatattccaagtcatttgtctacaaaaaaaacattttttttttaaattttctactcaaatctgaaaggctaattctgcaaacttgaccctactgaaagataacataatgctaaagctgtgagactggtgggtcctagaggtaattaattataattatacctttaactactgacttcatttcagcaagatttaatgtaagggctgatttcagatttcattactagaaaatatgagctatatactatatttgccttagtggactttgtttctgtaactctaaaatttatatttttaaacacaattatgtattttgggacaaggacttgaagtttgtttcatttagcaatctatttactaagctacttgttctttaacaaagttctaattatttggttctaagatttatatatatgagatttgtataacatttttaaatagctcttaaaaatatttagtagtaatatggagactttattagtgacaaaacatttgaggagtcaacagtacttttgtaaaggagtttctctgccaactagaagaaagttcagtaagtgatcacaaattctcttcctagttggccaacattacttcaaaaataaaccttctgggtcacaaacaccccattctctctgcccacttgaagttaactaaccactaatataaatcattacccacagagtgaacagaaagtgttgacttaagtgccaagcaaatgttcaacatacgatgcttttcgagaacatatgtcccctgcttttgcaagccctactataccctcctacctcgggaagagtgagagcatcttgcttgacatcttgtcgagtatgtgtcagaatcagagccaaaacctccactgtctttccaagacccatctcatctgctaaaattccaccaagcaactgcggcccagaatttgggtactcacgaatgatgctgaggaaaaaaacaagataaatcacatcataggaatgtgaatacaaattacaatgttcctaattacttttcctaaagagaactggaagcaatgcataaagtctaagtttattgaaactatattttagggcaaaacaattcaaaccttagattacaaacattagaactgtgataaccaaaaaaactgcctgagctgacaagtaactctgcagaaatgagtggtagttaaaagagaacacgtctgccttctttctatgacctttatgaatctatgaataaaaaaaaatacaaagggcaataactactattcattcatgatgtttaatgattactaagaaaaaataaaactgaccccataataaacaagataacatttttactttaaataataatctcttttagtcttgataactaagcaccttatgtctattattccaaattcatttactgaaaaatgacaagtgctattaattctaaatctatcctatccatagatatgtctaatcaagacttcacctttgattccttcatgaggtagagtcaaagttacagatatgctaacaatctcagacagtttttcattatatttattttttaaatcaagcatataagtaaaattttgccttaccagcctgtatatggattatagtagagtttcagaccctcagatgtaacaatctctcgccataagaagtgcagggcactttctaaagaaaaatataatcataataacaaatttttgttttcccttcagtcagataatcacattaaaaaaagaataggttaacagtgaggatactctggcatagtgatacccatattcttgtgaaatctcattctggaaaagccacatacttaacacatgagtaaaaagctaaaagtccctctatttcctttcttctgatattactctttagctccctttgttttgggcacaaatccacatcagcaaataataggacagataagcaaagtgtggcagattacagagaattaacaggaaaactaatacatataaccagctcctacctgatgaatgagtctatttttaataaatcttgcaataaattatatgaagtctttgaataactcaatagacatatgctaggtggctaaatacatttacccgaatcagacctgacctcttctacgggtctgagagtgggaagaaaggcttacttaactgggaaaaaaatatctaaaaccataactcagaagtgctgagtttgtttctaccagaatcttccactagccttctccttaatattttaacttatttaaaccaactgccaaataagtagcatgtctctacccaccaatgaaacagcaagtaatttttaattggcttctttagagattaatagatattttatatttttatattctagaataaaatggccattaaaaattcaaaaaactatggatgttggcacgaagccagtaaaaagggaatgcttttacacggctgatgggaatgcaaattagtacaatctctatggaaaacagtatggagatttctcaaagaactaaaagtagatctatcattcactccagaacactactgggtatctacccaaagtgaaacaagtcattatatcaaaaagtcacccatgcttacatgtttattgaagtacaaattcacaattgcaaagatatgaaatcaacttaagtgcccatcaaccaatgagtggataaagaaaatgtgtgtggaggggggcaggtgtgtatacacaccatggaaaccatggaatactatacagccacaaaaaagaatgaaataatgtcttttgcagcaacttgcatgaaaatggaggccattatcccaagtgaagtaactctggaacagaaaaacaaataccacatgttcttacttacaagtgtgagctaagctataagtacatgggggcatacagaatagtataacggatactggaaactcagaagggaagtgagggatgaaaaattacatagtgggtacgatatacactattcaggtgatgggtatactaaaagcccagacttcaccactatgcaattcatccatgtaaccaaaaaccacttttacccccacaaagttattgaaaaaagacagcaataaagaagtggcataaatgcctcccgtaaaactactactttcataaaaatactcaacagatgacattttattactgtaaagaaaaaaatgcaaagtctaggaaaattcatcacacataagtctcctacttttgtaaatttgctttctgtcaccaacattcaccattacattgtgagtttcttgcagatggtcagtaagattcccactggaccagattctaaagagcaattctttgtttgaaaggaatgtaaaaaaaatttcttggtttttaaaaattccaattgaggcaggattgatttccttttggcaagaaaaaccagtacaaacttttatgaatgaagaaactcacaaattcatttttctagatttcaattttaaagaatttcttagaaaataattttatggcacccattctatcttatattttcaggatgtttattttaatgatcaatttcaccctgccctaattgtctctgatgtaatctctctaatcaattggactttctttaaacatcttattcttaccagtagcaggactgcttctgaaacactcttgttgtagcatccaattgacagcctctctttggtagggtctcaacacagggatcaatgcaggatgctggacatccacttggatggactgcgtttcttgctgatgtgtttgtttcacaaagtgatacagctcgtcaatgtcttgtccctctggctcactctccggatcatcttcatcctcttccaacacatctgtacatcacacagcaaatgtactcaaaaactgataggttttttctaactataagcaattcttattctaagagcatacaatgaacttgcccaactctggggccttgctcagtgtgttttgtcactgaaaggccctatctttaattcttcattaatcaaaaatctactcatccattcttcaagaaagtttaactgatactttttccatggcattttcttttgttttccctggctggaattatgttctcctctgtggatacagtattattacattgtaatctatctggtactgcaaacatttatgtccactggtcctttccccagggtaacaaaggcaaagtttttcatttttgtagcccctcagagaagctgacacgtagctgacacgtgtattgtctattgtggatgttttataaacatttgaggaactcaatgtgaatactgtttgaagtttatataggaacaacttactttacttttgtaattttaacatacaaaatccatatggagacataactgttctatgcccaataagaaatgggttctcattttatttcttatgctagaaaaggataggcatttggtagcagtagcagccaactggaagacaagtgattatgttattaatgcaaatttgtaaaaacactaagttcacttggtgggcacaattgttctgtggaagaagatttatacttactataacatgaaaaaagtaataaaaaccttgaacatatttacaaactcctttcagctaatggttctttattaaaaacataattctttcaaggtgaaaaagtatatcatttatttctgaattgctttgaaagaggcctatatacttttataggacatacctcataacttctaaaactaaaagatgacaccaaaaaattcacaacttatttttttccaataaatatgccatgtaaaatttccaaaacttcacaattaatgtacagctttatgctcagttgttttagacttttactataattatataatctaagattaatagctaaatttgaagttttccttagataccaggctttaaaatgaacaaattgtaatatttttaaaaggccataagtttaaaaactctagatgtacttaaattcattccttctaatcccgaaaccagagatttcctaatttaaagtatctaacttgcaaaacgatttactattactgatattataaagcattgcaaagaatgtactagagaaataacaatcgaagttagaaactgattttcaaatactccagtatgacaatgttctataatttgcacctgaaataatgctgacccaccatgagcagaacttggagaatttgggctgtttttccagtagtgttgatgagctgcaccaagccatccacactctcccaaggtgaccaatggcagacaactctgaatctgcagtcctgaccaaagatgcaacgtcttgccaagaaacagagcaaagttatctggtctttatgggaaccaggcttttgaaattatttgtcagactgcaaaggagaggtggaataaacgccagccaagaatttctggcccatgacaaaataaaagcacaggaataatgcaaaaatcccaaccagctcagatccctttagactctgccttttgacttgcatattgactccgcaaatatttctttaatatttaatataaggtaagcacagagttaaccaaagaaacaaattatattagtgggtgcatttcaaataagtataatttgccatataatcatttaatttttattatggctttattagctgtttttctgattgttatgtccaggggttagaggaaaaaactcacaactcctaagtaatagcaatttttaagtttactgtaaatattacctggaataatagaattgtgtaacttttccattactttcttcatgagctgattgaactttttcattcttgaatttgcatcactcaagaagtctagttttgctaggccagcttccaaaagataaattccaacctaaaaacaattaatcaaaataaaagtagtttcatttgaaatataccattctttatgaggacataagcaagaaaaaattagcatcactacttttaaaggtattcatagcatgtgtgacacaaacaataaatacatgcctaccaaatttcccccacgtgtttcattttcactaacaaattataaatgtaagtgcctacaatgtacaattcgagttgctggaaaaaaatattcccctaactgaaatcgaacctgggagaatgtgataagaacacctagttctatctaccaatgcaatgattcccaaaactgatgaattaatcagtcaagtttgttaaaaatgccgatttccccagaagattatgacatacatgctaggaatcttctgcacagttaggtttgggcatcctcattactgaatcaaacactaaaacgtgtaaaaaaacagaccttgattaatgttaatattttgaccctagtgaagcaatgtggtatgaagttttacagttgaaagacttgattttgaatactggcattgatatttggaagctaaatgaatttgagaaaaataacctattgattttgacctaagtgttctcatttacaaaatggagagaagtccatcttaaataatataactataaaagtttctaatggtagacactcaataaatgttaattccctttacttcatgttgactatgttgtacctgactccctaatcactgagaatctcatattctttcactacagaacaggaatccaccagccttacacagaaatgaatgacaaagagtgtatttcattactgctagtattctgtcttggctcgcttggtgatgtcttactacagcagcaataaatgtttaaatatttgtaaaattcaggatcaggaaaaacagaatagattaacacttggtctgtagggaacgtagatagaacacagatatgtgagtcataaattgttacatacttgttatcactgagccacaattttggcaaaatcagtaaagagagggaatgtttgattacatagtttcactgtacagggaaaaattaattggagtctaataattctaaatgttctcctttccttctgacaattctaaaactataactaaggttatcgatgcaagaaatatatgagacagttttcagttaaacaacatgaaattaacattttaaattttcaggtttagcataaaagcatattaacttgcttcacagtttacaaagtatactttcttacattatctggcctgattttcaacacaattctatgctgtaagaagaatgggtattatttacatttcataaagaaactgaaattagagcatttaaatgattcacataaagttatttggccagtgaatgacagagactgaaataaattacaaatttattcattcatctactgaaaatttaggtaccaggtactttactaggctgtaaagatgaaaggcttcatagtttagcagaggggaatgatctaaaatgttaagtatgtgacaagccgccaaggccaaaaaaaaaaatctaccagagattctgaggagagggcacataatactaccaatagatttaagaaacgatctccctgggtgaattaaatgctatactaaatattaaagaataaccaggaattaccagggaaggggaagggaacaactcaagcagaaggaactataagaacaaaagcaaagacgcagaaagtcagtgtggtatatggagaaaataaatcaatttggagtttctgggacaaaataaaaagcagagtaataaagggtaaggctcaagggcttgtcaagggaggaacttgtgtgccagattagaaagattatacttaattctgtaggcagtaatgggtagaatttcatttgcattcaatcatacaattccagagacaaaatcgaagcatttgaaaaggcaaaatagcaaacagataaatggttaaatgactgctgcagtaagaggaactgatgatgaggaccaaaacaagtcactgaaagtagagatggaagatcttgaaaaagtgtagcctgaaaatgattagttgtaacatactttgaatagttattaaaagcttaaagtgtactttgaaacttaacaatgaaaggcttattgctggcttttcagacttctctcacaagttaatttaaaattggactgccaatgtagaagagcctcaaaaaagacaccacaaaaaactgagtaccttgataatgtgatttccttctggtttctgatagagttttattcttctcttcttttgtagccaccccaaatcttctaacatttcaccactgaaggatgactccaccagaatacccttgtcacaaatactcatcggttcttttttttgtttctctacatcttcaccttttgaatgaacataaatcaggaactgattgcttgactctgaactcatcaatgtaatactcctttcggaaaaattttcaattaaactctgtgcaggaagaagctgaagagttaattctcctagaaatgctttccaggaattatcaaaatgatagggagaaatcacaatatttaactttacagacaaaggggaaaaaataccaacagtctcttctttttcaattggttttgagaagctcaccacttttgaacacctcttcttatctctgtgagccacttcttcctttagactatcacttagaatgatataatgagcagaagaggtatctgaacctgggcagggctgctcgtcatcatcacttatgatgataggttcattccttctgtcctcatgcatattccaatgaagctgctgcctcttttcctcatctaccctcactggaggagcacgtttccgtcggctgctcattttcaagttttcttggctggtaactgtgaactctagaggacaaatgaaacaacaggaggtataacaagagatgatttagtatttaagggttaccagatgagaaattcagcataaattcatagcccataaacataatatgaaatcttctgtgagatataaggcaatgagtaatttttttaccaggtcattatgactaaggaatgaacatattaaccataatctcatttatcaaataaattctaatggttttgctagtctttaatagtaaaggcaatttgttgtataaaataaaataaattgtagaaatacatttaataagcaatataataggaaggtaaatctctcaatcccaagtaatttaactgcccctcagaacaaagcccaacaatacttaaaagagcgaaacaaaatccaacacaaatgtctggcatcaaatctaaaattatcaggcacgcaaaaaaaatgaaaataaaacagaaaaataagacccattacaagaaaaaaatcaaaaagccccagaaaagacacagatgatataattagcagaaacaaacattcaaacagctactgtaaatattctcaatatgttaaaggtagaggaaaacatgaatatgacaaagaaaaatgatagatatacaagtgactcctatagaatttatgcagatggaaatgcaacatctaaaacgaaaaacacattgtatgagattaccagcagattagaaatggcaaagaaaaaaagaagcagaataagcttaaacaatggaaacaacagtaacaacagaaactgtcaaaaatgaagtagagataaacaaagactgaaaaaacaataaatagaacatcagaaacctactagacaatgttaaggagtcaaacatgcataaaactggaatctcagcagcaaagaatggaaaggatacaaaaaactttttgaaaaaatcatgcatgaaaattttccaacttctataaaaaccatcaactcagaaaaccaagaagctcaatgaaacccaatcagggcaaacataaagaacaatcacaataaggtatgccataattaaattactgaaaagtgaggacttctctccagattggccctatttctctggtttagacactgctcccaccccacagctctaaacccagcaaaatatctttcaaaaatgaaggtgaaaaaaagatcaacaaaagccaaaaggacttatcacctgtatacctacaatctaagtaatgtaagaagcgcttgggtagaagaaatatgacatcagatggaaatctggatccacacacaaggaaataaaaagcaaaaacaaaaaatatgtgtataaatatagtaaacttttttcttgatttttaaatttctgtaaaagataacttactatactttcattctgaaaattttcaagcatacataaaaatttagaaaatagtataacagtataatcagagatctatacagtgtactatgttcatggactagaagactcaaaatgttcagatgtcaatttcttagtactgacctatagaaaagcaatcccattcaaaattccaacaggtttgttctgtagaaactgacaacctgatgttaaaatttatactaaaatgcctacaatacaggaaagtcaatataattttagaaaagaaaaataaagttgaatgacttacactgattccaagacatatgtcaaaagaaataaaaatggtgcagtagtggtgtaaagaccaacatatagatcaagggaaatgtcctgtagtggacccacacatggatggtcaattgatttttgaaagaagttcagaggcagtcaatgggaaaggtatccttttagtaaatggataccaatatgcaatgaaatgaagctttacctcctaaaatgtaagaattaactaaaaatagataataaactataaaagctaaaactaaaacttctcaaagaaaacagaggagaaaacctaaatgacattggattagcccaaaaaaaaggcacaaaaatttttaagcaggaaacaaaaaccatagactatgtaagaatatgataaactaagtttcatcaaaattaaatattttggttcttcaaaagatactgtcatcaaaatatgacagcaagtcacagatgggagaaaatattagcaaatcaagtatctgatgaaggatatgtttgcagaatatataaagaactctcacaaattaatagtaagacaaacatttaaaaaagtcaaaaattttgaatagacatttcaccaaagatgacctataagtgtaaaataagcatatgaaaatattttcaccagcatcagtcattaaagcaatacaaattcaacccacaaatcacaatgagatgccactattcatatactaaaatagtcaaaaatttaaaacactgagagtatggctcaaacagaactgaactctccaacatttgaacacagcacagtcactttggaaaagtatcagtttctaataaaattgaatataacttactatgcagcctagtaatccctctcttaggtatttatccaagagaaatcaaaacataaatccacaaaaatttaaacttgaatgttaacagctttactattaaaagccccaaactggaagaaaacccaaatgtccatcaactggtgaatggacaaattgtggcatagtcacacaatggaatactattctgtgataaaaagagacttctgtaaaataacctgaatgaactgttaaagcattatgctaaactgaagaaagctagatgtgaaagactatatactatatgattccatttacatgaaattctagaaatggcaaaaacctgattgcagaaagtagatgagtggttaccaggggcaaggaagtataaagaggtgactgacagtaaaggagcaggaaggcaggctttggggtgacataaatgttcaacacatgattgcagagtatacatctgtcaaaactcatcaaattatatactttaaattgaattttcttatacataaattatatcataaagttgatttaaagagcaaaaacaaaaagatgcacgagatttagaaattttaatattaagtataactttattcaataaatctgaaaaatctagataaaatgataaattataaagtgataaaattttgctaacaaaatacaaatgaacaaaactggcccaagaaggaaaatatgaatagaccaataaccataaaagaaactaaagtgacattatttacctgcctaaggtctatcctccttccctgatgactgaacctttatttaggaacaaggtggccctatgattcaaaggaagtgatttccttggcacctccaaggaagtagtttctagctactattggccaaagcaaatccaataaggtagttattggctgcatgtgactacttaactttcaatacagttatgcattgtataatgacattttggtcaatgagggaccaaatattacagtggttccataagggagctgaaaaattcctatggactagtgacatcatagccattgtaacatcataatgcatttatttatttatttatttattgagatagagactcactctgttgcccagctggagtgcagtggcgtgatctctgctcactgcaagctccacctcctgggttcatgccattctcctgcctcagcctcctgagtagctgggactacaggcgcctgccactatgcccagctaactttttttttgtatttttagtagagacggggtttcatgtgttagccaggatggttttgaactcctgaactcaagatctgcatgcctcagcctcccaaagtgctgggactacaggcgtgagccaccgcgcctagccgcattactttattttttaataaactttgtgtagcataagtgtacagtgtttacaaagtctacagaagtgtacagtaatgtcccaggccttcacattcactccctgactaacccagagcaaccttcagtgttataagctgcattcatgctaagtaccccacaaaggtgtactattttttatcttttataccatatctttattgtacattttctatatttaaatatgtttaaatatacaaatactacggtgtgacaactgcctacagtatccagtaccgaatatactgtacaggtttgtagcctaggagcagcaggctgtaccatagagcctaggtgtgtagtaggctggcggtaccacctaggtttgtgtaagtatactcttaagatgttcacacaacaaacttgcctatgatgcattcctcaaaacacagccccatcattaagtgatgcatgactataaataaaattaaatgttataaactcagctcttcagtctcactagccccatgtgctcagtagcgctatgtgactagtggctactgtactggacagcacaaatatagagcattcacataattgcaaaaagtctatgtatcagacagtgcttgtttaagtcaatcatgagaattctattcccttagcccgtgcttcacttatgaatgtgcaggtgatggattaaaatcaatccttggctatggtcaactacttttaaagcatcttatcctctcttatcttagtggaataatatagaaagctcttaatttcctaagtgtttatgtttgtccagttttcctcaaagcataagctggaatactgaaagtgggtcactctgcaggaactttaaaaagttatgctatagtagcttatcagttaactactgccacaaacatgctgtgtaacacactacctcaaagctcaataccttgatatagcaatcatttattctcatagatctgcacattagctgaaggaggctaatctaggctaggtttctggaaaagcagtttggctctgcttaatgtagttcctatcccctctccttggatcagcaaagtaactcaggaatgttctttatggcaatggttgaggtgtattactgcaaatccaatcacacaagtagttttcaaagtgcttaaaaaccactaaggtgccacagaccaaagcaagacatatccatggacccaatgtcaagtggtgaagaaatatactacacctctttactaggtgaaactgcacatggcaaagagcatggatatggggggtggaagggtagagggagtgttggaagggaattgggccagttacacaatgtatcacactaaccataataatattaataacatggttattgtggaatcattaactctgaaaacccaaaaagcaactgtctagcagagtctcacattagcaaagcgatgtggcttaaaggtgagaatgcaatgctttgaagtcttatattcattctaattccagctttggcatttactgactgtgtggcattggaatagttatccagtcttctgtgccaattttctcatctctaaaatggggatgatagcaggattgtggttagaaataatttaagtacaacagcagtactagaaatttggcctgtattccataaatggtagttgctacttatcatcatcctgagaacactctaaaccagcagttcccaacctttttggtaccataaatgggtttcatggaagacaagttttccatggaccggaggagaggggtggagtggagagggggttgtttagggatgaaactattccaccttagatcatcaggcattaggttttaataagaagtgcacaacctagatcctgcgcatatgcagttcacgatagcattcatgctcttatggtaatctactgactgttgatctgacaggaggcacagctcaggtggtaatgctcgcttgcccgcaactcacctcctgcaatgcagcccggttctaacaggccacggactggcaccggtccatggcctgaggggtggggacccctgctctaaaccacatttcacaataaccaaactgtaatgtcgcaggatgggggaccacagattagtgcttctcaaacttgactgcacattagaatcaccaggggaacttaaaaaaatcctgatgtcgagccaactaagtcagaatgtcttggagaagggcccaggcactactccctttattttttagaatccctaaaaaattccagggtgcagccaagttcaaaaaaccttgttatggataaccagctgccaactaaaatccacttatttccactcaaagtatagagtagttgagaaatgactgcccagcttggtttggtcctgtgaccagtcctagccaatggaatgtgagaagtaatatgtgccatgtttcccacaataattttgtaacagacatattaccaaaccagaaaacattacttcaactatttattctgttctctggtaaaacctatccagtatcttttaaattatgtacaccattataatttgcacattccttcagatgtattctttcagcctgattcttccaatattagtgcctcaaggtacttatcagtgataatgataaactgcagaaaagtcaacaccagaatttctagcaatgctctccctttgtccagttcttaactgagtaaacattcatgatcaaaaatcaaccaaccaaacaaaaagctcctggttttgactgagtctttacttaaggaaatctctattcagggttaacttcttgaaccaaagaaaatagtatttggtcaaatatacttatgactaaaatgcaatttggcaactagtaagtcaagtactggtgaaattctgtatctaaccacatcccatattcttctggttttattcataccttatcagtcacaactacttcttcctcctccttaattagcagtgtttgggtaaaacgtaattatgtgaagttttctatatggaccgcacttttactgtcttgtatttaaatataaaagccttttgcttgaattgcttttatgcctgtctccatcccaatcttccctggaaaggcttccatgactagagaagctgagttaagggcctctctctcctcgatcccaactgctagagtgttcactttgaaagatgggcaggagtagtatcctattcagtgttgtactcccaatgccaggtcagtgctaggaagtaaagacatacaaaaagggtgaaacaaagatctctaattccgtggatgtattccctccttttgaggacctaacgatactttactcttatttctttttggagaagtctctcttatccacattctagaagactataggtaatatgaaactagtatttctgagaaaaatgaaatactagaacgaggcagggaaaactgcctgaactgtatctttaacagaaaacaaggatggaatgctagaaaaataaacataaaatgttacattactaagacaatccaacaaatgaataacacaacttaaattcacattttttccctccaaaatattatttcctctttaaaagatacacacaaatcttgaattacaacaaatccatggtagatctgggtttaggctattaagggcaaaaaggattacatacttgccatattcctgtccaaaatgttgtgttatggaaatgaagcccactcattactaagtactaggaagctcttaatgacccagggttaacataatcttttccttttctgtagaaataattccagcaaggtgagagtattttcttctactgaatgctaaaatatgctagttacataaactttaaaaatgccctcataagaagctttttcaccagcaaattgtttcccctaaatcttactggcctaaactcttaataataaaagttttgttttaataattctgtaagtccagctcctttcgggtggacaaagaggatatacaagagcatctctcaaaagtaaactattttattctcaattgccagcttactggttaactggtcctttaaagctctagaaagtgcaggttatcgagcacagacataatcattacaatactgctcaggactgctctgtctccagcatgtttactaatcataaactaaatagtcttttttgtgacagtagagatatcatggatcgtttctattcaagagtttcatcattcctactaatgcccactggaataatttaaagtaacagtaataactttatcttattttgttcagaaaaagccccaagttccttaagttccttaagtacaagttggaaggcatcaaacatctcggatttctacctcgtgctaatgtcaaactacttggaaaaagggcacaagcttcctggtcattatttaactgatcattatacagtgactattaatcatcaaataacaccctatcttcgttcataaacatagcaactaccagtcaaactgtacaatgtcaaagagtggttctgaattcgaatgtaattaatctggctccaaaggtaacggagaactttgagtgggactgagaaacctctgcctccccttttactaatacaatgccgcgcacaaagaagggaggcggcgacccagttccagcctccgggggtagatctgcggcgcacggtacccactcagttatcttccgaaagacccacaagcggctcccggagtctgagcggggctgtcagcgccggatcgctcccagcaggccgagcaaacaagcgaccgcgaggccaaggagcgtgacgacggactcccggatcctagtgtgttggacgctcgagacaaacaccgcaggccccagtgcatgaggagaagcacagcctcctttcccacgaccccactttatccccggagggacgtggtggtccgaagttcgctagtccgggatcgggaagaggtggggaagactcgcgcagcggctccctctcagcccttgagcttcccgggctccaggacaaccagcgtcctccctccctggtcccggaggccaaagaccacctccctccctccctcccgacctctgacccctgaccttccatcacccaagcgcctacccaagctggttctccgagcctcttgagtctgtttgcaccaggcctgcgctcctctacagacccagcagatcacgggcacgcattcgccacccaccgaacatgggcttgaggtgggcacgagcgctttttgccggaacgtgtaggggtcccccgggagacccagaaaccacagcgcctagctgccgggcgcgcgctgtagcgtggggtcaaggcgaacgcgctcgtcagagcaccccgccccctttctcctgcgctggcttcatgagtctcttctgcgcaa

SEQ ID NO: 164 - DNA, 56491 bp, Homo Sapiens
cacaattaatgaaggattttatttgaagataaagtcaaaattatggcaccgaggaaggtaataaacatttgaaatttttattgatttttaaatttaaaatccagttttaaccacaaaattgtttgaatcacaagtggtaatacaatgtcttcaatatttttctaaagttatttttctatataataataagacaacagcatagcatataggaagttttcattccagtggcttttttatatatttatccttcttaggaaggacaaattaaattttttaaattaaacttttaaaatataacaacatctaacagaactgtacaaaacaaagagacattttttaaacaacttgccaaacttacttatgagtgtgttttaaaaacaactttgtaaatgtctgggcaaagaagcaagctgtcctccctttaccttcatagtgagtttgtaaggctttgtctttgtaagcagaaagagtagactgtgttgttttttgccaaaaactgtttatacttaatctcactgaagtattgctatatggagaacccatactctgatcaacttgattttttgtgtgtaatgcttgatctaccaggtaacttcccaactgctcctaatgctagcgggctaatcccacattattattccactatcatccctgcagaaaggtcttggttttgatgaaaatcagccctttccttacctgctactgcctcaaaaagggaccaggaagattctagctggctaattcactgttccctttgagcaagaaaacggcacagggagaaaaggacttatctggtgagagatttggcatataccttcaatgtgtgccctataacacaacattgtctccgatctcatctttctatcaaatgacttccaacactcttaagtctcaggtattcttaaatctgtatcatcaaacatgaagcttctcttgtttgttagagtaattaatctttctttggattaaagtttccctttgaaataaaaccacctacctaatctgactgctaaatttctagcttctttgttttaaatatgctcaggagtcaacccaaattctgcagcaaataagtttgcttattaacaaaaaagtaaaaaaaaaagaaaagaaaaaagatgactaattctacagatagctgtaaggatgaattactcaagttcaaaatcaaattctgattctaaacacataacaattgtttacattcaggattaagatgtctttaagagttgaaacgactttggagatcatccagcccaacttccatccagatatcacgcctctcacatatagtagtcttctgaattataaaaatttataaagttacttccaaaaaaagctacataaataaaaattatctatttatagaaatatctatttagcagttccataatttaaaatattcaaatcaaattgggtaggactggtttgcctctcactcccacagactatatttatacctcagacacagcaagttacatttaaacaatgagtgtagtactacttaactaaaatggaaaaaatagtactcttaacataatccctaattttttcatgaacataaaactccaagtcatttatgtgaactatatctcaatgtagctgtaggaaaaataaaaacctgtgctaacctggactttggtctcatttaagatttggttctggaatgcaaatatggtttttgaaagcccaataaaattaattcttgtatagtctgtatatattgtttacaaggactacaaacactgcatcacaaatcggaggctttggtaaataactaagtgtccaacatagaaaataactatttggtcaaaagtataaaaggtctgaccttatttgaaatacgaaaaagctgagtacttggaagatacgtgaaaatactcagcatagatattatgaaaagctgaataacaaagtaaccttttttctcaaattatttcaggccacagtatataacggaacttattgctatttgaagtttcattaaaaataggttcatatatagaagaaattgtgtcagtaatacctcttcactaatataaaatatgccccttttagaagacgtgttctctagatctcatttctaaaactctgtatttttctcatttctaaaacttaagtatccaatcaaactgaccttactaaaatcccacaaattataagtcaattaatgttctgatttcattaattttggcttgtttcatttcgtcagcatttggttttttagttccaaaggctcctgctgcaagttctctctttttgttttgtattttcagcatattttcttcaacagagtcctttacaatgaactttaaaaagaaaaaaaaaagttaagtagtttttaaggcatagtatttaaaatctttattaaaaaaactaaatgaaagatttgcctaatggcaaaaaccgcaattacttttgcaccaaactataataactatttaatagaactgaactttgctttccttacccaatatggttttcttatataaagaatatggctgtacgaatagaagttacagatcacaagataagcaaagcaataaagaaaaaaaaagcaaactatataggcaactctggcaaaatgacttcagcattgtattaaaaaggccattctggccgggcacggtggctcacacctgtaatcccagcactttgggaggccgaggcgggcagatcatgaggtcaggagatcgagaccatcctggctaacacggtgaaatgccatctctactaaaaaatagaaaaagttagccgggcatggtggtgggcgcctgtagtcccagctactcgggaggctgaggcaggagaatggtgtgaacccgggaggcggagcttgcagtaagccgacattgcgccactgcactccagcctgggtgacagagcgacgtctcaaaaaaaaaaaaaaaaaaaacaaaaaactattcccagaaattcaagaatgaatctttagtataattcacaacactaacaaagagaaaaataaaacgtgatcatctcattcctgataaaaacttgattttaaaataccccaactaggaatgaatgtctcaaccttacatatttaatgtgaaacaataaaagtattctacaacaaaacagaaacaagtcaagaatggtcactatctgctactatttaacattgtttaagaagacccaattactgcaataactaaagctatataataaaattttactgaaatacatataagatctacataaatggagaaaggatactatgttcctgtatggaaacattcgttacttataaagaaagatagttctcgaaagtaataataaattcaataaatctcaagatatcttaaatgggattttataactaaaatctaaagttcaattcaagagcaataataataaccaccaatacaattttcaaaaagggtcatcagaacattttaccctatcaggtatcaaaacttactttaggaaaccatagttgttataagagtaatactgccctaagaaaaggaaaagagatcaatggaacagaatagtctagaaaaagacccaagtaatatatataaattagtttatgatgaaagtgacatttcatactagtagggaaaaagttggaattttcaaagaaaaaaaatgatgtgacagaacaaatcgttcttcatctgataaaataataagcttagactcatgtcacaaatcataaaacaaaaaataaaatcttccaaaagaaccagaagtaaatacagaatagttgaaaaaatgtgaaaataaagccttctgtcctaggtaagaccttaaaacctagaacgtataaaaaaggctgacgttttaaatcataaaaattttaaagctttttcatgaccaaaaaaatgcagtttaaagacaaggaagagtatgggataaaccattttcaacatacataaacaaaagatttcaagtcagactgtatcagggagtcctttatactataaaactatttgtaccataactatgagaactggacagaagatataaataattcacagaaaaaatgttaataaacaagatatgtgaaatatactcaaggttttaggtaaatgcaaattagaacagcacttttttggccacagaagcataaattaacaattttcatataaatcctattttgaaaccaactcgatagttgataaaaattctaaatccagaattctagttttcttaacttatcccaaagaattacttgcatctatgtgaaaagatttatatataataatgctcattatggcactgtttttattagcaaaaaacttaatgggttaaatatattacgatatatctatatggttttgtagagtagtcaaattcagagaaagaaagtagaatggtagttgccaggggctggggggagaggaatgggaagttattatttaatggatacacagtttcagtttaagatgatgaaaaagttctggagatggatgattgtgatggctgttgcacaacaacatgaatgtacttaatgcatctaaactgtatacttcaaaatggtaaattttgtattttaccactatttaaaaaaagtgttcatctaaatgtacttatgaggtagtctccaatgtatagttttaagggaaacaaatatgttgtagaataaagtataattccatttatctttaaaagaatgtttttaaggagatgtacacataactataaatgtaggtgcagagaaaggccccttaaacagcatatattaaattattgatgaaggaggaaaaaggtgacttatattttgctctgcataattacactcaatcataataatatattcatgcattacttgcttaattgtaaaaatcgtatcaacctagtcttaaaatagtttgtttaaaaactcacttttgtgatgataacttcttgcttctgaccaagtctatggcatctgtcaaagcactgatcttcagcagcaggattccaggcctaacaagaacatggatgagttactttactactgccctgatctttcagtgttttgcatttgtcctttcatttcactagtattcattcatctttttctgactgaaagttttctgcctgaagtcagatactaacatcacaaatactctggggaaaaatccaccctcccaatcactatgatgataggcatcctccccctactactacttctaatacctaatacaggccccgacatatgtatcagcacccaaaataagtatttgttgattaatcaatttggttttttttttcatttttaaaagaatctatgtgtgcttaacagcagaaaaaggttatacatcctcttaaatgacttaatttatatgagaaaagacacaattcttgggcctatttagttttctcccccttttctggttttctttcactttcctctgttcatgaaataaaagtataaaaaaagggtttctcctggctaacacagtgaaaccccgtctctactaaaaatagaaaaaattagccgggagaggtggcgggcgcctgtagtcccagctactcaggaggctgaggcaggagaatggcctgaaccccgggaggcggagcctgcagtgagccgagatcgcgccactgcactccagactgggcgacagcgagactccgtctcaaaaaaaaaaaaaaaaaaaaaaaaaaagggggttttaagagtcagtaagtcctaaaaattatttttttgttgatgctattttctgtatcagtatttgacgttagtttgactttaaagctgagctaaaaaaagtaccattagctaattaacacagacatgatcatgagaactgttttaagctaaaaaataaaatgatgggtccggcacagtggctcacgcctgtaatcccagcactttgggaggccgaggcaggcagatcacgagttcaggagatcgagaccatcctggctaacacggtgaaaccccatctctactaaaaatacaaaaaattagccgggcgtggtggcaggcgcctgtagtcccagctactcgggaggctgaggcaggagaatggcgtgaacccaggaggcggagctggcagtgagccgagatcgcgccactgcactccagcctgggcgacagagcgagactacatctcaaaaaaaaacaaaaaacaaaaaacacaacaacagcaataaaatggtgcaacaatgaaaagggaagaataaccaaaaagatatagacccctggtaagtggtttttaaatagtatcatgaattgtttggataaggatcattaaattttaaattaaaactatgaggttttttttttgagatggagtctcgctctgtcaccaggctggagtgcagtggcacgatctcagctcagtgcaacctccacctcctgggttcaagcgattctcctgcctcagcctcccaagtagctgggattacaggcgcttgccaccatgccccgctaatttttgtatttttagtagagacggggtttcaccatgttggccaagatggtctcaatctcttgacctcatgatccgcccacctcggcctcccacaaagtgctgggattacaggcatgagcctccgcgccaggccatattaccccaatacttatacaatgttcaatgaaaaggtaaaagaaagctgggcacagtgccatatgcctgtaatcccagctactcaagaggctgagggaggattgcttgagctcaggagtttgagaccagcctgggcaaaagaggaagaccctgtctcttaaaaaaagaaaaaaaaatttaatggtaaaagactttcatgagcaaatttttatttttttattgaatcattatgtttctcggacctgacttttaagttagaaacaacattggaaagcttgatatgttcaatgaagaacactcaacttactataaaactgctaaaacgttctgtaaatttttaaaaactgttaacacgtttagtctctgatcaactttttcatactaattattttggtattaacctctttggtactaagattataagcaagaaaaataaaatttgggatttgttctaaaaatcagcttctagaattatcactggattaattaatattcaacaatctatagttacaaatattttttatagtagccataaaatactgcaaacaaagatttcaaacttcatccacagtacaaaggcaagaaaatacaacagaccggctgggcgcggtggctcatgcctgtaatcccagcactttgggaggctgaggcaggtggatcatgaggtcaggagttcaagaccagcctggccaacatggtaaaaccccgtctctactaaaaatgcaaaaattagccacgcgtggtggcaggtgcctgtaatcccagctactcaggaggctgaggcagtgaaccgcttgaacccaggaggtggaggttgcagtgagccaagattgtgccaccacactccagcatgggcgacagagcaagactctgtctcaaaaaaaaaaaaaaaagaaaaaagaaaatacaacagaccataccatatccatgatattcacccatgaaggcctaagtatgatgaccctagttataatcttactgagaaggataccgtcagttgagggaggaaaaaggaagcctgagtaaacatatatgcatcaacaaggtagcctcacccaagtaactaaaatttatatctcagtagtattcctacatgtatctcagtagaattcctacatgttaaaaatcttctgagtttcaggtaacaagttacaaccacaaatcttaagtctgaatgcacagaaacagcagagggttgcctttagcccacatagtacccagtgcaaattagaaactgaattagtccaaggtcctctcaggccaaacagcccctttgtacacgtagaaaaacacgctcctatgtgaatgcacgtccaggtcacacagcttggtgagtaaagttcaaagtgaattttagcctctgttctaccttcatgcctgtactacacaaccacaactgactgcactatattaggcattaaaacgtactcagaacattccattaatgataatttgtttctcaaattgtgatcctagaccacctgtacctcaatcacctatgatatatgctaaaaatgcagcttcctgggtctaatcctagaactcctaagtctctacgttgaatgcaaaggaaattgcattttacctaattcttatgcacattaaagcttaagactactagaaccgtgatggtaatcattttgtctatcttgtttatagttagattcccagtgcctataaaaactgacgcaaagcaggatctcattatttgctggctgaatgaaccactaccctaaaaagcattacagttaatatttattatagaagaaaagtagaatagcatagcataatagtacttaaatatttacatggactatgattctggttttgcctattactaactgtatgatactgggcacattatttacttttctgtgcttcagttgcctcttcagtaaaacagagcattttttttcttttttttctttcagagacgggttcttgctctgtcacccaggctggagtgcagtgacaggagcatggctcactgaaacttcaacctcctgggcccaagcaatcaatctttccgacttagccctgcaagtagctgggactacaagcacaaaccactacaccagagtaacttttctggtacttttttttgtagagatggggttttgccatgttgcctaggctgctctcaaactcctgagctcaggcaatccattcaccttggcctcccaaagtgctgggattacaggcatgtgccacagcacctggccaaaacagagcatttaataatggtatctacctcataaggatgttgtgaggatttcagtaaagtgcttaagagaaagctcttaatccacatttactaagtttttgttatttatttctaaagtttgcctaagaattttcacagttaattataactatgaaggtatttaccaaatagttttttgtcttatttttttgaaagaagtactaagattctgaaaaaatttacagaactacttactggatccattaaaaacactcgagaagctgcagacagattcaaaccaactccacctgcttttaaggacagaagcattatagttggagatcctgcttcagtgttttgaaaacactgaattgattcaactcttttcttttgggccatggaaccatccaaacgagtaaacacaaatccagaggctctaaaggggggaagaaaagagacaagtaacaaacactattattataaaaataaaacaaagttaagtaactacaaatctcttcaataaattctttcactcatttattttaacaaatgtttattgaacacttattaatatgctaggcactgagtcagtcattttctgataaattcaggacttaatctttaaattcttgtgctgccaggaagtattctctattgtgactctgaatatctttcagataaaatgactaaaactggcaaaacaaattaagtttttttttttgctatccaaatcaatatgattatataaaatccttttactgaaagtgaaaaacactgtggaacttacttaagtggtatttctattaaagacaggaatgttgtaaactgagaaacaaccaaactttttatgttgggattcttctttcttaagtcagtcaatgcgtgcattagcgcattaatctgcaaaaaatattaagatgtccattagattccattttaaatcagtaaaattagtctaaaagtttttatcataaagaaaaggtcctgaaatgttatttccctaaaatgcaaaagactactcatttaaaacaaaaaattaagactgaaagaacactctaataatctgaacccattccatttcccctcaaattcaccactaaaaataaaaagccagtggtcaacaacagaacactaaaatgacaggaatgaaagcagaattacgattttgatatactgtgtatatttccttatataaaggtaaaacaaatactcaaatatttgcacatgagtactttacctttgaactggatgtccattccatatcagactttttctcactgtcacgtgctaattcttctggaggacattctaataaattatcttcatgtatatcatttctgcataaagggcatttagcatgtggctatataagaaagaacgaagtatgagcaacacttaacagaagaacaaatataaatatgcctaaaaatttttaaatgtatgctaaaatctgtatctctcatagctaacattttattaaaccttttaatggatttcatccatttaagagacatctgaacatgctgaactccagacataatgtggtaagtagaacggataaaggagggagcaaaagtatgtgatctggactagctagaagcaagagcaagaaaccaaaaattataacattgtaagcaagtttaaaaaaaaaatctatgaataacaatttattgaacctaaatacaatacagctacactatttagtactattctttaaaaaaaaatccatcttaatggcttataaagctattaagcttataaagcttataatagcttataaagctactaggatctgttaaatcctatcaagttcattccaaagcaacatctgttgtacccgtttgaacctgttaataaaataagattatatcttaaataactatatataaaacaccattacaattaaataattctgaagctaaaattatttaaaagtcaatacagtggggttacttttggggaagagggagagggtaaatggttgggaggggccacaaggggacctaggcagcagatacaggaatatgtttacctcataattgactgagctatttaattatgaatttatacattttttctacatatgttatatatcaatttaaaatgtttaaaaaaattctaccccagctgaatgactgcttaacagactagtcaacttcaaaaaaattctaccacacaaaagaatctagacctaccttatccaacacaatagccaataatcacatggggcaattacgtccttgaaatgtggctaagccaaattgaggtgtgctgtaagtatacaccaccaccaaattctgaagatttagttttttgtaaaaagcacattaatactttttatattttagatatattgggttaaatacaaatgtattaaaattagcttaatgtttctttttacttaagagtatgactactagaaaactgaaaattatctttgtgtctcacattatcaatccatttattgaacagcaatgatataaacagcggaattaagatattgactgtgaacatctttttatgttgcaaatgttgcattagaagaaatatatcacctattaaaatactggaataattaactatcaaaggtatattattaaatccaagtgcaaaactccatatactatcttttattatattaaagacaggtacactactctatcaaacactgaacctgtactgagcaaaaaactaacctgctcattctgaatgacttggcaaatacagggtttacaaaatacatgtgcacaatgtgttatcacaggaactgttaaagaatccaggcaaattgcacattcctcatctgaacctgagctcagaattaacttcatcttccttattaacttctttctcagttcttcaggtgtatcatttcctagagaaaaggctgaaaaattaatttcagagcaaggtttgtaatatgacaagttaatctatcttataaggaaaagtttcgcttgccagtagggaaagtctctcatcattttctgccataggcaaaaagcataatttaaatttgaaatttaagaaacattcagaagccaaaatagtagccaactcacataatatacctcatagagaagcatcattataacatgacaataacataccaccacacaataaaaggcagatccaatatgaatctttcatcaaagggtatctatcaccggaattcctggaaagacctcattataattccatttcattggtaaaaaaattattggatgtattcctagctgagtctcacactaaaagcaatctccatttgacagaacaaaataaactaaatgtatgccacataaaaaaaatttatcactcttatttaagtatctctgacaaatacaatgatatgaagcaatcaaatttacctacctgaggggccattggaagacactgcatttgtaagaaggtaagtatggcaacaaatttgccgcagtctaagcaaaagacccaggacatctgcataatgtgccaggacagtcccttcattaaaatacctagagattaaaatgtcaaatattattaagtccgctaaacaataataacttcctattctaaaacagcagagtaaaatggcatttttcttttcttctctagaaattactccaaaacaagaatgaaaagcagaaaagcaactctaataaaaccaagagagatctataacaataaggcacaatatatgagaaatggctgccaattgcagtctaagtcagataggaagatgctgagagggatgactgcagatctcaaacagagctgccaaaacacaattctttaaaatggatggcatgccctgaggggaaaatcaatacctctcatgtgcagaaacaggaacagggtgcatgcttggtgacttgagcttccatggagaaatttatatcaaaaaaagagggaaggtaaactgaatacagaaacatacaggtgcactgtattttcaaaaaaagactatgggcacagcactctacactccaagcacccctaaagtttctgatctctgtttatgtgtactaataaaacctaaagtaactcaacatgtaaccctgagtcttaagtaaattgggttatttcctgctggtcggggacatgattgtgacctttcccttttgtatatctggactagcaaatagctagtccaagaagaactcaagatattcaaatataagtaataatcagcagagagcaaaggtaggggacacatggcagtgaaagaaaactcagcagaaaaatgttgccacagagcaaataaaaattatgaccaaggatactgtcacaatttaacaccactcaataaaacaattcctccaaaaaaaaaaaatcttaaagcaaagacaaagagctttgaaaaaatatggcaagagaacaggaagagatgaaagatgagctggtatggctcaagaaagtgaaagaaaacagtgaatcatcagagaaatgaaagtcacactgaaaccaatataagccaatataaaaaaagactagtcactgataaaaacatagaaaaggatgtaggaaacaggactgagaaaatcaaaattaaacaaaaaaatgtaaaagatcagaaataaaatgatacctatggaacacagataaaagacatctaacatacacagagagaaataaaataatggaacagaaaacaatatttaaagaaagctttccaggaaagagaaggggggaaaagcctggaatctaaagatttaaataatatcacatgtcccaggggaaagtcaacaaagaagttgctgaacttcagagggaaaaaaaaaaaaaaaaaaaaaaccaggcttccccacagaaacattctatacaaaatacagtggtacaatgacaacatagattcttaaggaaatgggtgatccaaaaattatataaccaggccatctgatatttaagtattttaaggcaacagaagaaatatagcctaacggctaagagtacaaatttttagagctagctggtcatgaattcaaaacctggctgtgccaatttaattatgtaaccttggacaggttgcttaacctatgtcttgagcttcctcagttctaacagtggcattgtaaaagtacctacctcatacaactactgttatttaatttaatacatgtaaagtatttaaaatagtgcctggactatattaagtgctatacatgaatctgttgctagtattagtactggtagtattatggcaacaaacatttctgaatattcaagaatgcaaggaataggcaaaataatacaaagattaaacttacaagctctaaaccaaagtgccagagttaatctgtcctgtcactcactagctgtgtgacaacagtgtaagtcacctaaactgctctgtgcctcagtttcctcacttataagatgtggataattatactgacctaataggattgctgtgaatacatttaaagcactaagatcaatgtataacacctagtgagtgctaaataaatgttagtaaatatatagcctattaaaaagaatactttaaaaataacttattttctgagaacagtttcaataaagttaatctttttcaactttttcaaatagaataacctttactaacactaattattccctggcatggtcatatcttactgatactcagcatttcaatttaagagatctcttttgagtgcctaccatgtgctaaatattagaagcttccttcctcctatttcaccagccattgctatcttcacagttagatctctttcactttactcactcccttggtgatctcatggctttaattaccatccacacatagctgactttgaactcgactctcctatccaactaattatttgatatctctacttggaaaattcacgggcatcctatgatcaatgtgtccaaaactgagcttctgatcttagcttaaaaaaatctctgctcttcccatagacctgtcttggtaaacagcaattccagccttccacttatgcaggtaaaaaggcttgaagttatctttgattcctctttcacatgccataacatatcaaccagcaagttctgttggttctacgttcacaatttaacagaatctaatcatttctcactccctttatcactactatggtaaaaaccaccatcatctcttgctttgactgccactggtctccctacttctgaccttattcctattcaaataacctaaatctgagcacagcagccagagtgatcttttaaaaatataaatcagattacgtccctctcctggctcaaaaccctttaaggtttcctgtcataaaaagtaaaagccaaagtccttgacatatgcgttacatacccccattccaataaatctctgatatcatgactattttctctcgttcatactatccagccacacttgcttctctgttattcttcaagctcaccaggcatgttcccaactgggagcatctacacttgctcttccttctggctgaaacaccccttaatcccaatctcctttagatctttacctatatatcatcttctcagtgaggtcttccttaataccctactaaaacagctttggcattccccatcccctttcgttgctttattccttaaaacttaatcatgtttttaaattatctgtttcttcccattaaaatataaattcctcgagtgcaggcatttttgtctgttttattctgctgtatcccaatgggtataagtgcctggcacacagtgggcacttaataaatttttgttgaaagaatatgaaaagaaagaagattttgaactcagaaatctgctgcttagaacaatctttcccactctctctaattcctatcaaacctgctttgtacctacctcactgaagtttttatgttttgaagattcccctttcacagtcctattctgctttcacttgtctcttattcattctgttccctgtgggctcacattaaacctgatcttgcttggaccagaatttcataccttctaccaatccttaatcttcttgttaaacctatttcatcagttcctatttccagatttccatacgattttggaaatagaagcaagcaaaatcttctggctagcaattgagaacttgtcatttaaagtaagctttaaattatttcctaacttaaaaaattacttacctggtgaattatactattatttcattcactttattgatttgtaaaaaacactgtaattcatagaagcaaattatctttcagtatacttcaaactattgctaacacatctaaataatgtcattcagtgaatgggaaacaaagtaaacaaaaactaatttttaacatggttttctttctccataccttccaatagtggctctgccttcatttttcacagactgataaatctttctctcttcatctgaaagtgtaatgtgctgaataaatactttacgttctggtaactccaaaacaggttttcctttaattttgcttgtctttgttcttctaagtgtaatatttttaattagggactgtaaacgcctaatcagaataaaacaaataattatgtaacttttaatttctacataaattgatccaagaagaacgaaacagaacattttaatttgttactgttttatagcttctgtaaaagtgtttttaaaatcccttatttgggattttaaccaatctgataatcacagaagtattctacaaaaataaaattattaaaacaaatgtatggaaatttcccctcaatacctaacatagtttaatctttttatatcctgtccttattttcgtaagttctgttccccatttttgttccaatcactaactcttttacttctcaactgtcctgtcaactccatcaccgaatagtcaacactcaaattctaagtatctattaagtgccaggcactgaattaaatgttgtaagaatacaaatatgggtaagatactacattctgtaatattaaaatcaaaagtatataaataagtaattgtataaagtaatgagtgcccccaaaataaaaagataatatggtaattcagaacacagaaaaatgctttacaggttccacaatctttacatttctttctcagtactggaaaaaaagagatgtatcaattcttgttttttcccaacattgaaatataaatacaatttcctggagtttaaatagttggttttgaggaatcaagtggatagtactgccaactaggttagtggctcttgaagctttctcactataactcacagtaagaaacacattctatccagcaaaaatatacaaacacatacaaaagaaacaaatatttcacaaaataatacttactatgtatcatgcactccgatatttactaatctcttctctatttcattgtctttttaaatgctggctaccacctttataatgattttatatcccactaatagctctcaaatcttcagtctataaaccggtgctttagccaaaaagttgaaccacattacatcttgcaaaatggctatcactgagttttaatttatgttctcaacttttatctatctccaccagaaacaaccacataaaactttcctatacaacttttgctaaggtcatggtacctcacatcattcactatataaagctatgtaaggccaggtgtggtagctcatgcctgtaatcccagcactttgggaggtcgaggcaagaggataacctgaggtcagaagtttgagactagcctggccaacatggcgaaaccccatctctactaaaaatacaaaaattagcggggcatgctggcgcagacctgtaatctcagctacttgggaggctgagacaggagaatcgcttgaacccaggaggcggaggttgcagtgagccaagatcgcgccactgccctccagcatggacgacagagcaagactccatctcaaataaataaatacataaataaataaataaagctatataagatatgaaaacttaatgcatattagatcctcaaaggatatacgatgtttcctgctaaatctgttaatgctggttttggggctttggggcttagcaacacacaaaaaacagttatgtctttcctttcagtttagccacaacaggggaagggtagttatcgacaattagaaatctttgtctttccaaacaagcatcactaggttctgaaagacaaaggtactgagccataaacactttttagaaggaaaagttaagagtcaagttaaaatagtaaagaaagtgccaactggttcaagctactaacagttatttgtaactaatattaatcactgtctgaaagtacttacctaagtcctccttcatctcccattgtgacaggacgctgtattgttctatgccaccattctctatcaataaatggtttaagttttaaaaaggaaagaagagaccacaagtcctttaaagaattctggattggagtacctagaaataacaggaaactgttataactctttaaccagagtatccagtaagagtatctatttggcccaatcagagaagacaacaattgaaaatgggcactctgtaccaggctcatcattatcaattaaattaaactatcaagtgttgactataatcatttattaaaaatatacacatctcaagatacagttttgctctaatttttagctctcacatgacacactagccaagaaaaagactggaaaattcaactttctccttatcaagtacatctgcttatttagtttttaaagcagcagcactagcagaaggaaaaagcaactagtttaagtttacattcttttccttaccttctagtaaaggtactgtgaatggcaaacaggtttgaggatgggaaacagaaatcaagattatgactggatgactagagtgtctactccatttccactagagtgtctactccatttccaaggttcaagaataagtctagtgactgttccataaattatcaataagtcaaatgttgttatatcacgggcaattatgaagaacaactcaaaacatttgattaaattatttatatgattaattttggggcagaatttacacccactttaagtttacaaagttactttactaacttacataatgatatattttagagatttaaggttttagtaagtttaatgctatgattacctgtcaaaacccatcttctttctgattctaagtcaagtacagcttttgtctgctgagcatttggatttcgtatggcatgtccttcatccaggatcactcttagccaccttatgctatgtaatggactatctcctttagtctgaaataaatgttttatatgaattaaaaaacacaggaaagtaaaatagtacttaatatgatttgctaactagttgttatcattatttaatatcaaatttactatgtgctaggtactgctttaagcactacattaattattgaatactcacaagtttataaaataagtacttattagcacacctaattttacagataagaaaactgaagcacaaactgctaagtaagtatgttacccaaagcaccacaggtggcagaactagcattcaaacccaagcagcagtctagctctctgttgagtcactggtcaatacactgaactgttctacctcggattaaaacatagcaatgatatagaaaatggcagttgtaagaattacttgaattcaacattactttcttttatataaaaggtaatatttttactagaagactgaaattttgatagcaaggtatttttcaaaaagttttaacttttgaacaattggaattataaaggtaaaaaacaattagactaactggaaaacttatgaactgtaactacaaaaaaagcataccttcaaactgagatattaatcaaatcattgtgatagaaaacaattttccagaatattaaaaaagaaaataaaattcatttacaaattgcttcatatacttacaatccaaatttaaaatcttaacttaaaatgttctaaatgaaaaatattcctgtctgggtgtggtggcacacgcctgtaatcccagcactttgggaggccaaggtgggtggatcacctgaggtcaggagttcaagaccagcctgaccaagatggtgaaacctcatctctgctgaataacaaaaattagctgagtgtggtgatgcatgcctgtaatcccagctacttgggaggctgaggcaggagaatcatctgaaaccaggaggcagaggttgcagtgagctgagatcacaccattatattccagcctgggcaacaagagcaaaactccatcgagagggagggggaggggaggagtggagaaaagaaaaatactcctaaattagcatctaaataaaatgcaaccctttcacgcaaaaagtcaaaaaaaaaaaccatttatttttctatatatcgttaagtatctaaagagaaaaaaaaagtataaagcctgaattttggaacactctagaaacctgtggcatatttcttacattcaatctttaaaagatctgttaagtatcaacaatacttactccatagtcatgagttaaaatattatacgtagtcaaaacaatatcctgttttgaaagtaaggccggttctctaatacgatcaggaccataataaacataaaaattcaagtgtacatctgattttatatgttgtccaaactggtcctaaagaaaaattaggaatatttttaacaatgagcagatttgtgtcagacttaatagatgtataaaaaagtaactgccctggcagtagtgtgacaaatccaactactaaaattgtatgaaatcaagtttccttcagtctagaccaaaataataacaataagaaaaatgacacatacacagtaataataaattatttaaaatttacttggccctaccaatcagcaactgcttcatttttaggaggaaaaaccaaagttattgaaaacaataatgagttttataaaaatattttaattagaaggccctttaatgctgcattagttagcagacttaataatataaaaattaaacagtaaaagaacaacaaccaatatttccaaggatgtgggcagagattcaagcactgtagccactttctttcactcatttattattggcctactatttgccaggtatcaaccacaatagtgatgtaactaaaaatgaagaacaaataatcatccctgactttcttgaggacatgatcagttttaaaaacttattattatttttttaatcatgaaaaaaaccagacctagaagattttcagcagaaaaaaatagtctgattaaactgaaaagagaagataccagggagacacagctgggaagctatgaggagagagatgatgaagtcctaaaccagcaaggtagaagtaggaacagggtggaaaggacaggtgtgaaaaacagaaactaagacaagactgataggacttggggactaatgaaatatgaaatatgaataataataataagactaagatgctctgatacttgaatgactacctagaattgtgtgataaaaatataaggaagtttaaaaaaaaaaaaaaagaagggaaaagtgggcatccaagtaagaaagagatgaatattttagacctttatcatttttggtcactatagaatacctaactgaagacgtatactaggaaaatgtaaataattacctatagatagaagtgagaggtgtagatatgaattttaaagttaacaacagacagtatttacagctgtaagaatgaatgaaatttcctaaagagagcatgtacagtgagcaaacgttagggacagagtctacagaataccggtatgtaaggagaagacttgtttttattgggagaaaacacatgatgcctggggtataattaaaaatattccaggccaggtgcagtagctcatgcctgtaatcccggcactttgggaggccaaggcgggtggatcacttgaggtcaggagttcgagaccagcctagccaacatggcgaaaccctgcctctactaaaaatacaaaaattagctgggcatggtggtgatggtgatgcgcacctataattccagctactcgggaggctaaggcatgagaatcacttgaacccaggagacagaggttgcagtgagctgagactgtgccactgcactccagcctgggtgatggaatgagattctttctttaaaaaaggccgggtgcagtggctcacacctgttaattccaacactgggaggccgaggtgggcggaacgaggtcaggagttcgagaccagcctgatcaacatggtgaaaccccatctctactaaaaaaacaaaaattagccgggcatggtggcatgtgcctgtaattccacctactcaagaggctgaggcagcaggatcacttgaacctgggaggtggaggttgcagtgagctgagatcgcgccattgcactccagcctgggcgacagagcaagactgtaaaaaaaaaaaaaaaaaaaaaaatcaatccagcaaagaaaaaaaggaaagcacatgtgtcagacttttggtaatttttgaatcttgatgagtagatggagatctcattaaaattttttaaaatactctttttaaaaaattatatgttgtatggaaatacagaaaagacagatttaataggaaccagaacaaagacagagaaaaagttaggacaacaaatataaagggtaaaggcctgggatccaaagaatataaaagtttcaagaaaaaaaaccaaggtggacttttaatttgtcatctatcttcattccagttctttacaagaaggtttagagatagcttacaaaataagacataacaaataataaatgaataacatattcaaggcagaggaaaaggggagctcattgtacatggcaatattgaagtctgaagatctctgcaaagggagtttctgtagtgagtggaagcaaaaaccagactaccaaggactgaagaaagtattaaacatgaaataaaggcaaaaatgcagagaggataaaacatgaaaaagtaaagctgaaaatgcaaagaatttcttatagaaatttggtaaagaagaaaaggaaattagaatccagcatgacaaagaatccaatatgagaaaactgaatcaatgggtggccttgaaatgggacagtgcattatttgtaaagggattacacttggaacagaagaaaatcagcttttctggagaataaagggagagaactatagttactccatctctagacagtgttaggctctactgtatatgtatgtatgtatcatcctctcaatagaaaacgaaataggtgttatttcatgagattacttgtctaaatatccagaacaaatatgtggtagaagtaggattggtacccaggttctattcctttacctggattatttgaagacaaaaaagggaatataagtcagttctagcctgctctgtagaatgctagatcctttacttgagagccaggaagacggtatcttgttcagattgtgaaattttaattcttgatcattgaaatcgtttggatgttcatctcctccaaatctcatgttgaaatgtaatctccagagttggatgaggggcctggaggtggaaggtgtatggctcatagcggtggatccctcctgagtggcttagtgctatccccttggtgatgagtgagttctcactctaagtccacacgagatctggttgtttctaagtttgtagcacctctccactctctctcttactcccactctggcaatgtgatgctgggtccccatcaccttctgccaagagtgtaagcttcctgaggctgtgtaagcttcctgtggcctcaccagaagcagatgccagcacgatacttcctgtaaagcctgcagtatcatgagccaattaaaactcttaaattatccagcctcagttatttctttatagcaatgcaagaatggactaacacaaccatgaatccctaaatgccaaaccacctctcattcctttaaattcacagagtgtgcatgatctcacttggcaagattttgccacactttcctttctgaactttacattacttgaactttcctaaatataaaattataattaaatactgattacccattttaaaaatacatctctataccccaagccctcaaataatcagttagatagtttatacctccattaatactctaaacctcatcccaaaactgccattcaagtacccatgtactatccttcccataacaaacaacaaattaaagaaagaacagtttcgttggaataaaaaaatagcaacagaccattaacattcattcttctggtcctaagaggaaaaatgatacacttatcaggacaaggtgtaatttaaaaaataaataaataaaccaaaaacttatataaaaaaagataattcatgtcacggaaaaaaagactataaagccaagaagaggccactaaatttgacaattaaactatcacaagtagtcttttccaatgcaatttagagaactaatggtacaagccagattacaatgaattaaggaattagtaagtaaaagcacaaagtagaaattaacctccaagagtatgacagtgaaggaaagcagaagagtagcaacttttaaagatgcatatcaagagaatgtattttaaaatgaaaaaacctgagtatgtatcaggaagagccagtgggaagagactaaataaacaagggaaaaaagaacagatgagcaatgtgggaaaagagagaatccaatgtagagactaaatactggtcttaaaaagagtaggatctcttcctcctctgacataagaagaatggcgatgagagataaacagataacttggaagtggcaagaacggtgagtggtccttatattcacagggattccaagagagtcattatttcatcataacaagaagtttgaagctcaaactaggaagaaaacatatccaggctgcaaataaacaattaatcaagaggttccattccaatgtcaatgtttcagaacagaaaagcaatctggaaaaaaaaaatttctgatgggtagtgttaaaaggacaggctctagattcaaaatgttggagactatatacaagatccatcatttattagctggatgaccttaggcaacttaacctctctgtgtttcaatgtgggcacctggaaaatcagggtaacagttatgagaattaaatgagaaaaatccttaaaagaggttaaggacaaaccaaataaacaggagttcactaactgttgttattgttataaaaataagttattgttggtatagctcttagaaaagacagttccaacagtcaatctgtaaatgtagaggagtcaaactatacatctttcccactttgggggacaaaaatagcaaaggcagaaatacaaaccaaatcttatgttagcaattgattatgttcctttaccttcttctctactacacatcttcaaagaaaaatttcttcaattcagcaaacataatccaattcacctgatgattatttgaacttagatacgaactgatgaccaagtatatttaccccaatgaatgactctttaacagaatactttctaccttgtagataaaatataaattatgttacatttttaaagggcttaaagacttacaatccagttgcttaacacagaaagcggacagatgatcagtgttgttcttggtctctcctcaacatcagttttctttgacccctccactgcacaagctcctaaaaaaatgaaccactgatagaacctttagctgtttttctgaaatatatatgtcaataaggagatggcaataatgtgcctccatgaaaagataaattaggaacaattaaaatgaagcagatggacttttaacagggaataaattttacctcatcacttaaaaaaactaaaaatccacatagtgattatgagaagaaccaaaggactatgacagagagtaggtcacaaggaggaagtctctaatattttctgatagtcatagtcattcattaagacgaacatttgttttatgcagttttctgaatttgtgttatatttaatttggtagccagccaagatggccctcaatgatctctacttcctgatattcacaatcttgtgtaatctcctcccatactccaccaggactggtctgtgtgaccaacagaatatagcagagaagatagtatgtcacttctgagatagattacaaaagaagtttccgtattgggtgtgcaagctcactctcatactcattctctctctccaatctttcactctggtggagccagctgccacgatgtgaggccactcaggcaacttatggaaggatgcacatagtgaggatctgaagactacagttagccagcaagtaatgaggtctgctgacaactatgtgagtgaacttggaaatggatcctccctaagtccaatgttcagatgacggcggcccctgaagaagagtttgactgcaacctcgtaagagaccataagccattaaaccatccagctaagccactccgacttccagccctgtcaaagtgtgtgagataataaatgtctgattttaaatggctaagttttaggataatttgttacacagtaataggtaactaatatattacaacaaaaattcttaatacttttctgtggagcatgtttaaaaatagtgataataaagtgtttttacaaattcttgaaataaattctagagatggtatcccttaccaatggagtatcttccagtaaacttaaaatgcaaatttctgagtttttaaaaaattgtattttcacactaatttcaaaattaaactggaaggtgagcaaagtatcatactgtatctacgtatcattcacaacttgcttttttctctcagtgctatctacagtagtccctccttatccactgggggtatgttccaagaccctcaatagatacttaaaaccataaatagtaccaaaccctatatataatgttttttccctatatatacctacaataaagtttaatttataaagtaggtgcagtaagagattcgtaacaacaaagaataaaacagaacaattataacaatatacagttgacccttaaacaatatgtttgaactatgtgatgcacttacatgcaaatttttgttaaccaaacgtggattaaaaatacagaatgggccgggcgcggtggctcacgcctgtaatcccagcactttgggaggccgaggcgggcggatcacgaggtcaggagctcgagaccatcctggctaacacggtgaaaccccgtctctactaaaaatacaaaaaattagccgggggaggtggcgggcgcctgtagtcccagctactcgggaggctgaggcaggagaatggcgtgaaccccagggggcggagcctgcagtgagccgagattgcgccactgcactccagcctgggcgacagcgagactccgtctcaaaaaaaaaaaaaaaaaaaaaaaaaaaaatacagaatgggccaggcatggtggctcatgcctgtaatcccagcactttggaagactgaggcgggtggatcatgaggtcaggagatcaagaccatcttggctaacatggtgaaacccgtctctattaaaaatacaaaaaattagccgggcatggtggcaggcgcctgtagtctcagctacttgggaggctgagacaggagaattgcttgaacccatgaggtggaggttgcagtgcgccgtgatcgcaccactgcactctagcctgggcgacagagtgagactccgtctcaaaacaaacaaacaaacaaacaaaaaaacagtatctgctgattgcaaaactcatgtatatggaaggccaacttttcatatatactcgtcctgcagggcagactgtgggacttgagtatgcgcacattttggtatacacagggggccctggaaccaaatccctgacaaatactgagggatgactgtactgtaataaaacttatgtgaatgtggtcattctctgtctctcaaaataccttattgtatataatattttagaactgaaactgtagaacgtgaaactgcagataaagaacaactgtgtttgggatttacacttattagtatttgtagctctagtgtattcattttaaccaattcatagcatcatactgcaaagtagattacaatttatttaccattcccctactggacaacatgtacattatttctaatattccattaaaataatgctgcaatgaaaaccattttttcatgtctccttatttatatttacagagttacagatggtctatattcagcttcattatatttttgtccagttgctctccttggtaattggcgctcccatcaacaatgcacgaattcctattgctgcacaactttgtcaatacttggcattgtgagattttttaatgtctgaaaatatgaagggtaagagcatccccctattcctttattttatgtttttgagacatggtctcgctctgtcacccaggctggaatgcagtggcgctattatggctcactgcagccttgacctcccaggctcaagtagctgggactacaggcatgtgctaccatgcctggctaattttgtgtatttttttgtagaaacaggattttgccatgttgcccacccctgatcttgaactcatgggcctcggcctcccaaagtgctgcaatttcaggcatgtgccaccatgcctgctgccactattcctttaatttgcatctccccaataattctgaatcagcatattttttccagtgttaactggttatttgggttttctttctatggactccatatgtacatcctttgactattctcctattgggtggtctttttccaattgtttggaaagttcttacatagtctagaattgaaccttttgtcagttacacttaatacacattatcttcttcagttttatcattttttactttgtttatggcaccttttgatgcatggaaatttaaaatgtagtggcatttaatcaatcttttccttatgaccttttgtgtcttactaaagagatcactatctaccacaaggacaatcaggattatggcttctgtctccattcacagagttttgtttctattctgcttctctttcaaagatatacttagtttggttaaaaccaaaatgacacacagctgtgactttgaaaatgttctctcttgtatcacagctatgcatctgcaactgaaagtggtttctaatgtgtaatttaattctatctcaaccgaaatttccacatttctttaaatttctaaaattagggtaaagaataatccacccaacatgcctatattttctattcctaattatctgattcttggaccaaaagtcggctctttctcatgagtctatgttagcttcataaacaagccccttcaggtcaatctttacttcattatcctcctttttcttcacattacttctcattatttaaaattatattgacttgcttattgtatatttctctcatcattacatcatatgctatatgaaaacagatagcctgctatatccccaacatgtaaaataatggagaccaaggggcagagatataatttgtctcagatcttctcaaccttagttcaatctcttcccatctcaaatatttagtctcttaagcagtgttgttttcctatgaattacaaaatataaaatcataacaaagatcactaacattttaaaatgaaaagcaaattctaataccaaaaaattaaacctttaacttaaattaaccaaaattaaattaagctttaaagcagccacaaattgctttgtgccatcactagaagaaatatctctgctattcagaggagtaagggcccccatcacattttggccctaactaaaacaaatacagtaggaaaatgcaccaaaaggaaaacaaattatgaggtagctttgttcttttaatgggttatatactttaaaaaatagtctctattttctaaacttcttgtaatatggttttataacttaaaattttaaattttttcattcaaaaacagaaaaaaaaccaaaaactagaaaacaaggatatttactgaccctttttcaacattttcttttttgttgtaggaacagatgaagttaatgcacatgcaaatgccacatcttctataaccttagaagatcctgctgataaaacaacaaagaatcttaaatttttttcaaattatctcctgtgctagagtacaggtactttctaagggtaagaaatagaatatcattttcaccctctattgtaagagcttatattattaagttaaaatatttggtaaccaaaattactacctctgacactaaggatatcttttcaactcagagaaacgatgtagtcattcatggtaagacttgaggagaagaaatgaaagtaggagcagtcatatgcaaagtaattcggctctcaggtggaaggagaatttttcaaggaaacaaacagtttgattcctaatgataaggctgccaaattttcagatcagtcaagatgatcagttattttccaaatgcaatacaatttctcaacgaatgagaaatatagtatgatgtgaattacaggaaaataaaacatattttaaagaaaaagaaaaaatttgattattttcacatctgtataataatgtaaacaataatagtattgccaggaagacattctcaacctaattttgtaattactattcatactacacacataggttttattgaagtcattttataggtagtagaaaattgttttaagtatagtttaaatattattatcccttagattttaatttgcaactatttattcacttttcctcctttacaaaattaatttaaaacccatggttagctccatgaagagttcaaatgtaaacatcagccaagtttaagagctattactaaaacattccaacctagcgagatacaaatcaatggagctgtactttaataatcttgaagtctagattatgggtatatagtatacacatacctttcgccctgcctttagtttcagactgtacatttttcagtttgcctaaaaataaaacaaaaataaacataaaaatgggcaaaacaggacattagaatataggacacattatcaaatcaaatctattacatgttacctttcattttctgcggcaattcacttgtttcaatttcctctgaatcactgctttctatgtactggacagcagtttttcttctaaaattaagtatacacaaagaaatttttggaccaacccaaagcaaaataagatatacaaacatgtttaataaatgcaataaaaaacttttgtcctactcatttattttttgaaaaattttttaaagattttgacaaatgaaagtcagatctgctaaaagcattctgctttcataaccagatagatgcattaactatacaaaatggagtaccaccgttattgttttttgagacagggtctcactcttttgcccaggatggagtacagtgacacaatcagaagtcactgcaacctcatactcctgggctcaagtgatcatcccgccttagcctcgggagtacctaggactacaggtgcgtgccactacacccagcgaatttcactattattaaaataaatttgatagccgggcgtggtggtgggtgcctgtagtcccagctactcgggaggctgaggcaggagaatgacgtgaagccaggagacggagtttccagtgagcggagattgcgccactgcacaccagcccgcctgacagagcgacactccatctcaaaaaaataaaataaaataaaataaaataaaataaatttgaaaaactaagtcattctaaaaaattaaaaatttcaataccaggtttaatatttggtagttcaattaaagcatataaaactggaacaaaaaagaattggctcgtggccaggcacggtggctcatgtctgcaatcccagcactttgggaggcggaggtgggcagatcacctgaggtcaggagtttgagaccagactggctaacatggtgaaaccccgtttctactaaaaatacaaaaactagccaggtgtggtggtgcgtgcctgtagttctagctgctcaggaggctgaggcaggagaattgcttgaacccgggaggcagaggttgcagtgagccgagatcatgccattgcactccagcctgggcgacaggagcaaaactctgtctcaaaaaaaaaaaaaaagaaaagaaaagaaaaaagaattggctcttatcaaagaaaatacttctaacacaatgaaataagcagccaaaaggcaaaaatgtaattctttcacaataggaaatttcataaattttgtgtagaaagtttaacagtgattaagtgcctaagagcaataaattctgaagtcagactgcctagctttaaatcctcattccaccagtaatttgttatgtgattttaagtaaattacctaatattcttcaatgcctgtttcctcataagaaaaatagaaataaaaatataatcctcatagaataaaatgttactacatgcaaaagcccctaaaagagtgcctgttacacaataacataactattagctataacatgtgtgtcagctgttgttaagtttttctcatgtcctcaccattattatttctatgtcctttaatctgatcttgtccaattaacagtgttgtgttacccaggtttatgataagttcaaagttgtaacatttgtcatttatctaaatctgaagcaattagatttagataacactgatgagtgctggctttgtgcttagttcagacagctattaatgacagaacaattaacatagccagtttcaaaacctttgttgatgaaatagctagcagagacaaatttgcgatgacttgtgtagatactgatggtagacaatacaacaaaagcccaatttttagacctacttcagaagataaatgaagtttgtaaagttaacagattcaagacaagatcagaggggaattacatcttttattcaaattctccctctagtctatgttaatataatactgtccacaaataactttatcatgtcttatttccactacatgtgaagaactgaaacgatcaagaatgcttttgtcaagttatctaataaaatattcttcagttttcatccccttaaatccataaagaaaacttctaaaatctcaaaaaaaagcaaaaatcccaagatctagatcttagttccttgacaaaatagaaaaaaagtagtagaaagatgagtgattattaaaatttaccaattcatttcttttataggtcagtatcattcttcttcatctgtaaaatgagaatactctatctgcctaagtcatagtgatcttggtagtttcaaataaaagaatgtatttgaaagaactacttaacaaatataagggtcatggtcatctctatctctctctttttcttttttttttgagacggagtctcactctgtcacccaggctgcagtgcagtggtgcgatcttaactcactgcaagctctgcctcccgggttcacgccattctcctgcctcagcctcctgggtaactgggactacaggcgcccacgaccacgcctggctaatttttgtctatttttagtagagacggggtttcactgtgttagccaggatggtctcaatctcctgacctcatgatccgcccgcctcggcctcccaaagtgctgggattacaggtgtgagccaccgtgcccagcctctatctcttttacacataagaaaacagagtctaaataaacatatgacataatcaaaccataatagtttaccttttggggcgggagctagacaattctgacatgcgaaacttactcttctccttgatatctgaaatactgggttgttcactacatctagatgcgtctatttcaaagaaaaatgcaaatataaagtattagtaaggtgtcttagaaactagtattatccctcttaaaaccttggttttctaattactgattttcagttttcttaagatcttcattcctttcattactctattttctctacttttttcctaatctagtatttcctcatttctaattagaaagtaccttcaaatttttatgacccagtcttttctttgtactcatccagcccatccccacactagctgaatgtcttgctgtaccaaggcagctaagagctattggaaaaaaaaatcaacagaaccacaaataggtgctgttataaatttacatgttcaaatctcagatgtcaccttgtgtcacttggtaactctttttactaaacactgttcggctcccctacccatttatcagaatgatccataccagaatgatccatactacattgacccctttgcctagattataactccttttattccaagatgacctatttcactttacaaagaaaatgagaaggtatcttccataaaaatctcaattttcctatcttttaatccactcatttatctatactttccttcaaccttacttctttccttctactgctaactcatctacctaactcatctaggtagatgagttagaccacagaacaaaatcaaaaacaaaaaaaacctcatcttaccctaactcgccacctttctatttctttcctgttccaaacttaagtaatagcaccaattgttatttacaatttttcacctactactcttaaaatattttcagtctgctctaatctatctttagaaataagctttatgagggtcatttaagtaaaatccacagatctctttccatttctcctatgacttcagaatttggctctaaagctagctttctagcattatctgctgttatccatgcatattacattttaaatacaacaaaattcactgaggtcccagaataaaacatgctctttttaaagtaccctttcatgagattttttttcacaacccaaaatgctcttccccagttctctaaatgttatactacccaattcaatcatctccttcatgaaacctttcctatcagtactcagggaagaccttttaaaaaagagatcctaaatttttgtacagtacaaagccaaaactagaattacaatattaggctgaaaaaacgcaaatcaaatattgggtcatattcaaattaaagtttaccagatcaaatattggatcatttcaaaattagcatttacctttgcttagtccatctgccttttcactggtattgtttcctccaagtttcatagagtcatcgttaacattatattcctgggtaaataggcatatttcttaaacagtactgctatcagttttaaataactttaaatgcatcctgttttatattgctttactttgcataataaaaacgacttaaattgctacccaattctggagcaactgaaggggagggtgaataagtgaagaggaaaatatacaaactgatttaaaattttttcacgggttatctcaaaaaaaaaaaaataaataaaactacttggccttcaccttttcgaaaggaataccgaaagcaaatctcaattataaatgacacattattgtgagaaaaattcaagaactgggatttactttataattaagaattctcagacttcaaacttttcaaaccaatgttccatgttcagatctttaatgaggctgccattgtcatcctctctttctctagaatttgcagggcaaataactctaatatataatagtacaggtcccagagtgtcctctcttcttactccatggggtattttcctgctagcccattttcttttcttttccaatgtacctttgtttccaaaggcaccaatgtacatgaattgaaaacaattttataaaatttgaattgtaagcacttaaaaaatccccccttagagttaagtcttactaaaaatgtggttgaaaaggttcatcctctttaaaggtaccaatcaaaaaaaactaaaaatctgccgggcgcagtggctcatgccagcactttgggagaccgaggcgggcggatcacctaagatcaggagctcgagactagcctggccaacacagcaaaaccctgtctctactaaatagacacagattagccaggcatggtggcgggcacctgtaatcccagctacttgggaggctgaggcaggagaattgcttgaactgaggaggtggaggttgtagtgagccaaggttgcgccactgcactccctctgtctcaaaaaataaaattaaattaatttaaaatcccaaatacaatatttttagagatacgtaactagaagagttactttagacagttaatgtctaagcattagctccaagaaagagatggtaaaaatgcttttcatcaaacatcctatcaagtctacaataattactataaccatttatattaaacagtatgcaaaaaaactaaatgtttattcaaacataaaggatgtcctttgcattcatcttcttttttttttttctgagacagagtttcactcttgttgcccaggctggagtgcaacggcacaatctcggctcattgaaacctctacctcctgagttcaagtgattctcctgcctcagcctcccaagtaactgagattacaggtatgcgccaccacacccagctaattttgtattttcagtagagacagggcttcatcatgttggtcagactggtcttgaactcctaacctcaggtgatctgcccgcctcagcctcccaaagtgctgggattacaggaatgagtcactatgcccagctttgcattattctttatattaaaatattttgctcagcaaactttttctctataaagttcaaagataaactttttatcaagtccaagctggatgaaataatagtatgttagaatctaggggaatttaaatcaatatttcagtctacttatgtttggaatatctaaacatacttgaaagagtgacaattttttttttttttttaataaatccctggctggaaatcacatcttcagctgccatttcaattaatgtagcaacccaaatattctaaaacctttctactataaaacacactttaaatatataacttatcttggggaaaaataagagaaatccttattgttaattgataatttctcaattaataattgagactaaagcagtaagtagtcttatgtgcttctatcaaatctggtaacctaaaacttcagtttcaataaccaaatgtaggaagaacaagacataaaacattaggttgctcagggtgaggaattgaacctgagacttcaacaggtttaactctcaataaaagtagaaagtaggaagtaaaactaagtgcagacattaataaaataaaatctcaatagcactgacaggaaactgatgtactgccttctctgaaaactaaaaactaggaagaatggtaattcagaagagttcagaaaagaagtatattgcatacatctttttgctatttccttctatttaagttacttgaattttcaggtaagaaaagaagtaactgttcctctctagtaacatttatttttctcactaaactaatttttaattcttagaaaccaaatataaatgtatgtttatattatatacatatatatatgtatatatatacacacacacacacaaattttcaagaaaagtcacccttattctcatcactaggacataagttattattaacattttggtacagatagtgtagtgaatggacttaaaacacacatgaatatattatttacaaagtgaggaaccaaactccacacaaagatttgtacctgtcattttttaactaaaaagaatcatgaaagtgattattcatcaaaaataatacttaatggttacataatagtaagttttatggctatatcgtttaactgttcccttgtcaaaagatgtttcaaattgtccacctttattttatttttatttgttttagagacagggtctcacagtgtcactgaaggtggagtgcaatagtgcaatcatagctgaccataggctcaaactcctgggctccagcaatcctcctgcttcagcctcccaagtaggtggaactacaggtgccagtcactatgcccagcctttaaaacaatgttgagggaaaaaaaaataataataataaaaaaaaacctgtattttctttggaaaaaatgaatttctggtaactcctttcagatagtttcttagaaatggcattattgactggcaaaattgttcaaagattataaacaattttaagactcctgatacaaattatcaattgttctcaagaatgtgatacctgctggtggctcacacctatagccccagcactttgggaggctgaggcaggtagatggcttgagctcatgagttcgagaccagcctggacaacatggcgaaatcccacgacttgagcctgggaagcagaggttacagtgagctgagattgcgccactgcactccagcctgggcaacagagccacaccttgtctgaaaacgtaaaaagaatgtgacacgaactttcattcttatcagcaacacataaaagacagagagaccattcatcgcatttctgaaaacacaatttcttggtagttttttttaatgatgaaatttaaagatttcacaataaactggaggtttcacataaagcgcacttactactactttaccttcttcagtagattctttttaactctttcaataggaagaggtctgccatcatggaagttggtaaggattactgcaatggccgtaagagttttacccttaaaaatgttttaaaaagataaatggtcagattgtgaaacccagttcaccagaaaaacgttcccattttaaaatcaagtaatcgaatatcaaatatcattcaaggtcacaaaagtgtactgtatattaatgaaaaatgagtatttcatttagttagaaaatgctttcccccactgcattattagggaattattaaatgatttacactataaaatactacaagtatctctgagaagtgtcattttattgaatgactgctattctacaattctacatttaatcctgaactcttgatttttatcatgcaactatttataactactcatttgccatgaagttcggagctaaagtgattagtaattccagtatgcatataatcattttattaaaatttgacttaaagataataccaagcttaaaagtcataacttctccataaagcataaaagatatatttcttatgcatttttcttaagtggaagtatgtaatttttcaatatttactgcagcttaattcatagttggcaatacattagtaaatctctggcaattttaaagcagtgtaaataacagcagttttcaaagtgtggtccacaggccactggggatggggagggtttcccaggagcccttcacgaaaatgcaaagtcaaaactgtttttataatactactaagacagaccttactctgttaacatctgcactaatcctacaaaaagcccaaatagcaatggtcaaaaaagtgcctcagcataaaacaaagcagttggcactaaggtatattagtactagtcatcatattcttaactgccacatacagttaaaaaaaaaagttttccttaagaatgttcttggctgggcacagtggctcaggcctgtaatcccagcactttgggaggccgaagcaggtggatcacctgaggtaggagttcaagaccagcctggaccaacacggtgaaaccccgtctctactaaatacaaaaaattagctaggtgtggtggtgcatgcctgtaatcccagctacttgggaggctaaggaaggagaatcacttgaacctgggaggcggagggtgcagtgagccaagactgaaccattactccagcctgggcaacaagagtgaaactccatctcaagaaaaaaaaaaaaaaagaagaagaatgttcttgacgaagcagtacacattaattttattaagtctcattacttcagtacaaatctttttaatattctgtgtagtgaaatggaaactacatattaactacttctgttgcatatcaaactatgagggttagctagagaaaaatcactcaagatgggagttataagctcaactagtcacttttttcatgcgacaccatttttacttgaatgacaactatcaatcacgactgagtgtctgaaagatactttctagaaaatgaacaaagtgaggctgtcatctacaaaggaaacaactgagcttgtcaatgataaaatgtgagttttcaatagaaaattagaatgttggaaaagttgtgtgtgacactatgaacatagtgccttcccaaaatgtaaatgattttctaataacatcagtggtaatattaatgaatgtaagttttggatattgcatatgaaatacatcaacatttagtaggtctgcccaactcaatgaaccaacattttctaaatgagcaatgcctggtgttataaaatcatacatgggtaaaatattcattcaatgagcaagatacacaaatagattttaacaaaacagggtataaaaagctcactgatatgatttagcgttccatattacaacaattaacctttaataaactaatatttattgaattttgatgcagtatatcaaagaaatctgcaattatctaaaaagctattacaatactcctctctttacagcaacataccgtcgtaaggacaaattttcttcatatacttcaaccaaaacaacctaacagaacagactgaatgaagaagcaggtgagaattcagctgccatctattcggccaaacacagagatgtgcaaaaatgtgacaatgccagttgttgcaacaaaaatgttaatgttttggcatagttatttttcttttaaaaatatgctatttatgttaacaagcaatgagtttgtactgctatctttagctaccactgcctaatactataactactgataacagcacacaaaagcaaaagctctttgaaatcagtaatttttatgagtagaaagggttactgagactgaaaaatataaaaactgctagtgtaaggacacataagtatctatttaatactctgcataacacaatatttgtgatggaatacaatttcacataacattgttttgtctttactttttaaaagaaaacctatgaaagacaggtcaccctgaatttcaaagagcaaagaaaattgagaaacatggccaggcagggtggctcacatctgtaaccccagcactttgggaggccaaggcgggcggatcacttgaagtcaggagttcaaaaccagcctggccaacgtggtaaaaccctgtctctactaaaaatacaaaaattagctgggcatggtggcacatgcctgtaatcccagctatttggaagtctgagacaggagaactgcttgaacctgggaggcggaggctgcagtgagccaagatcgcgtcactgcactccagcctgggtgacagagcaagactccatctcaaaaaaaaaaaaaagaaaactgaggaacacatctttataccactattttaactaaaaactacaggaaaaactgtgttctacaaagatagtaagatctagtcccaaactggtaccaacatattcctatctctttttacttcaaaattactttctagaaaatcataatcacaaaattagattttattaactaaagaaaaaaataattaccaaacccatatcatcagctaaaattcctccatggacattttctggtcggtccttctcagaaaaatttgttattgtgttatagtataagtcatttcgctgttcccagaatggtggaagttctttgctattttcccgtgacaccatccaagctagagcttgtttttgatgtggaagcagtggtgtttcaatagcctataaataaaaagtcataaagcgaaatacattaagccattcctttttcacatgcagatcctgtgattaaacaaaaagtagattctaagtatatttaaacattctgagtagtcttaaataaaaaatattggttcaatacctcagctggttccatttcatgggttttatcatcttcttttaaatcttcaaacaatttgtcaaattctgttttaagctacaataaacagcaacaagaaacaatgtaaaacaaactaattaaaataatacttgcatttaagtcagatttgaaatcatttaattaactggcgttaatgtcaaacgggccaggagtggtggctcatgccaataatctcagcactttgggagaccaaggtgggaggatcacttgagctcaggagtttgagaccagcctggataacatagtgagagatcccatctctacaaaaaaatttttaaaaaattagccaggcatgggggtgcatgcctgtagttctggctcctagggatgctgagatgggaggatcacttcagcctagtaggtagaggatagagtgaaccatgattatgccactgcactccagcctgggcaagaaagtgagaccctgtcccaaaaaattaagaaattgaaattaaattaaatttaaaaaccacaaactagtcaaacgccaaaaaggcacataaatcaactctagaattacactactcactgaagagcgaatgaacaggtgctttagttgttaggaggtaaaagaatataaaagaattttaagtcccgagtttcagtcacagttttatcacaaataagcttatatgtaagtttcagcaagacttgacctttatggccccatgtcttattcctataaaatgaaagggatgaactaaatttagattgtctctaaggttccttctgccattaaaattctgtgatgctatcagttgtattcaaaatattttctcagtcctaccaggtcaatgacattccatttattattactgcaataaggaacttgccatgcactataggatacttttattattatgctaacttaattgactatttaaactaggttagtccaattttatatcaacatatatgtgatacagatatttttgaaaattaacacatgaacacagcagcagctcagaagaaatcaggccaggtctaaaaaatcagaagtaaccgggggcttatctaccagaaacaagctcaagtccttctaacaataagcagggtaaatatggtaactacaattagtagataaaaggactaacactggtagatacaaacatcaaaaaagttttaatgttatttttaaattgatctgcattaattactttatatacttttttttcaaagaaattcagcataactcatcctaaattacaaattagacaatgtgaagaatttggagttaaatctttagcactgcatttgcaaaattactgaaaggagttaagtctcagcttcaatttttttcttaaaattactacttgaacatttaaaacatttcagatacaaaaatatgccgtgcataaacaggaacgtgtgtgttttgtatgttgggtacaaatgttcacgtatggatttattccttatcagtactttttatataaaatgttaacatatatatattctatttattctataacatgtttcattataacttaatatatttgaagaccacaaatacccacacgtacatattcatcctgttcttttaaatacaaacctgcaacatttaaaattcacttttagattacaaaataaaagagaagcacacctgttcagttgtcatctgtactgcagcatgcactggcatactatagcttggtccagctcttccagagccccaaccactttccaaattgaatcctaaagctataatttacaaaataaaaagaataaagccatcaaataaagtaggtttttatcttttattaagtagcttttaaaatatgcattaacagggctgggtgctgtggctcatgcctgtaacccaagcactttgggaggccaaggcaggtggtttgcctgagtccagtagtttgagactagcctgggcaacatggtgagattctgtctctacaaaaaatacaaaaattagcagagcgtgatggtgtgcgcctgtagtcccagctactcaggaggctcaggtggaaggactgctggagcccaggaggtcaaggttgcactcagccactgatcgtggccactgtactctagcctgggtgacagagcaagactctgtctcaaaatatatacacaaataaataaataaaacgtgcataacaaactgcattaaaagccttgtattttagaggtattttaaaagctaaatactaaatcactaaaaaaacaagtaattccacattatttgaacaaactcttgccaagcaatccttttcattcgctatcagaagattatttttgcctaaaatttatcaaaaagaatgtttaaagtcaggggtttccagatgttaccattagggaaaattaggggagggtatatatgagacttcattgcatatatactttttctttaatttttttaatatcccctcactcttactgtgtatatttttatgtgtgaatctatttcaatagaggcaaaaggaaaaatcagagatttcctcaaaaagactcctgaaaaaaagttgtaccttggagccttgagcacaaattagccaacaaactccaagagagaataaatgtttcataatccctgcatcttacaatatcagaataatattaagtgaaaccctaaacttactttttggtgcaggacccaatttaaatccatgtttcttcaactgatctgaaaccgcttttctattttcttcttttccccaaaaagtcatatgcagaggcatggtaaaagcattgtttgcaccaaaaggaactaccctattatatttgggagaaaaagaaagggaaatcagaagcattactttttatccccactaagaattagttcaatattttaagtgtatcatttacattttacattgaagtaaagtaataaggaactagttgggcagacttgaaagaaaaaaaggaaaagaaatagaaccataaacaatcagaagggtgatttttagaaacagagtgccagaaaaaattgagaaaatggaataaagcagttttaaaaatgcaaggatggcctgtaaacaagattgtaatataagtaaaataagttaaatcaaagggtagagtttggctaacggaaccactgagggtagtaactcattctgcttggaaaatgggaaatgcaagaacttgtgattcactaagttattctcaataactgaaaaacctgataaactgaaaaaggagaaaacaaagtgagacattatgagcatttattttctcttcaaactcacctaggattatatgaatatcctaaaaattagaattagaatatcaagatcctaaatattccagatacttaaattgagatcacaagtacaaatgcctaaaagagaaaaggtaactgaaagattgaaagagtttagaaaaagaaaaaagaaacaggtgataaaactgggagagcatatgccctagctaaagggagagttccagtcaactattgtcatatggaagtgacaactcatcctgcattgccagatttcccacttgtcaagagaaaaataagttttttgtatttaagaaaataaattaatatgtataaaatgcggacttagctatttcaataattagtactgaacgaaaaaatgtctaaaacactgcagggcaaaatgaaattcacctacatcatatcacagaataccagtttataacctctgatataaacaaacacttccaggctgggcacggtggctcacgcctgtaatcccagcattttgggaggccgaggcgggcagatcacctgaggtcaggagttcgagacagcctggccaacatggcaaatctctgtctctactaaaaaatacaaaaattaattgggcatggtggcaggcacctgtagctactcaggaggctaaggcagggagagttgcttgaaccctggaggcggaggttgcagtcagccgagatcacacaactgcactgcagcctgggcaacagagtgagacttcgtctcaaaataaataaataaataaataaacaaataaacacttccaaattcctaaacctaggtaccaaaaggtttggagaaatggaatgtacttcctaatatttgaaccaaggtctattttctccatggtaataattccataggaaaatgagaggacaattgtttgatggctggggtagtagaagtatgtaaaaggagaaataaaacatttatttaacacgtaccaaaagtacagtgatagaaattgttagcatacctttataggctctaacaagaagccctaacaagttcaaagatgactataattcacaattattaaaactaaattctgaaagtacattacccttcaatttgtgccaatttgttgtccatgatataggccaaagcacctgcaagctctttctttaaatggccaacttgatttccattcacattgtttactttaattgcattcttatcataagggttattaggatctcgttgtaatgcaaccatttcattattattaacctaataaaaatgataaacagataatattacattataaataatagacaataactttgttatactttatctgggatttccattcattttttaatgctactgctaaacactgcacataagaaaaatatattttctagacacaaactacagaaatattaatatatattattatgactccttaatattatttttctaatctatattcattaggaagttaacaaatccttaatgtcttaaaaaatagtcaaatgtaaactagcaaattcaaattatctaaaattttcaacatcataacttctgaaaaatagccaacccttattgagcgcttactatgtgccaagcattggtctaagtacattgcacagactgactttttaaatcctcacagctctattgggaggtactatcattattcccattttacaaatgaagaaactgaagcacagaaaagtaacttgcccaaggtcacaaagctaaaaggtagcagagctaggatctgaacccacacagggtggttcctgagcctcaattctccagaatataaaagtcagggaataaggcatttataagtcaggatggaactaggtaagaaaaatatatccagccttcaactcatgccattctgattctactttattaaaaactgtatgatttaacttaaatattatgatgtatatttttaaaaactgaaggagggtaacacaataaagaatggtagaatgaggactttcaaaaattcctcaataaaggcaacaaaaaaactagataaattatttgtcagaatcaaatgtttcagaacactgagaactaaatcaaaggcttgcagaaatctgggtaacatttattcaagaataaaaagaataaacagctgaatatcagtacttcagtcccatccccagcaatcctgtagcctttaaaaatagctcacggccaggcacagtagctcacgcccccagcactttgggaggccgaggtgggaagatcacgaggtcaagagatcaagaccatcctagccaacatggtgagacccccgtctctactaaaaatacaaaaattagctgggtgtggtggcacgcgcctgtagtcctagctactcgggaggctgaggcaggagaaccacttgaacccggcaggcagaggttgcagtgagccaagatagtgcccctgcactccagcctggtgacagagcgagacttcatctcaaaataaataaataaataaataaataaataaataaataaataaataaaaataatagcttgttgggatcctaggtaaagcctggcagtcaccagaaaaaaagagaatggagttacagttctttcagagattcattcccaaagaactgttattctcctgaagttccccggaagaccccacttgcaaggctgactgtatttaacctctgagctcaccaagtacaaaaaaacctcccttgggcggatgtttgtcaaaacaattttacaggaaagtgttttaacttcatggctacctgaggcagtggataacagctgaagcaaaaaaacaaaaaggcttataaagaagagctagggaatgagatgtctgtgagggctttgaaaagctccagtgtatttctggatatctagaaggccgtaagcaagcacagggctggtatgcatgaccagggctgtgcacattctcaagaaagacctgagaaggccctaaacgctcacctttgcctgaacttgagcatttaaacaagccagaagtgaaagctaaagcagagttgtcaggggccttagagtgttgaaggaatgccctaacatacagaagttctcagcaaagaatgtacgatttattagttccagcacaatcatcagctgaccgctaagctaaccaagtacagacttcagtgaccacacacgataaaggatagacatcacagaattaattcaggaaagtcactaacaaacacacactaattacaaaactcagcaacaaaccaccctagaagcctaacaaacacacactaattacaaaactcagcaacaacaaaccaccctgatttccagagctgccacattatttaaaatgtcaatttttcaagaaaaaaagtacaagacatgcaaaaaaaataagaaagtatggtctatacacagggaaaaaaagcaatcaatgtcaactgtccccaagaaagtatagatgtttgacatagtagaaaaagaatttaagtcagttattttaaatatgttcaaaggggctgggcatggtggctcacacttgtaatcccagcactttaggaggctgaagtgtgaggatctcttgaggccaggaatttgagaccagcctgggaaacatagcaagaccccatttctacaaaataaaaatagaaaaattagccaggtatggtggtacatgcctgtagtcccagctattcaggagtctgaggtgggaggactgcttgaatgcaggagttcaaggttacagtgagctatgatcacgccactgcactccagcctgggtaatagagcaagaacctatctctaaaaaattaaaaagttcaaagacctggccgggcacagtggctcacgcctgtaatcccagcactttgggaggccgaggtgggcggatcacgaggtcaggagatcgagaccatcctggctaacacagtgaaaccccgtctctactaaaaatacaaaaaattagccgggcgaggtggcgggtgcctgtagtcccagttactcgggaagctgacacaggagaatgatgtgaacctgggaggcagagcttgcagtgagccgagatcgtgccactgcactccagcctgggcgacaaagcaagactccgtctcaaaaaaaaaaaaaaataagttcaaagacctaaagcaaatcatttctttcgacatgaaaacgcatgtctaaaagcatggagacgatgtctcaccaaacagcaattctagagtcaaaaggtacaataactgaagaaaaaattcaccagagagactcaacagcaaatttgagcaggcataagaaaaatcagcgaagctgaagataggtcaattgagattatacaatctaaggaacaaaaaaatgacacacaacagagcctcagaaacttgtaatatcaagcataccaacacacatacataagagtaccataaggagaaaagagaaaggggcagaaaaaatatttaaagaaataacagccaaaaccttcccaattcgatggaaaccactactctacacatataagaagctcaacaactccaactaaaataaactcaaagagatccacacctggtcacatcataatcaaactgtcaaaagaagtttgagaccagcctgggcaaaagggtaacgacagtttctaaaaaaaaaaaaaaaaaaaaaaaaaaaaaaaaaaaaaaattatttaaaaaaataaaaatttttaagtataattttttgtaatttttgtcctatctcattaaaaagtatataattataaatctttgttgataggtatactacatatataaagatataacttggataacagcacaaaggaaggcaataggatggagctgtgagcaaaggtttttttggggttttctttgttgttgtttttttgagacagagtcttgctgtcaccaggctggagtacagtcgcacaatctcggctcactgcaacctctgactccctagttcatgcgattctcctgcctcagcctcccaagtagctgggactacaggcaggtgccaccatgcccagctaatttttgtatttttagtagagatggggtttcaccatgttggccaggatggtctcaatctcctaacctcgtgatccactcaccttggcctcccaaagcgctgggattacaggcgtgagccaccatgccccatgcccagccacaaagttttttatatactgttaagttggcactaatccaaactaggttcttataaattaagttgttaattgtaatccctaaagcaatcataagtaactcaaaatatatagtaaaagaaacaagggaattaaaatagtacactaaaaaaaaaaatctatttaacataaaaatgagtattggaggccagacccaaatgccacatattgtatcatttcatttacgtgaaatgtcaagaggaggtaaatccatatacacaggaagaagactgattcatggttgccagggactgaggggtagagataatgggagtgactacaaatgggaatgaggtttctttttggagtaatgaaaatgttttggaactagattgtagggatggttgcacaaccttgtgagtattctaaaaactactcaactgtacactttaaaatggtaaattttataataaatgtatctcaattttaaaaaattccttgaaaatatacaagaaagctgcttcaaacctctcccagcatgtctactgactcaagagattacagccagaactaaacagagtattagacagatattcatctctagacttttagagatattatctatgaggcagagctatgttctctcccagtcgccacccctctgccactgcctacaggatgatcttttttaaaccggattatgcaaatcctagaaaatacataaccaaaataaaaaagcagggcacaaaactaacaatttttgagcatttcatctcaaggtattacataattgtaatttatcataataagctatcattaattacaattagttaactgtcgttacaaataagtaattactagaattttaaataaaatatatatgagccaaaatattggagactataaaaacaaaaacatggtcccagcagcaagaaaaaacaggacatataaaaaaacaaaaagacaaagacaagaataacaaaaggaatgagaattaatcataacagtatagtcataccccgcataacaacatttcagcaatgacagaccacatgcattatgcaacagttgttccacaagattataatggggctgccctatagaagtgtaccatttttcatattttatacaatatttttactgtacttttttcatgttatatatgcttaaatacacaaatgtgttacaattgcccacagtattcagtaaagtaacatcttgttcactctgtttccacaaagaaatcacctaacacttttctcagaaagtatcttcattgttaagcaacacataactgtattttaaaatagaaaaagaaataaaccacattataaaataaagcctttgatgggtcaaaaaataaacttaaccatatgcttattgaaaacacactaaaaaaaaaaaaacaaaaaataaaaatgaaataagaataagaaaacaccagagttaaaaataaagaatgctactacataacaaaacgtggtggctaaaggcaacgcaatacttaacacgtttaaagattaaaagattaaatgactcaaattaagtgctcaaatcgcaagtccaacagaaatgaaaagaaaataaatctaagtagaaaaaccgaatgtaagagtaattattaagccaagaaacacaatcattaagaaaaattcaagagagcctgccttgaaaagaaataatgtcatagctaatcaataaaaaagacacgaatgtgtaacacaaagaataaaaacaggaatataatcacctttttaaaaaagtttttaaaaagtttaatggagccaataaggcatataaaattatgttctggcagacattaaaaaaatggcacattttatcaaaatttgacaattcagagtaaagggtactgaaatttaaggttcagagcaccaacttaaaacaaccaaaaaaatggttattcaacttggaaagagtaactagaaccaaggcataaaagggagtttaagtatgtgttcctccaattcaaaatccttcaggaataggagttctggccacttgtgagcaacacatcataccaccaaaccccaattccagaaaattacagttacaattttataaggataaatgattactatgcacaattctatgggaataagtttgaatatctaaataaaatggatgcttttcttcaaaaatgtaactaaccaaaatagaccaaagaagtacctaaattatgctgagtgaaaaacgccagacttaaaatagtacatactgtagaattcaatgtatatgaagttctagaataggcaaaacttatttatagtgatagaagacttgtgtggccgggcgcagtggctcacacctgtaatcccagcactttgggaggccgaggcgggcggatcacgaggtcaggagatacagaccatcctggctaacacggtgaaaccccgtctctaccaaaaatacaaaaaaattagccgggcatggtggcaggcgcctgtagtcccagctacttgggaggctgaggcaggagaatggcatgaacttgggaggcggagcttgcaatgagccgagatcccgccactgcgctccagcctgagaaacagagcgagactccgtctcaaaaaaaacaaaaaaaaagaaaagaaatgagactcgtggctgcctagggcaggaacagggaaaaatgaatgcaataggatacaagatactttgagggagacggatacaatctgtatcttgattggggtagtagttatcaggtatacatctttgtcaaaacactaggatcatacatttaaaatatgtacattttatcatacgtaaaccacatctcaataaagtagaaaaaaaattaaaataacaagtatgcaaagatagtatctcaatttttattatttttataatagtgattaactcaaaaatgtccatcaacaaggaaattataagtccaatatagatgatattcctaatcacattaggcataatatgatctcatttttattaatacataatatgattccaatttacatgcacatgctcacagaaacaagtgtagaagataagttatggttctggatgatagacttcagaagatttaatgcctttttagccatttaaaaataatgaacgtggctgggcgcggtggctcatgcctgtaatcccagcactttggaaggccgaggtgagtggatcacctgaggtcaggggttcaagaccagcctgaccaacatggcaaaacctcatctctcctaaatacaaaaaattagctgggcatgatggcgcatgcctgtaatcccagctacttaggaggctgttgcaggagaaccgcttgaacctgggaggcggaggttgcagtgagccaagattgcaccattgcactccagcctgggcaatgcaagcaagactccgtttcaaaaaaaaaacaaaaacaaataaaagaacatgcattaattataaaataaatgatatctcaacatagtgttcctggaaaaaaataaaatttaaagtatatatatttggcaaaataagaaaactgatgattactttttatcaacacacactagagtttaccgaagtcatagagattattctcagatcaaaaatactgattgttctaagatcaataactaccataatctagtatttcatggtggtataaaataattatcgaaagcaatgtaagttttgaaaaattagcacaaatctgaaacagaaaagctcagaaatgcatatgagagccagagaatatatagatgtgaaataagaactgatagagttcaagaatctattagaaaaaattagaggccgggtgcagcatcccagcacttggagaggccaaggcggacggatcacttgagcccaggagttccagatcagcctggacaacatgccaaaacctaaaaaaaaatacaaaaaaaaaaaatacaaaaattagctgggtatggtggtgaacgccagcagtcccagctactcaggaggctgaattgggagaattgcttgagtctgggaggcagagattgcagtgaggccagatcaggccactgcactccagcctgggcaacaaaacgaaacttggtctcaaaaaaaaagaaaaaaaaaaaaatccaattcacttaagtgaaagaaaatcacactggcctgagaattctatgcaacattaggatatggagattttattacaaagattttattacaaagatatattacaaagattttaaattcagcccaactgtcattaagtccttcataactttcattttatgaaactgtcattcataaaatgccacaagtatgaaaatataaaaacttaggaaatattgtctcttcctaaggaatctcctagacaacacatttcagacaatcaaaaaacaatttgaaacgttccaatgtaaaggaaatacaggagaaaaacaaatccagaacatgaaactcctaaggaatctcctgtcgaacatgcttcagacaccctattgagaagcttaaacataagaaacatacggagaaatgaaagaataaaatccagaagattccacaaaacgatctcctttttgcaacaaatcgatgacatgaacaaggcgctggggtgtgggggtggggtgctacccataataaccaaacataacgcactgaggccaagcatattggctcattcctgtaatcccaacactctgggaggctgaggtgggagggtcacttaaggtatttgttattttttgcgtacaaatatttaactaacttaaagtaaaataaagattaaccgcacacatcacctgcgaattctcttattttctaggttaacgccagaaatataatcaaaatttaattatctactattatactcactactcccgtgtaatagcgtagtccaaccacatgacctctcaaacttccaaataaaacggaatctacttcttcatcactagttagaaagtcatctggagggataacatcttggaattcaaaacgtggaaagaaagttggatatgagaggcgtggaaaatttccatgaactccatactggacagtctgcaagtacttccaaactggatccctatttttttttaaaggcaaagaaaaacaatataatatttaagtatttccaaagaccatatgagtagttttctcatgctttacttcagcaaatgaaatcttacatgggaatcacggtaaagattaatagttactctcgttaaagcaggaattgcagtgagtggagaaggcttctaggaactctacctgttttcaatattggctcttctacctgccccctaggtattcaaaatgaaaagcctagtcagagttcactaacctctttcccagtgaaaatcatctaaattgatatgtatatgatgtctgtaactacaattatgggccggatgcggtggctcacgcctggaatcccagcactttgggaggcagaggcaggtggatcacctgaggtcaggaatttgagaccaacctggccaacattgtgaaaccctgtctactacaaatacaaaaattagccaggcgtggtggcgcccatatgtaatcccagctactcgggaggctgaggcaggagaatcacttgaacccgggaggcgtaggttgcagcgagccgagattgtgccactgcactccagcctggacgacagagcgagactccatgtcaaaaaaataatttaaaaaatgaaatcatatgccaaaatttcaatagggattgagctatataaaagacttataaaaatacaactattaatgtaccagaagttgtttataattttccagaaaatacatccagcatccatcactgtaactccctgcgagcagaacacctattctggtatccaaaccacgccaccgtgggaaattggccccaagccacccgtacccgccttccgtcgccggtttaagcataaccccaaacccattaggtgtaactgtttcgggaatgaccataaataccaatttggacaatgaaaagtgaaggggagtctactggagcattgcaaaaagtttccattctcctaagaacagtcgcttatttgcgatgcgttttccttgcaagtggcgcatatctctactagcgcctctgcaaatacttatctgcacgtctgtgcatacagataagctgtgagccacttggggacaaggactgtcttactcggccctccaccgagcacaatgcctggcgcacagtgggtatctaatggatgttttgttaaataaagcactggccgagatgctttaagccccaggccccccacagtcggtgacagagatttcccaagtccctaacacgggactcgccctaggagcccctactcgccagcgaagacaatgcatttatttctccggcggccacatatgcgaccaacagaacgaatacagctgcacaaatcgcccagggaacgcagaggaacgcggggaaggtcaggttcatttggggacgcctccaggccgttagaccgagcgccccaccccctccgcccccttcacctcttgaacatccaggacatggcgctgagtgggatgacaagaggagcgcctcggctcccctggatcgttttcgagccgcctcgatacgcctccttccaggccccgcagccctgaagccggggacaaattccgagcgccggatcaggagcgcacgactgaaaggtaagtcgccgcgagtccagtcagacgtcgacgccgtctccttctgcaacaatctgggagaccagcgtcgctctgt

SEQ ID NO: 165 - DNA, 34986 bp, Homo Sapiens
tttttatttttagtattttatttttcagattctcagcctctgcacagccttagtactccctgagaaattcagtgtttgcatatcctttccacaaaaatgagaggaaaaaggaccagtacctgctagtgactgatacatttattagtttctaacaaaaaggcatacatggtaggcagagtagaaatactaacagaaattagtttatcttgaaaccaattttagtcaggaagacttcttcacagagaatgagctgaatatataaatcccaaatatatcacaccatatatgtgatatatttacacctaaatatatcacaccctcctttttggtcacagactattccaggaagattaaatagataacgtttaatttgaggcattcaagaatgtccaccctaaaactgaaagtgaaattgctcttagagaaaaattggtttgatgagaagattgatcttagcctgtctcagacaaatttggtttatttatttttacttaacgacccatgtgatagtatagttgcaagctatacttcatttaactacaatcattactcagaggacaatcaccttaagaggcaaattaagttttaaattagcacagaatttataattacccaatcagcattgacatagatgccatcaggtatgcaaagattaacaaaattctattaccaaccttagaggaaaaaaacttaatgacatacagaaatactggcaaatttaagctagaattagctccaggacattttatcttattttcacattaaaagaatagattactagatatcagcagaaatgctgttaaagctattttttactaatagttgttcatattaatgaaacaaaagatcaatagtctctgagctaaatttcacaaaatgaaatcagtgtcttctgatttaactttcaggagtaagaaagggcaaaacccaagcaccatactttctatttctgttcataaactcaaataaaagcagtatcaacacaaatgatcatataagaaaacacgtggttatgtttcaggttccacaacataagacactgtgaggtaactctcctgtaatacattcccatttttttctggaatagcagatgcatagaaatgcaggtttccaaaaattcacccaatttagtaactaattttgattctgatgcctgatagtagggtgtgaaaagctgtaaaacccaaatgtttcctgtgttctttcacaaggacaagggaagaggatgctctgccaaactgcccctgctgcgtcatagtggaccagtttcaatgatccagactgtcagtcaccccatccagcctcatcctcatctggacccatttctcaccacccaatcagtttcaatgatccagactgtcagtcaccccatccagcctcatcctcatctggacccatttctcaccacccaatcagtttcaatgatccagactgtcagtcaccccatccagccacatcctcatctggaccagtttctgaccacccaatcagtttcaatgatccagactgtcagtcaccccatccagccacatcctcatctggaccagtttctgaccacccaatcagtttcaatgatccaaactgtcagtcaccccacccagcctcatctggaccagtttctgacgacccaatcagtttcaatgatccagactgtcagtcaccccatccagcctcatcctcatctggacccgtttctgaccaaccacccaatcagtttcaatgatccagactgtcagtcaccccatccagcctcagcctcatcctcatctggacccgtttctgaccaaccacccaatcagtttcaatgatccagactgtcagtcaccccatccagcctcagcctcatcctcgtctggacccgtttctgacgacctaatcagtttcaatgatccagactgtcagtcaccccatccagcctcatctggaccagtttccgacgacccaatctgtttcaatgatctggactgtcagtcaccccatccagcctcatcccagctcttaactccttctgcatagttcagtttcctttctggcaactaattcccaatttcctagaaaaccctgattttctgatttaacactgattcgaatccactttaaaccaaaggaaacaggccgggcgtggtggctcacgcctataatcccagcactctgggaggccgaagcaggtggatcacctgaggacaggagttcaagaccagcctggccaacatggtgaaatcccatctctactaaaagtacaaaaaaaaaaaaaaattagctgggtagctgggtgtagtggcacatgcctatgatcccagctactcgggaggctgaggcagaagaatcgcttgaactcgggaggcggaggttgcagtgagctgagatcgcgccattgcacaccagcctgcgtgacagagcaagactctgtctccaaaaaaaaaaaaaaaaaaaaaaaaaaaaaaaaatctgggatttcccacatatgaatatgaatccaaattttgaaactccgtctaaaaaaaaaaaacaaacaccaaaggaaatgctacaatgctgaaaattgaattaaattggagatggaaattagattactttaggaaaaccttttgagtactctgtaaacattggacaatagcaagaaaatggattttaaaccctgcatgggttccttaatcactcagaatagtataatcttgctttgattaccagtcacgacaaaaaggtgagcaaaggccataaaacatgcagtttttggaaagacaatggcacttgaagatttcctggagttggccaaagcttaagatatctctaagaattgtaaagcttaatacacatctgttattaagaagggaaacgacaggggacccctgcttaccgctgagctgtgcagaagctcatgtgtctatgcagtccttacaatcacacagaccttcattaaggacaatgagtgtgcctagagagcagcatgaatgacacatggatgaagattccatgataggaaagagcttcacattccagctttactagatcacaaagcactccctttaccaggccttactttgtgcatctctgaaacatctgaaaaacacttttctgtgaaatgctaggctgtagggagtgagcacttttggataccttacagtgatctctagtagaatttggcatctttcttctattaactgactgcttcaactgcatctttaaagacacttgcctatttttgtcccttgagcctctctctggtgttggatgctttgtgtgagtttgccttttgaagttcccatctttgggattcttcctctgtccatttagcactttgtctggaggggaggatgtagcgcgtaagtgatactcatctggggatcctttttgccggtttggcaccatttgctctttatccacctccttctgaagttgtaatgccaataacctgtcctgttcttcttgtttatgtctctcaaacagtagatgctccaaatctatcagtttttgggtaaagtttatttctgtttcctcttgatctggggaagattcgggggacacttttcttctttttgcagaaaagcatggatccttgactgcttcaaaggaagattcttggttttttcttttggaaatctccttactgatcagtaggcacgactcttcattttctgtctcacctgtgttgtttccatttgtctgtgtcacccctgatgtgggggcgcacccactttctgttctgccacaaggcataactgcagtttctttcgagtagggaactctggttttaggtcgctcgtgacttaagacacataactctttcccatgattgcttggtcttgttttgacgtttccttcatggtaccattcggcaccacaggcacataaccatggcataggggactctattgaagaatctgcaccttgttctccaactccaagggatatctgtggagaaagtgtcggcatatcttctatttctgtgtcttgccctgttgggcttttcctatcactactgtcaatgtcctgtagaaaacagaaaaagactgagtgaaccaggggaaaatatcaaatcataagatgtaagtctaattacactgatactacagctggactgtcactatacattattattactaataaggtatatatttctttctttcttttctttttttttcagagtcttgctctgtcgcccaggctggagtgcagtggcgcggtctcagctcactgcaaccttcacctcccaggttcaagtgattctcctgcctcagcctcccaaataggtgtatatttattcttaatagtatttttatttcatgggcaaatttagattaagctattacttcattttcactcccatgaaaacctacagattaaaacccacagactagattccaaatatggccaatagctggtatcaggacctgaccttctttcaccttacaaaggtctgccagcataggggtttttaactcttttctctaccgtggaccctccttttggcatttaggtgaagcttacagaccacttctgagaataatgtttttaactaaaaaattaagatatacagtagctttacaaaaggaacaatttatgttgtaaacacaatcattaaaaggttcaaaaaaatgtgaggtaataatgtgcatctataatacagtaaataataggatctaccagccagtctaataactcataatacccaattatctgtgtcacccctgatgtagtacacccactctctgttttgccacaaggcacaactgcagtctaataccaatgtagagataagtataaatgatatttaaagatatctgtaacatggctgggcacggtggctcatgcctgtaatcacagcacttccggaggctgaggcggacagctcacctgaggtcaggagtttgagaccagcctggccaacatgatgaaaccccatctctactaaaaatacaaaaattagccgggcgtgggggtataagcctgtagtcccagctaccagggaagctgaggatgcaccgagcatccactgtactccagcctggacgatggattctctctcaaaaaataaacaaaacaaaacaaacaagcaaaaaaaaaatacctagtgtttggaagataaagcttgggacttctataagttacttctataagtaacttgactgggtgtatttctcaccaagacccctggaagctagacccattgtttgttataagaaataattgacccttacagggcatgtggtctcaaagtagttaatacactcacttgtgtggcctttttccaggctatcaccttggagctctgctgctgaggactcctgctgaacacacatgcctgatgctgccttactagcatactttttctcatcttgcaatttttttttttttttttttttgaggtggagtctcactctgtcatccaggctggagtgcaatggcgacatctcagctcactgcaacctccgccttccgggttcaagcaatactcctgcctcagcctcctgagtagcagggactacaggtatgtgccacacctggctaattttttttttttttttggtatttttagtagagatggggtttcaccacattggccaggctggtctcgaactcccaactttctgcctgcctcagcctctcaaagtgctaggattacaggcctgagccaccgtgcttggcctcccatcttgtaatattctttttttttttttttttgaaacagagtttcactcttgttgtccaggctggagggcaacggcacgatctcagctcaccgcaacctctacctcccgggttcaagcaattctcctgcctcagcctcccaagtagctgggattacaggcatgcgccaccacacccggctaattttgtatttttttgtagagatggggtttctccatgttggtcaggctgatctcgaacccctgacctcagataatccacctgcctcagtctcccaaagtgctgggattacaggcgtgagccaccgcattcagctccatcttgtaacattctaagtgaagctggtgccaggtataacctattcagttttgtgagtttggattacataggtcaaggatcagtaatctatggctcatggaccaaatccagcctcctgcctgtttttgtaaacaaagttttactggaatgcattcaagctgatgtgtttacatattatctatagatgctttcacactacaccagcgtagctgagaagctgtgacacagatcacactaactgcaaaggcgaaaatattcactctcttagagaaaaactttgctttttgtagtatgtttatttaaaaaattgtagtttcctttggagaaaaagtgctttttctctaggtgagcctaagaggactcagacagggtgtttgattaactataggggcttttgttaaaaggtagaaaactatggatagcactaatctacagcattaatgaaccagcaaaactcagaacatcttcagtatcaacataccttagatacggagtctttcctgacttcttgtacagcttcagagtgtgaggctgacccaaactgagatttcggtgtcaaatacctaaaagaaaagtttaccaaagtttcaatgctttcaaagacagatggtatgtacccaacataataaagctatttataccgaaggttgtctggtttgctgcttggctgttttatcagagtgtatctcatttccgtgcttcagatattttggtcaattccaggacaaaacttaaatgattgagtattgatattttagtgaaaaacagaaaaggaagtaaaagtcaaatctaaatattttttcttttttttttttttttgagatagagtctcgctctgtcacccaggctggagtgcagtggtgtgatctccgctcactgcaagctccgcctcccgagttcacgccattctcctgcctcagcctcccaagtagctgggactacaggcgcccaccaccacgcccggctaatattttgtatttttagtagagacgaggtttcaccgtgttagccaggatggtctcgatctcctgacctcgtgatccgcctgccttggcctcccaaagtgctgggattacaggcgtgagccactgagcccggctaaatatttttttttcttttcttttttttgagacggagtctccctctgtcgcccaggctggagtgcagtggcgcgatctcagctcactgcaacctccgcctcccgggtttaagcgatttttctgccttagcctcctgagtagctgggattacaggcgcccgccaccacgcccggctaatttttgtatttttagtagagacgggtttcaccatgttggtcaggctggtctcgaactcctgacgctcaggtgatccgcctgtctcagcctcccaaagtgctgggattacagccgtgagccactgcgcccagcgtaaatatttcttaattcttgaaaaaagcttaaaaaagcagatagcatcaaaacaatgcaagactctatagtcttcccaaaagtaatgaaaatgatgctttaaactaggagaaaggatatgttagtttcttctttatgctggaaatgttggctgttcacgacattttaaatctctactattgggaaaaagtccatgattaaattccttactattctggtatagagatgttatcatacatacttttatatcaactctcttcttttttttttttttctgagacggagtcttgctctgtcacccaggctggagtgcattggtgcaatctcggctcactgcaaccccgcctcccaggttcaagtgattctcctgcctcagcctcctgagtagttgggattacaggcatgtgccaccacgtccagctaatttttgtatttttagtagagacggggtttcaccatgttggccaggctggtctcgaagtcctgacctcaggtgatccgcctgcttcggcctcccaaagtgctgggataacatgcgtgagccaccgtgcctggccctcaactctcttcttagaaacacatatctttacatttctttctttttttttgagacagagtctcactctgtcgccaggctggagtgccgtgacatgatcttggctcactgcaacctccgcctcccgggttcaagtgattctcctgcctcagcctcctgagtagctgggactacaggcacacgccaccatgccctgctaatttttgtatttttaatagagacagggtttcaccacgttggcctggatggtctcaatctcttgacctcaggtgatccgcctgcctcggcctccctaagtgttgggattacaggcgtgagccactgcacctggtcatatctttacatttctaagaatcttcaatataacaggctgtttgccactgaaaacactacggttttaatagaatggaaaatgttataaaagaacggggaatagaaaaggcaggctacaagatggtaggtatagtttaaaaattgtaaaatatccaaacatgcatataactatgtttacaaatggcagaaatttcccaaaatgttggttgtctccaaatggtggaaactttgggtgattttcaaagagcagctagccatggcttttagaattagagaaaaaaagtgactataaataacagacaaatccataagttacactgtgtcaaaagcaccaacaagtagcatatggaacaatcaaacctaaacaaagatctcatataaagaactaatgaatattccttatgggcaaacaagagtacctaacccatatatttagttatatcaatctatatatttactctgttaactttgaagaacaagaaccaaattttcagttgaaaagaagcttagtctcatttagtttctttaggctgaagaattctttctgtcaatgctgatgcgggaccactacttacgaagcataccagtaccaaagtatcactgttataacagttgttttgacgttcataagcagagaacagaatgttattacttatccaacacaatcactgaagattcattaactctcttggatattccttatttataataaccaagtaatatatgaatacatgctcattctgaaaataagcagaactggccgtggtggttcatgcctgtaattctaacactttgggaggctgaggtgggaggatcgtttgaggccaggagtccgaaaactggacaacacagcaagacccatctctacaaaaaattaaaaagaaaaattagctggacataatggtgtgtgcctatagtcccagctactctgaaggctgaggtgggaggatcgcttgagcccaagagtttgaggctgcagtgagctattttcttgccactgtggcctgggtaacagtgagaccctgtctcttaaacaaaacagaaatacaggaaatatatgtcatcaaccctttcccttcccatgttttaagaacttttttttttcttttttccttgagtctgaatttttgggatccattcccatttgcttccttttatgttttaaattaagtttagcctaaagctgcctccttacgtattttaagttcagcccaaagatttctctgtatatagtgaactacagcctaaagggaggtgtgaacagcctgtaaactactcttgtgccagtcaccaagctttggccaaagggggccaactgttcaaatcatgttcaaataaggcaaatgccaaactgtaaccactctggctgtctctgcccctcatttctgctttccatacatcacgttcccttttctgtctgttaatcttcttccgacatgtggctccacgggagtcgctctcggcctactctggctcgagaggctgcccaatttgtgaattgtcctttgctcaattaaactctgttaatttgtctaaggttctccttttaacatatgtaaccaattttttaaaaatatgatttctatgaaatacacactctttttgattttgtttattttagttattttattttttgggggacagagtctcactctatcgcccagactgaagtacaatggcacaatctctgctcactgcaacctctgcctcccgggtttaagcaactctcctgcctcagcctcccaagtagctgggattacaggcatgcaccaccatgcccagcgaatttttgtatttttggtagagacaggctgatctcgaatgcctgacctcagaagtattgtatttttggtagagacaggacagccaggctggtcttgaactcctgacctcaggtgatccacccacctcggcttcccaaagtgttaggattacaggtgtgagccaccgcacctggccattattttatttatttttttttgagacggcgtctcactctattgcccaggttggagtgcagtggtgcagtctcagctcactgcaacctccacctcctgagttttaagcaattctctctgcctcagcctcccgagtagctgggattacaggtgctcgccaccacacccggctaatttttgtatttttagtagagatggggtttcgccatgttggccaggctggtcttgaactcctgacctcaggtgatccacccgcctcggcctcccaaagtgctgggattacaggtgtgagccaccgtgcctggcttcattattttttaaggcagggtcttgctgtcaccaaggctgaagtgcagtagcaccatcatagctcacggcagccttgacctcccaggttcacgtgatcctgccacctcagcctcccaaacatctgagaccacaggcacaccacgcccggctaatttttgttattttttgtagagacagggtttccgcatgttgcccaggctggtctcaaactcctaggctcaagtgatccacctgccttggcctcccaaagtgctgggattgcaggtatgagccaacacacccagcctcacgcttttttttttgagacggactatcgcccaggctggagtgcagtggtgtgacctcggctcactgcaacctccgcctcccaggttcaagcaattctcctggctcagcctccccagtagcgggattacaggcgtccgccaccacgcctggctaatttttttgtatttttagtagaaacggggtttcaccatgttggccaggctggttttgaactcctgacctcaagtgatctgcctgcctcaccctcccaaagtgctaggattacacgcataagctactgcgcccggcttgtgatttgcttttttcactaatgtcttaagatctttccaagtctgcctcatgaaaacaaagtttatgagagaacagtcatacaatacatgtaagaatcacagtacagcacggtcacggggagggggacactgactggaaagggaaagggcacaagcaaacctttgtaaatattccgtcttcatctggtgggtggtttatacacacacaaaaattcaccagaaagtatacttaggattggtgcaccgtctttttaaattttttactttttcttttttaccctgtcttatggtgccgaagactggtgcactttaaaatatatgtttgctgctctgtggtccattaaaaacaaaacaaaaaaatgtgttattcttctaaaaagtttaaaaatctgtattaccatgaaagcccatatgcttattacttggttgaagggaaaagaaatcattggtttgaaagtctcctatggggcctcgtcatctcccacctcatactatcctgagtttcttatatcttactttttaaaacagatttgccacacttttgcatctctaaacactttattgattagtattgtgtgattctgagcgagactccgtctcaaaagaaaaatttgaaaagttggaattctgattcgaattgcactgactctatagatcagtctgaggagatctgaccattttgtagtattaggcatcttctaacccatgaatattgtatatttaatataatacaattttctccacgggtcgtacagatttttatttttctgagacatggtcttgtctgttgcccaggctggagtgcagtggtaaaatcacagctcactgcagccgtaacctcccaggctcaagtgatcctcctgcctcagccacctgagcagctgggactacaggtgtgcatcatcatgcctggttaattttttaatttttttttaagagatagggtctccctgtgcagctcgggctcgtcttgaactcctgggctcaagcaatcctctcgcctcagtctcccgaagtgctgggattataggcatgagccaccatgcttgcctcagattttaacacatttatttttaagtacttttattttctgatactactatcgacagagtatttttaaagttacattttacaattgactttttgtacagattttatatctggcaaccttgctaaactcttcattctaaaaatgtacctctgactttttgggttttctacatagataattataccgcctctgaagaatgatagctgctttttccttcctttccaggctgatatgttttatctccttttattgtgttactgtgcagactaaactctccagcatgagtctgaatgcaggtggagagtagcaggccacccttgcgtattcctgaccttacaaggggaatggcggggcgtggcggctcactcctgtaatccaggcaccttgggaggcccaggcgggaggatcacttgtacccaggagtttgaggttgcagtgggccatgatcgcaccactgcgctctagcctgggtgacagggcaagaaagactgtctggaaaaaaaaaaaaaggaaataatttcgatgttccactatgaagtatgatatgtgatgtaagattttggtagatatccttcaacaggttaagaaagtttctttctgttaccacttcattaagaattatcatctcgtgtatttcatatttatacagctaattgaataacttacagtgattcattttctaccattaaaccagcaatgtattcctggaattgtctttttaaatacgttttcagctgcgtttttttttttttttttttttttttttgagatatgatcatagctcactgcagcttcgacctcttgggctcaagcaattctcccacctcagcctcccaagtggctggggttacaggcatgtgccactgcatttggctaatttttttattttgtgtagagacagggtcttactatgttgcccaggctggtcttgaactcctcctggcctcaagcaatcctaccacctcagacctcagcctcccaaagtgctgggattataggcatgagccactgtccctggcttttttttttttttttttttagagacaggatcttgctatgctgtccaagctggtcccaaactcaaactccctgggcttaagcaatcctcctgcctcagcctcccatgtagctgggattacaggtacgtgccacaacacctggctgccctttcttcttttctgatacggcacgtaaagccttctaaataccactttagccacataccagttttcatgcatattttcagttctgtatttccaacaaaatttactctttaatcaacaagttgtttagaaatttttcttaattttaaaactatataatcctgttattcatttttaaacttttgaattgaggtgtaattcacataaaatggaatgccacattttgtttacccattcatttgttaatggacatttgggttgtttctacctttcggttatttgaataatgttgacacaaatattcatgtacaagtatttgtttgaatacctgctttcaattcttttgggtacatacctaggagtggaattgctgggtcatatgctaattccgtttaacttttcaaggaatcaccaactgttttctgcagccacgataccactttacattcctaccaagcaatgcgcaaggattccaatttctccacatctttgtcaacacttattattttccctttttgtggattatagccatcctaatgggtatgaaatgctatatcactgtggttttgatatgcatttccctaataactaatgatgttaaacatattttcgtgtacttattggccacttgtacatcatgggaaaaatgtctactcaagtccctttgtccagtttttaattatttgtcttctgttgttgagttataagagttttcatatattctagaaaacagactttatctgtttttaatattgttacaactttaatccatcagtttctcaatttttgcttttaaatccttagtttttcttgtatctctggtaattttttatttttatgtatttcaaagtatatatttagatatataaagattcatgagttatagccttaaacagcatattgtatcaatatgaaatacttctgcattttagcggttttctcatttttactttgcacattatgagtactggcgacactgatattgtcacatctttttttttttttaatagtacctccctcatttaacattctcttctcctaagcttcctcccacctcaaatacaaaatttcaacaaatcttggaaggagatgagttacctgcacatatttcctcagttgaaccagaagtccttatgtatttttcaagtctagactgtggtttttaaacttttccaactgtgagttaccatgggaaagctgatgtttgcgtaaagccaccaactccacctggcacctgaccctggaggggtgttgtggtgaaactcaatcacgccacctttgtctacctgactcatgcattttgtgtaatagagaagaaatgacaaattgtaaactctttcagtgaagataagcctatctgggacccatttttttcatctgaatttaaaccaagagaaagaggaatccaatggttcactttgagaaaactggaaatcctgaggcagtaagataaaagtatgaatctgccacagtaagtggctgagtgagaagccaagaggaagctgtgtgagtagctctctccttttcaatttacctcaacctcagactattttcatacaaagttcacggaccaaactttgagaatcagtagtagtctatatgaacagaaaacactggcatacagtaggaggtcaacaaataattcatagtcatgttcacttacttctgaatatctccagtgtttctttgtttgttcttacttttcttttcagacttgggtgtaactggatcagattttctggaattcaagggagaagccgagatacttccctcacagaaattgttcttcaacaatagaaaaagcataacagacattatgagagagaactttatgataaaataagctattaatttgactaattcagaaatccatagcatttttcagaaattatagttatatttaaattctgtacatctcttgaagaatattgaccatgcaaaaatcagaataaactatgttcatccaagttggtctaaattaattacatttttactgtacatcaagcacaaaataaggcataatactaacctcattagctgataattcctgttgatctttctttcctttttttttttttttttgagacgcagtctcgctctgttgcccaggctggagtgcagtggcgcgatctcggctcactgcaagctccacccccgcaggttcatgccattctcctgcctcagcctcctgagtagctgggactaccggcgccctccaccatgcccggctaattttttgtattttttttagtagagatggggtttcactgtgttagccaggatggtctcgatttcctgacctcatgatctgcctgcctcggcctcccaaagtgctgggattacaggcatgaggcaccgcgcccggccttttttttttttttttttttttttttaagacagggtctcactctgtcgccgaggctggagtgcagtgtagcaatcatggctccttgcaaccttgacctcccaggttcaagtgatcctcccaccttcacctcccaagtagctaggactacaggcatgagccaccaggcttggttaggtgggttgtttttgttttattttgagacagagtcttgctctgtcatccaggctggactgcagtggagtgatcatagctcactgtagcctcaacctcctgggctcaggcaatcctcccatcttagcttctcgagtagctaggacacaggcatgtgccaccatgcccagctacttttttttaaatgctttgtaaagatgaggtctcactatgttgcccaggctggtctccaactattggaatcaagtgattcccccaccacagccttccaaagtgttcggattataggtctgtgccactgtgcccagcctgttgatttttctaataaatacttttatataattacttttatctatatggacatattcagagagctgtggatatacccaaaagaatagttttatgtaataatattttagttctggactttaagggcgtattaataaaaatcacaaatatttacttgctgtaccagtctcgtaagtttcttactaccctaatggaaaagttcatatatggtgatggtgaatatttggccttaaaccaccaaactttcataaataaatagaaaattattctaggttgggcatggtggttcatgcctgtaatcccagcactttgggaggctgaggtgggtggatcacatgaggccaggagttcaagaccagcctggccaacatggtgaaaccccatcggcactaaaaatacaaaaattaacaggatgtggtggcggcacctgtaatcccagatactctggaggctgaggcaggagcatcgcttgaaccgggagttgaggttgcactactgcactccagcctgggtgacagagtgagactcttgtctcaaaaaaaaaaaaagttaaaaaaattattctacagtatcaataaatctactcttataataccatgggaaaactagatatacttcttccctattccatttattattccattggtcaatgacttttatttagtttcctgattgtgtatttctaaagcgattctacttaaaaaagacacataaaaaggggcatataacccaaaatttgggtacattattattaatggtaggcctctcaaaaaagaaaaaaattcccaattctgcgtatactcattttgctaagtgtatatacatatatatttttttattctattgaacttcccatgattcaatggtaagtgtatgttaagatattcgttgtttgaaagctgaagaattgttttcacaggctctcaaacctgaatgtttcacacttccctacatgcctctgaagattgtattccctaggtcccatccctagagactctgacttaatagatttggagtaaatatgagagtttgtatttcaacagcattcccaggttactctgccaggctcgttcaaaccactgggccccacagtaccctctgatcttaaagtatgtgttttatcacacaccatttaattcattttcttacaggcagcaatttaactacaggaagcagaacatccaagtttaatacattatctaaaaatttaatgtgccttactttcaaaatgtgatttacatccataaaatggaatattattccactctttaaaagaattagattgactacatgtagtaatatgaaaaatctctacgatgttatcaagtggaaaaaatgtaagcagcaaaacagtgtgattgctttatataatcctttttaggtcaataaagaaaaaaagcttttttttttgagatggtcttccaggttgaagtgcagtggcgagatcagctcactgtaacctcaaactcctgggctcaagggatcctcctgcctcagcccctcccagcaggtggagctccaggcacgcaccatcacactcggctcattattaatttttctgaagaaacagggtctcactttgttgcccaggctggtctcaaactcctgggctcaagcgatcctctcgcctcagcttcccaatgtactgggattacaggcccgagccatcgcaccctggcaagaaaaaagttgtaagaaactgttaatagtggttacctttggggatagagactgatataaatggaaaaggaacgggagtggagaggtggaagaaggaaaaaggaagctttcattcttcactgaatagctttcctacatataaaaaagttgttaaacaacttgcggtggctcacgccacaaacccagcactttgagacgccgaggcagatggacggcttgagcccaggagctcgacaccagttcaggaaacatggcaaagccctgtctccacaaaaaagtagccaggcatggtagtgccagcctgtagtcccagctactcgggaggttggaaggatcaccggagcccggccgtcgaggctgcagtgagtcgtgattgtgccactgcactccaacctgcatgacagagtaagacctgtctcaaaaaacaaaaaaccccaaaaacctggattagagcaaatatgtaacaatatgcaaaacaattttactttaagtaaagcaaaaatgttatcaatagcttctaattatggcaacgccatctcttctgttctttgaaaaccacagtcaaagcaatcggaatgttaatagttagctttccgtatcagcaggttccaaacactcaaatccaaccagcctggggtggaaaagacaatatttgtgggatgcagaacctggaaatacaaggagctgactcttcccatgagcgggttctgcagcagcgcataccaagggatgaccataccttagcgttccctcctaaaacttacaatatcaatgcttagctttcttgccagttcctcatcacttttcagttgttcttccatcgctcttcgccttttttctgcctgtcttttttcctcttcttcctcctctgccaacaacctctgtatgtattcttcactggctttgttttcttcttcctcgctggcccgtcgctctgccgccaccttaaaagtgattaataaagagcaatccttctctgaacgttttggtatacttgcaatatttcataacaagaatagaaaagtagaaaaagaacaaattggcagaaatttaaatgatctcaaatgaagtacaaatctggagaagtagattcctgcaagatagctgtcccatctcagcctcccaaagcactgaaattataggtgtgagcctccacacctagcctgagatgtattacaagtgaaaattatacacaaaattttgaagactaacaaaaaaagagaaaaatctctatttatgtataacttcatatgtaattaaaacataatgcttcactataaacactgctttttaggtacttttcctatttaggaacttcacagctagccctttaacctttcctcatctaaactcacactctaccacccttttactttaagctcaaaactttggggaaataaaaatatatcctggtatggattaaattaggaaaaagaagaattaaaaaattttcttcatatgtaaatgcttagggaacactatcacataagagcattaattatgtagaagtaaattacagcaaaaaacaaagcccttataaagtacattaaaattatccatattttggccaggcacagtggctcacacctataatcccagcactttgggaggccgaggcgggcggatcacaaggtcaggagatcgagaccatcctggtgaacactgtgaaaccccatctctactaaaaatacaaaaaaattagccaggcgtagtggcgggcgcctgtagtcccagctactcgggaggctgaggcaggagaatggcatgaacccgggaggtggaggttgcagtgagccgagattgcgccactgcactccagcctgggtgacagagtgagactccatctcaaaaaaaaaaaattatccatatttcaagatatactagttatataagcacaaaaaactaaattaaaatctgaaactaaaaacacagcagagaaatattccaaaaaaaaaaactatttagcacctaccttgcttatttcctcttcatattctcttctcagttccccaggtttactgagcagacgaactggctgatagtcatcagctatttcatatcaaaaaagaaaataacattataggcaacacaattttatggtaactttggtcttccattaaaacgaaaaattaaaatatacaactattaataactgcagcaatatctccttttggaattccatttttaacatttattttatttatttattttagatttattttatttattttttttgagacagagccttgctctgctgcccaggctggagtgcagtggcacagtctcggctcactgcaacctccacctcccaggttcaagcgattctcctgcctcagccttctcctgagcagctgggattacaggcatgcgccaccacacccagctaattttttatatttttggtagagtcagggtttcaccacattggccaggctggtctcgagctcctgacctcaagtgatccacccgccttggcctcccaaagtgctgcgattacaggtgtgagccaccacgcccggcctggaattccattttgtgaggccagaggtttagggttttgggtttgaaatggcatatgaatgcatatacttaacccttcctctaaactccattaaaataacagtaaaggaatttttaaaaactgtaatcctacaacagcagaaattagcagaggaggttaactgattaaaaaaaaatgttttttttttttgagacagagtcttgctctgtcacccaggctggagtgcagtggtgcaatctcagctcactgcaacctccgcctcccgggttcaaacaattattgtgcctcagtgtcctgagtagctgggatcacaggcatgcccaaccatgcccagctaatttttgtatttttaatacagaccggtttttgccatgttggccaggctggtttcgaactcctaatgtcgggcaatctgctcacctcagcctcccaaagtgctgggactacaggcgtgagccaccgtgcccggctccagttaaaaaatttttaacaaatttctagaaaatgggaaggcaatgaaatagagataattgatacagcagaaatgaaggaaaagaaatccttgaaagggaagactacagctgaggtagaattagaagggaatctgcctcctatttgcctagagagaggctcatagagtccagagtgagtaaccgtgggactgaaaacagaactcgagatttataagctgttaaatcagaatcctcgacttaccggcatttctccctggatatgggtgcaggtgcacacacgcatatttctttaaagaaacagatctagagagagccagagcagctaatgtaataggtggtgacccagagcaaagtcctctgcgatcgggcagttagggatggcaaagcacaaaggccaggtttccatcggcttgaactcaacgtctgcccatcaccaatacccttccacatacacagagcttttctcctgggcctcattctcaaacctaaaagctaatccaaggatcgtcagacatttgaaatacatctgcaggactagggaaacagtaagctatacaaagagaaaaaatcatcaccctggagttgaaagataattctgggtcagaaaataacctaaatgtgggtatgtatcctcaacaaatctgatgagaattttattctataaaacaagacactgttttataaagtgtaaaaagggaacatccaaaaaagagaacgcatctgtctgtttcaaggggcagctgctactcaactccagctgactacgactaccaggaaactcaggcctgtccgtgccatattttttgctttctcaagaaaatccagaggcggcaggggtggatggtgagagatgacttcatgggtacaatgtacattatttgggtagcagataccctaaagagccctgacttcgccactgtgcaatctatacatgtaacaaaattacccttgcaccccataaatttatccaagtaaaaagaaaaaaaaaaagaaaatccagcaatcaagatgttaatatgaaatcttccaacttaaatagtggcattggatgggtcacaaaaaacatgcacacaggattcctatggcctgcaggccagcagtttgaaaaatctgcaacagagagactaaaaaacagtgatgtaactccaaaacaattagggatgcagtatgctgaattctcatttattttagtcactaaggaggatctattcaagacaatacaatggtatacacaggagagacatatataaggctccttaaaaagtagaaggataatcagctggcttaaactgagacctagatcagcaagtcttaaagtagaatctacgaaaccctggaggtatctgagactttttttcagggaaactgcagagtcaaactattttcatttaaaaaattaaagtaagctgggagcggtggctcacgcctgtaatcccagcactttgggaggctgaggcaggcggatcatgaggtcaggagttcgagaccagcctggccaatatggtgaaaccccgtctatactaagaatacaaaaattagccaggcgtggtggcacgcacctgtagtctcagctactcgggaggctgaggcagtagaatagcttgaacccgggaggcggaggctgcagtgagccgacattgcaccactacactccagcctggacgacagagggagattccgtctcaaaacaaacaaacaaagaaacaaacaaaaaacccaaataaaacaactgacagtaggccgggcacagtggctcatgcctgtaatcacagcattttgggaggccgaggcaggtggatcacttgaggtcaagagtttgagaccagcctgaccaacacggtgaaacccgtctctaccaaaaaatacaaaaagccgggagtggtggcaggcacctgtaattccaactactcgagaggctgacacagaagaattgcttgaacccgggaggcggagcttgcagtgagccgagatcacgccactgcactccagcctgggcgacagagggaggctccgtctcacaaacaaacaaaaacacatgttcaacattactagtcattagggaagtgcaaatcctgagtacggagataccgcttcagaggacagccaacacttggttttttttttataatagtcatccattaagatatatacacacacataatggagtatgcggccaaaaaaggaaatggaatggacacgtgctagaacacgatggaccttcaagacactacgctgcgtgaaacagccagtcaccaaaggacagacactgtgtggggttccactcgtacgagacacctagagcaattaaacccgtagaggcagaaagaatggaggtcgccagcagccaggggaggggtgaatggggaattaattattgtttaatgggcagtttcaagcgtggaagatgagaaagttcagagatgaatggtggtgacggctgcacaaaaacatgaatgtacttcatgtcacgcaactgtccatttaaaaatggttaacatggcggattttatgttatgtatcttttacaataaaactggaaaaaaagtaaatcactttacacattagatacaataaaatagtagctaagaggctgggcacagtggctcatgcctgtaatcccagcactttggaaggctgaggcaggaggaccacttgagctcaggctatcaagaccagcctgggcaacatagcaagaccccatctttgttcaaaaaaattttttttaagtagctaatttaggaaaacaataataagacagatgtattatactagaaagcaaaacatatcattaagcagaattaaactaagcatgtgtggtactgacacagctactgataaagagatagttaaaaaataaaaagcccaggcaaggtgccatggctcatgcctgtaatcccggcactttgggaggtggaggcaggcggatcacttgaggtcaggagttcaaaaccagcctggccaacaaggcaaataaccctatgtctactaaaaatacaaaaattagccacgtgtggtggtgcacgcctgtaatcccagctactcaagaggctgagacaggagaatcgcttgaacccgagaggcagaggttgcagtgagccaagatcgcaccattgcactccagcctgggtgacagagagagactccatctcaaataaataaataaataaataaataaaataaataaatagccccaaattgctctggaaaataagcatatgattagtgaaatagtacgtatatcaatgtggctgtattactaccaagtagtgtggctattaagtggcaatcaagggcagggggagttaagatgcctacctcatacaatactcgaattcaaggtggattaaaaaatggaaaaaaacaaaactataaacgactaagaagaacatatgagataaattccaaaacaattaaaacttccatgtgatgaaagacatcacaaagttaaaaacaaactagaagttatttgcaaatacataaatcaccagagaattagtgtccagaatataactagaacttccacagatcaattaaaaaccacaacaggcaaaggaaaggcacgtgcgatttacagaagatgcccaactacagcaagcagagagctgaacttttgttaaaccgtggaatgacagatttttaaagtttacttatttctacataaactgaatctaaattaagatcagtgagttattcaactgcagacacaagttaaaattgtcttcatttgcctttttcttttgtttttggaaacaagatctcactcttgcccaggctggagttcagtggcgggatcatagctcactgcagcctccaaccccttggctgaagcgattctcctgccctagcctcctgaagcactgggataacaggtgtgagccactgcatccagtccatttgctatttctttttcttctttgacggagtttcgctcttgttgcccaggctggagtacaatggcgcaatctcaggtaactgcagcctccacctcccgggttcaagcaattctcctgcctcagcctcctgagtagctgggattacaggcatgtcccaccacgcccagctaattttttgtaattttagtagagacgggggttttaccatgttggccaggctggtcttgaactcctgacctcaggtgatccacctgccttccaaagtgccaggattacaggtgtgagccaccgtgcccagccttccatttgctatttctttctttttttaaatttatttttttttttttttgagacagagtctcactttgtcactcaggctgcagtgcagtggtgcaatctcagctcactgcagtgtccacctcccaggctcaagcaatgctactgcctgagcctcccatgtagctgagactacaggcgcccaccaccacacccggctaatttttgtattttttgtagacggttttgccctattggccaggctggtctcacactctcaggctcaagcgatttgcctgccttgaactctcaagtactgagattacaggtgtgagcccccgcacctggcctgtttgctatttcttaaacaactctaattttataagaaatttgaatatctcagttttatagtcttaaagtgactatacaatttttgccatctgttggaaacaactctcgacactcttcagttctggttaactctaaaatttctgctgaaacccacttcggttaaacattcctactctactcgatattttgcttcttcgcagcaagtggtcttcctaggcggccaggactcatttaaggaaatatgtccccatgctttttattttattttgaaggaaaaattcaagttagttaaagacctgaatgtataatactggatgaaaaataaaaataaataataagccttaacttgaacagttgagctgttcataaaactgccctcccatcactgaactagactgcagctccatgtaaatggcagtttccttctcccaattaaatgtgcattcctgggctgggcacagggtacaaaataaagagatagttaaaaaataaaaagcccaaagttgctctggaaaataagcatatgatttgtgaagcagtatgtacatcagtgtggctggatcatcaccaagtagtgtggctataaatggcaatcaggggcaaagtgctcacacctgtgatcccagcactttgcgaggatgaggcaggagtatcacttgagctcaggagttcaagaccagcctcggtaacatagtgagaccctatctctacaaaaaataaaaaaattagcctggcgtagtggtgtgtgcctgtggtcccagctactcaggaggttgaggtgggaggattgcttgagcccgggcggtggagggtacagtgagccaagatcgctccctggcattccagcctgggcgactaagtgagaccctgtctcgaaaataaaataacataaactaaatttgcactttctgcctcaatatttattttgaaaattttcaaatctacagaaattgcaaaaatagtatgataaacccccgtttaacctgcatttagattcatgaagtttttaaactgccacattgcctttcgtgtgtgtgtgtgtgtattttctgaaccatttgaaagttgcatgatcataacccttcaccaaatccttacgtgtccacctcataagagatgctgtccttatctcttgatttgatatacaatgatcaagttcaagaaaattaacattgatatattacccatcatatcaatgataaaaatttcaccaactatccccatgtctttaataacaacctttgtcctaatccatgttctaatccagggtcatgcactgcatttagctgtcattctcttttaatctccctttcaactagaatgattcctaaggctttgccttcatgacactgacatttttgaggtactaacaactacgttttgtagaatttcaatttgggtttttgttttctcacagttagattcaggttatgccttatactcgtcctatcaggaggaccgcaatgtttgtttgttccatggataacgttaactgtgatcacttcattactgtggtaacaggcttctcgactgtatccttcaccctttgtaattaataagcaatctgtaagatgatattttcagactatatgagtcctccgttctccggcaaattttcaagcagggattttggcatccgtttgtaattcttgcctgcatcaatttttacagtgacagtcgcaaacagaaaggaaatttagacattctaaggctgattcttccctactataggattcttttttgagaaatccaaatgtaaaacacacctgtctccgtcacactaattcactttcaaatacttcattttttaaagctatctcatatgtgctttcttacaaccttccttccataaattaaaaatacataaagtaaatgagtagattcactttatgtattatgtgttaacaaagttaacacagaaacaccaattatatttttataaattatcaatgaacaatactgaaaattttttaaaatttacttaaaacagtctcaaaagccataatataattagggataaatattagtttcttagggccaccatagaaaagtaccacaaattgcgtgacttgaaaatacagcaatttattttctcacagttctggctaaaagtccaaaataaatgtgtcagcagggccatgacacttttcaaacttgtaggggatccttccttgcctcttccttgcttctgacagtatgctgataaccttagacgttccttgggttgtaaatacatcactccagtcctccagcctcacgtggtactctgtgtctttacatcatcttccttctgtgcgtgtctgtctctgtgtccaaatttctcctttttataaggaaaccagtcataatggattagggcccattctaatgaccttattttaacttcattactgaaaaaaattgaaggtgacctacacaaacagagaaatatactattttcatggatacaaggactctgttgctgtttggatgtcaattctccccaaattgttctattaagttcaatgcaaccccaatcaaactcctaacaggctgttagtagaaactggtaagttgattgaaaaatttaaataggctgggtgtggcggttcaggcctgtaattccagcacttcaggaggctgagacgggaggactgcttgaggtgagctgttcaagaccagcctgggcagcatagcaaaaccccgtctctacatacaaagaataaatatacggaggacgggcacgatggctcacgcctgtaatcccagcactttggaaggtcgaggcaggagtatcatctgaggtcaagagttcgagaccagcctggccaatgtggtgaaactcccgtctctattaaaaatacaaaaattagccaggcatggtggtacatgcctgtaatcgcagctactcaggaggctgaggaaggagaactgcttgaacctgggaggcagaggatgtagtgagctgagatcacgccactgcactccagcctaggcaacagagcaagactctgtctcaaaaagaaaaaaaaagatttactctaaagtcacagtaatcaagacagtgtgacactaatattagaatcaacggatcaatgaaatagaatagacccacattattttttttaaaaagtcttttcaacaaaaggtacagaaataactgatacccatatgggaaaaagttaacctcaaccccctaacttatacaatattcaaaattaatttgaaatggatcaaagacctaaacataaaagttaaaactggccagacacagtggctcacacctgtaatcctcgcactttgggaggccaaggcaggcggatcacgaggtcaggacttcaagaccagcctggccaacatggtgaagccccatctctacaaaaaatacaaaaattagccaggcatggtggtgcgtgcctgtagtcccagctactcaggaggctgagggaggagaatcgcttgaacctgggaggtggaggttgcagtgagccatcacgccactgcactccagcctgggcgacacaacgaaattcagtctccaaaaaaaaaaggtaaaactataaatcttttagaaaaaaaaatagcaatatcttagcctgaaggtagctaaaggtttcttagaccataaaaagcaataaactataaaaggaaaaatttatgagacttcatgaaaattaagaatttcagctcgtcaaaacaattaagaatatctggcaaagtaccagtattcaaaatacataaataatgtctacaactgaatataaacaatttaggggaaaaagaattaaacagacactttacaatggaagagggcaaaactgtcaataagcacatgaaaaagaacactatcattagttacctggaaattgaaattaaaacaagatactactatcaatacaaatcaactggaatggttaaatctaaaaagacagataacatcaaaagttggtaagatgtacggcaaccagaacctgtatgctgttggtgggattacaaaatgacacaaccactttcgaaaaagatctggtagtttcttctttctttttttgagatggagtctcactctgtcaccgaggctagagtgcagtggcgcgatctaggctcactgcaacctctgcctcctgggttcaagcaattctctgcctcagcctcccgagtggctggtattacaggtgcccgccaccacacccggctaatttttgtatttttagtagatggggtttcagcatcttggccaggctggtcttgaactcctgaccttgtgatccacccgcctcggcctcccaaagtgcgtgagccaccatgcctggcaggtagtttcttataaaaatatgtacctattctacgttgcgtaattccagctcctaagtatttaaccaaaaaaaccctgaaaacataaggccacacatacacacacagagacacaaaaacttgcacaagaaccttctcagcaactttattcataatatccaaaactgcaagcaactgaagcactgtatcagtggagaatggccaatcatatacagcatagtcaatggtggaataatacttaaaaaacgaatatctacacaagaataaatcttgaggccaggcgcggtggctcatgcctgtaatcccagcactttgggaggccgaggcgggtggatcacctgaggtcaggagttcgacaccaggctgggcaacatggtgaaaccccatctctactaaaaatacaaaaattagccaggcatggtggtgcgtgcctgtaatcccagctacttaggaggctgaggcaggagaatcacttgaacccaggagacggaggttgcagtgagccgagatcctgtcactgcattccagactgggtgacagaacaagactgtctcaaaaaaaaaaaaagaataaatcttgaaccttatgctgaataaccccccaaaagatatgcttaagtcctaactcccagtaactaagaatgtggtcttaactggaaacaggttgttacagatataatggagttcatacaaagagtacagagcctttaatccaatataactagtgtcctggtaaaaaaaaaagagagagacacagaggagacggccatgtaaagacagacacaccgggaaactctacgtgccaatggaggcagagactggagtgactcagctgcaaaccaggaacaccatggattccagccacaccagaagctaaggagaagggcacggaacagattctctcccagagccttcaatgtacatgtccctgctccctgctagcatcttgggtttggagttctactcttcagaactgagggagaataaatttctgctaagttcgtggtactttgttacagtagccctaggaaataaaaagaattccatttatatgaagttccagaacagaaaaaactcatctatggtggataaaaactaaaacagcccggacgcggtggctcacgcttgtaatcccagcacttttggaggccaagacaggtggatcacgaggtcaagagattgagaccatcctgaccaacacagcaaaaccccatctctactaacaatacaaaaattagttgggtgtggtgtcgcatgcctgtaatcccagctactcaggaggctgaggcaggagaatgcccacaactcaaaaaaacaacctgattaaatgacaggcaaagttgtggctttttctgggttttgggagaaaaacagaaacaaaaagaatgaatgagcacaggatttgaatagatatttcatatttttccgaagatgatatacaaatggccaataaatgcatgcaaagatgctcgccatccttagtcattggggacatgcaaataaaaaccacaatgggataccacctcatactcaccaggatggctactatcaaaacccagaaaatagcaagtgttggcgagggtgcagagaaactggacacccacgcactgttggtgggaatgtaaaacggtacagtcactgtggaaaacagtatggcggtttccaaaaccaatcacacatagaattaccataggatctagaaattccacttccaggtatacacccaaaagaatagaaaacaggcccctgaacagacatttgtacacccaagttcacaccagcattatttctaatagccgagaagtggaagcaagccaagtgtccactgacagaggaacagatttcttttaatgtagcatatacatacactggaacattattcagcctggaaaagaagggaatgctgtcacatgcagtatggatgaacctggaaaacattacgctaggtaaaacaggccagacacaaaaggacaaaacctatgaaaattccacttacaggaggtacctagaagcagtcgggttcacagaaatggaaaggagaacggtggttgccaggggatagtaggagggaggaacggtgagcctcaagggtgtggaaattcagtttgggaggattaaaaagttctggagatggacggtggtgacggatgcacagcagtgtgaacggaggcgatgccactgaaccatacaattacaaacggttaaaattttcctcccttctttctagtcaaaaacatttttaagtggttaaaatggtaatcttgctatattttaccacaattttttttttttgaaacggagtctcgctctgtctcccaggctggagtgcggtggcgtgatctcggctcactgcaagctccgcctcccgggttcacgccattctccggcctcagcctcccgagtagctgggactacaggcgcgtgccaacatgcccggctaattttttgtatttttagtagagagggggtttcaccgtgttagccaggatggtctcgatctcctgacctcgtgatccgcccgcctcggcctcccaaagtgctgggattacaggcgtgagccgccgcgcccggccccgcaattttttgacacacagagttaagataccagttcacatgtactagcatggcacggaaaataacaagtgttggtgaggaagtgaagaaactggaaacttcgtactctgctaatggaaatgtaaaatggtacagccactgtagaaatcaatgtggcagttcctcaaaaagctaaacacagaattaccataggatccagcaattccactcgtagatatatagacaaaagaactgaacacaggtattcaaacacatactggtacataaatgttcgtatcgccagtattcaaataacgaaaaggtgaaaaaaaccaatgtccagccaatggataaacaaaatgtaacaagtatatccgtaaaacaaattattattcagcccgaaaaatgaagtactgatccatgccacactgtacatgaacctcagaaacacgctaagtgaaataagctagacacacaagatcctatattgcatgagtcccttctatgaaatacctagaatggccagattcatagagacagaaagtggaatagaaggtgccgaggctggggggaaaggtgaaatggggagtcagtgcctcacggttagagtttatctggggtgatgaaaagttctggaaacagtggtgatggttacattgtgaatgtaattaatgctattgaattgtacttaaaaatggttaaaatgtcagtttgttatatacattttggacaatattttaaaaataacgcaatataccaaaaaccattaaattgcacacttttaaacattttactgaatttatgttacccagaccggcctcaactcctgggttcaagagatcctcccacctccgcctcccaaagcgctgggattacagctgtgagccatcgctcccggccaaccgcacacttttagtaggtgaattgtatggtctgcgagcatttgaataaagctttttcttttaactattgtttaaaaatgtttaaaatggcatttttttacaataaaataaacgtatgtttaaaaggcaggtacacatataactgtgaccaaaaaaaattagaaaaaaaaaaaaaaaaaaaaaaaaaaagacctgtccacgagagaacggagacaccatatcctaagcccagacaggaaccaccgcccggcttattgctcacattagtggaggaaagagtcaagggttcagtttggggctcctgagtctaccgggtgcagggttgagtgataaaaaagcgactttagcctcgtcgcatgattaggagaatcaagaattaaatgaatggagatgtatagataagtaaatcagaggccgggcgcggtggctcaagcctgtaatcccagcattttggcaggccgaggcgggcggatcccttgaggtcaggagtttgagatcagcctggccaacatggtgaaatcccgtctctactaaaaaacagaaaaattccccgggcgtgatggtgcacgcgtgtaaccccagctactcgggaggctgaggcaggagaatcgcttgaaaccgggaggcggaggttgcagggagccgagatcgcgccactgcactccagcctggaggacggagcgagatcctgtctcaaaaaaaaaaaaaagaaggctccagacgggcaattctttaatttttaacacaacaaacacccatcgaacacagcgcgggcattttgacaatggacaaaatcttgcccttgactttataatccatcgacatttggggacccataaaccccctaacctctgagaactatttagacaaatactagtcgggttttttggtttgtttttactttttaaatggaaaagtgatgattcaccttttcaaagacttgcggcttttggccaacaaacacgccatggtttactcacccacttcctctgattcttggccagacgctctaagcttgcactccctgggatagtgtttttgaattatcgtccacagttccacgttgacgagagaatttcttcgggtatggtaccgagtccacgacgatacccggcggcgacagaagggacagcataaactcgccttttcgacggtcgactggaagcacggtttacacagcgtgtggttacacgggagggtgacgggctccacgaggatttccatgcagatcccgcactggcactcggacagcgaggggatggcgtctttgggtagagccatttcaatatgttagtaaagccgactaaacaacgacacctgcacgaaaaagaatcctattttcggccaaccacagagagagcaaaagcagttttgtgtttcagtattatgcccagaagcgtatcagaattcggagaacaggagcatccaacacgtcttgaagcaaaaaggcgctctcagggtcaggcaaacaggaataccccggagggcggcgtctttgtccattttcaaggcaaacgtcccgccagcaaataaatgcaggttttcgtcggaggagcctggctgctccgcggcatgaacaccgcggctgcggctcccggggcagcgaggggaacgcgccaagtcctctcctcccctcacccggaaaggatgctccgctcagctcggggcagccgggccccgggacgcggctccgggaggaagcccgggctccggctgcagcataacttccgctttaccgctgctgcgggggagacgcgcgactcccgtgttcacctttcgggcgcctggcgcagtttcccagagctccgcgcccccgtccctcctacgcagccagaaaccctattcgttgcggcagcgcagcagccaccggacaagc

SEQ ID NO: 166 - DNA, 17094 bp, Homo Sapiens
tgcgcagcaatgccatcggttaaagcgcatgcgcaagatgagctattgcggaagtgaggggagggagaggccgagagaaatttcggtactgcgcatgaaccgagcgtgacgttgaggtttgaaataaccggcaaagagtaaaggctgaaactagcttcctgaaagcttcgtagggcccgagccctgtgagcccaggttctgcgcccactaggaggtgtcatgctgactgctttttttaaagccctagaatcttggcttcggcgtttggggtaagctccgttctcgttctcaagcgcgtttccgcgaactctcgcgggattgacgggccgtctcgagagccggcatctcctaggagctagtcctggtcctcggctaggcggcttggggtcgcggcgtaactggggagccagcctgacgccggcggaccccgcctgtgatcctggcaacgatggatgatgacttgatgttggcactgcggcttcaggaggagtggaacttgcaggaggcggagcgcgatcatgcccaggagtccctgtcgctagtggacgcgtcgtgggagttggtggaccccacaccggacttgcaggcactgtttgttcagtttaacgaccaattcttctggggccagctggaggccgtcgaggtgaagtggagcgtgcgaatgaccctgtgagttccgagccccgctggggaaagaggcgggactggcagctttcctgcagcccccggccctggttttctctcctttctctagtccgacggtcccagggggcgttaaatgaggggagtctggttttggacctggcaattcctgcctcggcgtgtttctgtcttccttaccttttctcccactcgaacaataagaaagctgtgtagaccacaccgccacggttggactcagggccgtaacaaaaaagagatttttatttgaatctcacttcacttgaaaataacaagttcctgatttgccttatgatagtgctgtaggacccagaagggagaagcaaccaaatctgcacctaagaaagtgctgaggacgcagagtaactgccaaaggatgtgtgttctcctcctctattcccgttaggaaacccactttagttagctcgtgtgttgcattggggatcttcagtgatgcttttaaaacgattctttttctacacgctaaatttcagaaatccctatttgaaataataatctactcctgcacgtgaacagggttaagtttaagatacagttgtatcccagcatgcttgtttttgagttgatagaaaacaacctactgtcaaacaaattaagatatgatattaaattgtgtttaaagtaccaatttcctttatacaggcgtctgttatgattttggagatatgctactggagatatctgcttgttaataacaccgaactgtaacttgtcggaaggagactgggagtagcagaataggattgcctttgagctgttgcagcctagctagggcaaggggagctgcagttgggccatgtggtccgcatcgtattccactaggtccccgttgtacaccaggtacggtcctggcgtctctagcaggtgcctgcagccttccaccttctcaagcagggtggtgagagcacgctgctttccttccttgcccggcggggatcggagccatcgcgggaggcgcccgcgggggttgtaactaattaattaggtgaaatgcaagtatctgctaaccaaggggggtatactttcatgaaagccatctgccaactgagttagtgtgaactgcccaagaatgtgtaaggacttgggcatatttggccaatgtaacacatttttatggtgattgttttctaggtgtgctgggatatgcagctatgaagggaagggtggaatgtgttccatccgtctcagcgaaccccttttgaagttgaggccaagaaaggatcttgtagaggtatttttcgtgtaaacttgcttcctagcgcagtaatttacaaatacttgtcaatgatttagactgctgtgaattcgcctgtatgtatcgttaaaaaaagtcactttgccctcagtgaaagcttgaattatggggcaaacaataatgaacaccttatgttttttatagtgcttcatagtaaaaaaaaaaaaaacaaaaaaaaggcttctaggggccgggcacgctggctcacgcctgtaatcccgacactttgggaggccgaggcgggcggatcacgaggtcagaagatcaaaaacatcctagccaacacggtgaaaccccgtctctacaaaaaaaaaaatacagaaaattagccgggcgtggtggccggcgcctgtagtcccagctactcgggaggctgaggcaggagaatggcatgaactgaggaggcggagcttgcaatgagccgagatcgcgccactgcactccagcctgggtgacagagcaagactctgtctcaaaaaaataaaagccttctaggtatattatctgttttgattttacaacagccctgtttatgttcatgtgttgctgttttcatttttatgagtaaagaaattaaggttcagagaggttaagtaactggcttaagttacttatttagaaacagagaaaacaggatccacatgttcctgttgagaaacacaaattttgattctcctcagttgggctgcaacactgctgtgctctcaggacacctagctgagctggcagcacaaaccagtgtgagggcacgcttcacatttagagctggtacttacttctgctagcagaatggagcagtgggagctgaggcaggaggatctcttgaacccgggaggcggaggttgcagtgagccgagaccgtaccattgcattccagcctgggcaacaagagcgaaactctgtctcaaaaaaaaaaagaaagaattatctgtacaaaagagcacagtggtagtttctgagcatggggtgggaagcatgttaaaacatgcttggagatgagagatgctgtttttaaggataataaaaggcaatggattacataacagtgtgaatatactcaacactgaactgtacacataaaaatgggtaagttggggaattttgttaattttttttaccacagtttgtttaaaaagtagctactaaatgtaaagtggtacagtagaaatacttgattaatgaaaaagaacagagctcagatgataaagagaaaggtaggtgtaaacaaaatatcagttaaatgtaagtggactaaacactccattaaatacatggaatggcatgctagattaaaagagacatgcttacagtaaagacacacttattttaagtttaaaaggatgaggaaaagtaatcatccaaacacttaaaagcagaaaactattgtggctataaggttgagtactcattatccaaagtgggaccagaagtgtttcagattttttttttttttactttggaatatttgcattatacttactggttgagcttccctaatccaaaagtcccaaatctgaaatggctttagtgagcatttccttagaacttaacctttaatcatcttgtaagtgctcaaaaagttttagattttggagcatttcagattttggattgtcaaattagggatgttcaaccagtattagtatcagactaaagacttcaagggaagaagttttactagaggaaaagtgggatattttataataataaaataatctattaagcaacaatacataatctctccaaaagtaataacataactttaaattttatgaggcataaattagcagaagcaaaaagaatatacaatcaggctgggtgcggtggctcacgcccataatcccagcactttgggaagctgagacaggcggatcacttgaggccaggagtttgagaccagcctgaccaacatggtgaaaccccgtctctactaaaaatacaaaaattagctgcgtgtggtgacacagcctgtagtaccagctactcaggaggctgacgcacaagaatcgcatgaactcgggaggtggaggttacagtgagccgagatcacaccacagcactacagcctggggtgacagagcaagaccctgtctcactacagcctcaacctcccaggcccaagcaatcctcccgcctcagcctcccaaagtgctgggattacaggtgtcagccaagacacccagactcatacttgaagaatgttaacacaaccttcttagtaacccaatgaataagcggaaaaaaataatacacattttaaaaagttgaacagcatgattaaccaaatcagccttagaaggagccctaactggaagagttgcttaatgaatatgtattgggtaaatgattacataaacacatgagaaaaaaatgtttttaagtagtgggtgagaagagaatggggaatgtataatagtatcaagtgagcatttcctgttggcagaaagttacaaaatgacattttcgtcaatgacaggccccatatataacagtggtcccataagattataagaccatatttttatttatttatttatttttattttttgttttttgagatggagttttgctcttgttgcccaggctggagtgcaatgatatgatctcggctcactgcagcctccgcctccctggttcaagggatcctcctacctcagcctcccaagtagctgcgattaaaggtgtgcgccaccacgcctggctgatttttgtatttttagtagaggcggggtttcaccatgttggctggtctcaaactcctgaccccaggtgatccttctgcctcagcctcccaaagtgaatgggattacaggtatgagccaccatgcccggccaggactatatttatttattttttttttgagatggagtctcgctctgttgcccaggctggagtacagtggcgcatctccactcactgcaagctccgcctcccgggttcaggccattctcctgcgtcagcctcccacatagctgggactacaggcacccgccaccatgccaggccaattttttgtattttttttactagagacggggtttcatcatgttagccaggatggtctcaatctcctgacctcgtgatccgcccgactcagcctcccaaagtgctgggattacaggcgtgagccaccacacctggccaagactatatttttattgtaccttttttcttctttatatttagttgcacaaatacttaccattatgttgcacttgcctacagcattcagtacagtaacatcctgtgcaggttcgttgcctaggagcggcaggctatactctatagcctaggtatatatactctatagcctaggtatatacactctatagcctaggtatatatactctatagcctaggtatatataccctatagcctaggtatatatactctatagcctaggtatatatactctatagcctaggtgtgtgtatatatatatatatattacataggctataccatttaggtttgtgtaagtacactcttaagatgtttgcacaatgacaaaattgcctaacaatggatttttcagaacatatccctgccaagtgaggcacaactgtagttacctaaatcatagagaagggggttcagaaaaggaacagactttatctggttgaggaggtcaagaaaagctttataactgtacattttgttactaccatcaccactcctgctgctcactattgagcacctattgtgtgtcagactttggactaaacgtcgtctttaccacagccatgcaaaatgaggatatcccattttagggatgaggagccacttggagcctgtcccaggtctcatgctgtgattgtgggtttaggttccagtttccctgactctaaggctcttgttctgtcccctttaccattcaactcatcactcctgcgattaaaacatggagaggtgagcattaaaggacgaattgtacttttgacaagcagagataggacaggaggctactcttggcagaaagcatgggaataatgtgaacaaaagtgagttcagacaactgggggcatatttaggactagaggtagttcattttaacccgatagaacagtcatggaaaacagaggtattttgggactgtgttgtgtatagatccttgaattaagactaaatatggaaaatgatagatatttaaaaagttcagtaccattttcaagatgttttttaatgtttaattaaattgaaccaaaaatcaggaacctaaatttgtttctcctttatgagaatagatctttatcattgctctaatttagaacattgagaaacttttgcagtacctttcttgaatttgagtcttcttcgttgagcggcatttacttgaaaaataaagttctggctgggtacagtggctcatgcacgtaatcagatagatggattgcttgagcccaggagttgacctgtctgggtaagatggtgagaccttgtctctacaaaaaattgaaaaaaaattagccaggtgtggtgacatgcgcctgtaatcccagctgctcaggaggatgagatagagggatcccttgatgccaggaatttgaggctgcagtgaaatataatcatgccactgcactccagtctgggtgaaaaagtgagaccccatctctgagaaataataagataaataaataaagttccttttaagagatacagttgataatttttagagggatatatgaatgaccaagttaaaatgtttgattctctcatttttctgttcagcataattttataagactaaaattcattaatgacagtctagttcttctgatggaaattgttttttaaaaaaattatggaggatcatgaaaaaggtatgtctttgaagatctttctgatttttgcttaaaaaaattatttatattttttagagcaaaaaccccagcaatcttaaatgcttttgttaattttgcacagaaacttgtgcatctttggtgtggaatgagcagtaggttttagtgtttgtttcaagttttcatgatttctgaatcaaaacccaaaagctgtagaaagctatacacaaagatgtcttgttcagtgtcctcctctatcttgaactccttacttgctgtaggagctgttagtttcttttcatttttctgttttgcaaatatttctattcatttttattcctcctccccaccatacaaaatttttcttacacaaaatactatgtacattcttctgtactttgtctttttctttttcttttcttttcttttctttctttctttctttgtttctttcttttttttttgttgcccaggctggagtgcaatggcatgatctcggctcactgcaacctctgcctcccaggttcaggtgattctcctgcctctgcctcagcctcccgagtagctgggattacaggcgcccgccaccatgcctggctaatttttgtgtgtttagtagagacggggttttaccatgtgggccaggctggtcttgaactcctgacctcaggtgatccacctgcctcggcctcccaaagtgcggggattacaggcatgagccactgtgcccagccccctgtctttttcattaatacgctctatagctttctccaaaccatttcatgtagatccttctcattcttttttgtggctgcatagaattccattatatggatgtataaaacactggagttatttctaatcttttgctgttataagcagtgtcacagtgaatacaccttgtgcatatgaccttgcatgctagtctaggtattgctctctcagaagacaaatgcatttgtaattttgttagatgctaccaaattttccataggagaattgcactcccaccagcagtatataggaatgtttattttcccttagctttactaatggtgtcaaactttaggagttttaccaatcttgataagcaataaataacatcctagtgtagtgttgggtttttgtgggggttttttgttttttgagacagggtcttgctgggttgtccaggctggaggtaatcatagctcactgcaaccttgaattcatggcctcaagtgatcctcccatctccgcctcctgagtagctaggactacagatgcacaagctaattgttttatttttatttttatttttttgtagagacaaggtctcactatgttgaccaggctggttttgaactcctggcctcgagcaatcctcccacctcagcctcccaaagtgctgggattacagacatgagccaccacgcctgaccatcctagtgtagtattaattcgcatttctctttttataaataaagttgggcattttttcttttcttttcttttttttttttttttttttttttgagatggagtcttggtctgtcatcaggctggagtgcagtggtgcattctcggctcactgcaacctctgcctcccaggttcaagcaattcccctgcctcagcctcctgagtatactgctcggactacaggcgggcgcaactatgcccagccaaaattttttttttttttttttgtattttagtagagacagggtttcaccatgttgagcaggatggtctcaatgtcctgacctcgtgatccggaagttgggcgttttttcatttgtttgtgggtcatttatacttcttctgtgaactccatggtctttgcccattttgaaattgggttgtcattccctgttgacattaggagctccttgtatattaggaatagcctgtgataagagttatacatatatttttctgagtttgtctttttacttggtgtttttttcctatagaattttaaagttttgtctgggtgcagtggctgacgcctataatcccagcactttgggaggctgaggcgggcagattgcttgaggtcaggagtttaagaccatccttgccaatatggccaaaccccatctctactaaaatacaaaaattagccaggcatggtggtgcacacctgtagtgccagctactcaggaggctgaggcacgagaatcacttggaccgaggaggcagagcttgcagtgaggagagattgagccactgcactccagcctgggcaacagagtaagaccctgtctcaaaaaaaaaagaattttaaagtttttatgtagttgaattcattgatttttctggattttgatatatagtcaaaaaggtcttcctagaacagggagttcttaacctgtgattttcagagctttagatgttacacaaatttgagtaccccttctctgaaatgcctgggactagaagtgtcttggatttcagatttatttggattttggaatatttgtgttattcttacaggtggagcatcccaaatctgaaaatccgcaatgctccaatgagcatttccttttgagtgtcatgtcattgctcaagagtttctgattttggagcattttggattttcagagttgggatgctcaactcatatgcaatattttgtgaatgagtgcttatataatttttatagaatgaggtgggttttttgttgttgttgttttgtttttgtgagacagtgtctcattctgtcccccaggctggagtgcagtggcacaatcacagctcactgcagcgtcaacctccccaggctcagaggatcctcccacctcagcctcctgagtgtagctgggattacaggcatgcaccaccacacctggctaatttttgtatttttttgtagagacagggtttcgccatgttgcccaggttggtctccaacccctgggctcaagtgaccctcccacctttgcctcccaaagtgttgggattacaggtgtgagccactgcacccggcctagaatgagttttatcagttctgaaggaagcctgtgatacagaaaaggttagacaccagatagaataagaaaatttatattttccaaagtgtcatacagactctaaaactaatttgaatattttatgttccagaccctcctgcatgaaatgatacatgcctatttatttgtcactaataacgacaaagaccgagaagggcatggtccagaattttgtaaacatatgcatcgcatcaacagcctgactggagccaatataacggtatagaaagccatatctatttatgatgtttagtagttgtttattcaataactcctgagatttaattaaaagtagagaactaggtagaaacaagtatctttgaggattttccacagcgaacgagaggcctagagaagcaaattggcttgtctgggactacatggtggaatggcagcagagccagtgatatccctgaggcctctgacctcttctgagtcaacattttacacacaggtaattcaggcctgcagtacgtcacttctggaatcatcatgatctcttaactttgtttccttattattgtcttttttagtccatcctgtatcctgctaccattgcagatgtcattccctcatcagaattcttctttgattcatatctctgtatagcattgtaggagatagcaaagcctcaggttcaaaaagctggaggcgtcaggctgcttggattcaaatcctggctccaccaattattaactttcctatgcctcattttatacccatggcaaatgagagtagtaacaatacctatctgttggatccttgtgaggagaaaggattaaaggagaaagcacatcaaaacattttagcccaatctgacactaattaaatattagttttattgtattcattttattaaataaccttgttccttttttactgcctccaactctgctgcctgtgtcctgtctctttaactgcacttttgacctccctgcctttcctcaggtgtagcttccctgaggcgtgccactgctctgttttgtgtccgaatgcttttcatcgttccagtggcatctcatttctccctcttttgaatcctcagcagatatttaagctattacaattttttatgctactttcatacttttgaacgcagggtaggtcttgcccatctttatagtacatctgtataaggtgtataatgtactgaattgaatattaataggatagattaaattctttcttatgtttgggtatttccttcctttaaaaggcaacaaaatccactgtgatagaaaatgaacagtgctcaaccgccatgttttgtttatttatttatttaagatagggtcttgctctgttgcccaggctggatgcagtggtgcattcatagcccactgcagattcaacctcctgggcttaagtgatcctcccacctcagcctcctgagtagctggggctacagatgtgtgccaccatgtcaagctaatttaaaaaaaaatttttttttttagagacagggtctcaccatgttgcccaggctggtcttgaactcatgggttcaagtgatcctcccatctcagcctcccaaagtggtgggattatagacatgagctaccatgcctggcctctccatgtattactattttctagctatcagttttaattttctaaagacttcatttcattattagacacagttacttcaacattaggaaagtgtcttgcagtttttaaaaaaatcagacataaaatccgggttagcaagagaattatagacttgcttgtataaaatacattaagtttcttaaccagaacttatactttaagcaaagcccttgtatacgtcccattgttcagctggaagagtatctgttcttttatcttagatatctgtgtgtttttatttaggagaggttgtaaggagtgaacactccttgcttttacaggttacatcctgttataaggaactctgcagggtatctacattgtagagtaattttattttagtgactacattgttaaaagtcacattcccaagcgttaggagttacaggaattggaagcagaacagatccaggctgggtgtggtggctcacgcctgtaatcccagcactttgggaggccgaagtgggagggtaacttgagcccaggtgtttgagatcagcctgggcaatttagtgagaccttgtttccacaaaaaaaattcaaaaattagctaatcgtggtagctcacgcctgtattcgcggctactcgagaggcagaggtggaaggatcacttgagcctgggaggcggaggttgcagtgagccaggttcatgccacctcactccagcctgggcaaacagagcaagtccatgtcacagaacaaacaaacaaaacagatccatttgtctctctttttgggtaatgaattaagagttctgaacataatagagtgcgtggtttcccgtgcttctttgccttaaaacctatgtccttcagtcccttctgcatttaatataatgtgcattctttgcatgcttaccaagtagaaattttttgcttaggatggagcgatagtgagtttaaaactatctatagagttatagaaagcttagcattctttcccacaaggggaatttattagaaagctaaatgtctttggtaaaacaccaaaatcttacatacagatgcttctcactcttacacagagagttccactgagaaggcagaagaataaggtgcccatagtcatttaggagtcatttcaaatggtgctctatagtcttcagtgccaccatgctgggagggctgaccctcttttcagtcaggtcttttcccttacctgttttctgcttgggttccaaataggatttttgtctagagggtgaaaaagaaggcatcctacttaaggcctgaaaagcacacttcagagaattttatttgactcaatgaatgatgcttttctgactgagcaccttcttggtgccaaaagcactatattagccactagggacacaaaaaattaaaacattcagatcctggagaacttttcagtctggtaatagaaatatttataaacagataaaatggtacctcataaggcttattacagagacataagcacagaacttggagaatgtggagagtgagcttagcagaagcttcactgggtaagatacttgtgttgttagcgtcagtcaggcatttatagggagtaatgtagtcctttagaaccctttgctatttttacttatagggaaaacttcaatttagcagtgggaatgattcttattttagtatggtattacataaaatcttatctttatcctaatttttgatcatttacaaatttgatttctgaaacttttagtgttcatgaagattttctgtggttttgtttttaaaagatttttttgtcctctaatcccatgtgcatctatctttacacagtttatgaagtattaactgctgctgtttcccattaaaatcaacttttgaacagaaactaaatatagttgctttctctcctaaaatagaacttttcagaaagctctgggaaagtttcaaaaattaaaaaaaaaaaaaaaaaaaaaaaagactgcttatgtaaattgttttcttgcagttgttaacttgcttattgaatactaaaaattctgtctccactcaggtataccatacttttcacgatgaggtggatgagtatcggcgacactggtggcgctgcaatgggccgtgccagcacaggccaccgtattacggctatgtcaaacgagctactaacagggaaccctctgctcatgactattggtgggctgagcaccagaaaacctgtggaggcacttacataaaaatcaaggaaccagagaattactcaaaaaaaggcaaaggaaaggcaaaactaggaaaggaaccagtattggccgcagagaataaaggtaccttcgtgtatattcttctgatttttatgtgaccatagctatgatgtaaagacaatactgtccttcagagaactggtattaagataaacttaaggatcgtttctggtgtagaagtcttcaagtgtagacttaaggaaaaaatcccactgtccatgaaatgatggtaggaaaacagactttgctctgtacagaagtaagtaaaagtaggaatagtttccatggatatttttatttttattaacttttttcagtttctttttattcaaagaaacaaaattcaatctctgataatatttgaggtaaagttcctttccctatcttgactcactgagttattaggaaacagaaggcaaaaagattgtcaaaataaaaacaataattcaagtaacaatgcccggaatatacgtcctaactacaccccttcctatcagctggattctatccaagtgactctattgatgtatgtatgttcattcaaagaatgggaaaaggatatgacatatatttgccagtacttcatcttcaagatttacccttttcctgtgaagttcagagttactgaagatgcttcttcccttgggaagttgttgacccaagaacataggttatatttcccaaatctttaattattgagtgaaagagctatagatgaattgatatggaaagaccgtatcttcattttcgtgagtagaaggaaagataagaatgaggcagcagattttccctcctggaattacacataaaggacactaagcaattttcaaggtaaatgttgccttgttgttggtctttggcatgataagattctttatttaaatatgagagaatttttttttatcctttatattctctcaatatcagaactcctgaattctgaagattgccctcctcccattaataggattgtatggatgtaagatggaataaaatactagttcttcattttgagaaaactgtacattagtttaatgtttgttactgtatttcttttgagttgaggcacttacataacaatcttctttgcttttttggcagataaacccaacagaggtgaggcccagctagtaatcccttttagtgggaaaggatatgttctaggagaaacaagcaatttaccttcacctgggaaactgatcacttcacatgccattaataaaacccaagatcttttaaatcaaaaccattcagcaaatgctgtaagacctaattctaaaatcaaggtgaaatttgaacagaatggttcaagtaaaaattctcatctggtctcccctgctgttagtaacagtcaccaaaatgttctaagcaactactttcctagagtatcatttgccaaccaaaaggctttcagaggtgtgaatggatctccaaggataagtgtaacagttggcaacatccctaaaaactcagtctcttctagttctcagagaagggtttcatcttctaagatatccctaagaaattcttcaaaagtaacggaatcagcatctgtgatgccatcccaggatgtgagtgggtctgaagatacattcccaaataaacgacctaggctagaagataagactgtttttgacaatttttttatcaagaaagagcaaataaaaagcagtggtaatgatccaaagtatagtacaaccacagctcagaattccagcagttcatccagtcagagcaaaatggttaattgcccagtttgtcagaatgaagttctggagtctcagattaatgagcacttggactggtgccttgaaggtgacagcatcaaagtcaaaagcgaagaaagtctttgaaaaaggtttcaaagtctcaagtaccacctgtattatctcactaatgtgctatgtcagccagtcaggaagttctggttaatactaagatttgtaggttataatctagttcacataaccaatagaaagtgtcctattttatatatacgcatataagattgtaattttaagatgttttgtgtctcagggtgctacattcactcttgccttaggtatactgtaacccaggttctgcctgtcgtgtataagttttagatacttttgttctttcttgctcttaaggattttaaaaacctgttaatctttttatttgtatactttcctaaaaatattcatatggggaatcctgtcaggtgtttggttatattgactatttattaatagtattagaactcattccctgaactgatgtaaatcttcatagtgtcagacatactgaccaaaaccacaatctagactacaaagtatattgttttagagtactcaaattgtattatttattaatttttttgtttgcaaaatcttaacaggaactgtattttctatattttaaagaattttatttgtcccacttttactaaacagtggcagcagattttaagttaaagaatatggaatatagtaaaataagtaaatttcttttggaatatttttagtaacaaatagccactataattctgtaggccaaattttatattgagtttagctgttttctcaaaatttagcagagtggttaaaattctgtgctgataagtaactgatacatataacataaacataacaaagttgcctagttgatgtaacagtggaaagttatctggaaatagtattttgaactttaagccaagtttaaaacattataataaaaggaataccatttgtgcattttaagtaatcttttttaaaaaaaatattttccatgttatagggaaaggacaaagagacttttatcagtttgctttttgtcttgtggctgtacatgctgttggcatagccctaacacagttgttcacaagttttcttttttcttgttgcaattttccttcactttgttgtaatacaggtgcacaaatcttaagtgcacagctgggtaaacttttacagtgttcacctgtgtaactaccacccggatcaagttagagaacacttccattgccacagaaggcttcctataggtgtctgttcccagttgatacccatgaccctcaccacctccagaggtccccactgttttcaccccatcgtcgcagattattttttaattttataatgtagtatctttgttcctatgtatagcaggagttcattttcattgctcttgcatttgtatgaatatactagaatttattcatccattctaatgttaatggacatttgaattatttccagtttggggctgttaagcataatgctgctaagaacattcttatcttttctgttgggtatatatacaggaatggaattgctgagtcacggggtatatttctgtttagctttagtaaattctgccagtttacactcctaccagcaatgtatgagagttttagttgttcaccattcataacactgttagcagcccttttcgttttagactggttggctgttcacaaattttgatattccttaaagcattaaaacattttaataaatacttataaataggtattaaaa

SEQ ID NO: 167 - DNA, 40767 bp, Homo Sapiens
cttgcgcaggcgtagtgctcctgcttcctggccgagggcgggcgagcggagcctgctttcgcagcgatcgcgagcgtgtggcgattgcttctgtctgttatttagatatggaagctgaggggatgcacagaggcagccagaacctaggtcagggtctcgctcggtgctgaccgcccccggggtcgagtaggcgatgggggagcccggcttcttcgtcacaggagaccgcgccggtggccggagctggtgcctgcggcgggtggggatgagcgccgggtggctgctgctggaagatgggtgcgaggtacgggggaaggggtcctgtggagcggagggcaggggctggagggagcggggctccggggagggaggaaggtgtcttgctgggctgaatgaatggcagagaggaggcgggcatcaggaagaggagcgaagtgtctgtggggggggtggattcctggggagagaagggagaaagcggttctggcgcgagcggctgaagggtctgcggtgggaggtgtttgggggagaaataggggccgagtgggagaaaggaagaaaagagagttcggctctggggagcccgggggggccacaagggttggggcgaggacggaggccctgacccgcggcctgtggggcgagaagcgggccccgtccagagaggcctgggtcagcgggtagctgggccggggactgggaggagagggacgcgcagggaacgtgaggagatgcgggggtgtcgaggaggggagggcgggggctggccagatcccgtttagggcgcacagagccccgcggtgccaggtcggggaacggtggcgggggccgcgagctgccgggaagccgaggcagggcccggcgcctgaactttctcgagtttgttttgaaaacgattgcaaattttgggttttgtcccttaaagcaatcaaactttcacgtagaaatgtcttcctccttcccaactctgaggaacatgggcggcttgggctgggccacatttctcctgtgaggctcggtacggccgagtggcactccctgaggtgggtcgggcaggtattcagagttctctccagaggctgcctgtcgtctttattaatgcagttgcaaatgaaaaatattttaaggggaaagatgaggtaccgttcctggcacggttcaagatgcaccagcgtggtgcatcttgaaaagacgagggaagggaggagggagttagattgcaatcaggttgagaaggagaactgggtcagggacaagcttgtgatgactgggaaccatttgggttttggaaataatctgtatgaaaagttctctttgcagtaaaagtggatggttggtcatgatgtaaattcaagaagtattttgagtctcatgtgtgttcaggtagatttttcctataagccgtactgcctcaattcagtctgccaggtatttactgagtatttaacattgtttggtgtacaatgaggacaaataaaatttctgcgctcgaagagtttaaggcttgagtggggagagaggatttatacaatgaagcagtcatcgtataaagaacatccatatgggctgtatgatcaagtgctaagatttggattatttagttccttcccagagcagtagttcttcaagtcagaggaggaattcatgtctaggcacaaatttaattgctagattagggagtgttataaagggttacttgtatgctgtggtttgaggaacaccaagaaaacatctctgcctccaaatacctcttctatccaggtattagtgcctaaaagtccacattaagcattcattcttttagcttgagcactgatctttccctgcctggccctttccaacagcatatgtttgtgggaagtttaacaaattaaaacacgaacacctgaataataacctgaataatacacacaaaaataaattatttttgtgcataactattagttaatttcacatacattacttaatctgatccctgcatacacacaacctcataagataactcagtgggcaagtgttattcctttagattcaattgttgtggattaatttatgacttctgaatagcttgtcagtactgcagtcttgggcaggtgggatggggaggacgaattaaagcacctgaagaaagggcaagaagactataaagcagtcttagacatattctaaaccatttgatagttctttatggggccagttgcatggggagggacccatataaactcagtggtaagactgtggctggcttcagggacctgtgtgtaggagaagcctgccaggcttggctgcctgcaaggtcaggtcgtagcatagcctgaaaagaagtctgaatcaaaggcaagagaagaagttgtacttattgttatggtccccaaatcatagcacaagctgttttgcacaagattttaaaagatacgctaataacataacagcaaaggtaggtcagttccctgcctttccagttcttagtctcagatgttgtggataaaataataaaacagggttcctttcatttcattgatgggaacactgtagtaaattgtctaattaagtggctttaagcttgttaaagcaatgcatagagtttggtggaaaaacaagtagagatttattgcaaattagctagttctcaggtactataaagtatctaggcctttggggaaaacaacagaaccttctctccccttttcttctcttgtatttagttttcattaagttttctgccccaagggaaaaaagggaaaggatggttatatttactggtttgggggcttttttgtggggtgttttgttttgagacagagtactccttctgtcacccaggctggagtgcagtggtgtgatcacaccttcacctccctggttcaagtggttcttctgtctcagcctccgaagtagctgggattacagatatgcaccactatgcccagttactttttgtgttttcaatagaggtggggtttcgccatgttggccaggctggtctcgaactcctggcctcatgtgatccgcccgcctgggcttcccaaagtgctggaattacaggtgtgagccaccacacctggccagatttacttgttatttgagaaacagtaggaattgtgcccaggaggaaagagatagtcttagtgaaggtgggcaaagacaggatgatcttttagatcaataatgtgtgtaagctcaaaggcttgcaaaactattgtaaatgaaaacaacccctcacatatgggtcgtcagtcagttcccacgggaaattcagtgttatgttgagtggtcctgagatttccaggtaacctcactgcactctttaactacagtataggtgaaatatcagtagtaccaaggtaaattctaagaccaggcagtgcagggaaggatgtaaaagaatgattcctttttctgggttcagagtctgttggaggcaatgtcaggaaaaggcactcttctactgttttggtactgttttcccctggctactcacaatggcagtctggctgtctcccctcaagtattagcatgtaatatgagatgcttcctctcttagagataaagctacctaaatagaaattttactgaatatggacgacagataaatccctagccattccatttttaacagatatgtgtattcagaggaacttctataattaatataattctggcagagtgtgaaagaactgaaaaactttgtgctcagtgttggtggagtgatcaccacaacattttaaagagaaacaagtgagactgtatgagttccaactgctgctccatattttccaatggtaatacagtctctaacttctgacctaaaaacacccaccctaaaatcttgaggactcatatgcaagacctctttattctttcattcattctcaaatacttaactgaacactatgccaggtatagaaacacagtggtaaacaagacagataaagtccctgcttatctaatttatattctattacggggacagaggggaaaagtaaaataaacaagataattttggtctgtgataagtacttcctaataactgaagaaatatgatgggaagcagacaaccaactttagacagaggtaatcagagtaggcttatgagtagctggaacatgaaagataaggagcctgtgcaagatctgagagaagagtgttcttagcagaggggctaagtgaaaagaccctcaggtaggctggcacttcggggagatgggcttaaggaacaacaacaacaaaaaagtttgaggggctggagcagctagtgttggcactatggtatgagttaagactaaagagtagaagggctcaggacattcagggtcttataggccatggaaggaagtttgaatgattggacagttttaaggaaagaaggaaaatgacctgatttaaaatttttacatttctattccagttactattataaagcttatgggggctagagtgagaacagaaacagtaggaggccaggtggtttggactaaggctgtggctgcagagataggaatgaacagacttaggacatatttgaattatagcccatataatttaccagtgatttcaatgtggggatgagggacagagatgaatcaaagatggcttctgggttatgggttgagtagttggttggatagtattgtgaatactgagataagagtttgtggggaggaatagattaggtcagtgagtcgtggtggtctttgagggactgaggaggacaggcattctgaaagattttaaagagaagagaagagggcagttttagctaactttggtttaaagttcccagttaaggttgtgatatgggacattaaagaggtcgtttgtgcactaagaagaatatgcagggagccgggcgcggtggctcacacctgtaatcccagcactgtgggaggctgaggcaggcagatcacttgagatcaggagttcgagaccagcctgaccaacatggtgaaaccccgtctctactaaaaatacaaaaattagttgggtgtggtggtgcgtgcctgtaatcccagctacgtggaagctgaggcaggagaattgcttgaacccgggaggcagaggttgcagtgagctaagatcgtgccactgcactccagcctgggtgataaagcaagactctctcaaaaaaacaaaaaaaaattaacaaacaaaaaagaataagggaattctgtgatctggaactcagaagaatttcatttccttccttcacagggttgttatgaactagactggtccaacaggaaagtatgatagatgtgaactggggcttcttttcaaccttttccggaagctctcaagctgttcttgtggataagacagagaatatgtactccaatgcaaagacttttggttgaattataactggctgaaggtatatccagatggtgtgggttaatgtttactaggttttcctgaaaactttgcctttggctgcatcccattctgtgtcttgaacgaaggtatagaaggcatcatctcataaatttggtggaagagatattaagtatgtctgatctgatggcagattaaaaattcagaaaggtcttgacaaattggtttgataggctgaactagcaagatgaaatttaataggaatcaatctaaggtcctgcgcttgaatccaaggttttccatccagtcaagtatagagcagaagagacaggacttaggatagcatttcttggaggagggggagaccaagaaatttaatcattcctaagttcgaggatacactggcagtgtactagatctgctatgaaagctaatgcaatttatatgctccagtgataatatctagaactgggaaagtaacacttgcgtttgactgtgtaatagaaattaagtttatttttcttaatatgccatccaggaataaagataaaccagcagtcccttcacagactcattagaatggcaaaggctcaagcccatcccctgggagttaagttgaagtaactgggaatacagaaccaggaaaagagaaaactcagtgttcactttatatctgtgccattgaaaggggattggagatttcccgatggtgcccagggcaaagccagggccaatggatggaatttacaaggagaaaaatgccaagtcagagacattttaaaaattggagggcctgccttatgtaaagttactgacagtatttatgcgttgatgggatgtgtagaaagaattcctctatctcatagtcattgaaccagatgacctttcaagatcttggcaaccctgagatacatggataactctttttcagctttctcttgttgtcacaaccgtttgcctttttctacttggtggttctcaagacagctgaagaggagatagctgatgcactgttttggttccacaggtgtctggtttcttaagtcaggacctgcatatgctgctggttgatgagatttgtaaaggacctcccttttcagcacaatgactgatggtatttcttgcattgttgttgtctcccaggtgactgtaggacgaggatttggtgtcacataccaactggtatcaaaaatctgccccctgatgatttctcgaaaccactgtgttttgaagcagaatcctgagggccaatggacaattatggacaacaaggtacaggaattcacagaagcctaatgacttttatttgtttttaaattacttttttttttttttgcataggtaattcatggtataaaattcaaaagtataacttcttctttcctagccatccagttcccttttccagaggcagccacttccatatgctgccagagattcgattatgctaaaataatttctcttgatttgggttaaagtttgttaacttgaagagaatacctgaattggggtagtaggtcctattccagaaactagactaagttactgggcaaataagcctgtttgaggtgaagctcccagagaccctgggaatctgcagaatctgctgacgcttctggagtacacttatggctcagtggacaaggggaggagggagaaactgatctgattgcgcttagctcctttccttcctcactcctttcaatctgagcaacctcccctggcctttaaaacatgttttaaatattggtgttccgaagatttcctttgaataatgggtttttctcctttaaacaaatttgaaaaccactagtttagtggtaaatatattgagggaggtgcaatagtatatgaagcccagcaattagaaagtacctaatgtgctgggtgtggtggcacatgcctgtagtcccaactactggagaagctgaggccagaggattgtttgagcccatgaattctgggttatagtgtgctatgccattctggtgtctgccttaagttcggcatcaatatggtgtcctcctgggagcaggggaccaccagtttgtctaaggagaggtgaactgacccaggttggaaggagggcaggtcaaaactgctgtgctcatcaacaaagggattgcacctgtgaatagccactgcactccagtgtggctgacatagtgaagccctgtcgctatcaaaaagaaaagaagatacctaaagtgcagatatacaagcaccgaggaatgtgatgaaaatacagactatgaggtgagagaaattctaacataaacagttaatgtttaggaagtataacatgtctttaagtgccatttcatattgcttcactgccccagttaggattttaaaggtaccattagaagggagggtatcccacaggtctgcctgccatcctcatattgcgtgcataaaactgctagatttaagctgttggaaagtatcttcctgctctagaattaagttgagttggcactgtattgaaggagacagtacataaatgctaagtaaatcagttcagcacttttagcaaggcaccatgagcaggataaaaattggcactgagattatctactttaaccccttatgtagacagatgaatctgaggcccagagagataaactgtcttgcccaaagccttctctataatgagccaggacttaagtttctctgctatgccctgtgtcaagtatcagtaaagtatgtaagcaatttgctatactggctttatgacgtcaaacaattaattatgcatatttaaaatatagctgcaaggttttaaagcctctgtaatagcgtatatcaaaacagcttaggaaaagatgttttcctcatcagagtaggctgtatgagagttaggattacaatattatagaggtgagttctctgctgctgcttttcttaattatgtgcagtgtagatgtgatccacttatgggattagcagattttcataggttgggaagccaacagctgatcaacttcagtgttatttgaatttcaaccacagggatacagaggcagcctgtgcaagatcagatcatgactgtgctccgggctcactctccagtgtttgctttgtacccttccttctagggttgctgttatcatatgattcttctcaggtctcagtcaggcaatagagaggaaagataggtttcttaacaacctgtttaaactttttagctgtgattgtttgtgagataactgatttaattttaagagaagctaggactggggtgttttgatggaacaattcttacaagtaaatcccccctgccccctgcacttttcttttgactacagatgccccctttctggcttcctcctggcatgatgccatggcagccctcttctgctgataagagacctgaatttcagctgtagggtattattgctgtggttgtgtttgaagtcatttgccaaatctttttcaagagataggtgtttctaacaagttaaaaactcagagctgcattctcttatctgctggaatggccagaaagtgagagcttaagtatagatacaaaaattgcaagaaatgttattttggtttaaaattggcttaaaatatagaaaaaaaccttggaggacagctaagtctgcacacagtatgaggatggttctagttgtgtaggttttggtcaattcataagcttttcagatggcccgtcctttgtattggtatccagctctttcagaaaattggttgttttaaagtcacagtatgaaatgccttagaggttcagtcacgtcttacttgagcctttcccattcttaccctcctctcctgttgcttttcacctgctgcctggtgattcctacctttgttcttctgcagactctggcatttgaagtccctgttgagtgtactcttacgtgaacaaagtttgctgtttgggacagttcagcttctggtcctccagcaactagagcagtggttatcaaccctgtttccagtttttactctcacctggggcactttttaaaaatactgatggtagtacaataaaagcgttcattcgtcaaaaaacaccattaagagagtaaaaggcaaactcagaggaagatgtttgctacacattatagtcaatgaagggtttatactgaggtatctgcagaactccaataagaaaaagacagatatgccctatttaaaaatgagcaagagacaagcacttcacaaaaggttctatccaatgaaaagttgttcaacctcattaataatctggggaatttaaattaaaaccataatggaatacctctacacattcaccagagtggctaaaattgaagactagtgatgccaggtattggtaaggatatggagtgatagaatgttcttacccttctgttgggagtgtaaattggtacaatttgggaaattatttggcattattcattaaagttgaacatacatatagctcttgacacagtattttcactccccgggaaacagcccaaatgtccatcaacagtagaatggataaattgtggaataatcttatattgaaacactatactatagtgaatatgaatgaactactatatctaataacatggataaacctcacataatattgagtgaaagaaggctgggcgctgtggctcacgcctgtaatcccagcactttgggaggccgaggcgggcggatcacgaggtcaggagatcgagaccatcctggctaacatggtgaaaccccgtctctactaaaaatataaaaaattagccaggcgtggtggcgggtgcctgtggtcccagctgctctggaagctgaggcaggagaatggcatgaacctgggaggcggagcttgcagtgagccgagatcaggccattgcactccagcctgggggacagagcgagactctgtctcaaaaaaaaaaaaaaaaaaaaattgagtgaaagaagacagacacaaaagaatacatattatatgatgccatttatacaatgtttaaaaccaggcaaaatttacatgtgctgttaaatctggatagtagtcactttattgccaaggtggctactgactagaaggagacacacaggggtttctgggatgctgataatgtggggtttgttttgtttttgaccttatggtagttacactaagatgttcattttgtgactgttcatcgagttggtacatttatgatttgtgcacgtttatgtttgcatgttccgctttagtaaagactttaaaaaatatattgacggatacatacttaatacaattgctgaaataagacttgatgataccaagtgctggcaagcatgcagaataactggaactcctcaacattcaagtgtgaatataaaatggtacctccactttgaaaaactggtggtttctaagagtcaaatatatacttgtccagtgatcctatttctaggtatttacccaagattaatgaaagcttatgttctcgcagaaacttgtatgtgaatgtttctagtggctttattttttttgtttttatattttgagatggagtttcgctctttttgcccaggctggagtgcaatggcgtgaacccggctccccaaacctctgcctcccgggttcaagtgattttcctgcctcagcctcccgagtagctgggattacaggcatgcggcaccacgcctggctaatttttgtctttttagtagaggtgggtttcaccatgttggccaggctggtcttgaactcctaacctcagctgatccacctgcctcggcttcccaaagtgttaggattacaggcgtgagccaccacacctggcctgtagtggctttattaatattcaccaaaaactgggaaaaaaaacaactagggaatggataaactgtgctccacccctactaccttcaatattactcagcaataaaatataacaaactgccgataatgcaacagtgtggacgaatctcagaggcgttacactaagtgaaagaagcaagactcaaaagtgtagataataagattccatttgtattacattctgggaaagagaagagaacagataagtagttgcctgggaatgcgggaaaggttgactaccaaggggcactgtttcttgatatagttacacaactatatgtgtttatagataaatgtaacttttaaaatactgatacttagttcctatctcagaccacttaactcactccgagggtgaaacctaggcactgctctttgttttaaaccttcccaggtagttttactgtatagccagggttgagaaccactgagctacgtaaattatctaaagcactccaagaaaacattgtcttttggtttgagtgtccactttcctcaataactgtttaaaagcagctggacagagattgagcatctagtgaagtaattcctgtctaagtggatgtgaattatcccacttttttcccattggtggctaggacacatcaggcagacttttctgggtatcattttctgctgctagcattgttcaaatgggtagttatgaaaaccaacattaagaaagccttgaacagagcatgattatttaagccattgtatttgagatcatatctggcagtacttgattgttctgtaccgccatgggatttttgtccttttctagtctccttatatgaacagacctgactcagggcttggtttaaattataccactagatgtcaccaagaagtaatgaatgggtaaatgtacaaggatccaaggacaaaatgtgatgggagaattttgagtttaccttccagcttctaaaagggctctgaaggcaatgggttaatgtagaggatctaatggaaggctgcaacatatcgtgaaagtttgccccagcttctgagggcaaacttactctctttagctgtggactgtcagaactcagaagttctgagggcaaacttcctactctctttagctgtgggctgtttctgtaatcttatttatttattttaccttatcttagctttggagacttcctttaaatttctgtaccttggcattaggtggccttctgtgtcttactactttttctgagacctttttcctgtgtataatctaaaatcgactgtcctgctctaaaattgttctcagatagattgttctagctccatccctctctgttgttatttctcatatgttgtttcaaaattcagcaaaccttatcactccccatagtttctcaggctgaatagaaagagtgtgaggaggtttcctagatgaaccaggttaggcccaatgcacagtgggttaagactaatatttctgtatgtatctatgccagtctttctttccgtgtaaaccaagtaatggaagataaaactggaaacaagggcctaatgccaaaccagagctaagatctgatctctactttccctttaccctctgtgccttgtggtcaagccccctgtccctcatatttgggttgactggagatttttttctagctgaaagtaggtagctgtagttgccagtgtaaacataaatcttggtcccaattcagaagtgagcttcatctctggcctatcccctgaacttaagtccttgatacgggttaaaatgctcaccagtatatttcaactctgaatcttgcctttgtttcaagtctattttaggacctatcatctccatttagcatcccatagctatcccagctgcacatgatattcctttgcatttacaggctatgccatgtaatcccacatttgctcatttgtgcccttgtgttgtcttttccaccatcagctgctgaaagctttcatgtccttttcactcaatatatttaccttgcgtgacattgagcatagagttgaaatgattgttgatgaatcagttgaaccaaggcatagtaatagtagtgaacacttacgtaatacgatgcccaggcactgtctaaatacttgccatatgttatctcattaaatccacacagacaccatgagggagagacttattttcctccattttatcagtgcagtaactgggccataaagaggtcaagaaacctggccaacatcacccagctgctaaatgatagagccacattacaaacccaggcagtctgactccaggatctgtgctcttaacctcaatactatgacttcattaaaaccataaaagtaaatttttattttattttatttattttggagacagagtctcgctctgtcacccaggctggagtgcagtgatgcaatcttggctcacggcatcctctgccgcctgggttctagtaattctcatgccttggcctcccaagtagctgggattacaggcacccaccaccacacctggctaatttttgtatttttagtagagaggtggtctcactgtgttggccagggtggtcttgaactcctggcctcaagtgatccgcacacctcggcctctcaaagtgctgagattacagatgtaagctgccactcccagacagtaaatatttattaagcatttattctatgtgagtcattgtgctaagtgatttacatgcattatcttattcattcctcactggaacagtgtgaggtaggtactgtaccatccctgttctgcagacaaaactgaggcatggagaggttaagtaaattgccaaatgctatgcagactatgaacccacatctgagtccagagctccagctcttaaccgctatcctgtattgcccatatacccctgttgatattaattgggtcagatcctacctgccatttgaccccagtaccagatatagtactctcttttttttggtttatgtgtgcttgcttgcttaccagtgcgttaaggaaccacatccagagatagcatttgaaactacttcatggacctcacccttagctactgctttcttcactaatagcattttttctagttttgggacattgctccagtttaggttaataggagctatccaatttcagtttcctttaatgctattccatgtgtttgagtaaattatccaccaataataaggtgattcctgcctgttatatggcagttctctgtggaggcatgaatgtgaaatataggtaaaaagccaaagcactgcttgacgaatgctgtttctaaggatggtcgtttatgaatctttcttttctatttgttatcaagagttttccttctgaaaaggcagaagattttacagcagcaggagagagattcctttaagaagacgaaaatcatgaagcttatttcttctttctttcactttccccagagtctaaatggtgtttggctgaacagagcgcgtctggaacctttaagggtctattccattcatcagggagactacatccaacttggagtgcctctggaaaataaggagaatgcggagtatgaatatgaagttactgaagaagactgggagacaatatatccttgtctttccccaaagaatgaccaaatgatagaaaaaaataaggaattgagaactaaaaggaaattcagtttggatgaattagcaggtcctggagctgaaggcccctcaaatttgaaatccaaaataaataaagtgtcttgtgaatctggtcagccagtgaaatcacaggggaaaggtgaagtggccagtacaccctctgacaatttggatcctaagttgactgcccttgagccaagtaagaccacaggggctcccatttaccctggcttccccaaagtcacagaggttcatcatgagcagaaagcctcaaactcttcagcatctcagagaagcttacagatgtttaaggtgaccatgtccaggattctgaggctcaaaatacagatgcaggaaaaacatgaagccgttatgaatgtgaaaaagcagacccaaaaggggaactcaaagaaagttgtgcaaatggagcaggaacttcaggacttacagtcccagctgtgtgcagagcaggctcagcagcaggcaagagtggagcaactagagaagactttccaggaagaggaacagcatcttcaggtaccacacagaagggaagggcaagagtggtcttcaggggtggggcaggcacttcatgagtctctggccagagttctcagtttctgggccaggtaccaaattctgagcaccaaagacaggaaatggaatgggaacagtaaacttttgagataagggaaggggattgagtagagggttaaggcttcagcatgctgatgagatcaggagccagagttagagtgccaagatagggtaaagtgaccagcagagccagccagggcataactcatcccaggaggcaaagctgaggcaactcagaaccaacatgaattcagggggaagttaggtgaaggtcaacatgccacaaaaccacagtatagtccaattgaatcaatagttgtcttcaagacttgtgtatctttgctctgtggccaaggccaaatcacttagtctcagggcaggtacaggtcagctggttcctctgccctggtacctgacagtttgttagctataaaggttagttaactctgtagctaagccaggaggtgaggggctaaaaaggcagaaaatgtttttgtttctattttgagcagccagcatgtgatgggacagatgcaccatgactgcattgttgggttgaatgataaaccaccttccacagtgcctatagtaggaaggtaaaataatgactgtcttagctgtataaaggtaagaccaaatgtatttccatccctcagtcatttgcttagatgacaagctcttgcacaaagctttaggctagagcagatcctgtccctgctcaaaatgtcatttcctatctggcaggaaccacatattttgctcccacccagttgctcagataatattgaatgtcaagaattccccattgttgacttagaactcagacggaccagtcacaactaaagtgaataagctttttgtttgggttgctcagggtaaggaacagccaggggtagtgttggcttatttctgagcaatttataaatttcattctgatctctgccatccccttgaactgacagtattagcaaaggccatggattaaataggtcttttgagagtatacactgcttacttatgtgtacctttttgcttcccttatccagcctagactagttcttgaaattaatagagggtggtttatgtctacgtgtttagtatatcacaccttcaccaggacagaactctctgtaaaggctaatatgttcaggaacaagttactgttgcttaatatttgtggctgctctggacatgcctcaaggtatagctgcaaaatctttttctgtaccaaaatgttaaaggcgaaaggattggtttagagaatttctctgggtatgagttggttgtgtatatgatgctcatagtgaagtgtatctagtcccttgtttatcagctgcatctccctctgcccaccaagccctgaggatttatcctatcccctactgctggtttagaagctcattaaacccttgctccttcacactttttttttttttttaagtactcaaattgcctggtactagggaattctagtggttataaagatgcttaccaaatggtttttgccattaaggaatttatcttgttgaggaggcaagatgtttcctgcacacgatataatcagagaatagttttcagtcaatatagtaaattagagaacaatttcaagttggcatattaaatgggtaggtaattcttaaggacagaagggcccagaagttcttttggaaggtgctggacatataggttaatgatcacctggaaagcttccacattggagggggctgatgaggaaatacagcataagctcaggcaaggagagaggaggagcagaggagcagtgtataaactgaagtggtaaagactcagaatgagagacaagatggccagagtagagggaaaagaagcatgctagatgttgtgagtgccagcactgggaattacatctgagtttaggtatttgggggctcagaagttctcagtttacatccttttgggaatcatggcgttagtccatgaaggaggcttggactgttaggccatagtatttccagaacaacccaattggtggcttaaagccgacagtcctgaagtgtgcagtatttgagcagataactgctcaaattctttactgccaacagcttgaagtaaaacaggagattttccacctgctccctcacccctgttgtttccagatgctcatactagctggtctgctctgcttgttgctggattgtgttcctttttttcttttccctgcagagaaaccttccattttgttttggctttgcagggtttggagatagcccaaggagaaaaggacctgaagcaacagctggcccaggctctgcaggaggtaactttgccatagtactaagattatagtgggctgtggagtggggagcaaacaggcatcacatgaccactggctgcctctgctgcttagcccatacctctgtggcatccccagtctgtaaacagagcaggtggcagctgctcacaccatcagatcagagatttggagccttacaaacatgccagacctcagcatgaaaacttacatctttgtctgagcagaagttgctctggtgaagatggaatggagctttagcagttaagaggctctctggggaagtggctccacttctagaaaggtgagggcagcagagggaaaatgtgaggtatgacttggccaccagggcccgtgaaggcctctgttaccgcaatgttcctgagctgtagccaaccagaaacaattggggaatgttccagttaagcattttaggccaggttgagaatgtgcagtttaacaatcaacaacacatatcaatttattgaaaaggtaaagctcaacaggactaaaattctcctaaaagattgcctgtaatttatttaatttaacctgactactctcatttgattatttttttgtgtgctcttttgcatctttaaaacctactatgtcttctaccttttatgtattatgattagtagtttagtgccatttagtcaggatggttcaaatctcattggaaagagtgagcaaatcacataggaatttgttcaggggaatttatccttttatcgtaaacctacttcccaaccttaacagtgctaacagtcatacagtattgtaagcatgacagggtgcctgccttgatctccttgagggttgcacaaacagctttggaaagaattagatgaaaattaattcaatctttttagaattttattttttgagcttgtttattttctagggtgggagagtaggcatgtttcccatttggaacattattaagttaatattcagacattgttttgaaattgaaaaagaatgtggttctgctagttggaaatccctgagggatcactgagtaccctgcaccctctcctgagacaggaaaacactctatcattttgcatgggatacttggccatgcatttattagcttaaaatgtgatacttttagaccgggcacggtggctcacgcctgtaatcccggcactttgggaggcccaggcaggcggatcaccagaggtagggagttcaagaccagcctgaccaacatggagaaaccctgtctctactaaaaatacaaaattagccgggcgtggtggcgcatgcctgtaatcccagctattcaggaggctgaggcaggagaatcgcttgaacccgggatgtggaggttgtagtgagctgagatcgtgccattgctctccagcctgggcaacaagactccgtctcaaaaaaaagtgatacttttaggtcatggttctataccatcatgcctgggggacatgccactctcatgcagtggtggttttttgttccaccatgctgatacttttgaaagctgttctttaccagaccattataaaaactgtttttataatggtcttttataactgatttcctgtttaaatcacataataccttcctctccaatctccaagaaactaccacatctttttaaaccgagtgattcataagttctcagggaatttgactatagttagaaatgggtccagaccttcactgccctaagcagtctgccagtctttgctttgagtggaaaagaaaataaaaagatgtgtttatatacagctcaaaaaacttctctgaatgcttttcatacctgttattttcttatgaacactgagggaggagggggcacctattttcccatttccttttatttttattttgagacagtgtctcgttctgtcacccaggctggagtgcagtggtgcaatctcagctcactgcagcctccgcctcctgggctcaagtgatcctcccacttcagcctcctgagtagctggaaccataggcgcgcgccacaatgcccgacaatttttttgtatttttggtagagatgaggtttcaccatgttgccgaggctggtctcaaactcctgagctcaagccatccacccggctcagcctcccaaagtgctgggattacaggtattatgagctaccacgcccggccatattttcccattttatagatgagaaagttaaaatacacatatctaattagtgtgtcaagttgaagacccaggccttttgacataactgcttttttttgtcaggagatcacacattttaaaatttggttcttgaataatatcttttcaaaaatacttacctttactccaccttcttttaaaaagaatttgaggtgagattctaaagtataagctatacttaagcatgagagaactcataaattatgtttcatatatgtggaacctcttgacattcagcataggcatttagtcacaatgaatgagctgttagctcctgggtgtgccttcttccagaaaacactggcagggttcaggcagcattgtctgagcatgtaatatgtgatttgtagaacaaataggttaaaaatcttttttatttcaataaaaatgactatctaattctgctgattcccatttcctcctgattatttcataaaagctgcttccagttctgaatagcttttaattacttactagttcttaaatactgttcccagaatcacttgggtggctttaaaaaaaaagaaaaaaagaaaagcacatttctgggctccaagccaaacctatagaagcagactctgggacacagtgaaagttcttcagttgacttggatggccaccaatgttgggttagttttagaggccctagtccatttggtggccgccttccctaactgccctctcccctgaaaaaagcagcaggtaggtaagatagcccaatggaataaaggtattattttgaaattgccaatttatcgatccctgaaccacaaagtcactaactagagggagagaacaggcatgtttgtggctaaaaggaaggatgcattgtagttcatcctgagtatgtatctgctatgtttttgcagcattgggctctaatggaagagctaaatcgcagcaagaaggactttgaagcaatcattcaagccaagaacaaagaattagagcagaccaaggtactggaaagaagatggaagtttagaatttggttagtgcatgcaactcagcattttcaacagtgcaagggttgctagggaaaataaagagagaaattatggctgctccttgcctctggggagataatctataaaattatagaggcctatagcaggttctgcctgtcagacaacatctatttccttcccttgttcagaagcaaaatgctgggaataaggcacttgcatcctgtattctagtcctttgtctatggtgggtactccttcagagtgtgtcactgatacagactgaggaatattgtagtcaagaaatagttcctcctgaactatgtaatttgaattacataaagtaaagtgaattacttaatgcagtttcttcccatgtcaaatcaggagaactcttgaattaggggttataaacttaaatgcccaccagggccagactggtaatcaaagtgagtgaagtggcctgaatgtaagaacacagtagggagctgtgcgggctatggcttattggatggggtacttgcccacacccccatcccaggaggcaactcttctctgctcagccaattgttgccatccagaagtgcaggcccagtgttgtcagatcttctgatttttccacagcagatgaaagtccaaatgtttaagtgaaatatcccaaattttaaatattggcaacaacttcagctttttgtgtgtgttttaatatgaaggccaaactaaacaagtctgcagggtggatccagtccacaggccaccaatttgcaacctctgacttgaaattaatacctgagtctgactgcatctgtcatcccaccccctccatgtaccaacctagaactgaaggagggacttgttttagctggtttgatttcctgtttaaatcacataataccttcctctccaacctccaagaaactgccacatctttttaaacccagtgattcataagttctcagggaatttgactatggttagaaatgggtccagaccttcttcactgccctaagcagtctgccagtctttgctttgagtggaaaagaaaataaaacaattaaaaatgagccagccactcaaatatacctcaaatggcctatcctctccccctcaggggctcttaatgctttttgttttgggggtgaagtgctaaaataaatgtctgcttcaagagagcatacgtaggagcctccttaaaaagtgtgtccacacgcagtctgacctcttggggaaagccggggagatggtactgcaggcctctgcaggagtgggaagtggcaggtatcatagagcatggagcctgaaggtaattcaagaggcctgtctccagccttctgcctccagaggtgtaccttactttacagaaaaggcagctgcaaagaacacagcaactttataactaattcaagtttcctgcctctggactattcatgcctcttttcttgtccagtgagtttttaattgtttgggataatcttatgtaatgtctgaactacagcttgctataaactacttaatgtcccatctggtcttgggtggttggtgtggttagtatgtcacctgcatttttctcatttgattaattttggggaaggagacagaatttgcaatgcaaatactgaaaaagtggtgttttagtccattcaggctactacaaaaaagacccataaactgcgtagcttaaaaacaacagaaatttatttctcacagtactggaggttgggaaatccaagatcaagatgctggcatgtttggtgtctggtgagggctgtcttctgattcgtagatggagtcttgccatgtctgtccctatatggcggaaggggcaaatgagctctccttgggcccctttaaggccactaaccccatttatgagcatggagccctcatgacctagtcacctcccaaaggccccacctcttaataccatcacgtttgaaaataagtttcaacatgggaatttgggaggaagcacaaacattcagaccatagcaagtagggagaggaaagaaaggaggttagtgctctgtattagaaaacaattattgaaaaacaataagccttagggaaagtgttctattcttaatgttgctgcaccagaatgaatcactcattaagactgaatcctcttctaaataattgaccctgctccctgtcccattttgcatttttgttggttctctgaatgacaggtaggattgtgtgtcttgcaggaagagaaggagaagatgcaagcacagaaggaagaagttcttagccacatgaatgatgtgctagagaatgagctccaatgtattatttgttcagaatacttcattgaggtaattatgaacagttgctcaccccttcttttttttttttttttttttttttttttgagacagagtctcactctgtcaacccaggctagagtgcagtgccacaatctcggctcactgcaacctccacttcctgggctcaagcagttcttgtgcctcagcctcccaagtagctgggtcccttacaggcacatgccaccatgcctgtctaagcttttgtatttttagtagacatggggttttgccatgttggctaggctagtctcgaactcctgacctcaggtgatctgcccacctcagcctcccaaagtgctgggattacaggtgtgagtcaccacacccagccgaccccttcttattctcccaaccctgaatgaagcctgggctacacaggctgcttctactataggggaacattctgaagagattttcttccaggaacttataactatttgatttcaaagtcacctctagagatgaccacctcttatttgtttttataatcttctttcccttcactgtccttttttggcatttcatctgttcttaaatgtttatttggtatgattaacattttgagctgcaatgaagcctttatctctttgttgttgaggagaaaacagggccaaattagattttggaagtatcagaataaagctgctcaataaaagctattctttctttactctgaatgggcactatgccgagaatatgcttatagtgcaaccttttaaacgagggggtaaacgtcattaaaatgtggtcactttgggaatttacggcccaagttgaatatatttcagggactctgaggctccttatggaaatgaaacctctaccatttgttagcctatcatatttttgcactggcttatttatttatttgacaaattctgctgtttgtgaccagttcaccttagaccacagatgttaaattcaagttgctaaatgacagtgctattcagactcctttaaaaagaaggccaggtgcagtggctcacacctgtaatcccagcactttggaaggccaaggcaagaggatcacctgaggttaggagctcgagaccagactggccaacatggtgaaacaccatctctactaaaactacaaaaattagccagacatggtggtgtgtgcatgtagtcccagctagtcggaaggctgaggcaggagaatcacttcaatttgggaggcggaggctacagtgagtcgagatcacgcaactgcacttcagcctgggtgacagagcaaggcatgaaaaaaaagaaaaagagaaagaaaaatgtaggccgggtgcaatggctcatgcctataatccgagcactttgggaggccaaggtgggcggatcacctgaggtcaagagttcaagatcagcctggtcaacgtggcaaaaccccatctttactaaaaatacaaaaattagccaagcatggtggcatgcacctgtaatcccagctactcgggaggctgaggcaggagaattgcttgaacccaggaggcagagcttgcagtgagctgatatcgcaccactgcactccagcatgggtgacagagcgagactccgtctcaaaaaaaaaaaaaaaaaaaaaaagaaaaacatatacacacagctttcttttctcaggtgatctttagggaagttgggtctgttagcctcttgaaaaatctctcctgggcagaactgtttcttttcctctgggtccgtttggacttcagatcgtaacttctcccataatttctagtcatctgattctctactttggagaagttctatgttgttttgacagggcttatggactctataagaggaagacaaggaacgggggttgaaataaatgatgagttagccaacctggagcatctgcagagacatataagacataaacaacttgaccctgtgttttgtttacagaatactgtcttatctactctactggtcacctcttaaaattcgtctcagaaatatgttttattttatttatttatttatttgtttatttttgagacagagtctcactgtgtcacccaggctggagtgcagtggcgcaatctcggctcactgcagcctcctcctcttgggttcatgtgatcctgcctcagcctccggagtagctgggactacaggcacccgccaccacacccagctaatttttttgtatttttagtagagatgggatttcatcatgttggccaggctggtctcgaactcctgacctcaggtgatctgcctgcctcggcctcccaaagtgctgggattacagtgagcctggccagatgcttcatttttatcagataggttttcagtactgtttatgagagcttgtctcatgtaataaacacaatgtttcctagcttctgtgctcaacttggcatttgaaaaatatgtaatatctgtgttattttgcactgttatcctaagagcaggaatgagcatttttgagcctcagaaaaagttgtatcttaggagatgtacataaacaagagtaacaaagaaaaaggtttgtattcttctgagtgaaaagggctcaggcagaaattgaccagagggattactcagaggagccccacaaatacaggcttccttttgctttctctcttcattggcacattacttagatattcaggcgttgtcaacgaacccactacatttttacttttttagtttctttttttgcccagcatttttagttgccttctatattattttacttttttagttttagagatgatgtcttatataattctgtatacttaatatttagtatgtgttccctttcatatgtcaattagcaagacataaatttgtttttctttttaaaaaatttgttttataaaagcatcagattggtggaaaataatactttttattgtttgtttttgtttgtttgtttgttttttccagacagtgtctcactctgtcgcccaggctggagtgcagtaacgccatcatggctcactgcagcctctagctcccaggctctagtgatcctcccaccccagcctcctgagtagctgggaccacagactgtgccaccatgcctggctattttttttttcctttttttgtagagatagggtttcatcatgtctctcagactggtctcaaattcctgggctcaagcagtccaccttcttcagctccccaagtgctgggattacaggtgtaagcattcacgcacttaatagtcctactcatatccaataacattttgtttgcaaggtggccagcccacattgggagtgtggtctaagttggtggactgaaaaagacaaatcagcctgcctggaacctgagtctgtgaccttaactttaagaaaagaattgtctaacataaagcttaaaatttcccaacccaggccgggcttggtggctcacacttgtaatcccagcactttgggaggccgaggcgggcagatcacgaggtcaggagatcgagaccatcctggctaacacggtgaaaccccgtctctactaaaaatacaaaaaaattagccgggtgtagtggcaggcgcctgtagtcccagctactcgggaggctgaggcaggagaatggcgtgaacccaggaggcggagtctgcagtgagccgagatcgcgccactgcactccagcctgggggacagagtgagactccgtctcaaaaaaaaaaaaaaaaattccccaaccctaaaaacgatttctgcctctgtcaccctggccggagtgcagtggtgtgattttgtctcactgcaacctccatctcctgggttcaagcaattctcgtgcctcagccacccgagtagctgggattacaggtgtgcaccactgtgactggctaatattcgtatttttagtagagacgaggttttaccatgttgcccaggctggtctcaaactcctgacctcaggtgacccacccaccttggccttccgaagtgccaggattacaggcatgagccatcatgcccggcccaaccccaagaatgattctgatactctttataagcccttaagatgggattgttgttaattttccatttggcctttgaaattcactcctgtcctaactttgagatcacaagcatcctgagaaagtaagcatgaaagttctgatatgtgtgtccacattcctactgtaggctgtcaccttgaactgtgcccacagtttctgctcctactgtatcaatgaatggatgaagcggaagatagaatgccccatttgtcggaaggacattaagtccaaaacgtactctttggttctggacaattgcattaataagatggtaaataatctgagctcagaagtgaaagaacgacgaattgttctcattagggaacgaaaaggtgagtgggtgtgagaattcctacccctcaagaaaggacttatttacttccaaacttcaacaaatatttttggaaagagaaagagtcagataaacaattcttgaactagggaagagatggaataaatggggaggagtaaagggagttaaagataatgcaggagaggaagagttgagatagaattaaccgcaactgttacttgagcagcagggaagtgggaggctaagtatgtgtgccttggttgtggggggataaaatgaagatgtgatttaaaaaaatacacacagtcagacgttttgctgtaccagtcactagatggtgctgttgtcaagacacttcagttgctgtccaggtgttgaaaaaaccttgagttaagtatacagtgagttataaataggatagtagggccaggaatctgatgctgacttgcaagcacctgtggtttgaaactggccctctgctggtcagccagaatggaggcagcaggcttgtcacagaggctgagcaggacgtgtgtctgagcctcttatgcccaaggaagacattctgacctgtgggagggcagagtagactttgaaagctggttctttggaactgaagttttaccactttactaacagctgtatgctactgggttttgtgcctaaatttaagcccccacagattttcacttccaagagctacttgatctgacagaatcccattgttcttccttttcacctcccatcactccataagcatttacaggaatactacactaggcatcaggagaaaaagttaaataagacattatctcagcccttacggcacaaacagtctggcggaggagatagaaaggcaagtagatagtgtgatgagttccttatcagggtgctatgaaacttcaaaggaagggacacacctgatttggcctggggaggtgcaggtatgggaaaaagcttcatcaaggaaatgacatttgaatgagccttaaaggttccctaggaggttagctttctaaggagaggcagtagcacaagcaaaacacagaggcatgagaagcagtgacctgtcctgccccagttcccagtgtggcccacacaagacataatattcacatgatgtcaaggcttagaaagtatctacggaggctttgtgaatttttttttcttccctctttccctttttgagaggagcagtgatctgggaatccagatttggccaagatcagctgagtcgggggacggggttggggggtggacctagggacacccatgggctttcttcgcccagtctaccacctaagttccttccctgcaatctaagcatggcaaatggcttcacaaaacatcagggaaagaaaaggctgggcacggtggctcatgcctgtaatcccagcactttgggaggccaagatgggcagatcacgaagtcaggagttcgagaccagcctggccaacatggtgaaagcccgtctctactaaaaatacaaaaattagccgggcgtggtggcgcacaccagtagtcgcagctactcaggaggctgaggcaagagaatcgtttgaacctgcagaggttgcagtgagccaagatcgcaccactgcactccagcctggatgacagagcgggactctgtctcaaaaaaaaaaaaaaaaggaaagaagggccctgggccctgtgtcctaagtttacgtctgactcctattacacagagttaattctgcagagtaataacagatcccccttttctctccaaaggctaaagagggtgtctctcacttttttggtaacactagggggctacacagtaaaatgagttagcttccctgttacatgcattggctgggagcacttctggcacccatcttggtttctgtagttatcacactgaatgcagctttgaagttttctctagagacagacaggttttctgagacctgatttagggaaagacatgccagagctatcaacagcttcactgggtttagagaaaattctcagtttaaataccaaccttccttccatattccaaggccaattgaaagctggtttaatccctgttgcatgggaatttttaaaaaggaccaaatttaggatctggaaactaggattggcaagcctgtaattgtcagagtcccatcactgcaggccctggagcaggaattgctcttataaattcagaggagacctgcctgcctgtggccacagggtgttgcccatgcagacatgcctgtattctgatttcaccaagaacagcctcacttctaggcctcctgggctggttattgaagtttcatatgttagtgggaggagtagagtctcatgactgattagccattgatctcttgtgtgagaccagaggagaggaagaggatgggagtgttaggatgctgggtcctgagttggagatggatgctctggagctaggacagataacagacattcagtaagtcttgtatcatgagtcactgtggctctctgggatattgacatgagattttttctgaatggaaaagtttttttgaaatcccctatagagtatctccctctggagctggtgaggtgagagagcagtcttctgtcagctcctcccctcccgtttcttctgttctcattcgatgttagttggttgacaagagtgttaaaactcttctgttttgcttttcctagcggtttctttgggttgtactcagaaaaaaaacaagcaatgtagaaataaaatctccttggtcctttagaacagtgattttcaaccaaggggctttttcaaactacattccttagctcccttgctactatttttttttttttttttttgagatggtgtcttgctttgttgcccaggctgaaaggctgaagtttaatggcgcaattttggctcactgcaacctccccctcccgggtttaagtgattctcctccctcagcctcctgggtagctaggattacaggtgcatgccaccacgcccagctcatgtttgcatttttagtagagacggggttttactgtgttggccaggctggtctcccaactcctgacctcaggtgatgtaccccgctccgccccccaaagtgctgggattacaggcatgagccactgcgcctggccccttgctgctgtaatagtgaattgtggctactagtgagagtgtgccatggccttcacgtgtgctgaggtggggagaggcatttgtgaactattgtgtgaatctgtgacacaaagacccctccagaggttgggggtgtctggggagatggatccaggtcagaccacatggcctgtatctcttgccagcttcttataggctaagtagagggtggacctaacacagggcaggagaaactggcaaagcccaggctctgaagagtatccatcagcccacctgtaaggctttccctgatattgcccatcctcctttgctgaaagacagccttttaaagggatgtttgaaggagtggcagcagtaatcctctctcttccagagagaatacttattagcaggtagttgtaacctactcagtcctgtccctggagaatcagggtcatttgcaggaagttagcatttctgcctgccttgtataagacagtgtttgtctaagggaaaatggatcttggcaaggtcaggatgaggcgggagtgtccacatgcttgtactcagatagtatataacactgtattcttaagattttttttttttgagatggcgtttcgctcttgttgcccaggctggagtgcaatggcgcgatctcggcttaccacaacctccgcctcccgggttcaagcaattcttctgcctcaccctcccaagtagctgggattacaagcatgtgccatcatgcccggctaattttgtatttttagtagagatggggtttctccatgttggtcaggctggtcttgaactcccgacctcaggtgatccgcccacctctgcctcccaaagtgctgggattacaggcgtgagccaccgcgcctggctcttaagatttttttactttaaacaatgtatgcagggcgggtgctgtggctcacggctgtaatcccagcactttgggaggctgagggggcgtggatcatgaggtcaggagtttgagaccagcctgaccaacatggtgaaaccccatctctactaaaaatacaaaaattagccgggcgtggtggtgcacacctgtaatcccagctactcaggaggctgaggcaggagtattgcttgaacctgggaggctgaggttgcagtgagccgagatcatgccactgcactccagcctgggcagagtgagacttcgtctcaaaaaaacgaaaaagaagaagaaaagaaaaagtatgctttgcaaaattgtaatgggatagaacaaaattgtagtgggatagtaacattattgttactagaagctttttaatttctctatcaccacttccctattcatctcccttcttttttccttctcttcttttgtgtcctagtatccttccttatcatcaaaatgtagtttttcctctgtttaatttctttcctttgtcatttttttttttttttttgaaaaaggctggtgtgcagtggcatgatcacggctcactgtagccttggccttctgggctcaggtaatcctcttacctcagcctcccaagtagctgggaccacaggcatgtgccaccacacccagctaattttttgtattttttgtagagatgggatttcaccatgttgcccaggctgatcttgaactcctgagctcgagcaatccacccgcctcagcctcccaaagtgccaggattacaggtgtgagccactgcacctgggctaatttttttcccctatcactcttattggcacctcagaatacacagtttgaaatgacaagggcatcataggaactattcacctagtgaaacttagtaaaagtctgctgtgggattaattggactgtatggagtagcaacccaggaagacctagaaccttgaattctttattgtctctgtaatccttgtgatttccgaatggtccttccatctggaggtcaaaaggctgttctgtgcatttgtgctctgtggtagagtgtcttctccctttcaccaaaagctactaccgccctgcaggcacccggaaaagttttcacagcttaggagagtggccttcctagatgctattaatcatctttcagtacaccctaaatgtatggaagattgagtttgagggaaccatgcatgccagagttgagagatccagggctgactttgactgctgggctacaatagctttaaatacaccctgaggagtccaatgcaggagagtcagtgactccaatgagccctgcaccatgttgcactgaaagtgaaaatcagtggttgctggccatggtgggatcccatcgctgctggaggctgcagcccagctatcagcccaccagcctagcttgtccatcaggctgggaaaagggcctggagatggaacatgagcagttctggccatctctggtgtttagcaggagacacttcagattgttcattgctatttcccacagtaaaattttctcctgcccttttttgatttttagtgataacacagttattttggccctctaaaaaatggatcctctttccctcctaacgtgtaattttatcatttttcatacctacttccaggaatgtctattgtaggagactacctgtgcaaatatagagtagcgtcattaaccaaagcagcttttctttgagtttcttggttaaccctagatgaacactgagtatttttagagcaagctcaaataagttgatattctatgaactaatcatagagaatggctgattataccttatcagctggatatatattctgtccaactgcctactgctatggttcttaagaaatctgatataactagacatgctccttttcctggctagggcttctacttcagttactttctgtatcctggagagtttggactgcttttacacttgtctcattaaacttgagccagaaccaaccccaaagaaatatctcttacttgcttcctttcttctgggtctttcctttttttctgtcacccaggctgagtgcagtggcatgatctcagctcactgcaaacctccgcctcctgggctcaagcatcctcccatctcagcctccctagtagctggggctacaggcgtgcgccaccatgcctggctaattttttgtattttctgtagagatggggtttcattatgttgcctgggctggtcttgaactcctgggctcataggatcagcccacctcagcttcccacagcgctggggttataggcatgcgccaccacgcccagtcctgggtctttcctttttcttagcacctactaaatgctaagtgcttggggataaaagcaaagagggcatgtgcagtctctcccctcatggaacttttgctctaagtgcaggccctaggttccttatagtaaagtcctacaatatgagaaataaagggtgctaagtcaaggaaaggcttccctgagtcagtgaaggacatggagtgtattttaggtgaaaggacaagaagcaaaagcaaggggtttttaggggctgagagaagtacagagtgctagagagaatattgagcattcagcctggaaaagttggcaggactgggtcatgcagggtgttacagacatgttgcagagttagtctaggggcagggggaaacagaagatatgaagtggagatctgactgttgatgtttgtgtttttctggataggttagtctggctgtagtgaagagacgacatggtgctgggaacaagaataaaggcagtaatcatggccagtgatgatggtggctaggttagagaagtagcagcagggatggccagagtggatagattcaagaggtagttaaggaggtagaatccacaggtctgtgggactgatgtgctgtggggactgcaagggagctcagatcatgtctaggtttctttctattggggcacctgagttgatgatgatgcatttactaaaataggagtagttggagcagacaaatttagttttcaactggaaagtttaaggcacctgaggacatcaatggagctgttcagtggttatttgaatgtgtggatctggagcctgaaggacaggccaagttgagattctaggtttggggatcatgagccatggaagtggatgaaccactgttaccgtctctgtggtattaagagccaaagggcaagttcttagccatgagaaacaccaacattaggggatgagtagtagaagaggggcctgcagggcagactgatgaatggccaaagagagagatggaaaaagagggatgtggggcagggatgtggggcaggcagagctggcacatgcctgtcctcacagctacttaggaggctgaggtgagaggatcacttgaagccaggagttcaagaccagcctgggcaacatagtgagacccccatctcaaaaaaaaaaaaaattaggcatgatggcatatgcctgtgatcccacctactcaggaggctgaggctggagcatcccttgaacccaggagtttaagtctccagtaagctgtgactgtgccactgtactccagcctgggcaaaagagccagaccctatctctttaaaaaaaaaaaaagacattacatggtgtcctttgagccttcctggccacactcttgtctagggtagatccccctcattacattgccctatatttctttgaaagcatttaccagattgaaataatatttgttagtgtactcttgcctctagatttccgaactccttgagggcaggaattttatctttctccttgtagtattttcagggcattgaagagtgtttggcacatggtagctcttcagtaaatatgtgtttatgaagagttataaagtgagaagtcagcgtttgaaatgctgctgagacattaaacaagataaggatgaaaaattgcccattgagtatgcaggcatgtgggatatcggtgactttatctagtataagttgtgggggatggtggagtcagaagtcagtttacagtgattggggagtgagtatgaggtgaggaagtacagaaagaatagataacttcttcacaaaatttggctgtgactaagatggggaggaccaccaccaaaagaaggctgtatttggaggaggaagtagggtgaaatggggtttttgttgttttttaaagacgagatttgagcatgttccattgcagattgaaaggagcctgtacagaagggcatgctggaaagccaagatagcaggtagggcatgactcgttggaaagcaggggaagacagggagtacagagctcagaaagcaattagtctttaagaggagaagtgtgcattctttgttttatagaaagaagagtatcgtgggggggtggggcaaggaagtttgcttgaggggtgtccagagaatttctttcttgtggcttctgtattcttctgtgagctaatagttgaggctgttagctaagagggagggaaccctacttggttctctctctccaaggctgagggcatgcccagccccaaggcccaccacctcaaaggctacccagaagtgggagacgaataacttctgtagtcctttcaatccccctaacaaagcattccagaattcagtctcagagaaaggggacaatttggttggtgactttattgtgcctttggcataggccaggattcccacaaggaagcggactattggaaaagcctggaggctagtaagtaaacagcctttcttgtcccctccctctctgaacacaggaagaattcccgcctctccctgcctattcctgtatataattcattcctttctttaacatctttaacagatatattgagggccagatttgtgctaggcactgttctagatgctgagaatgtaaaaagtgaaaatctaagttagatgtaattaatgctatggagaaaaatcaagcaagaaggggagaaggggtgatggtgaaagccttggcaattcttgatagggtaatcaaggaaggcacctctgagcaggaactatttgagggaagctctgaaggaggtggccatgctgccatgtagggaaagagggaatggtaagggggagcatgctggtatgtgggaggggcagcaaggaggctagtgctggggagtggagtgagcgctggggagtgggtaggagaggaagcttgagcaagacgcagattttgtagggccttgtaggcctttgaaaggactttgactttaactcactgtgagaggaatgaggagtgggctttgagcagagagtgacatgatctgacttctgttttctcagttcgctatggctgctgtgtgaggaagagacagggtggcgaggctggaagcagggagtccacggaagggaaatacaggctcctcatttatttatttctcttctttttctccaaagcaaagagattgttctgaagaccgtgctctaagggcatttgaaagactgccaggtagtgcgagcctgagatggtctggaggattctctctagccgtgactccgctgctctgaaggtcaactgagaagtcttgtgggacagagacttgagttaggaagccctcagtcacttgccttccacggtggccagccctgctgccatcattggctgaagcaccaccaggattcacggcacccaactgcttcagggtacttcgtagactctgcctcactacatgtcgaaagagttatttgagttctcttctgtttttttttaatttgttgttgttgttactgttttgatacctcggaaacacctccgttgacagttgttttggataggttgggtgtaccccatggctgcctctgaaggcagtgtctattttgagaggatggcttacctcttctttgtgaaaatactatctcatttcctggaaataaaatgtaaaacctgtcagttgctcagctgggctttggtgtatttaccttccttcccttcctgctcccagacagtctcacaagtaaacaccagcagctcatagattacaaccaagaaagtgactgtatcagatgatagacttcaagtgaatgtcagcctaagaggccaagctgcagatcgtggcaacagatgagctctgttaacctcctgactgtcgtgtttcctttttattacagaggtgggtcactgtttaccttgtttcaggggtgggagaaactcctttccttcagctggcatttgaatgtttccaaatctattttatctgacgtcatgaacacacaggcaatgattttatgacaacttgatgtgcttttttctttatttttcttttacattagaagttttctctcttttctccacctctcctttatttttaattttaattttaatttttgaaacaagatctgactctgttgcccaagctggagtacagtagtgcaatctcagctcactgcaacctccacctcccagactcaagccatcctcccacctcaacctcccaagtagctgggactacaggcatatgccatcacacccagctaatttttgtttttctgtagagacagggtttcaccatgttggccaggctggtctcaaattcctgaccttaagtgatccacctgcctaggcctctaaaatgctgggattacaggcgtgagccaccacgcccagcctataccccatgtattttcataaagggttggaaactattgattgccaactttttaaggatggtagggattttttctttgttgaatatactgtgaattttgggattctggagtccttagtcttcatttccattcttctgcccatgattactgatcaaaatactggtagagtcatggaggaagtaagttaaatgtggaaaaaatgctttaaaagtacttactataaccacatcataagaattctggaaaaatagagaacaaaaggaaaagattgttaccaccttgatttaataacttcttgtttccccatacatgtgttttgtttatagattgcatgggtatatgtcaatttttatatgttctgtgtttagtttacatattgtaattcatttttaagagagtacagacatacactttttgagtaggcaatatgttcacatagtttgaaattaaaggtacaaaatggcgtagaatgaaatgcctctcaccctttccccacagcgactacttcccactcagaggcaacaagtattacagttgcttgtatattcttccagagatctctgtctatacaagcaaaaacacatgtggtctttttccttgctttgcacaaatggtaaactgtacgctattctgaaccttgcttttttcagatatatgttggcaacagttccatgtcagtacatagtttcctttctttattacagctgcctgttttttcattgtgtatttgcaccatcatttacttttctggcttacttttgatagaaatctaggttggttcaaacctttttactcttaaaacaatgctgcagttaacacccttgtacatatatctttagagagaagatattttaaaaagaaatacctttttaaaaattattttattattttttaatagagactatgttgcctaggctggtcttgaaattctgggctaaagcaatcctaccaccttggcctcccaaagtgctgagattacaggcatgagccattgcacctggccaagaagagacatcttgacttgagcctgaagactatgtacagagactgacctcacagactgaccattccatcccacagctgctggacatagagtgatttgcagcccctcctttcagagtaccacatccctctcaagtgttccacaacatctaggaaagtgagctcttaaagacagactaaaaagagtaataaatcaatacaacaacattaaaagccagactagcggagtttgaatcttggccctgctgttagtaactgtgtgagccttgggcaagttactcagcctccttgtgtcttggttttggtttcttcatctctaagtaattatatctgtcattattgccctgatcacaaacaaaagcctgaatgtactatgtttaaaagacaaaccaaaaattaacccaaacttgcattatttgtctgagctacagaatgttctttccttggagagatatctgatattaaacatcatctgcattttacttgcctagaaaatacacggtaacttttctgccttgcagcatcaaactatagtacagctgagccccagtgctgtgcagtctgactctaattaaaggcaccttctttacagcagggctctggggaactggaaaagggggtttgtttcattatctggttttattaagcagatgaatgcagccagctatatgaagcactttgcagtgaatggcaggtgtcccatatctggttatgttaacctagaaagggctcactctacctctaggcatgtttcatcccaacaatcagactgtgccaaagcaggggactttgtcctttgtggattgcatagctggatacccatcatctgtttctctgattggaagctgctgttgtacagaaagacctgcatttcccccttgtctccagttctctcactactttttcctcctctgtgagtgaccatccaggcagtcaccataactgctggagtgtctgggattggtagctctctccaactgcctgcttgctctttacagcctctctctgtgactggaatctctccacctcatcgtatctaaggataacccagaaacatggggtgtcctaggtatgtttatctcgacactgaaccccctaggcttctgatgaatccagtgattagctaaatttgacatagaaagtaagaaggaatgtctactttgtattgtggtcctaatctaagatcaggagaatcctggaattgttatctgtctcttgctctgagatacagacttgttcataggtgtggggcctgattggaacaggatctgccattggtcacaataggtcaagggcttgttctgaaccctagttagcttcattcagagaaagaaacttcctacctggtcagctttttcagcttctccaacaaatgggagttgaggcagtaggagtgtggggttcttgggaagacgatggggccttgtattaaggagaaataatgaactatcttcttgattcttccattgagaaaagcatatgaatcctaggaaagggctcagcctgtgataggcattcaataaatactccaatgctgtcattcctttgtctacagcatccccaaacaatgtaccagtgatgggctacctgagctcatctagtcgccaagcagtatctcctgcttgctgctgctttactacattccagatgcccacctcatccaatttccagagccactatctctgctgtccactttccttcaggctctgtgaatacttcaacctgctgtgatttggggccgtttgtactctgcatgtattcaataaattcaattcagcaatagtta

SEQ ID NO: 168 - DNA, 66019 bp, Homo Sapiens
aataatatagagatcatgccaagtaagttcataagtctgggtgagatatttaaattctttcatataagtgtcgggatgggaggacaaggaccccagacgttcctcagtttgggagaaatcagagagggaaaaggggacgtggacacagacaatccctttggcccctgccacttcccggagaggaagcaagggagcgggctgctgggcatgctgggctcgaggacgagtaaggggtggagacggggaggactcagagtaggaggcgggatggttggagagacggaggtagagccggagtggaggcatacggtgggggggtcatgctgttctggtggaggattaggatgttgtcaaggaggggaaaaatcagtgggatcaaaggaggcgaagtcatcggctggggctattggggtgaggggagcaggaggcgagtggagtttggagcgggcgaggataatttgaaaagtagagcaagactggcagagggaaggatgactacagagagtaaagaaagccagaacataaggaatctcagaccacttcccattgcggtgacaaaagttgtcttaagtctctgagcacgttggaatcgaaagtgccattttcggaccattgggagtcatggtctaatttgtattgaggtcacgcggtattacagtaaaagataagccttttagggcagatttctgaacggaggccaagagtattgagattgcataggaggcacccaaggcaggtagttttagaaggagcagactgaaaggctcctattatgaatggaagtaggggcgcacgtagaagaagaagagactgccggtgacaaggacgtggaagagggcgttccctttcctggggaacttgtctggaatagagaaggtaaccgccgtgtcaggtgtccctgacacagaggaaccagaagcctggaggccggaggaagcccttgacccagggctgggtcttttggaaactgagagacaggcggtcaagggtttcggagaacagcaacagtctctttttactcaccctggcggaggctttgatggtggatgaagtcgtcagcagtgggagagtctaggagattctctgggacttcggcaggttcagggaaggggagagactggccaggagataggtgataggggagggagggggagagagagagagaaagagagagtgagagagagagagacagagagcgagagccggccagagtctatccccttcccggtttcggcaccagaatgtaaggtcagccaagagaaaggaaaaatagacccaaagtcaggcgagcaagtttttattaacctgccggctgaccccttaacagtcaagggaagcagcaccaagcttacagaatgaggggtttatattggggaaagtagcttgagggagttctttggtatggccgcatcctggggttgtttgctggttaattttgccacatatcaccttgtgacgtttattacaggagggtgtaggtaaagtttgtttatgcttcccacaaccttcccctatgcggtctgagtggtttgtaattggggtttgcttatcgcagcaaggtctgataagtgaaagtcggctggcttcaccatggcccttgataagggcttagaaatgtaaagagacttggggaagggtgggtggcacagagaagagttgcagagcattagggggaggggtgggcagcaccaaagaagctttctttgggcagtttgtccctaacaatatccaaggactgagaactgaggagagcaaagatcacctggtggctatcaagtggaccatccagaggcaatactccttatctgaggaattcataagtaattagacttcccctttttttttttttgagatggagtcttgctctgtcgccaggctggagtgcagtggcacaatattggctcactgcaacctctgcctcccaggttcaagtgattctcctgcctcagcctcccgagtagctgggattacaggcatgttccaccatgcccagctaattttttttttgtatttttagtagagacggggtttcaccatgttagccaggatggtcttgatctcctgaccttgtgatctgcatgcctcggcctcccaaagtgctgtgattacaggcatgagccactgcgcccagcccagacttccctattatctaaagccagcatctggtaccaagcttctttacaaaaaacttataagtaagtatgtagcaggatgagccacagacaaaactcctcagacactgggttaaagaaggaaggagctttatacggtcgggagcatcggcagactcacgtctcaaaaaccgagctccccgattgagcaattcctgtcccttttaagggctgacaactctaagggggtccacatgaaagggttgtgatcgattgagcaagcagggggcttgcatgcaccagtaatcagaatggaacagaacaggacagggattttcacaatgcttttccatacaatgtttggaatctatagataacataaccggttaggtcaggggttgatctttaactaccaggcccaggccatggcaccaggctgtctgcctgtggatttcatttctgccttttagtttttacatcttctttctttggaggcagaaattgggcataagacaatatgaggggtggtctcctcccttaactagaatttctatacgtctctggaatgtatgcatgttgaaactcattgtgcaacccttgctgacatcatggcaccaaaatgtctacagatgtaatcacttatcatgacatgtgtggctaagatggtccaaattatccttagtctcccactttaaggtccataaatactcctaagtaaaatccactgtgcagctcagtcctctcttgccgaagcgccctgttgcagtctgctgcaatgtgttatctaatataactttccttttcaaacctaaactgttgttggtaaattattttaccacctgcaagccaaccactctctgctgctggggctctgataaggccactaagaactagtcctcaatggctgggtgcagtggctcatgcctgtaatcccagcactttgggaggccgaggtgggcagatcacgaggtcaggagatagagaccatcctggctaacatggtgaaaccctgtctctactaaaaatacaaaaaaattagctgggtatggaggcgggcacctgtagtcccagctacttgggaggctgaggcaggagaatggcatgaacccaggaggcggagcctgcagtgagtggagatcacgtcactgcactccagcctgggcaacagagggagactttgcctcaaaaaaaaaaaaaaaaaaaaaaaaaaaagaactagtcctcaatactatgaattcatgtagaagaggaagactcagaataaatggcaagtgaagtagcagaaggaccaggtgtttctctgtattttgatgcattgacgacttgaggccttgtggacccttgaaggatggcccctctcagtgttagctaattcctagagatagtaaacagcactttgtggattgagcctttcaaatacaaaccaaccgagtgcgctccctcaccaccttcattattgagctctcacactctggacactattttcccaacttaatcattcaaggacaaagtaaccgacaattagggacagcccttatgcctcagagcccgcttagcattggcttagcagccaatgctaagcctgcttgtcattcctttcctgttccttcccatggaaaatacaattaaggctgttacccacattttcctcttgctcctgcctcctgaccaaacctactacctttaaaacactaggacatgcctgtaatcctagcactttgggagaccgaggtgggcggatcacttgagctcaagagtttgaggtgagcctgggcaacatggtgaaacctgtctctacaaaaaatacaacagattagccagacattgtggcatgtatctgtagtcccagctactcaagaggctgaagtgaaggatcacttgagcctgggaggttagggctgcagtgagctgtgatggtgccactgcactccaggctgggcaacagagtaagaccctgtctcaaaaacaaaacaaaacaaaaaaacactatgaaagtgtggtagctttgaagccaagtgaaaaattggtcctccagaaaaaacaacccacagaatgggagaaaatatttgcaaaccatacatctgaaaagagcttaatatcaaaaatatataaggaactcaaacaactcaaaagcaagaaagcaaataacctgatttaaaaatgggcaacaggctcagcacagtggctcatgcctgtaatcccagcactgtgggagtccaaggcgggtggatcacttgaggtcaggagtttgagaccagcctgaccaacatagtgaaaccccatctctactaaaaatacaaaatgagccggacgtggtggcgcatgcctgtaatcccagctgcttggaaggctgaggcaggagaatcgcttgaacccaggaggtggaggttgcagtgagctgagattgcgctattgcatgccagcctgggaaacgagtgaaactccgactcagaaaaaaaaaaagggcaacagatccaaaaagacattccaaaaagaagcagaggcttatgatctaataattaattaaaggtcgtacctcttaacattgttgcattggggattgtttcccacacttgatctttgggggacacattcaaaccactgcaaatattattcacaatagcctcaagatacagaattgacttgtgtccatcagtggatgaatggataaagataatgtggcatatatgtacacagtagaatactactcagtcttaaaaagaaagaaacagtcatttgttacaatgtgggtgaacctggaggaccttatattaaagtgaaataagccaggcacagaaagataaatattacattatctcacttacttgtggaatataaaataatttcaactcaaaagtaaggaatggaggccaggcatggtggctcacacctgtaatcccagcactttgggaagccgaggtgggcagattgcttgacctcaggagttggagactagcctgggcaatatggtgaaactgagaggagaggagaaggggaggggaggggaaaggaaaaaggaaaggaaaggaaaaacagtggttaccagggtgtggggggattggggagatgttggtcaaaggatacaaaatgtcagttagataggaggaataaattcagatctatagttaataacaacgtactgtattcttgcaaatggctgagaatagattttaagtgtccttaccagaatatgatacgtatggtaatgcatatgttaattaagttgatttagccattccgtaatgtatacgtatttcaaaatatcatgtcgttaaaaaagaaagagagaattggccaggcgcagtggctgacacctgtaatcccagcactttgggaggccgaagaaggcgaatcatgaggtcaagagattgagaccatcctggccaacatggtgaaaccccgtctctgctaaaaatacaaaaattagctgggcatggtggcgcatgcctgtagtcccagctacttgggaggctgaggcaggagaatcgcttgaactcgggaggtggaggttgcagtgagccaagattgcgccactgcactacagcctgggcgacagagcaagactctgtctcaaacaaaaaaaaaaaaaaaaaagagagaatttagttctcagataacagaattgttgattgctctagaagctgctggcaggtcaagtgggatgagcactgggaattaaccatcagattccataattggatggcaccgtaaacagggaaaacataatgaaagtggagaagagtaagctttagaccaaacactttaagtggttgaactttgtcctcaacaggagaaagaagcccagttccaaatttaaattacaggggagatagcatgaaaatgtcaaggcaacaatgttcccagggcgcataatgggtttttctgtgtgtgcatgtgtgtgagtgtgctttgatcgcaggtactgagcttcctgctagtgggagggtccatgaatgtcttggctattgaggccccacaactctgagggttaaaaagtcaagtggattaaaatggatctgattttcatgttacagagagaacatattagtttttttgctgtactaacttcttagtacagactaaaagagcagatcagtttaatgaaaagacaagaaaaataaatcaggaaaggattcagagaagtgggatttcaatttggccttaagggaggacaggatgttgaaaggtggaggagagatgtggtatctcaggtggagaaacaaccagggcagtggcaatagtgcacctgagaggcggcttggctgagtgtgggcatccactggagagagatgggaaatcattcaggaggtatcagtggaggctgggttctggtaggttgtgaaaatcaggccgtggtgtttgggcttggcatccttggccagggtggtaaatggaccattttctgctataactacctatggtagttacaccaacatgggatgacaagactttttttctgctgaacttggatatggtcttagaaatggctcttcagataatcattactggcaatcaatatgaaacttactaccaatctggtggtaggcaaaaggaagcaaatgcaggttttctcaatcagtaaggacataataaatgtggtgtttaagaaatattgatatttaggataggtcagctagaggctgttgctaagtatataatgctgaggtcactagaactcagcagacaaacttggggaaagtttaataatttgatgataatattagagtttttctctgcactggtaagaaatttcagttaggttattgtgtcaggtccctttgtgagaaaaacagtctcattttggcttgtcaagttacagtggcttgagagtagataaggatagtatattatgattcttctttatttcctcttctgttttttttttttgttttgtttttttgttttttttttgaggcagagtctcgctcttgtcatccaggctggagtgcagtggtgtgatctcagctcactgcaacctccgcctcttgggttcaagcaattctctgcctcagcctcccaagtagctgggattacaggtggccgccaccatacctggctaatttttctatttttagtagagggagggtttcaccattttggccaggctggtattgaattcccgaccttgtgatccacctgccttggcctcctgaagtgttgggattacaggcgtgagccaccgcacctggccccctgcatttttttttttaagacagtgtctcattctgttgcccaggctgtattacagtggtgccatcataactcactgaagccttaacctcctggctcaagtgatcctcccatctcatcctcctgagtagttgaggctacaggcacgaaccagaatgccagcttttttttttttctcttaactactttttctcctttttttttttttttaatttaaattctggggaacaggggcagaacatgcaggtttgttacagaggtatacacgtgccatggtggtttgctacacccatcaacctgtcatctacattacgtatttctcctaatgctatccctcccctagcccccaacccctgacaggccccagtgtgtgatgttcccctccctgtgtccatgtgttctcactgttcaactcccacttataagtgagaacatgaggtgtttggttttctgttcttgtgatagtttgctgagaatgacggtttccagcatcatccatgttcctgcaaaggacatgaactcatcctaatttatggctgcatagtattccatggtgtatatttgccacattttctttatgcagtctatcactgatggccatttgggttggttccaagtctttgctattgtgaacagtgccacaataaatatacatgtgcatgtgtctttatagtagaatgatttataatgctttgggtatatacccagtaatgggattgctgggtcaaatggtatttctagttctagatccttgaggaatcgccacactgtcttccacaatggttgaactaatttatactcccaccaacagtgtaaaagcattcctatttctccacatcctctccagcatctgttgtttcctgactttttaatgatcaccattctacctggtgtgagatggtagctcattgtggttttgatttgcatttccctaatgaccagtgatgatgagctttttttcatgtttgttggctgcataaatgtcttcatttgagaagtgtctgttcatatcctttgcccactttttgatggacttatttttttcttgtaaatctgtttaagttctttgtagattctatatattggccctttgtcagatggatagattgcaaaaattttctcccattctataggttgcctgttcactctcatggtagtttcttttgctgtgcagaagctctttagtttaatcagattccatttgtcaattttggcttttgttgccattgcttttggtgttttagtcatgaagtctttgcccatgcctacatcctgaatggtattgcctaggttttcttctagggtttttatggttttaggtcttacgtttaagtctttaatccatcttgagttaatttttgtataaggtgtaaggaagggatccagttccagctttctgcatatggctacccagttttcccaacaccatttattaaataaggaatcctttccccattgcttgtttttgtcaggtttgtcaaagatcagatggttgtagatatgtggagttatttctgaggcctctgttctgttccattgatctatatatctgttttggtaccagtactaggcaattttttttactgtagcctcgcagtatagtttgaagtcaggtaggtagtgtgatgcctccagctttgttccttttgcttacgattgccttggctacgtgggctcaatacccctgatgaacattgatgcgaaaatactcaataaaatactggcaaaccgaatccagcagcacatcaaaaaagcttatccaccaagatcaagtcggcttcatccctgggatgcaaggctgcttcaacatatgcaaatcaataaatgtaatccatcacataaacagaaccaatgacaaaaaccacatgattatctcaatagatgcagaaaaggcttcgacaaaattcaacagcccttcatgctaaaaactctcaataaactaggcattgatggaatgtatctcaaaataataagagctatttacgacaaacccacagccaatatcatactgaatgggcgaaaactggaatgaaggattctttttattttttatttttttttattttgagatggagtctcgctctgtcccctaggctggggtggagtgcagtgtcgccatctcggttcactgcaagctccaactcccgggttcacgccattctcctgcctcagcctcccgagtagctgggactacaggggcctgccaccatgcctggctaattttttgtatttttttttttttagtagagacagggtttcactgtgttagccaagatggtcttgatcttctgacctcgtgatccgcccgcctccgcctcccaaagtgctgggatccatgcccggccaaaagcattccctttgaaagccggcacaagacaaagatgccctctctcaccactcctattcaacatagtattggaagttctggccagggcaatcaggcaagagaaagaaataaagggtattcaattaggaaaagaggaagtcaaattgtctctgtttgcagatgacatgattgtatatttagaaaaccccatagtctcagccccaaatcttcttaagctgacaagcaacttcagcaaagtctcaggatacaaaatcaatgtgcaaaaatcacaagcattcctatacactaataacagacaaacagagagccaaatcatgagtgaactcccattcacaattgctacaaagagaataaaaatacctaggaatacaacctacaagggatgtgaaaaatcttttttttttttttttttcagttttatgtagagactaggtatcactatgttgtccaagctggtctcaaagtcttgggttcaagccatcctcctgcctcagcctcccaaagtgttaggattacagaagtgagcttcggcgcccagcctgtattactttcctttttctttctttcttttttttttttgaaatggagtctccctctgttgcccaggctggagtgcagcgatttctgctcactgcagcctcacctcttgggctcacgtgaccctcccacctcagcatccctagctgttcaaatttattgtccaactcttttgaatcgtttatcaacgcaaatctgtcaatgcccacttatttttatttatttttttgaggcggagtctcgctctgttgtccaggctggagtgcagtggcgcaatcgcggctcattgcccctccgcctccccggttcaaacgattctcgtgcctcagcctcccaaatagctgggattacaggcgcgcgccaccacgtccggctaatttttgtatttttagtagagacggggtttcgccatgttggccaggctggtttcgaactcctgacctcgggtgatccgatcgcctcggcctcccaaagtgctgggattacagacgtgagccaccgcgcccggccctcatgaacttattctttagcgtttcattttgagagcgggattcacaagggaattgcggaaacagcagcgaggccccgcgacccctcggcccacgtgcgcgctgtccctcgggtcgccccgcgcccgccgggggcggagtccgctgtgacgcgtgcagggcggcgcgctcccggaagtgacgcgcgacggttcgtgcgtgcgtgcgggcggctgcgtcgggctgcaggagaagatggcggtctccacaggtcggttcccgggccgggctgcgtgattttccgctccgacccggctctgcccctccgtctgctgctggcgcccgagcgctgaccgtgcgggagaagcccgagtgcgctgtctcgaatgccgcgctctccgcagagcgtagcctgggaccgggtgggaccggcgccgaggccccggcggccgtcgggttggcgggtcgtgctcgcgcgtcggccgcgcgccggcgggctgggggcggggtggctcccgcgcgggcgcccccgtaggttccggcgggcgcgggtccgagttgtaggctgaaggctctacgggagggaggcgaggaggcccaaggtgggcgggtgtcaacctccggcaccgaagatgggtcaggccaaccggcaccgaagatgggtcaggccaagaggtgtcctggatcagagtaggggtcccattcctttggactctccttgacatgggttggggagtagaggacgattgctccttaaaataagagcgagaggatctttcttacctgactgaatacgtgtgatctttttattatttatgaggaaaactgcagtgcaaacaaaataaaagaccagagcaagatgaaagctaattgaagaacaagtggtttcttagataagctgttcaactcctctttcctactgaatacaatgtttggtttcctgtgagcacacaagtattaacgttgaggttttagacattagaccatttcagaaatgttaaaaacgttaagctttagtttacatttaaaaatgttaacccgtgtgatctgcctttttcttttcttttctttttttttttttttttgagtcagaggctcaccctgttgcccagttggaatgcagtggtgtgatctcggctcactgcaacctccacctcccaggttcaagtgattctcctgcctcagcctcccaagtagctgggattacaggcgcgtgccaccaggcccggctaatttttgtatttttagtagagacggggttttgtcatgttggccagactggtctcgaactcctgacctcaggtgatccgcccacttcggcctcccagagtgctggaattacaggtgtgagccaccgcgctcggcctgatctgccttttcctagtcttcgttgaaacaagagtatagagcagtgtgatttaatagtttatgccatcattgcataataaaatgaattttcaaatctatatgtactgaaatggaaggctttgaatatatgttgtaattgttgctttagagtaatacctcaggatacattctgcatacattttaattaagtggtgtcttttacatctttattacatataggtgtcataggttttaagatctttagcagttctagtgttggggtagtatacatacttgggtcagctagctagtaaggcaaggattgttttaaaagtggaattttagtgttatgactttactgtgcttgctgaaatctaatctgtgctcgttaacggggccatatctttataacagttgtgcttaggacctcttatagatttttgaaaatttagtaataaaataatgcattttaatttaatacttttcattttccttttgtgggttgcattattaaacacaattttttcataacactatacatgagtgtatgttaatattttgaaaagaccaaaggttagatgatattaatggcaaatactttttgttaatcacttttagttgttttggaagttgaatataaattataaagattactgataaattattagcatattgtacatagggagtctgtattttttttttttttttgagatggagtctcgctgcattgcccaggctggagtgcagtggcatgatcttggctcactgcaccctcctcacctcaggtgatccacccgcctcagcctcccaaagtgctggattacaggggtgagccaccgttcccatctactagttttttttttttttttttttgagacgcagtcttgctctgtcacccaggctggagtgcagtggcgcgatctcggctcactgcaacctccgcctcccgggctcaagcgattctcctgcctcagtctcctgagtagctgggacaacaggcgcgtgccaccatgcccagctaattttttgtatatttagtagagacggggtttcaccatattggccaggatggtcttgatctcttgacctcgtgatccggcctcccaaattgctgggattacaggtgtgagccactgcgcctgggtttgtttgtttttttttttttttgagactgagtctctcgcttctttgcccaggctggagtgcaagggcatgatctcggctcactgcaacttccacctccctggttcaagcaattcctctgcctcagcctcttgagtagctgggattacaggtgcatgccaccacgcccagcaaatttttttgtatatatatattttttttgtatttttttttttttttttagtagggacaggttttcatcatgttgtccagactggtctcaaactcctgaccccaggcaatccgcccaccttggcctcccaaagtgctgggattacaggtgtgagccacagtgcccagcctattaattagttttaattttactattagctatacttttgtttgctttttggtaacatgggaagtaaatagtacctgtgtatttgtgaaagcagcatgatacagcttaaaatttaaaattagatgagctacatcgatgtaatgcacgtgtttgtttgaaacggagtctcgccttgttgctcaggctggagtgcaatggtgcgatctcggctgactgcagcctcttcctcctgggtttaagcaattctcctgcctcagcattctgagtagctgggtttacaggcatgcaccaccacgcccagctaatttattgtatatatattttttctagtagagatggggtttcaccatgttggccaggctggtctcaaactgctaacctcaggtaatccatctgctccggcctcccaaagttctgggattacaggcataaaccactgagcttggtctaatacacgtgttttttatttaagccaaagtatctcgataacagttgtttaagaggccaaaaagaaaaaccctgacaaatatgttttgatctttagttcagtgtgcatcatataccttagcccctttaacccttccttctactggaagagaattttggaaggaaaaaacttttaattagactgagactttttgagacggagtcttgctgtgttgcccaggttggaatgcagtggcatgcgatcatggctcactgcagcctcgacctgctggggtcaggtgatcctcctacctcagcctcccgagtagctgcgaacacaggcacgcattgccacacctggctaatttttaaattatttgtagagacagggtctccgtatgttatccagtgtagtctgaactcctggactcaagtgaccctcctgccctggcctgaggttaggattacaggtttgagccactgtgcctggccagacggagacttctaagcagaaacatttttggccatcccatctggtcttcttattttgcagatgagaaaactgaggctcaaacaagtaaaaggctatacataggtggttactagtacaggcaagactagaatccaggtcttttacccttagtctgatgcgctctccattatgaagaactctgaatttggaatatttctcagaacatgaatcttaattactccctttcacacttcccttcttagcacaatccttgtttcagactcttagatccttcttatggatgaaaggggaacgtagccctcaccagctaggttctccttttccaagagacagagttacccatgcaattcaagagtatttcacaggacagaggttaagaagctactctcgggaatagaaatttgatactgtttagtactcatgattcaaaattttattagattccagcattaataataacaattagtttagatagaaaagtatgtgcaggccgggtggggtggctcacacctgtaatcccagcactttgggaggccgaggtgggcggattacctgaggtcgggaggttgagaccagctggaccaacatggagaaaccatgtctctactaaaaatacaaaattatccgggcgtggtggcacatgcctgtaattccagctactcggaaggctgaggcaggagaatctcttgaacccgggaggcagaggttgtggtgagccgagagcacgccattgcattccagcctgggtaagaagagtgagactccatctcagaaaaaaaaagaaaaaaagcgtgtgcaatagttttaaaaaaatacaatagttttagttttacagaaaagttgtgaagatagtacagaaagtttccatgcacctcacattcagttttccctgtcaatttcctttttttttctttcgggatggagtcttgctctgtcgcccaggctagagagcagtggcgtgatctgggctcactgcaacctctgcctcctgggttcaagtgattctcctgcctcagcctcccgagtagctgggattacaggtgtgtgctgtcacacccggataattttttgtatttttagtagagacagggtttcaccatgttggccaggctggtttcaaactcctggcctcatgatccgcccgccttggcctcccaaagtgctgggatcactggtgtgagccactgcatctggcttcgctgttaatttcttatattggtatggtacacttgtcacaattaaggaaccaatattgacacatttattattaactaaagttcagatttccttagtttttctttaatgtacttttgctgtcctaggacttcatccaggataccacattacattgtaacgtgaaactttttttttttttttgagatgaagtctcgctctgtggcccaggctggagtgcagtggcgtgatcttggctcactgcaagcactgcctcctgggttcatgccattctgtggcctcagcctccgaagtagctgggactataggcgcctgccaccatgcccggttaattttttttgtatttttagtagaagtggggtttcaccgtgttagccgggatggtctcgatctcctgacctcgtgatccatccgcctcggcctcccaaagtgctgggattacaggcgtgagccaccgcgcccggcccacatgaaacgttttacatttatcacttaggtaatattaatggtacagtgaagctctagtctctgactgtagatgcctggaaaatgtctttgagttatgagaaactcagaaaaaattgatgaaagaatatgttttctgctatgtaggcagaaaacaaaaccaaaatataacctactaattgccttcttcagaagtgggtagcattgtatatactggaagaactagtttagcagtgttctgagttccctgctgcccctgacagactactgtgccaccatgggcatgtcagttaatcactaaacattgcttttcccatcccatctgtgaaaagattggacaacatcatcttgttttcctctttagatgaagatacttggatatggacagaactcgggtgtggtgatagaagagaattacatagtttaaatcataacctagaacttgggaactaaacgatagaagagctgaactatggtagtctagtgtatttccctcttgaggcttccataactggcctggttgatttttctaggtcatttgggagcctgaattctcttgataaacatgcttttgataatatggtacaacctcactgtacaggcagtcctttgaacggcagttggcagaggtaaaaatggccatgcaaaaaactacccaaagcagtcttaataattgggaaaattatggttattctgagaccttcaaaaatgtcaacacattaagaactctccctgtttagaaatatgcaggaaagggccgggcatggtggctcacgcctgtaatcccagcactttgggaggctgaggggggcggatcacgaggtcaggagatgggagaccatcctggctaacacagtgaaaccctatctctactaaaaatacaaaaaattagccgagtgtggtgatgggcgcctgtagtcccagctactcgggaggctgaggcaggagaatggtgtgaacctgggagtcgaagcttgcagtgagctgagattgctccactgcactccagtctgggcaacagagagagactctgcctcaaaaaaaaaaaaaaaaaaaatgtgcaggaaaatgaaaccagtaaaattaatatttagtatgtcataatttaaagtatcagatattaagaattaaaatgttttatttcattaaaaaaagcttgttggctgggcgtggtggctcacgcccgtaatcctagcactttgggaggccgaggtgggtggttcacgaagtcaagagatcaagaccatcctggctaacatggtgaaaccccgtctctaccaaaaatacaaaaaactagccgggcgtggtgacaggcacctgtagtcctggctactggggagactgaagcagtagaatggcatgaacccgggaggcggagcttgcagtgagctgagattgtgccactgcactccagcccgagtgacagagcgagactccatctccaaaaaaaaaaaaaaaaaaaaataaggcttgtcaagagtagcttgaggctgggtgcagtggcttccacctgtagtcccagcactttgggaggtcgaggtgggtggattactagagcctaggagttcaagaccagcctgggcaatacaagaaaatcccatctctacaaaaaatgcaaaaattagctgggtgtggtgatgtgcacctgcagtcccagctacttgggaggctgaggtagagtatgggttgagcctgggaggttgaggctgcagtgagctgtgatcgtgtcactgcactcctgcctgggcgacagagcaagacactgtgtcaaaaaaaaaattaatttgaacaatgcttgctaatgttttgaagtacattatctgtacattgtggaatggttaaatctagctaattaccaaatacattatctcacatagttatcatttttgtggtgagaatacttaatagctactgagtatttttcaagaatacagtatgttgttaactaatcaccatgctatacagtagtgctcttaaacttgttcctcctgactgtaattacgtatcctttgtctaacatcttcccaatccccacccccgtaaccccaaccatcctaacctctggtaaccaccatctcctgtctacttctgtgagatcaattttgactccatatatgagtgagataatatgtatttgtctttctgtgcctgtgttatttcagttaacataatgttctccaggttcatccatgttgttggaaatgagagaatttccttcttttttatgattggaacagtgtcccactgtatacgtataccacatgttctttatccatttgtctgtgtggttttttttttttttttttttgagacggagtctcactctgtcacccaggctggagtgcagtggcgcgttctcagctcactgcaacctccacctcctgggttcaagcaattctcctgcctcaggctccctagtagctgggattactggcacccgccgccaagcccggctaatttttgtattttagtagagatggggtttcaccatattggccaggttggtctcaaactcctgacctcaagcaatccatctgcctcggcctcccaaagtatggggattacaggcgtgagccaccgcgctcagcctatccatttgttggttgatggatacttaggttgattctatatcttgcatattttgagtagtgctgcaataaaatgggagtgcaggcctctctttgacatactgattttattttctttggctatatatgcagtagcaggattactggatcatacggtagctctgtttttaggtttttgaggaactccatactcttctttctccatatggttgtactaattcacattcccaccaacagcatgcttagattatcctttatcaccacatactcaccaacacttgttatctgtcatctttttttttttgagacggagtttggctcttgttgcccaggctggagtgcaatggcatgatctcggctcattgcaacctccacctcctgggttcaagcaattctcctgcctcagcctcccgagtagctgggattacagccacgcaccaccatgcctggctaattttgtatttttattagagacggggtttctccatgttggtgaggctgctctcgaactcccaacctcaggtgatcttcccaccttggcctcccaaggtactgggattacaggcgtgagccgccgtgcccagcctttttttttttttttttttaattgagacagagtctcgctctgtcgcctaggctggagtgcagtggcgagatgtcagttgactgcaacctccacctccaggttcaagcgattctcctgtcttagcctcccgagtagctgggattacaggcacccgccaccatgcctggctaattttcatattgttagtagagacatgatttcaccatgttggccaggctaggctggtctcaaacgcccgacctcaggtgatccacctgccttggcctcccaaagtgctgggattacaggcgtgagccactgcgcttggcctcatctttcatccttttgattatagccattttaatgggagtgaggtgatacctcatgtgggtttttttttgcatttctttgatgattagtgatgttgagaatttttttcatatacctcttggccatttgtatgtcttttgagaaatgtctattcagatcttttacccatttttacatgaggttattttcttggtattgaatggagttccttatatattttggttattaaccccttatcagatatatagtttacgagtatagtgaaccattctgtatgttctctctctcttttttttttttttggtggagtttcgctcttgttgcccaggctggagtgcaatggcacgatctcagctcactgcaagctctgcctcctgggttcaagggattctcctgcttcagcctcctaagtagctgggattacaggcatgtgccaccatgcactgctaattttgtatttttagtagagacgggatttctccatgttggtcaggctggtaataaactcccgacctcaggtggtctgcctgcctcagcctcccaaagtgctaggattacaggcgagagccaccgcgcctgccagttctctctttattgtttcctttgcagtgcaggagatttttagttttatgtgatccaaattgtctgtttttgcttttgttgagtgtgcttttgaggtcatatcctccaaaaatcattgcccagaccaatgccattgacttttcttcctgttttctagtagtttcatagattgcctttttttttttttttttcctgagacagtctcaacctgtcacccaggctggagtgcagtggcatagtcacggctcgctgcagcctcaacttcccaggctctcacctcagcctcccgagtagctgggactacaggtgcacgccaccatacctggctaatgttttgtatttttagtagagatggggtttcgccatgttggccaggctggtctcgaactcctgacctcaggtgatccacacgcctcggcctcccaaagtgctgggattacaggtgtgagccaccatgcccagctgcacaatgcccaattttgccacttctgttcaacataatactggaagtcctagaaagagcaataagacaagagaaagaaatacaaggcatcttaattggaaaagaagttaaactgttcctgtttgcagaagacatatgatgtcagtgtttattgttataaaaacttctgtcttaaaactgcttttgctgtattccataggctttgtatgctgtgtgtttcagttttcatttttttcaataaacttcctaatttgttttttaatatcttcattgacctattggttgttcaagagcatgtgtttaacttccatgtttttgtgaattttctgaagatcctcctgttaatgatttctagttttataccattgtggtcagaaaagatatttgatatgatttccatcttcttaaatttgttaagacttattttgtggcttgacatatgatctatccttgagaatgttccatgtgcagcttaaaataatgtattatgccactgttgaatggtatgttctgtgtatgtcttttaggtccatttgttctatagtgtagcttaagtctcatgtttccttgttggctttctgtctgcatgatctgtgcattgctaattgtgaggtgtgaaaatctcctactgttactgtagtacaacctatctttcagatctattaatatttgctttatatatttaggtgctttgatgttgggtgcatatatatttacaattattctcttgctaaattgacccctttgttattacataatgaccttctctatcttttttttacagtttttgatttaaaaatctattttattgggggccaggcatagtggctcatgcctgtaatcccagcactttgggaggccgaggcgggcggatcacttgagatcaggagttcaagaccaacctggccaacatggcgaaatcccatctctattaaaaatacaaaaattggaccaggagcggtggctcacacctgtaatcccagcactttgagaggccaaggcaggtggagcacgaggttgggagttcaagaccagcctggccaaaatggtgaaaccccatctctactaaaaatacaaaaattagccaggtgtggtggcgggcgcctgtgaccccagctacttgggaggctgaggcagagaattgcttgaacctgggaggcagaggttgcagtaagccgagatcacggcactgcactccagcctgggtgacagaacaagactcctgctcaaaacaaaacaaacaaaaattgggcgtggtggtgggctcctgtagtaccagctactcgggaggctgaggcaggagaatcgtgtgaacctgggagtcgggagattgcagtgagccttgattgcgccactgccctccagcctgggcaacagagcgagactgtctcaaaaaaacggcagggcatggtggctcatgcctgtaatcccagcactttgggaggctgaggctggcggatcatgaggttaggagtttgagaacagcctgaccaacatggtgaaaccccgtctctactaaaaatacaaaaattagccaggcgtggtggcacatgcctgtaatcccagctactcaggaggctgaggcaggagaatcacgtgaacctgggaggtggaggctgcagtgagccgagattgcgccactgcacttcagcctgggtgacagagctagactccgtttcaaaaaaaaaaattagccaggcatggtgccatatgcctataattccacttgggaggctgaggcaggataattgcttgaactcaggaggtggaggttacagtgagccaagatcctgcgactgtactccaacctgggcaacagagtgagtgagactctgtctaaaaagaaaaacaaaaataattttatctgatataagtgaagcaattcttgggctttctctctctctgtctctctttttttttttttttgagacaaggtctccctatctaggctagagtgcagtggcgtgaacatggctcactgcagccttgaactattgagatcagtgattttcctacctcagcctcctgtgtagctgaccacagatgcatgccactatgccttgctaattttttatattttttgtagagatggggtctcaacatgttgctcaggatgctttcaaactcctgggctcaaacaattttccctccttggcctttcagaatgctgggattatagggtcttgttctctcttgatttccatttgcatggcatatctttttccattccttcaccttcagtctacatgtgtccgtacaggtgaggtgagtcttttattggcagcatatagttgggtcttgttttttttaaccattcagtcactctatgtcttgattaaataatttaattcatttacatttagagtaattattgatagatgagttaatactgccatcctgttaattgtttcctatttgttttgtagctcctttcttcctctcctatggtcttctttggtggttgattttctctagtagtatgtttttgattcctcgcctttttattttttgagacagtgtgttgctctgacctggtcatagctcactataacctccaactcatgggctcaagccgtcttcttgcctcagcctttggagtagctaggactataggtgtgtgccaccaaacctggctaattttattttcttgtagatacggggtcttgccatgttgcgcaagcgggtttgaactcctgggctggagtgatcctcctgcctcagcctcctgagtagctaggaatgcaggcatgtgccacgatgcccagctaattttttttttttttttaatttttgtagagacaacgtcttgctatattgcccaggctagctttgaactcctggcctcaagtgcttctcccaccttgggctccagagcactggggtttcaggcatgatccactctgctggcttgttattgctttttatgttttatctattataggtttttttttttttttttaagatggattttcactcttgtttcccaggctggagtgcaatggcgtgatcccggctcactgcaacctctgcctcctgggttcaagcaattctcctgtctcagcctccttagtagttgggcttacaggtggccgccaccacgcccagctaattttttgtatttttagtagagacagggtttcactgtgttggctaggctggtctcgaacccttttttttttttttttttttgagacggagtctcgctctgtcgcccacgctggagtgcagtggtgcaatcttggctcactgtaagctctgcctcccaggttcatgccattctcctgcctcatcctcctgagtagctgggactacaggtgcccaccaccacgcccggctaatattttgtatttttagtagagatggggtttcaccgtgttagtgaggatggtctcaatctcctgacctcgtgatctgcccgccttggcctcccaaagtgctgggattacaagcgtgagccactgcgcccggccggtcttgaactcttgacctcaggtgatccacccacctcatcttcccaaagtgctgggattacaggtatgagccaatgcgcctggctctctttttttttttgagatggagttttgctctgtcacccaggctggagtgcagtggtgtgatcttggctcagtgcaacctctgcctcctgggttcgagcaattctcctgcctcagcctcctgagtagctgccattacaggtatgcgccaccatgtctggctaatttttagtagagaccgggttttaccatgttggtcaggctggtctggaactccttacctcagatgatccacctgcctcagcctcccaaagtgctgggattgcaggggtgagccaccacgcctggcatataggtttttgctttgtggttaccatgaggcttacagaaaagatcttacagttacaaaaggttattttaaactaataacaacttagccttgatggcctaaaaaatcctttatacttttaccctactctcccattttgaatttttgatgtcacagtttggatctttttttttttttggagacagtgtcgttcttgtcacccaggctggagtgcaatgatctgatcttggcttactgcaaccttcgcctcccgggttcatgtgattctcctgcctcagcctcctgagtagctgattacaggcggctgccaccacaccccactaatttttgtatttttagtggagatggggtttcaccatgttggctaggctgctctcgaactcctgacctcaggtaatccacctgccttggcctctcaaagtgctgggattacaggcatgaaccaccacgcccagcctgcatctttttatattgcatattcctttacaaattattgtagttactttcaatagttttgtcttttaaccttcctactaaagatacaagtaatttacactccaccattacagtattagtgtattctgaagttgaccttgtgtttacttttcccagtgagttttatactttcagatgtttttgtgttactcatcagtatccttttctttcagcttgaagaacttcccatagcatttcttgtaaggcaggtcttgtggtgataaactccttcagcttttgcttgcctgagaaagtctttatcctttgtttctgaagaacagctttgtcctgggacagacagctttgtctaaaggacagattttttcctggtcgcatttttttttttttttaaagagagacaaggtctgttgcccagactggtcttgaactcttgggcttaagtgatctgcctgcctcagcctcccaaagtgctggggttacaggtgtgagcccagcccctgcgagcgctttaaatgtatcatctcactctcccctggcctctaagttttctgttgagaagtctgctgctaggtatattggaagtctcttatatgttatttgcttcttttctcttgctgccttgaggattctctctttgtctttgatctttgacagtttggttataacatgtcttggagtagtcttatttgggttgaatctggttggagacccttcaacctgtagccatatacttataactttctccatatttgtacagtttttttgctactttttctttagatatacttttttttttttttgagacagagtattgctctatcgccaggctgtagtgcggtggcgcgatcttggctcactgcgacctccgcctcctgggttcaagtgattctcctgcctcagcctcctgagtagctgtgactacacgcacgcaccaccacgctcagctgatttttgtatttttagtagagacggggtttcaccatgtttgccaggctggtcttgaattcctgacatcaggtgatccacctgcctcggcctcccaaagtgctgggatcacaggtgtgagccaccatgcccagcctaacatgaaacttgatagaagtggatatgaggcattcaaactagaataaacagtaacattcagtgttcaggctgggcgcgcagtagtggcttacgcctgtaatcccagcactttggaaggccaaggcaggaggatcacttgaggtcaggagtttgagaccagcctggccaacatggtgataccctatctctattaaaaatgcaaaaaaaaattagccaggcatgatggtgcttgcttatagctccagctacttgggaggctgaggtgggagaatcacttgaacccaggaggcagaggttgcattgagccaagattgcgccactgtactccagcttgggtggcagaatgagaccctgtctcaaaaaaacaaacaaaaaaaatcaatgtttgaaagtttgtttcaaacgtagttcactttttcaaaggctctttttcaaagagctgattaaaataagtttgacatatgtaagatgggacttcaggactgggtttgggagtgctttattcttgtttataaagtcttagctgatttgtgtgagagcagatggtattttcagtaagctggaactcagcagctgtttcaaaccttagaaggagataaatccttgtggctgtgtataggtacttttaaatagaaatagaaaaaacagtttaatagaatatatgttatggattgcctggactctagaccaagttcattttatagatgagcagtagaaatacagatatgaaatggcttttgcaggattttttagctagatgttgagtccagagctggtatcttgatttaagactcttggctgggtatggtagctcatgcctgtaatcccagcactttgggaggccagggtaggtggatcacctgaggtcaggagttggagaccagcctgaccaacatggagaaaccccgtctctactgaaaatacaaaattagctgggcatggtggcacatgcctgtaatcccagctactcaggagactgaggtaggagaatcgcttgaacctgggagatggaggttgtggtgagccgagatcgcgccattgcacaccagcctgggcaacaagagctaaactccgtctcaaaaaaaaaaaaaagagattcttaaatactgcttctgtatcacactgtatcctacgtatgccttggttgcttttatttcctggaaacccagtgatgttattttacagataaatgctgttaaggatcaagacaaaatacttgatagagtctaaaggcattaatagaatattaaaactccatgttcttttaaggtgtgaaggattttattgaaatgagtaacaaaaatttagaaaaagcgatttcagtggctaaatgctggtcaatattcacataaatcttttttgtaagcacatatttggtattgcaggtaaatacatatatattatttgttcccttactgatttttttttttttttttagaacgagtcttgttctgttgcccgggctggagtgcagtggtgcaatctcagctcactgcaacctccgcttcctgggttcaagtgattctccagcttcagcctcccgagtagctggaactacaggcgtgtgccaccacgcccggctagcttgttgtatttttagtagaaacggggtttcaccgtgttagccaggagatggtctcgatctcctgaccctcatgatctgcctgcctcggcctcccaaagtgctgggattacaggcgtgagccaccatgcctggccagtgattcttataaatctgtgattttcttttcttttcttttttttttttgagatggagtctcactctgtcatccaggctggagtgtagtggtgcgatctcggctcactgcaacttgtgcagggttcaagcaattctcctgcctcagcctcctgagtagctgggattacaggtgtgcaccaccacacttagctgattattattattttttttttgtattttagtagagaaaagggtttcaccatattgaccaggctggtcttgaactcctgacatcaagtaatctgcccgccttggcctcccaaagtgttgggattataggcgtgagccaccgtgcctggcctaaatctggattttcttttttttttctttcttttttttttgagatggagtcttgctctgttgcccaggctggagtgcagtggcgtgatctcggctcactgcaagctccgcctcctgggttcacgccattctcttgcctcagccttccgagtagctgggactataggcacccgccaccacgaccggctaatttttttgtattttttgtagagtcggggtttctccgtgttagccaggatggtctcaatctcctgacctcgtgatccgcctgccttggtctcccaaagtgctgggattacaggcgtgagccaccgcaccgggctctggattttctatctgaggtttatctaagggaggcgagggaaagggaggttattgggagtgttttaagtgtttgatagaaacgtatctctgtatcagaggtagaatttacaacctgatgagttatcctaaacatttcagtattgcagctgttattcctaaagtgaccctttagaatatttagtactgttcctttctttttttttttcattttattcttccttttacctacttccccaagtaggctgcctctagataaaactgtatattatcgggtaggaagaacttggttccaggagttttgggactgggaagattggacaacagctatgtaacccgggcttcttattctctctagggcttatgaagtggttactaaaatctaaagttctatggaaaagggccagtttcctctaggatttgaccacacctttgagggatgcttcataagaaagctgaacttctggtggatggagatgtaaatgaatattgagtttggtttcagggagctgttgtttcaagacaactttactgagatataattcacataccatacagttgtctatttaaagtgtacaattcactgatttctggcatgttcacagatatatgtaactgtggtcattttagaacattttatcacctcagaaagaaactctgtaccctttagctctcactgttctatacctccaaacctcagcccctgactactataatctgtctcaatagatttacccattctgtactttcatatgtgtagatttatatattatgtggtcttttgtgactggcttctttcacttagcgtaatgtttttaagggtcatccatgttgtagcatgtatcagtatttacatgtttttatggctgaagaatattccagtgcattggatacaccacatttttgtttattcattcatcatgttggtggtgttttccaccatctggctattgggaataaggctgctgtaaacatttatgtacacgttccacccccgccccgcttgagtagatacctaggagtggaactgctgggtcatgttaactatgtttagctgtttgaggaactgctaggctgttttccaaagggagacttcttttttttcgagacggagtctcgctctgttgcccaggctggagtgcagtggtgtgatctcagtccactgcaacctcagcctcttgggctcaagtgatcctcctgcctcagcctcccacgtagcttggatgccacgtagcttggatgacaagcctgcgctaccatgcctgtctaatttttgtgtttttagtagagactggattttgccaagttggccgggctggtcttgatctcttgacctcaagtgatctccctgccttgaactcccaaagtgctgggattacaggcatgagccactctgcccgggcccaaaaggagaccattttatattcctaccagcagtatatgaaggtcccagtttctccacatccttaccaacacttattatctgactttgattgtagccattctagtgggtgttaagtggtatctcattgtggttttgatttgcatttccctgataactagtgttattgagtatcttttcatgtgcttactagtttttatttatttatttaattttttgagacaggttcttgttctgttgtccaggctggaatgtagtggtgcagtcttggcttactgcagtctccacctcctatacccaagtgattctcctgcctcagcctcctgagtagctgggactgcaggcacgcgcctttatgcctgggtaatttttgtatttttagtagagatggtgtttcaccatgttgcccagggtggtcttgaattgcttggctcaagtgatccacctgcctcagcctcccagaattgtggcattacaggcgtaagccactgcacctggccctttactggctatttatatatcttctttggagaaatgtctattcagattctttattcattttttttttgtttttgagacggagtctcgctctcgcccaggctggagtgcaatggcgcggtcttggctcactgcaacctctgcctcctgggttcaagcgattctcctgcctcaacctcccaagtagctgggattacaggtgcccaccaccacgcctggctaatttttgtatttttagtagaaatgggatttcaccatgttggccaggctggtcttgaactgctgacctcgtgatctgcctgccttggcctcccaaagtgctgggatttacaggcatgagccactgtgcctggcccctttactcatttttatttatttatttatttttgagctggagtcttgcattgtcatccaggccggagtgcagtgtcatgatctcagctcactgcaacctccatctcccaggttcaagtgatcctcccacgttagcctccagagtagttaggattacaggtgtgtgccaccacacccggctgttttctttttttttttttttttgagacagagtttcgttctcgttgcccaggctggagtgcaatggcgcaatcttggctcactgcaacctctgcctcctgagttcaagcaattctcctgcctcagcctctcaagtagctgggattacaggcatgtgccaccacacctggcgaattttgtatttttattagagatggggtttcaccatgttggtcaggctaatctcgaactcctgacctcaggtgatctgcccacctcggcctcccaaagtgctggaattacaggcgtgagccactgtgtccagaccaacacagctaattttttttgtagttttagtagagacggagtttcaccatgttggccaggcttgtctcaaactcctgacctcaagtgatctgcctacctcggcctcccaaagtgttgggattacaggtgtgagctactgcacccgacccctttacccatttttaaattgggctgtttgtctttttattgttgagttatcggagttctttatgtattctggatacaagtcctttatcagatgtatggtttgcaagtattttctttcattctgtagattgtcttcactttcttgatgttgtcctttggaacccaaaagtttaaaattttgatgaagaccaattaattttttttctacttcatttaaatgcagattctggctttttgtatgtagctcatcatctagctggtactttgttttaaaaacaataatgttcaggccaggtgcagtaggaggccaaggtaggcagatcacttgaggtcaggagtttgagagcagcctgggcaacgtaccgagatcctgtctctacaaaaaaataaaaaaattagctgggcacaatgctgtgtgcctatagttccagctcctcaggaggctaaggcaggaggatcacttgtgcccagaagttcgaggttgcagtgagacatgattgtaccactgcccaccagcctgggcaacagagtaagaccctgtctctaaaatgaacacacaaacatcagagaaccatgtttcatgcaggatatggtcagaaactaaaatataaatgaataaaaacaacctgatgaagtactgtgaattctagttgatgctctggttgtgattactgtatgacagaagggcaggagtctgagctcttcttgccaggtgaggtttaatctcactaaaaaaagttcgatagccagataccatgcatactgtaaacagttttattctttggaagtagtataattatgccagaggtttttcaatttatggattggaatgttcttgaaaagtacagacagtgcattgcttggtgtactgctcttcatgccattgtcatctgctacctaaattattgattgttgtttactaaacagtactgatgtaaatggttatgtcctcagaggaaatacttatgttattgagaagtctttaattttctcaagtttttacctcataaacagtgatttggagagatatctgtttattttgcttaatatggctttctgactgtggaagccagctacagcttcctggactcacaggtgagcagttatgcccatttaatagtctccgttagaagacctcacatcttttaaagtgcatgccatcctaattttacttagaaattaaaactagagaggaaccagaatatattagcttacttaactttcttccactccctagtgtattctaagggaagtctcccttgatagttctgcaataaacattcttagctacctcactggagaatgtgaagtaactgctacattcattggcttatctcattgggatatctgtagtgtatccaggtgaaatcttctgcaataacttactgcattatatttggatgtattcacttacatggttgtcttccccacgagatagtaatgtcctggggaaaggattctgtgttcagtatcagcaacatctgctgtcagtttatacatattgagagaaagattaaaaacaaacatttgccataaattcaccaggtgtttatcaagtgcctgttgtgtcatcattttctatggtacagtttctttctatgtcagagatttaataatgagaaaataaaggactcaagtaaaacctagcttttcaggctgggcgcagtggctcacgcttctaatcccagcatgttgggaggcccaggcaggcagatcacttgagcccaggagttcgagaccagcctgggcaacatggcgaaaccctgtctctactaaaaatacaaaaattagctggatgtagtggcatgcgccagtggtgccagctacttgtggggctgaggtgggagaattgcttaagcctgggaggtggaggttgcagtgagttgagatcgtgtactccagcctgggtgacagagtgagaccctgtctcaaaaacaaaaaacaaaacaaaaactggctaggcatggtggctcactcctgtaatcccagcactttgggaggctgaggtgggcggatcacttgaagtcaggagtttgagaccagcttggccaacacggtgaaaccccgtctctactaaaaatacaaaaattagccaggagtagtggtacatgcctgtagtcccagctatttgggaggctgaggcgggagaatctcttgaacctgggaagtggaggttgcagtgagctgagattgcaccattgcccttcattgtggctctgggccacagagcgagactctgtctcaaaaataaaaaaccaaaacacaaaaacaaaaattagccaggtgtggtggcaggcacctgtaatcccagctacttcggaggctgagccaggagaagcacttgaacctgggaggcagaggttgcagtgagctgagatggtgccactgcactccagcctgggtgacagagcaagactctgtctcaaaacaaacaaacaaaccccccccaacaacaacaacaaaaaaacaacttagcctttcctttttgtagattgtaatatttcactgttttatttttagtttgcttttctgaagtaaaactactaaaagaatattttagttcatatatattcattaaatctaaaatcatgaagccgcttattttccccttatctagctgagttaatatctaacaaatagattctaaatgaactctccatataggtggtgattttttggcagtggctgggggtagggtggttttggttacaacctaaagagtaacagtagtatgattaatttctcctgtatgtaatgtattctccacaccacagaattgagatactttgcaaatcctctaatccagaggtttttccacttgtgtttgaaagtgtagtacagatgcttcagatgtacgaagtttgacttgaatttgtttttttcttttttgagacggagtcttgctctgtcacccaggctggagtgcagtgatgtgatcttggctcactgcaacctccgcctcccaaattcaagcgattctcctgcctcagcctcccgagtagaggtgtgtgccaccactctcggctaattttttgtatttttagtagagacgggggtttcaccatgttatccaggatggtctcaatctcctgacctcatgatccacccgccttggcctcccaaagtgctgggattgcaggtgtgagtaaattttgtttttataaattacatttttttctgctatatttcatcaattctaaaacacattgaaatatccgaagtggatatatgtgttgtagtttaattggtagagtgtttaaattttttaaaattatggtatcatgtagttggttatgccatcttagatttgatcaaagacagtatttaaaaaaactgttaagatgcccacattgaggtgaatatataatagatttcaaatactggattctacaaacatactgacgtgttctcatttgttaactgaatactaagcaattgtgatcaatttaaacttaaatgtattctattgaaatatatttttaatctcatacaattttttgaaatattttagaggctaaagttgaaaattggtttatctggtaaaccttcatttcagcaaaagaatattaccttctgattttttttggtgaattatataaatatagtttttagtattaaatctatttgtataaattcacagtgtctgaatgatggatgtatttcaaatttaaagttcagaaaaagtgtagctgggcatggggctcacacctataatctcagtactttgggaggctgaggcaggaggaccccttgagcctgggagtttgagaccagcctgggcagcctagcaagaccttgtctctactaaaaatattttaaaaattagctgcgtgtggcggtgcatgcctgcagtcccagctactctggaggctgacgtggaaggatctcttgagcctaggaatttgaggctgtagtgagccatggcgacagagtccctgtctcaaaacaaacacgcagacacacatgcacacacaccccagcatatgctttgatgtcaataattgtgtattattgacattattgacattattaatgtcaacaaatagtgttcttgagagtggggttgtaactgatgtttttgaaacagccagtgggggttatgggcccagttaggattctggaacagttttcctgagtgtagaactgtggtggggcttatgattcatactcatttctttgctggatgagtgttaaaagcggataggatggcagacccactcagcaaggaattccactgaggatgccttgaaaggagcaggggcataccatccagagtacaagacagagtaaagttatcacatgaaggactcatttgcttgaaaagacttgacttttcttagtgtcctcagatattctaacaactttacaaggcaaaaagactcagtgattttttttattctttttccattttttttttcctgagacggtgtctttctctgttgcccaggctggagtgcagtggtgtgatgtcagctcactgcaacctctgcctcccaggttcaagcgattctcctgcctctgccacctgagtaactgggattatgggctttcaccaccacgctggctaatttttgtatttttagtagagatggggtttcaccgtgttggccaggctggtctcgaactcctggactcaagtaatcctcctgccttggcctcccaaagtgctgggactacaggcatgagccaccacacctggctcattccttgtttttttaaaataaaatttattgtgtgtatttaaggcatatatatcatgttatgagatatataggaaaatggttactatagtgagtcaaattaacatattcatcatcttacagttacctgttttcctccctgtggcaagagcaaaaatcctgactatagcaaactcttattaaaagtcctcatggctgggtgcgggctcatatctataatcctagcactttgggaggccgaggcaggctgatcacttgagcccaggagttcgagactagcctgggcaacatggcaaaaccccgtctctacaaaaaatacaaaaattaccttgcatgttggcatgcgactgtagtcccagcaacttgggaggctaaggtgggaggatcgcttgagcctaggtggatgaggctgcagtgagttttgattaagccactgtgctctagcctgggcaatagagggagaccctgttgctaaaaaaaagaagaaagtcctcatgctgttcattagatctgcagacttgttcatcctacatacctgctactttgtatcccttggtctatagctccctatttcctttccagctccaaccttggtaaccactgtttttattctgtcttaatatttgacctctgttttcttttccttttttttttttgagatggagtctcgcactgtcaccgggctggagtgcagtggtgccatcttggctcactgcatcctccacctcctgggttaaagcgattctcctgcctcagcctcccaagtagctgggattacagattcccgccaccatgaagccaggctaatttttttgtatttttagtagagatggggtttcactatgttggccaggctggtctcgaactcctgaccttgtgatccccctgccttggcctcccaaagtgctgggattacaggcgtgagccaccgcacttgccctgttttctttttttaaagattcctcactcccaatgaattttaaaagtcaattgtagtttgtctttggatccatactgatgtatacatgagagttttttttagaattatgatcaaaatatatgtgctgctattaggtctcccccaccccccctttttttttaacttatacacaattaatataattcatgtagtttaaaatgactttatataatattttaaattatgtgacatagtttgcctgaatgtataccaattggcttcttaagtttttgcactgccaaataaacatttttgttcagattgcttttccaacccccctcccttcatttatttattgctgtgtaacaaattacatcaaaactttgtggcttcaaacgatgattgatttttttcttataatatgggagttgactgggtggttcttctgctggtttcacttagagtcactcatgtggttgcatcagctggtgaagggataggcttgttgcccgggacgccttgctccccctccctgcagcctctccaggtggccagttaggacttcctcacatcccggtggtgtcagggtgttcagaattcttacatgatggttggcttccaaaagaacgaaagcagaagttagcattcctcttacaaggtgagtgccagaactggccttagcattgctgcttccctatttattctttttttttttttttttttttttttggaggtggagtctcactctgtcgccgaggctgtagtgcagtggcacaatctcagctcactgctacttctgcctcccgggttcaagcaattctcatgtctcagcctccagagtagctgggactacaggtgtgcaccaccatgcccagctaatttttttttggtatttttagtagagacggggtttcaccatattggacaggctggtcacaaactcctaacctcaggtgatatacccaccttggcctcccaaagtgctgggattacaggcatgagccaccgcgccctgccactgctcccctcttctactgataaaacaggtaggaaggtttgcgcagcttcaaggggaggaggggtgtgcctgggcctggagggtggaggatggctcacagcactctgcaggcattctgcgccctgtttttttgtcctgaggggaaatttcacaaagtagcatttaagtcaaatcacaatacatatttaaaaattattgtttttttttttttgtgtgtgtgtgtgtgtgtgtgtgtgtgtatatgtatgtatgctttttttttttttttttttttgagactgggcccgggttcaagtgattctcctgcctcagcctcgcaggagctggaattacaggtacatgccactatgccagagctactcaggaggctgaggcaggagaatcacttaaactcatgaggcggaggttgcagtgagctgagatcatgccgctgcactgtagcctgggtgacagagtgacactccgtctcaaaaaaaaaattggaagttgtataccttgtaattattacttttctccccttgcctttcttttttttttttttttttttgagaccgaatctcactctgtcacccaggctagagtgtggtggcgtgaacaaacatggctcactgcagcctctacctcccaggctcaagtgatccttccatgttagcctccggagcagctcagactacagctgtgcaccaccatgcctggctaatttttgcatttttttgtagagatggggttttgcatgttgctcaggcttgtcttgaactcctgggctcaagcgatcctcccaccttggcctcccaaagtgttaagattacaggtgtgagccaccacacctggccaattaaaaaaaaaaatttcttaggatagggtcatgtctgatgttcttaagtagtgctccaaatgaaatgaaggaatattaaaggaggaggaaaatcagacttcacttactagtgggaggaatagcaaagaatttgtggccatctttaatttggtatagagtataatgattcttgactcaaaaaaatatatattttttgagacagagtctcactctgtcactgaggcaggagtgcagtggtgcgatcttggctcactgcaacctctgccacctgggttcaagaaattctccttcctcagcctcctgagtagctgggattacaggcacgcaccaccacgccgggctaattttttgtatctttaggctagagacggggtttcatcatcttgtccaggctggtcttaaactcctgaccttgtgatccacccgccttggcctcccaaagtgctgggattacaggcatgagccactgcctggccgactcaaaaatattttttcaattgatgttgatacataatattttacatattttgtgggggtacatgtgatctttcattgtgtgcatagaatgtatagatcaaatctcagggtatttgtggtatccagattcttgactcatgacagatagttaatatatatgagctggccaggcgcggtggctcacgcctgtaatgccagcactttgggaggccaaggtgggcggatcacaaggtcaggagtttgagaccaagcctggccaacatggcgaaaccccgtctctactaaaaatacaaatattagccatgcatcgtggcaggcacctgtaatcccagctacttggaaggctgaggcaggagaatcacttgaaccctggaagcaaaggttgcagtgagccgagatcgtgccattgcactctgtcctgggcgacaagagcaagactctgtctcagaaaaatacgtatataggttatgaagttttaggaagtgacattttgggcatcacagggattggttgtttcttttagaatcagtctatgaaaggataaggctttagaaataatgtgtttcagcagggattctgactagggatagaggtgggggaaggaagcaaagtgataggatttctcctttcttttgcctcttctccccagggcagtgggttgccttcctgtactaggctcttgtgtgttggtcattgagatatattggggtagacaaaaagttgtatgtataccactgatacagtttagtagaagtatgcaaagtataaaaagaaagcactttgctcagtcatctggttaggttcttagtagagcaaaactctcgctttatgatgttacctcctccttcttacgcttctccttctctaattgtggtttctgtgtcttgatgccctgctgaactttaagctccacaagagcaggactttgactatcatggctagatcatgggcctagccacaattctttggctcacagtagacatttggtgctgttaaaatggaaataaataaataaaaccaaagaattacaacagtaaaatgaaccacaactttgtctcagttaactgagtgcttaacacttcttccctgatcatcctgtttcttggtcttttataacagctgatacttttctcctcctcttacctcccaatccattcccacgttgcagcaaagtgaagtttatgcttaaaacccctccctgaatcctcattgctgcagataaaggctgaattgctaagggtgcccttccaggccatttctgactctttgctctcatactcagttgcagtccccaaacattgcccagcattctctctctcttttgtaatgtcctccccacgccttttttggctccacccgtccaatcctcccttttctttttaaataaaatatttcaaacaccaggaaaatacgtgaatacacatatacccaccctggctattcacattctaataaattcttgcttcagattgttttttggaaacagaacatttctagtacatttaaagtcctattttcacttcttagtcctaggccactttctctttgcccagaggtcatcaatatcctgatttttattatttgtatttatttatttattttgagacagagtcggactccgtcacccaaaatggagtgtagtggcgtgatcttggcttactacaacctctgcttcctgtgcaagtgatcctcccgccttagtctcctgagtagctgggactacaggtgcgcaccaccatgcccagctaattttttttttttttgagacagagtttcgctctgtctcccaggctggagtgcagtggcacaatcttggctcactacaacctctgcctcccaggttcaggtgattctcctgcctcagcctcccaggtagctgggactacaggcgcacgccaccatgcttggctaattcttttgtgtttttagtagagatggggtttcaccatgttggccaggctggtctcgaactcctgacctcaaatgatccgcctgcctcagcctctcaaagtgctgggattacaggcgtgagctaccatgtccagccacccagcgagttttttgtatttttagtagagacagggtttcactgtgttgaccaggctggtgttgaactcaagtgatttgcccatctcagtctcccaaagtgttgggattacaggcatgagccaccacacctggcccaataatcctgattttttttttttttttttgagacagagtcttgctctgtcacccaggctgaagtgcagtggcgtgatcccagctcaccgcaacctctgcctcttgggttcatgcgattctcctgccttaggagaatttttagtagagatgggtttgtatttttagtagagacgggtttgaccatgctggccaggctggtctcgaactcctgccctcaggtgatccacctgccttggcctcgtaaagtgttgggattactggcgtgagccaccgtgcctcgcccgacccctgatttttaaatatcttttccactaacacctttatactttttgctacatatgtatatatgtataaaaactatgtttatttatagcttctataccagtttattctaatctcagcagtgaatgaacttccaatatctacacgtttgcccagatcaagaattatcagacttagtatttgtcagtttggtggctagaataagccgttatgattccctgattactgatgaggttgaacatatttttatgtttgttggtcattactgttttctgtaaaccttattcctaatatgttctcattgttctctagggttttcttttccttgttgatttctaggaggaattatttctgtattttgaataacgttcttgtcttctatatgttattcacatcctttttcagtctgtggcttatcttttcatttaatctgcctataattgatttttatgtatactatgagatcagattgggttctaattttattttttcatattggtaaagtgttccaacaccattaacttttcctactttttttttccttctcttttgagacagggtttcactctgtggcccaggctggagtgcagtggtgtgatcacagatcactgcagtcttgacctccctgggctcaggtgatccccaccttctgaatagctgggaccacaggcatgtgccagctaccacacctggctaatttttgtattttttgtagagatggggtcttgccatgttgcccaggctggtttccaactcctgggctcagttgattggcctacctttgcctcccaaaatgctgggtttacaagtgtgagccgccaccatgcccagccttttctacttttttttttttttttcttttgaaataacttcagatttgcagaaaagttaacataagtagtacgaaggattcccatataccttcatgcagatccatcaaatgttgatgtttaacatttttgcttgctcttgtgtgtactctctcttcccccctcccttcacattcgattttgttttttgggggaaccattcaagggtaagttaacagatactgtctcttcacccctacattcttcaactaggacattttcttacaatagaattatcaaaatcaggaaattaatgttgatagaggactattatctaccagccctattcagatttcaccactactgttctttaaagcaaaataatgataataatatttttcctgataccaagattgcatttggttgtcatgcctctattctctttactgacttttagtgttgcctctactaagaagcacattttcatatatgatatgtctgctttggggcttttctttttcattagtctgtccatttctgtactgattccatattttcttaatgatttctttagctgatgaggaagtcttaaaatctaggaaagtgtcccctctgttttttctttttttgttttgtttttgtttttgagacagtctcgctctgtctcccgggcaggggcttgatctcggctcacttcagcctccacctcctgggttcaagcgattctgcagcagccttccaagtagctggttgggattacaggtgtgcaccagcatgcctggcttatttttgtatttttagtagagatggggtttcatcatgttggccaggctgggttttttttttttttttttttttgtgtgtgtgtgtgtgtgagacagagtctcactctgtcacccaggctggagtgcagtggtgcgatctcggctcactgcaagctctgcctcctgggttcacaccattctcctgcctcagcctcccgagtagctgggactacaggcgcccgccaccacgcctggctaattttttgtatttttactagagacagggtttcaccgtgttagccaggatggtctcgatctcctgacctcgtgatctgcccacctcggcctcccaaagtgctgggattacaggcgtgagccactgtgcccggccttttttgttgttttttttttttttttaagacagagtctcgctctgtcgtctaggctggagtgcagtggtgcgatctcggctcactgcagcctccgcctctggaacattaaatgttccagaccagtctggccaacacggtgaaactccatctttactaaaaatacaaaaattagccgggcatggtgttgcacgcctgtaatcccagctatttgagaggctgaggcaggagaatagcttgaacctgggaggtggaggttggctcggctacagagcgagactctgtctcacacacacaaaataacacagcaggtgtatgaggaacattaaatgtctttcctaacttactgtatgcaaataaaagtagatacttaagaaattgtctaaaaatatttagtaaacccatttctacacagacaaattaaaagttctgagaaatcaggctaaaatcacctcaaatttataaggtttgattaataaatatttacctttgcatatacacgaaagcaaaaaaaggtaggaatactttcaatttcagataacaataaattgaaatcaagtacaaattttgactccccttcctaaactgaataaactcttaaaaagcagacacactttacttgtgtaaacactcttcttttttttttttttaaatggaatttctctcttgttgcccaggctggtgtgcaatggtgtgatcttggctcaccgcaacctccacctcccgggttcaagcgattctcctgcctcagcctcccgagtagctgggattccaggcatgtgccaccatgcccggctaatttcgtatttctaatagagatggggttcctccatgttggtcaggctggtcacgaactcccaatctcaggtgatctgcctgcctcggcctcccaaagtgctgggattacaggcccagccgtatccactcttttaaatttaggcatccatgtcactggaattatgtttttcacaggatcacttttaaattcattaagaagtttctttatgtatataagcctattcattttacttgaaaggttttctgtcttcccaaagtcaaatccttactaactaaaattaggaattttgaaaaaccatccatgaaaatctcacaaacacattaaaaaatgtattatctaaggtgcataaaattaaactccatattaccaatagcatttaagaaactcatataaaatgataatgttttctttaaagagacatactgaaagccaagtcagttgttcacaggaggtggttttgcaccattatttgaactttgatgtgtgaatttgctttagaagtccatggtctgtttactctctgacagattctgttttcacatgcccctcacatgaaggttcactcctcattcttttttttttttttttgagacaggttgggtgggactgcttcaggattctaaaagacagtaccttctggtgcactttctaagatggaacataattctactctttgaaaatcattagagagtatatattaatgaactttggcttctatgaactttctgggcatgcctgtttgattggtgcagagtccttggctgtaacagaaacatcaaatagggaaaacgatttccttatggttgattgacttacatcagtataaaattgatgaggaatttatatacacgttgtatactgctgttaatgtttggtacagtgctttctttagtgttttcattttgaggggttattagattcagcattttctggagcagaatgctttttaaaggggatttggtctttttgggaaataatttataaaggttaatttggaaaaagctgaatttaaatacgtgtagctcttataattatgagctttttacatttacactgacgttcttttgtataggagttaaagttcctcgtaattttcgcttgttggaagaacttgaagaaggacaaaaaggagtaggcgacggtacagttagctggggccttgaagatgatgaagatatgacacttacaaggtggacaggcatgattattgggccaccaagggtcagtgttataaattatattttttctattaatacttattgttaaagttagcatttaattttatactattgatattaaaataagcaattatgataacttctaaaatagttcctttttattttgtttacatttattgatgcttcccacgtgcaggatataatgctcgattacgtagaggattggggggaggaaggttgatatggtcattgccatcaaagttttgcagtttagtaagggagaaaaaatcagtacaaatgacagattctaaatatgacagagcaagttcactacgggactttagaatatgtttcttctagctggaataattgaggaaggctgaacagtggaggaagttgcctttggaatgatccctaaaggactgactggtaggatttcagaaggtggtgatggggatggagaacattccagatagagaggagaaaaggtgaggaaatggagggggtatgtggggagagcagtcattttgacgtaacatgttacctcttgtgtgaacctgagggtttctaaattggtttgcattgagtgcatgttgctatttgccctctgacacttcacatgccatagaaatgctgtaggtctcagcttcttcatctataaaaagtctatgattcttacatttttttctagtatggttggcaactggcccattgtactttgtctttcttgggtttatgaagttttatttttactcaaagtcttttagtctttttttctagcttgggatttttttttttttttacattgcattccttacttaatggtcccatccactgcactccctgcagtgaatctttgaaatttgtctctctaatgtttttggcttgttggaaagagcacacatttgaagggttttttaagtctttggttttgtatactggttgctaccttatgatgagagcattttaactgttttgctcttgggtagagtttagagttcctcctgatgatgatgatgatgatgatgatgatgattattgagacaacatcttgttcagccacccaggctggagtgcagtggtgtgatctcagcatactgcaatctcagcctcctgggctcaagcgatccttccacctcagcctcctgaggtggtgtgcaccaccactgctggctaatatttgtagtttttgtagagatggggtttcaccatgtcggccaggctggtctcgaactcctggcctcaagtgatccacctgccttggcctcccaaaatgctgggattacaggtgtgagccactgcacccagcccctcctgattattacaaaagaaaaatgtatcaggtaattagcaacattaattatagagaatgaattagtgtgtgttttatgttgttttctggtgttcctttgcaaaattcatgcacactcctacactgataggctccctgtttactcccttgctctattttttcctgaagacattttaggaaggaaatataatgttgatatgttgatggatagagttccatatgacttggtatatataatggaagccttgattttcactgcctgtgaacatcattactgtggtctgtttggtttaaaaaaagcgcttataattgatgaacattctgacttactgatttgaagatttaacagtcagaacttggtagaatataaatttgaaattatttagatttcgtttttctctagccactgcctgcagcagactttaagaatgttttggaacttgtgatgagttcatcagtggtcttgtgggctgacccacagcacagttcctagctgtcgtggaccggttcctgcttggtctttcacccggttggggtcccctgcaggatgccccaactagttgccattcctggtgtcaccgaacctcaggaaactctatccactgggatgggggtgaaggctgcttctctgcaactctctcccctctcagggcacacagacaaaatgctactgtggtcctccattccctgtgggtggtggttttggagctgcaggagagaaaaggtcataatagcctttcctcacttgtctcaagcttcacgctgaggcacttataataaaaagcagagaaaagcatacaaatttatttaagttttacatgacatgggaacattcagaaaggaagacccaaagaaacagggaaaccgtgtatttttatgctaaatttgatgaagagtggacagtgatgcaacagcgtgattggatctgatggtaacacactaggtaataaactgggggaacttaccagggcctgtttgttcacattattcctgtgtctttggatttcattcctttcttggcataagacaagacccctttggagtggttctcatgacctacctacttcgtggggaggtcagctagattttagggtctgcttcaggggagaagggggcgaaggtaaggtaagagtaaccttgcttctgctgttttcttaagtgccaaggtgccgtattttgggatagtatgtcctgaacctcatcagagaccccctcacttcctttgagtgccaggcagaggtaggagggtgtgccctgcaaaggcacaggcttcttctggaactggcctctgctcaccacctgatgatcttctctgcatcaccttctcagttctcttgaaggcaggtcacagcaggcatattcagttgccttttcataaaacaggcaggagttggtatcttaccacagttgttttctccttagaaggtgcaatgttgagaacaattttgtccccagggtagagtatctacatctagccaggagaggaggaagacttttttgtttgtttgtttttgagacagagtttggctcttgttgcccaggctaaagtgcaatggtgtaatctcagatcaccgcaacctccgcctcccaggttcaagcggttttcctgcctcagcctccctagtagctgggattacaggcatgtgccaccactcccagctaattttgtatttttatttttttttttgagacggagtcttgctcagtcgctcaggctggagtgcagtggcgccatctcggctcactgcaagctctgcctcccgcgttcataccattctcctgccttagcctcccgagtagtgggactacaggggcctgtcaccacgccctgctgattttttgtatttttagtagagatggggtttcaccatgttagccgggatggtctcgatctcctgaccttgtgatccacccgcctcggcctcccaaagtgctgggattacaggcgtgagccaccgcgtctggcctaattttgtatttttagtggggacagggtttctccatgttgctcaggctggtctcagactcccgacctcagatgatccgcccacctcggccttcgcaaagtgctaggattacaggcgtgagccgccgtgcccggttgagaggaggaagacttttaacatgttacatggttcgttgttttttatttttattttattttattttgagatagtctcactctgtcaaccaggctggagtgtagtggcccgatcacacctcacagcctggaccccctgggctcaaacaatcctcccaccttagccttctgagtagctgggactataggggtacaccaccatacctggctaatttgtgtgtgtgtgtgtgtagagatgggggtctcactgtgttgcccagacgggtctcaaactcctgggctcaaatggcccacctgccgtggcctcccaaagtgctaggattataggcgtgaaccactgtgcctggccagttgttttttattttttgtactttattgactaaggtccctctttttttttttttttgagatggagctttgctcttgttgcccaggctggagttcagtgacactatctcgggctcaccgcaacctctgcctcccaggttcaagtgattctcctgcctcaggctcctgagtagctgggattacaggcatgcgacaccatgcccggctaattttgtatttttagtagagatggggtttctccatgttggtcaagctggtctcgaactcccaacctcaggtgatccactcccttcggcctcccaaagtgttaggattacaggtgtgagccaccatgtccagccagatccctcattttttatgttgttctagtatttatttggatttatatgattagcagttttgtttttctatgtttttgtgttcagttttctgaagcaatatttgttgtcactagagtttagtactttttcaagttttctcatatttaatgaaggtactgtccccatctttaaaatagaaacagtgtgagaattaagtgaaataatgattagataataggagaatacctgagtacttgacttagtaaatattagtttgtttttctcctcttttttttgctcttgctttttattagataacagaaaaacttgactgttaattaaaattttttttttttttgagacagtcttgctttgccacccaggctggagtgcagtggcgtgatctcagctcactgcagttgccacctcccgagttcaggtgattctcctgcctcagcctcccgactagctgggattacaggcgtgtgctaccaatttttgtatttttaatagagacggggtttcaccatgttggccaggctggtctcgaactcctgacctcaggcagtctgcccgcctttggcctcccaaagggctgggattacaggcatgagccaccacacccagcctgttaatttaaaatttagaggggataaaatcaaaggtgtcagaagttagggtgatatttactgtaagaattggattagattaataggctagctttgggattaaatttttttttgtttacataaaatctttcagaaaagagctttgggtttttttttttttttttttaaacaaaaggaattgaggtagaatttacatgtagtgaaatgcacagatgtgccatgagtttgacaaatgtagcttgttacccctactgagatacagaacattcctgtcattccagaaagctccctttgcgctttcccacacctgagagatttgcgtgttgtagagctttggtaagtagggtcatgtagtgtgtacacttacggttctttactcagcatgaagtctgagcaattcagttgtgttatctcatgtagtaggagtgtgtttctttttattgttgaatagtattttactgtatggatataccacaatgtgtttatcacttctttttatggacatttggatttaatctactttcttgcttttacaaataaagctgctatgggcattcttgtagaagtctttttgtgaacatgtgtttgtttccatttcgcttgggtaaatgcctaggaatagaattgctgtatcataggggagtctgatatgcatccagattggagaatcacagccaagataatcatgagatctatctgattttagtcatttttatatattgaaagtgctggggatattattaatatttgcttgctattaatctcagatgagttttatatagctctttttttcttaaagtattgaaatatttaataacatacatataacattgttgcataggttttacattagagtagtttaatactgcaaatctgacctccatttggatagctcttgtttatggggatgggatcagtttgagtaggtgagatctgtagatggttggttagcttcctccctctctggtcttatacagcagccagcagatattaaatttttcactttcatttatttatgtatatatttttatgttattttaattataatttagaaaatttaaagtttcaataattataattctctttaaaacaatttttttttctttttaatctcttgagtcaaggtgaggattcatttattttttactttgctgttttaatggtacactaataagttaacagagtgaacaaaagccatagcagaaagaagagttaatttataggcatgaaaataagccctggataatctagaagctttaagtttgatacctatttgaaaatgatgtgtaaacataaagtttgccattgtatctctgaattcagataatgggatttaatgaacctcaaaattaatgaagtggcaacgtaagtataactaacaggggacataaaataattatgttttattgctgcaaaatagtataatatggggttttctcttttgctagaagttattgattgccatatttagtaggataatcatataatttgttatccaacaagacccttttgagaatgaaaggaggcactgttaatagtcaattctgggacaataggaataagcagaactgttctgtaaaacagaaaccttcatatatgtttaacacaagtctcaagtagcccctccctctacaatgtaaactttttagcaaaatctaaatttaagtggtttgctttttcgtttttccttcttcgttctaatttgttacaggcatcatttttatcacaaaagcaacttgggatcatattgataatactttgtagaattaattttgtaaaatctcatggaattaattttgtaaaatctcaatttttaagtatgcttattgcattttttctcaccatataggtgaaataaatttgaatgtagaaaaataaattcttaatcataaacactgtcttacgtacattcatattgtactttcccttttttttttttagcacttagacattaatattttaggtattgttattttgattatctttttgttttttgccttccagacaaattatgaaaacagaatatatagcctgaaagtagaatgtggacctaaatacccagaagctcctccgtcagttagatttgtaacaaaaattaatatgaacggaataaataattccagtgggatggtaagttaatatagtcattttggttttatataacataatgtatagagttatatattatacgtacacacaccataatatatgtaagatattaatatgtagttaggagaaagtttttaaaagaggacctttgttaagccaaaagtctaaagaaggttgcattatgttgtttttcttttattaatataaattaggccatccttaaaaaccttaatgtacttgcctagaatagatgcatgtggtggttaaaactttttttttcttttcttttttttttgaaacagagtctcactctgtcacccaggctggagtacaattgtgcgatcttggctcactgcaacctctgcctcccggcttcaagtgattctcctgcctcaacctcccgagtagctgggattacaggcacctgccatcatgcccagttaatttttgtatttttgtagagacggggtttcacaatggccaggctggtctcgaactcctgaccttagttgatccgcccggctcggcctcccaaagtgctgggattacaggtatgagccactgtgcctggccaaaagttttcttagggttttaattgccttaatagtcatatttcagttgatctttatttggtaaaaagatgaccattattgggcggggcatggtggctcacgcttgtagagattgtgccactgcactccagcctgggtgaaagagcgaaactccgtctcaaaaaaaaaaaaaaaaagagatgatcattatttctctttgaatgttacttttctgagggttaaggtacatttggtgggattaaaaggatgactgttcatgaaaaggatgaatattcatgaagggtttttttctttaaagagcaaatatgtctgtgttgaaacagtcatggctgagcatcattgtctatttatttttgggtttcactctgtcccccaggctgtagtgcagtggtactcccccacttcctgtggcctcaagtgattctcccacttcagcctcccaagtatgtgagactacaaggcacatgccaccaagcccatctaatttttgtattttttggtagagatggggtttcgtcatgttggccaggctggactcaactcctgacctcaagtgatctgcccaccttggcctcccaaagtgctgggattacaggcgtgagccactgtgtccagcccattgtctctttaaacaaaatgacatgccctgcttgacccacacaagttagttagtagaaacagctgaatttccagtatgagtagattgttaagttcatgataagtctttgaagcctaggctctcttggtgccatgttgagagcacgccacatacaaaatacattttaggaagcaaaataacatatcatcatcataaaatgagtatcatccatcttaggaaatagggcctcagtatccttgatttctcatcccatccctgcgttccctctctctaccagtgtattttgtactacaaatgtatcacatatgtacacaaattcatcctcctttcttctctccttctctctttccttctcatctgtttaccatctgttaaaaatcacgagtttatactaacaactcccactaattttattctaaaactatagggtttgttctatgattcttcctttccagttgagaaacctggctcccatgcttcccagtgcatttacttatttgctcaatttccccttcatataactgtacttctggcaacaagttgaatcttggattcacagccagctccctgcccctcaaccccaacctaatacgcaggtctgaggcggggccccagattggctggtgcatccagcagggaggcaccaggccaaataaagcatgaccctgagaaaggaagaagctgggaaaggtcattggaaaccttagccctgcacctgctgggccattaacacccccccacccctgtgccaactcagagctgggacctgagagtctctccagccctcacagtcctcagttggtcagtctttgtgatttactgggagcatttagtccatttacatttaatattcttaattactgacatgttcaggtttaaacagatcatcttatttggtggtttctatttttctacatgtttcttgcctacttttggaatggttgttctcaacttctttcattctgtttgtgttctttcagtgattattctagaaattatgcacacttatctatttttaagaaatttgataggagcaggattataaagcatatgagtacacagaaaagatattatttagggaatgtcctgtgtgacacacagcattgcctttatgaagaagacctttgttagattttgctactagacatatctggttttctccactactgttttgtttttacattatagcttctgtaaattaagtaactaatggtgtgttctacattgtcatggaagctaggaaatttagattaaatttcagacctacctctaataagcttatctgatctcttgggcttttggtccagtagttgatattttgcctccctctctacctcccttcccccaacccatttatcattaagccttgtcagttttatgttccaaatgtgactggatttaggtcttatttttctatttacattgccaccaagtgaatattggccatcatttatttcctggactcttgcaacaacgtctctgattctactttttaaaatcccttccagtctttccaaagttagcagccagagggatcctcctaagagacaaattgcgtcgtgtcatttctgcacttcagattcctttaggggcatcagcctcagcatgcatgcttcttgccatggctcactgggagtgctcaaggtgcacactggcctgcatgcctttcgtttggtctcaagacctttgcacttctgttcttcctccttcctccccagtctggctaactcctatgggtccttcatttctcactgtaaattccactttcttttttattgagacagagtctcactctgtcactcaggctggagtgcagtggcatgatctcgctcactgcaacctccatctcctgggtttaagtgattctgctgccttagcctcccaagtagctgggactacaagtgtgtgccacaacacctggctaatttaatacagatgggggtttgccatgttggccaggctggtctcagactcctgacccgcgttggcctcccaaagtgctgggattacaggcatgagccaccgcacccagcctaaattccactttttagtatctttattgatgttccaacttgaattatgtcccttctattgctctgttagagtcactcttattcttttgttgcacttaactataaatttatttttttgtttttaaaagaaatgtttctaacataatagaagttttagagaatgatagaaccagcatctatgtgtccttcacctagctttgtcaaatgttaacatttgtcttatttgtaacagatcttttaatttttttttttttttttttgagatggagtctcactctgtctcccaggctggagtgcagtcacgcgatcttggctcactgcaacctctgtctcccaggttcaagcaattctcttgcctcagcctcccaagtagctgggaccacaggcatgtgccaccacgtccagctaatttttttgtatttttaatagagacagggtttcaccatgttggttaggctggtctcaaactcctgacctcaaatgatccgcccgcctcggcctcccaaagtgctgagattacaggcgtgagccaccctgcccagctagatttttttcttattagtacaaagactacattataaatagagttaattctgtgtgtggctttctcttgtttccccttcctgttttttttttttttgagatgaggttttgctcttgttgtccaggctggagtgcaatggcatgatctcagctcactgcaacctcttcctcctgggttcaagcgattctcctgccttagcctcccgagtagctgggattacaggtgcctgccaccatgcctggctaatttttgtatttttagtagagatggggtttcaccacgttggccaggctggtgttcaactcctgacctcaggtgatctgcctgcctcggcctcccagagtgctgggtgggattacaggcttgagccaccacgtctggccaagtttaaaatttttaaattaaaatgttctccgtcagattgctataaaactttctaagttcttactctcaattgcaatgtgtatcttgtcaaggagcaatagaattcagttcgtggcctgcccctttccatggacacaccttgagtagtgctgctctcgggaatacatctagaagtgtgccgtggcgtggggctttcttcagcttgaatattgccaagctgctttcctcccggctgggtcaatgtcagccccaccagtggtgtataacaggaccctctgaatgtatattcccaccaacccttcttactgtcaatctggaatggggactgggaaatagaaaaataaatactgattttaatcattattggagtgtagatgtgtgtatagagggttgtgggtagggtgaatatattggacatctgtttttctcttcatttacatctaagagtttggattattacttttataactagtaaatggtacagaatttcacattggtgattgtgccaggatagtttttatattttgaggctgtttaagtgtctcatgaattgtagttcataggcattgatggtgggtgttgctttagtaattttagtttatacgtatttaatacgacgaggcaaagttattccctgtgggtggttagcactctgaagtgtaaattttattgtcttatgcagtgagatctcacattttggaggtcattgtatgttgtagactgataagatgcagattttattctgacatgatatttattttctcatgctctttactgcgtcctctctcttcatcttttttttcttttcctccaatgtttctttttttttttctgcaccctgttggtatttcacaggatttgcaatcacttatgtttatttaactaccatttacagctggaagtgtttgtttctgatttagaaatagcttggtattctctctacttatttttataaactgttcagttatggaatctatttaaaataggctaaggaggttgccactctttaaagtgaaagtgttagaggaagcattttaaatgtaccttaccattgtaacatttttcttactcttttagttagtttcttttccttttttttttttttttgagacggagtttcgctcttattgcccagggtagagtgcaatggtgcgatcttggctcactgcaacctccgcctcctgggttcaagtgactctcctgcctcagcctccctagtagctgggattacaggcgcccgccaacatgaccagctaattttttgtatttttagtagagacggggtttcactatgttggccaggctggtcttgaactcctgatttcaggcgatccacccacctcagcctaccaaagtgctgggattacaagtgtgagccattgcgcctgctgttagtttctaaaataaatatcactctaaaattatttttcttttctactttcaaacacttttatggtgatataattcacataccatacaattcacccatttaaagggtaaaattcaagggtttttagtattcacaacattgtggaatcactgccatgacccaggtttggaacatttttgttcttcccaaagcaaatctgtgcccatcagttgtcatttcccatcccatctcccttagacctaaacaaccattaatccactttctgtcttttttttttttttttgaggcagagtctcactctgtcgcccaggctggagtgcaatggcttggctcactgcaagctctgcctcctgggttcatgccattctcctgcctcagcctcccaagtagctgggactacaggcgcccgccaccacacggggctaattttttgtatttttagtagagacggggtttcactgtgttagccaggatggtctgtatctcctgaccttgtgatctgccctcctcagcctcccaaagtgctgggattacaggcgtgagccacggtgcccagcccactttctgtctttatagatttgcccattctggatgtttcatataaatagaatcatagagtatgtgttctttggcgacttaacgtaatgttttcaagatttacccatgtttgtattgtgtattggtactttattcctttttattgttggacaatattccattgtatggagatcccattttatttatccatttatcacctagtagatatttctatttttctacttttggctatcatgaatactgttgctatgaatatttgtatacaagtttttgagtgggcaaatattttcatttcttttggatatatatttaggagtggaattgttgggtcatacggtatctatgttttagtttttgaggaactgtcaagacagttttctaaagtgaataggccatcttacattgctaccactagtgtatgcaggttcccagcttctccacatccttgctaaccccaaataaaaagcaagaaattaaaacataacaacataaacaatcaccttcaaaaaaaggaaaaggagacagggtttcgtcatcttggccaggctggtctcgaactcctgggctcaagagatccacccgcctatctctcccaaagtattgggattacaggtgtgagccactgcacctggcctgcctttctggactaccgtagctttgtagtaagtttttttgtttgtttttgagacagagtcttgctgtgccgcccaggctggattgcggtggtgcgatcttggctcactggaacctccacctcctggactcaagcagttctcgtgcctcagcctcccaagtagctgggatcacaggcatgcgccaccacgcctggctaattttttgtatttttagtagagatggggttttaccatgttggccaggctggtcttgaactcccagcctcaagttgatctgcctgccttggcctcccaaagtgctggggttacaggagtgagccaccacgcctggcctgtaataagttttgaaatcataactttgttcttctttttttaatattgttttggctattctgggtttcttgcatttgcttatgaattttaagataagcctgttcatttctgcaagcaagaaaaaagcagttgaaattttaataggagttgtattgaatctctaaattaacttgatgaatattgtcatcttcacagtaataagtcttctgacccatgtatatttatttagctctttaatttctatcaactatattttacagtttttaaaaattatttttatttatttatttttttgagatggagtctagctctgttgcccaggctggagtgcagtggcgtgatctcagttcactgcaacctctgcctcctgggctcaagcaattcctgtgtctcggcctcccaagtatctgggatcacaggcatgtaccaccacgcccggctaatttttgtatttttagtagagacgggggttttgccatgttggccaggctggtctcgaacttccgaacttaggtgatctgcccacctcgccctcccaaagtgctgggattacaggcatgagccactgcacccgacctttaaattatttctatttaattttttttttctcttttttctggggagggagggaaagggggaggtaggagaggagggtggtaggaaggagggaggggagatattttacagttttcagtgcacaagttttacacttttgttaaatttatacttaggtattttattaatttttatttcagattgttgcaagtgtaaagaaaaactaattattgtatatggaacctgtatcttgttgccttgatgaacttgtttattagctctaataatttctttagtggattcctttgaattgtctatataccagatcatttcttgtatttcttctgcaaatagaggtagttttacttcttttctttctaatcagggtgccttttatttcgcttctttgttaattgtcctggctagaacctctccagtacaatgttgaatggaagtgatgagaacggggccaggtggtggtggcggctcatgcctgtaatcccagtggtttgtgaggccgaggtgtgcagatcccttgagcccaggagtttgagaccagcctggccaagatgacgaaaccctgtctctataaaaaatacaaaaattggccgggcgtggtggctcatgcctgtaatcccagcactttgggaggctgaggcgggtggatcatgaggtcaggagttcgagaccagcctggccaacatagtgaaaccctgtgtctactaaaaatacaaaaaattagccgggtatggtggtgagcacctgtaatcctagctacttgggaggctgaggcaggagaatcgcttgaactggggaggcatgggttgcagtgagtgaaagtagccgggcctgtggtggtgtgcgcctgtagtcccagcaacttgggaggctgaggtgggaggatcacctgagcccagggaggtcgaagctgcagtaagccacaattgtgccactgcactgcactctagcctgggcaacgagtgagaccctgtctcaaaaaaaaaaaaaaaaagaaaatataaaaagtgatgagaatggacatccttatcttattcttcatcttaggaggaaagtatttggtctttattaaatatgatgttagctctaagttttttgtagattcctgttaggttggagggtagtttccttctattcctaatttattgagtatttatatcatgaaaggtttttggattttgtcagatgcttttttgcatccattgagatgatcatggtttttgttctctgttctgttaatatgatatattactctgatttttaaaatattgaatctatcttgtgtttctgggataggtcctacttgtatataatcttttttgtttggagatggagtcttgctctgtcgcccagggtggagtgcagtgtcacgatctcagctcactgcaacctccgcctcccagatgcaaacaattatcctgcctcaacctcctgagtgggtgggactgcaggtgcacaccaccatgctaaatattatattattatatatttataaatacaaatattattgtattttagtagagacggggtttcactgtgttgcccaggctgttctcgaactcctgaactcaggcaatccgcccgcctcggcctcccaaagtgctaggattacaggcgtgagccaccattcccagcctgtatatagtcttatatgttgcttgaggtcagctgtagatgacagcttatggccttctcagctctttcataagcctgtgcgcagccctacacatgtgtgtggtcttctagattcccaggcctgtttggagacacttcgtttcccagcttgtctgcttaagtattttggttaccttcctgctttttttttttggagacagagtctcagtctgtcgcccaggctggagtgcaatggcgtggtctcggctcactgcagcctccacctcccaggttcaagtgattctcctgcctcagcctcccaagtagctgggagtacaggcacgtgccaccacacctggctaatttttgtatttttagtagaggcggggtttcactatctatgttggccatgctggtctcaaactcctgaccttgtgatccgcccgccttggcctcccaaaacgttgggattacaggcgtgagccaccgcatccggcccaccttcctgtttgactcaactttttttgacaaatgcccaaggtaggaggtgagtgaagatatgtgagctctgaggtcagataaaggaaagctctgtgtgagtggagttttccagggaactgcaggacaggtcaaatgctgacagttaactgggaatgggcttgcaaggagctccatccccattctgttgctctttcacagaagattaatttgggtcgggtgccgtggttcatgcctgtaatcccagcactttgggaggctgaggcaggtagatcacttgagctcaggagttcaagaccagtctgggcaacatggtgaaaccctgtctctacgaaaaatagaaaaattagcctggcgtggtggcaggtgcctgtaatcccagctacttgggaggcctcatgaggcaggagaatttcttgaacctgggaggcggaagttgcagtgagccaggatcgcaccactgtactccagcctgggtgacagagtgagactctgtctcaaaaaaaaaaaaaaaaaaaaaaaaggaaagaataattaggaatagtgcgtagaatacattggaaagaaaaatctgaaagaagagatcaggttagtagcttttgtctaaatctcagtgtgagataattccccagattttgggcggtggcattggaaatggagaggaaccttttgaccttactccattaagaaagaattggtaaatttattgacaaagtagttatttaatataacatttatttctgatgaccaaagttcactgtatgttttatgtctttatattttcccaaaatattaaactaattatgataaaatatactaattatggtattagtaattccatagtgtatgttttgtgaaaatagaggcaagctatgaattttcaaaatcattcttattaaaatatgcttaacaaattggtgccatagtactttaaacttgctagttaactgtactctttcctcccctttcaggtggatgcccggagcataccagtgttagcaaaatggcaaaattcatatagcattaaagttgtacttcaagagctaagacgtctaatgatgtccaaagaaaatatgaagcttccacagccaccagaaggacaaacatacaacaattaattttagtggatctcaaacttgtcttaaatcaacaaccttctactcatgttaatgtcttgattaaatatcacaatgcaaaatacacattaagtaaaagaattccagctggtaaacatgacctggacatttgtaagaatatatttaatatatgtacacccattatgttttcaggtaacaggaggaaaaatgcagcacaattttttttctcttgaaaggcactgtcatttaaacataaacctggagtactcgaaatagaattcaggtttacaagatgaaagcgtgtggagaagtgtcagatggcagtggaagcatgtgtgtttctaaaaagtaaaaatctcaagaaaacagaaatggcatgctttacccatcttacttagtgaaagagagctgcagttgaaattgtttaaaaagtagcaggtacaatgaatattgtcacagatgtgttaatttttgaagcaatgtgggtgctgactactagtagtatcaaaaatatgttcaggattgttttgatacctgtatttataataaaaaatgttggggggagttgatgaattcctgttaaaagctgttcttgtgtgttacatgtaacagacatggtaaatatttgtttacagtctttgtttaacaaaccatgcatttaagtttaagtgaagtcaacaaaaaggaaataggtgtatggatatgtgattttgagattaaagttagtcttaaaatgtaaataaaatgtgaaacgtgtcctcagagactgtgccatttctattatgttgatgtatatgtacagtaccttgccagggaagcaaaaattggaattattgtagcttttcatgtatacacacttttatttaccctattttgtgtacttcttgtgaattataatttgcagactatttcagaaaagaaattatctagtttaatttcttctttggacaaggagtcctaggtattatattttgagtttgatttcaccagaaataataatattaaaaagatctttgcattctggcagttcttttaggattataggttgcaaattatccaaatatatatcccattttttaaagcataatatcttttttagttgtttttctgtgaagcttttggttaataaatagggtcaactaattggagacttttctcttccaattagggcttttaatactaacaaggataactttattcattcctcgtattctctactctaacaaatatgaactctgaagttgaaaagtcatttatgttccgctttcaccaaagtgacgtgaggctttaggtcactgtttcacttcaaagtactggatccaaagctttgttgaaaatgctgtttgatgaattcactgaagaatatagaaaggtggtcaggtaaagtctacttttattttgtcaagcttaataatttgtgtcatactttaccccagtatatataggcaaaccaaaaccttatcaaatattaaattagttgtttaaactttgcttataaagtattggccatgtggtggctcatgccgctaatcccagcactttgggaggctgagacgggcagatcacttgaggtcaggagcttgagaccagcctggccaacatgatgaaaccctgtctctactaaaaatacaaaaaattagccaggtgtggtggtgggtacttgtagtcccagctactcgggaggctgggcaggagaactacttgaaactggcagacagaggttgcagtgccgagagcgcaccactgctccagcctgggcaacagagcaagactccatctcaaaaaaaaaaaaaaaaagaaaaatattaataattgaccttggctgtatattaaaatagttacttttatagtagagcacatttctcaaacatgccctgaaaggcttttatcaagctcatataaagttaaagctttgagctaccttttcttggccaataaagtcactgacagtttatgtaaacattaatttcaacatggctgttgcattttaattatcaaaaatgtttaaaatgctttaagatgacacatagagaacatacacatacatacaaattagtgcatttgtaatttgttaaatttgaaatgaactattaccttgaaatatagtctttaaaaatttttaatggttaaagattaaattgaatgaaactgtagtctaatggtaactgatgatctgaatccgtctctctgataacctcctttccattttgaaaatgtgtcttattatacatggaagctagtaactacgtgaatgctgttggcaggatgagggtctgggtacctcagtctcttgtcctgtttccttcccccaaatccaccattgtgaagttgccaaccccctgccgccttcccctgccaagtacatgttgtcagagtcagccctataatgttcatttcccctcttgtttgtgggattatggatctctgcagaaatctgcatgccaattaacccatttctaaagcagaatccattttgcatgtcacaatcaagatgtacttggcaatctaagacacactgggagactgtaagaggaattaatatagaaaagctcttaattataataacatttggaagaaatttttcctttgttttgtaaagtggctaaggttgtaggagtgtgtggtatttattaccttttaaatgaactgtaaatttgccttagaaatttgtttaaaaggctagcaagtgagacccttgaggatgatcatatactaataaagattaccaaaagaaactt

SEQ ID NO: 169 - DNA, 35497 bp, Homo Sapiens
ttaccaagcaatgcatttatttggaaggataccagttaccagtcatcaaaagcttttgtatgttgaaaatgtaattttaatagttaattcttcatcttacataggagcacaataaaatacaccacaatctgaagaaactccagaattacgagaataagagtgaagaaaattcaaatgggctacaatatccattaccttaaactgcaagagacaaggttgcaacccgaaggttaacatttatgtatttatgactggctacatttatgacttaaaaataacaagaatcaggaattagatatggagagaggtgggaaagaacagttttgtgaggggaggaattcgtcaataaagaagaaaaattactgaattccaaattaaagaataaaacgagctcccacagcaaatactggagggatgaaagcaagaatcattaactgaggacttgatactctcaaagggataaacctttctgatgacacacaagctagatagttgagatctgctcatcaggtttataaggaagactcacaaatgcctcagcaaatcccaaatgatcagatcagtgtttcttaacacacatgaaaggttacagatgaaattttcagataagaaccaagaaaaatgtcataacccaaattttaggcaaaaatgtggcacaactgtgaaagtcctacatgtcagtcacaactgctatctttgctgtgactttcctgtacagtaatttttaaacattgtggcaagacaccaatgatcatctaatcagacaacacaaacacatttatttcaaattcctagaaggttaaaaaaaggtcagatactgatgctttatgcatgctcagggccagtttataaatactccattcagtactatcttaacacaaatctgcatcagtgaaaagaaactggcaaaatccacctcttgccattcaatttgtcagatggtgaagaccaagaaagaatgttccatcagtttcaattttaaaatacgattgtcaaattgggaaaatgaaataaacacagtaaaataaactgtacaaaggcaaagtagaataacaaaaaatattttactaaaacataagatttacagaagtttccagacaagccatacaaaatggtcacaagctttttttgaaggggggaatctacacttgacagcaatgttattagtgagggctgtgatgtttgtttaatgttcccattttggttccaacaatcaagcttgtccatctacagcgtctaaataaagttagacttggctagagcatattctaaagacctggttagctgcttttaaccaatgcaattagatcaccaaaaaagggggaaaggagcccataaaattaaactacctcccccctcaaaaataaaataaaataaaataaaataaaaacacccacacccctgcagctaacctgacaactaccttcattcacagtgctttatacttaaaccaggatgggggaaatgaataaaagcagggaggggccactgcttttaaacgtttcacaacaatccagatgatacttctagcctctgctcatgctttatgacagtgaatcaggacaagacatagatttgctaatgtgcatttaatcaccaaaggactgaagatgtctgggcttttttattctgtaatgtttctaagactgtgtccattaaatgcaaacaaagaggaggaagtcttggcagaacaggagaagtgatgcacacttgatgatcgtatcaatttaaatattattcatggcatatagcctagtccatgctctagctgtagacagaaacaaacatacgattattattttacttagttcaatatgttactttccaaactataaatggcaaacaaccactattaattatggaaatgtcatgctgtaatctgttaaattcacgcctttttctataaattggatcagggctgaaagattttgtaaatgtccaattaccaaaacactacaataaaattaagaagttctagaaaattcaagaggatgaatcaagttgtccatttctagatacacaattctccccactaattttcttaaaatctgtagcagaagcttcttgactccaaattccgtagccataaacagctgaatactttaatcaaatgggttacaaaaacagttcaagttttccagtattctttacatataactagataaatggtatgcactcagtatttgttaaaccaggtgtagttacaagagactccaagatctttcaattacaggttgtctttatatttggggggtcccatagcaagccattttgttaagacgtatttacatactataagcaggatctcacttattatacttttttctatttcttttccttgccaagagctttagaaaagtttaagtggtaatacaaatttgtaaaagtggaagtggtgtgaaggagaatgaatattagatacctgtttctatggcttgggcttcgttggtcttccactgctccgctacatcatttgctaatggatcatctggattgggagcacttaacaaggcctggatcgatagcagaactgtgcggatctgcagtgctggggaccacttatctatgaaggcaacaggcccagtatgataaagcatgaaaaaaacaggcccagaactgcttcacttccctcccacagacctctctgatctttgtataatgtttacattctaaacatggaatgcttaagagaaaaaggagaaagcttaataatagcatatgctgataaagataacacttacctttcaaaatatctaaacatattcttcccaacttgtctacattaggatgataaattttggtcatgaaacgtactttaggggctgccattgggtattcttctggaaggaatagttcaagtttaaaagtccctccctcaaagggggaatcctgagggccagcaatgaccacatgaaaataacgggcgttgctctcatctggttcggctttgatgccaggaactggttctgccagcaaacgctgggtttcctatgacagaaaaacaaacacatttgtgaaacaaatgtcattttgctagacaccaaaagtaaaattagaaagttcatctcttagaactacgcataatagaacagctccaatctcccaacagatttagcttataaaatgcaaaattcaaaaaaataccatttaaataattacaaccagctgaatgaaactgcaagcgaatactaatgatgttatcatacattttggctacaaatgtctacaaatatgttaataaaattagcttaataaaactgattttttactcaagtaaaataaagtaacattaggattacataagtaaggcaacttgctctaaactcaaccaaaaccaagctatttaaaaagtaaaattagcttttttggtggttttttttggcttgtttgtttgtttttgagacaagatctcactttgtcactcacgctggagtgcagtggcaagatcttggctcactgcagcctcgacctccctgggcccaggtgatcctcccaactcggcctcctgagtagctgggattacaggtgtgcgccaccacacctagctaatttttgtatttttagtagagacggtatcaccctgttggccaggctggtcttgaactcctggcctcaagtgatttgctcgccttggcttcccaaagtgctgagattacaggtatgggccaacacactcggccaaaaattagtttttaaacccactgaaaacctcccctctgaaaaatgtaacggactaaagaaaggagataagaagaggcccaggtacctgaacaggactaaagaaatatatttaacaatgctgattactctaaaattgacaattaacttcagaggaacccttaatactcccaacaatcataccattagttctctttttcatcattctccctctcccctaaataattgtattattattatttctcttctctcttcaaacctccagcatctccatccccatcctcacttgtggctgatgtcctgcttcctatttcatgacaagttagatacttccatcagttcccactgtagcatttggacatttccctgcatctgcacccatacactctggtttttctcctgtatagatgaaatgtcacgtactcttggctagggccaatcggtcttgagcactagatcttactgatctctgaaatgtttgttcttcggtaccataaagaaatagcacttgaacataaatttaatttatttagtaaagccatttttacttcctgcagaaagggtacactcgccaggagttttgccacaagagtatactgaacaaaggagacagggtcatttataacctgacgcgtccaccctactgctgtgtccggtttccactggctggaacgggatctcacattctgtatttgtcctgactggctagcaacttagaactttttaaaagaggtaaaggtagaggggaacaaaggaaggaggaagtaacttgtggaatgctgagaaaggtaaaaacacttttaaataaggaagaggaacaggctatgacctaatgcttgcttggaccagtataagcatgccagggcaaatatttaggctaaattgtgggagctaagaacataaagtatattgatttctttattatggctagcaaatatttaagaatgtttgcacaggtcttcgaataaattttgcttctaagagaagttactatttattcctaattagatggggaggaaagtctttgaagaggaacctctactttgcttgtctccaatttctctcctcctcttctgtcttgaacataccctccaatcaagctgtagttatcgctaacttgtttgttaaggtcaccaatgatttccacaaggttaaatcaaatgtccagtgcttaatctttatcttacctaaatgcgacatcttatccagctggtctccttcctctttgcaaagctttatctaacttcctataaacattctcatggctctcttcctccttgtctggcagcagcttcctttagtttccttgttggtttcttctatctcccaacatcgcaacactgaaatgcactggggctctattctagggcttcctctctgtttatacatttccacagtgatctcatgtaatgcaatgaatttaaatactaaacacactctataagctgaagcctcccctaattcatatctagcccagacctctcccctcatcgtgcctcttgcctctataactacctgcttgatatacactcttgaatgtctaataagcatcccaaacttaacatgacctccctatccccaacctttgctcctcccataaagtcttccccacatcagttactggcaaacccatctttccaaatgatccaccttttccttcatatgccacacacatctagcctgattggcaaattggttttttttatacttcaaattctactcatgattggactgtttctcaccattccactgctacacctctgatccaagcaaccatcagctctgacctggcatactacaacagcctcctaacctgttcttcctgcttctgacctcactacctccctcgcaggtctattatccacagaccctttaaaagtcatagtcctgagccgggtgcggtggctcacgcctgtaatcccagcactttgggaggccgaggcgggtggatcacctcaggtcaggagttcgagaccagcctgatcaacatggagaaatcccatctctactaaaaatacaaaatcagccgggcatggtggcacgtgcctgtaatcccagctactcgggaggctgaggcaggagaatcatttgaagccaggaggcggaggttgcagtgagctgagatcgtgccattgcactccagcctgggtgacagggcgagactccatctcaaaaaaagtctgggcatggtggctcacacctgtaatcccagcattttgggaggccgaggcgggtggatcggctcaggtcaggagttcgagaccagcctgatcaacatggagaaatcccacctctactaaaaatataaaattagctaggcatggtggcgcatgcctgtaatcccagctacttgggaggctgaggcaggagaatcgcttgaaccccggaggtggaggttgcggtgagccccgatcatgccattgctctccagcctaggcaaaagagcgaagctccgtctcaaaaaaaaaaaaaaaaaaaaaaagtcatagtccttgtaatgggcccccaaaagacgctctatatgatgccctcactccacctacctctctgacttatcttcagctgttctctctccatcccctaaccttctctgttccagacaaaaattagcttccttgtagttcttcaacgtgccaggcatccgctcacctcaagggctttgtacttcctcttcctccccaagatatccatatggcttgctccctcagctcctaagatcttcatgttttctcagtgaagccatcataactgaaattgcaaaccccattcaaccctaccctgcacactccctatccccactccctggctttatctccacagcactactaacaaatctcatttctacttattttgttcagaatttaagctccatgagaggatggatttgagtctattttatggactgctatatcctcagcatttggaacactgcctggcacaatagatattcaattaatatttactgaattctgaatctatttgatgttatgaaaagagggaaataaacgatcagaatttcatcgttaacatcattaaggcagggttattttcaaggcaggatgtgcacattatggaaggaaaacaaaaggagccactcaggtatggggaaaaatagtctaacttctacttatatttatttttaaccagaaaaatgttcatatttaaataagcttttaggtatgaaaaacaataaatgagaacattttatttacactgccttcacctaaaaaaaaatacatcataaactgtttcattccacaagctacagggcatacgttaaaaacaacaacaacaaataacttctctctcagcacagtaatatactgaaatagtcataagatgtaaatacaaatcaaatgcttccccaaaatgtgttaattaaacccatggccattttaggtaatgtctctggtattttaagactagttttttgttttgatcatggcgatgtaagagcaagtgagaaactgacatgttctttaggttcaaactaaaacatttttagagtattaaaaagctcaagaggcaataatgaagcctctgaccttgggaagtcctttaacatgtgaccagaacaaaagaggctggtcttcattttttaggaaaaaagttaagatattagggatgaatagcaggagtagaaaaatgagaaaataactggatggtaaaattccttgaattctgggctctcctcacctccatcctttaattttaccccaggtcttcatgtttttagaaagccataaattgggtgactggaaaaaaaagaaagccagggcccaagagtcccaatccaccactcaccagttacacaaagtagtagcagctctgtatctactataaaaagctacagaaaggcctccaaaagcgtatcccaaaatagcttcaaaatcactctcaatacacagtggcagagataggtatggcatttactttctcatcttcagttcaccctcaaaatcagatattctttgtaaagaatgtacatattaagcacatcatgtgacctgatcaagcctagatttaattggaacacattctaaaataagctttcgtgtgtagaaaacattttgaaatagtccttataatatatgctgctctcaagttctaatggactgacacaaaaacatgcataattatttcactaaactgttggtttccctaacaaacccacagcataaactgtgggaggggaaaaaaggaataaaatccaaactaaatgaaacaagtctgaaatggcagcatctgaaaaagtctcaaccacagaaactgatgtcaacttttttcctaaaaaggcaaaaactggctaggaaataaaatctttccggccactattcaacacatgactaactaaaataccttctggttttacactattctttggtggaaagacagagtacagtatgatttctttaagtgaagaagtaaagggctaaaattcctactgtttcacttatctatctttttttttttttttgagacaagtctcgctctcttgcccaggctgcagtgcagtggcacgatcttggctcactgcaacctctgcctcctgggtccaagtgagcacctggctaatttttgtatttttagcagagacagggtttcaccatgttagccaggcaggtctcgaactcctgacttaaagtgatctgcccgcctcagcctcccaaagtgctgggattgtaagcgtgaggcaccacgcccggccttatctatcttttggcacaaataatttacattgcaggtgggatgccatggttcacacctgtaatccctgcactttgggaggctgaggcaggcaggggaatcacttgaggctaggagttccagaccaagctgggcaagcatagtgagaccccatcactaccaaaaaaaaaaaaaaaaaaaagttgacaaatgagatcacataggaaggccatagttgtttacagaaaaacagaataacccttaaatgaattttgtgattctattatgtttaaaagcagtccaaggattgaatcccaaacagaagtgagtttagggccatgcataatagaaagcactgtagactatgttcaggaaattagttaatgtagactatgttcaggaagttagttactaaaatagacaggtaagttggtaaaggaatagggtatggatttaaatgtccacaaaattaagtctaaaggaaggtatctcatcttatagaacgcatacaatagttaatgctacaaatatttttaaaaggaatcaaatatcacatcaaattgatctaattatcaacagatctactgggtcttgaagagcaaaccctagactcacactactgtaaactatactgtagttagtcaattataacaactgacattctgtcaacctatctctattaaccaggactcttatttttaagttgaaaaataatttgtgctcagtacgaagcaatgacaggtcttagatgctcttctgcaaggcaatgattggagtatgtacagtaaaattttggggtaataaacagtattcttagaaaaagtgctaatttgtgtgtgagaaaagttggtccagttagtaactatctatatcccagtgcatcctgtctacagtgattaggttttttagaatattctctgaaacacaaaattgcaatatatgaccagtaatatcaactgtagatcttttagctcatctcaaacaagagctgtctgataactcagtaactgccaatttcattactgaaaaataagtgttaaaaaactgagtgatgcttcaatgatacctactctgtaaactccaacctgtcactacatctttaagcgattctaaaatattaacaaacagggttctggacaaagttgtgtgttatagaaaaaaaatttaaataaagaaaaaaattatgaaaaatttgtaagataaaacaaacgggctccttttttgggatcactaataaagcaagtcaattcttcattatgtacacaactgtaagttacttatgagaatctgcaagttcaccctctatatatataagtgggcatttttatttatcactttttttgtagagatgggtttctctatgttgcccaggctggtctcctgcctcaagcaatcttcccgccctggcctcccaaagcaatgggatgacagacgtgagccaccacacttggcccaataagtgagcatttaaaaaatgttaccaccagcctgggcaacatagcaagaccccatctctgcaaaccaaaaaactaaaaaaattagctgggcatgctggcatatgactatagtcctagcgtacttgggaggttgaggtgggagtactgcctgagcccaggagttcaaggttacagttagctgtgatcataccactgcaccccagcctgggcgatagtgagaccttgtctcttaaaaacaaaacaaaacaaaacaaaaagttaattatcatcaatggacattttcaagtgcataccccttgcttcattttatctgtaagccctgtgaattttactacatgattttgtataacataacattcttagaaacatataatgtctcattatagtaaaactgactgcctattttctagctgggattagaaatagaaccaaagttttgctcaagctccccattacactacttccttacaaatcataaggccacctagagatacactaagataaaaatggctgatgagtacttttctccacagcactgctatccaacagaaatataatacaagccacgtaagtatttaaaaattttctagtagccaaataaaaaagtaaaaagaaacaagtaaaattaattttaatatattttatctaaaaatgtattcaaaatattatttcaacatgaaatcagtatgaaattaatgatgtattttatcttttatcatagccttcaatgcccactgtgcaaattacacttgtagcacatgttaatttaaactagtcatatttcaactactcaacagccacatggaatgattagtggctcccaaattagtctggagagtgaaacacaagacaatcatgttataatgttactgcctggtcattatgaataatttaatttatttcatataataggtaaaattttgtacagaaactttaaagcatcactattttcccctcaaaaaattctatacaaaaagtaatgtcaggccgggcgtggtgtctcatgcctataatcccagcactttgggaggccgaggcgggcagatcacctgaggtcaggagttcgagaccaacatggagaaaccctgtctctactaaaaatataaaattagccaggcctcgtgctgcatgcctgtaatcccagctactcgggaggctgaggcaggagaatcacttgaacctgggagacggaggttgcagtgagccgagatcgtgccactgcacttcagcctgggcaacaagagtgaaactccgtctcaaaaaaaaaaaaaagtaatgtcagaacatttgacatcactaataacagaaatgcatgtaacaacagttgctgtttgctacactcacaagattgtgtttgaaaaaaatttatggcaatttcaaaacacattaaatgaacaaaaattaattcaaacaagctaactgaatgatgaagtaaagagttcactgaggaactattttaatttttacagtacacactaccccctagtggacataagacatcatctacttatttcaccacctttcctttgcaaatgaaaaaactgatgctcttaaaagttactgtacccaagtttgctaagctttttaaacttacattatatgatcactccttgctttggtaaaaccaaaccaaagttagcacctacctaaacacgtccttgaaaaagacctatagattccaacagtaaataaaatgaaaatagcttaagaaaactaataaaagcaaaccaagcaaagctaagacaattttgtattccctttctgctttcacctcttgtgcctatcttgctcctaaccacttagactcccccagataagctaactgggtccatgagaatttcctgaaaatgcctatcctaaagtcaaatggagaataatgattctcaagacacacccctcccttgttctttcttttcccttctactcccacatatttaaatctcaaaatttcttaggtggcagattcagagaaggaaaaacggaagaaaaatctatttctaagattctgcgtaccaaagactaaatctcagagtactttagaccagagtattccttttttgggaaaagctttatttatgggttgataggtaacaaataggtaagtactctctattccacttgaagtaataatgaacagatggggccagatgacttgggctagaaatctctacatcctaattttttccctcaaacctagaccagatcaatatttctgtgaagctcagtgaaaaggaatggagacttgggagctggagggacttctgaaagtcaaagtatatataatctgagatacatcagaatgtatctcaggtctgaattagtctaaaagtttctcccttgtacttccagtttcctgttcattaccacctctccacttactgtaactacgcacaataactgctggtttacttctcagaccctaaactatttgaagagaggaaccccagctagtaaatggtggtaaattctaaataaatgcttgcttggtgaacgaacatctgcaatgcttaggtaccacccagagctgatgaggaatactgtatctgctgtgttcattggtaaattccatctcaggaacagcatttaagattattccaatcactgacaatgacaatggacaaaaatcagaataatcctactaacaaattgtcccaccaagaagaaaaactgttaagctgaattcctttatttcttgtctatcttgcctccccaattcttctgcccactaaacacatcaggttgtattatagtctgtgtatattttcctccccaccagtctgtaagccccataaaagcagggaccacatgcaattatcaagcactgtcccagatatacagagaatcaataaaagaaaatctcgggtaacagttaagaacaaactatgccaaatactgacttaagtgctacatatgtattagctcatttaatcctcatactcattttacaactgagaaacaaagagtaatcgaccaaagctagtgaatgacagagtgaagattcaaatccaagctgctgggctctattcagtctggtttcaggatgtgtttcttaatctttttctttcttttttttttgggggggctggggggacagattctcactctgtcacccaggctggagtgcagtgatacaatctcagctcactgcaagctccacctcccgggttcacaccattctcctgcctcagcctccagagtagctgggactacaggcacccaccacctcgcccagctaaattttttgtatttttagtagagacggagtttcaccgtgttagccaggatggtctcgatctcctgacctcgtgatctgccgggcccggcccatgtttcctaatcttgatggtatacaataaagacaattaactacataagcagtaaatgtctaatgtttggcagggacagtaaacagcacgggagttaaaagggctattttcaacccttcataatcgtgaagtggtgcttcatgaaaaaggtaaatttaagccataatgtcataaatttttttttctttttgaactggtaaccagaaaagtatagtcttattaagataaaaataggaaaaaaactgatttgattgaaaaattggtatatactattttgacttggaattatcagatggtaaaccattttgcctatctttgatagtgcatgagatcaacatgctctaaaatgtttcgtgactttgaaatataaatttacttacaaatgtttactcattgctattttgttcatggcattgtggtattaaataactggaaggaagagtaaaacttcttggcatccagcagtttatttcattgtgagtagtcaaggtcttaaggtacaggaggtgtgagttaggatactattaatatatgaagagcagaaccagattacagggctattatgttcttgtttatttctaaagacatttttaaagttttctggaaagattaaaaacctcgtctccatcttttttccctctttgttttttcaaagatttccaaatattggcatcacagctaaagatggtgtcaactattccttcataaaacactcatgaagttcttggtggtaaaaatgtcctttgaatattcagcactataattagtagactcgtggcagtcaagcatctccattttctatggttcctgatttgatgaatgacataacacttcattgcctgaacttttcttagcaccagctcaaaaaataaaaataagactttagtgatttaaataatgtagctgtctatcttaatgaactctgttatctcaggaatgatttgacagagatgtctcagaatgctgaatgaaaagaaaggacctagcttagtaacacagttcattgggactgctgtgtgccatggtcctcgaggcactattaacaaacctattgcatattttaggttctgggagtgggtatataacttagtaggtgaggtaggaaatgttcttctgtattcatcttgaattaaaattagggaaattttttaaaagcctgttttatgtggtgaacactaaaataataagatttattagcaaaaaccagtgaacttggtttttttctttgatccagcttttatgtaaaaaatgatgtagattgtgggttttttctttcataaaattttacttgtttttttcaagttggtaattcatttcaggcccttatgtgtaattttagtcatttgtctatgttaactattaaacaatgttaaaaattcccccactcattcatatgttcctttagctcccactctttagtataatgttggagctgggagataagaaaattgtaaaaattttaagtaacttgtagaaaaagaaaaacttacccgtggtcacacaaaaggactgcctggaagcatttagggcaaaatgaggttggtagtatgcatccagcacttcttgcgcatcacaagcaaagaaataacccattctggagagaactgcagtagttaccactaagacagcagcagagttctagtggtagcattctgcgcttgacatcaataatcacaccgcacacactgtagaatgtgttgcacacagtgtgagcactgaaatcatcgtgatgtgattctgaagtttgttcctggctccctcttttctttggccctcctgaagaatgtgtgaggtaactaataactcttaatatcatttctgcttaaactagccaaagctggcttctgttggttgctaaaatgaagtctaaactcaataggaaaggaagtgaagaaaaggttaagagttagcagaccaaggcaggagggggttgggggctggtaaatacgttaagaagctaaataactctttgggattaaatgaagtcaaaagaggagagcatacaagtcaaccaatctctttatcaaagaacttctacttaaaaccttttagaggaggagctaatttcacattagacagttaaattcaactaagcagcctggtgtacctagcgtggggagggggaagaggctcaagagttagcacatctgaatttaattccaattttaattgtaccaatgtgatatgtgaccacagacaaatcatttacctctccagccttctaaaatgtcccttgaacatttaaaaggttctctatagcaccaaaattgtctgaatactttattattattagaatgagttgaatcttattgctatatgcttctttctactggaaggtccccttttgtaataacattctttaggcctataattactgttttagtcttccctgctgaaggagaaggatattatgaactgtcatcctggtatttatgccaacgttcaatatctaaataaagagaaaatttgttgctaagggcacctgcttttttcccaagtttttttcacttgctcattaaagaaatacataaaattaatctaaataaaattagccattctcctaataaccaaaatccaattaacattctagaatgttttttgttgttgttgttctgataaagacaaaagcccttaaaaacagtttaatatgtttacattttttcactcctgtgtcactgcagccactttcctcaaggctagttgatttacagacaaatcaatattctttaaaaaccatacggcataaacaggtacttttcctggcctacaagctagtgactatactagtatagctaccatgtatttacttactcgaccctttttcttcaggttacttctggtttcaaatgcagcaatcacaacaaaatttaatgcctgaggactccataataggtaaggcaagacaagaacagatggaagcagagcagttgaacttttcagcgaagcaaacaaaaaaacaagttacatttcgctcagatttgcattctcaatccaattgtaccagtaacacaattttgtataaaatccaaaccatcaggaaagaaaaattaaaacagtctttcacactctgcatactaactctgagataaattaggaaacatgaaagcatgcagatattggagggttgtctcccacacagtaagcatcctctctcagggctaaccataccgcacagcttcaggagaggaccattcgtatgacagtctgcataaatggcgcctcttgaagttatacagtgaaatactttggattaaaaaataaaacttcaatttagcagttgcaaagatcaactttattattacctaacccatggaaaatggattacacatatgataattttaatgaaatcaaaatgttatttacccaaaacatcccattttgctatccactgtcggtaaatgagcattcattgtgctttcacaaaatctatgcctcacttcagagagttatatttaatgttatctattttgtgaaacaaatacataaatgaactttgtttcgtttatgaaacgaacaaaccattttcccacacactaggaagacattcaatctttttatgtttatggtgaagcagcatctttgcaaagtcagaaaacagtaataaccaacactacataaggctcagtattacgttagggtctgttctttacattctaatccttccaattaccatagagctagattagtatattaagcagataaagaagcagagaggtcaaatgaggttgcccaagctaatatttggcagagctagaaatcaaactcaagagtctggcctcagattctttgttcctgccatacataaacatacatttcatattccctaaatcagtgttttgctctagagaattaggaagtaaggctctctgagccataaaacattattttagtcatgaaaagcagcatttctaccatcttgaaagtcaattgtcaattaagaggtcagcaaaagactacagtaggaatgaaccttctgtaagccatcccttacacactttgctaccttactgtctctccaactaaactagttcctagagatcaaggcctgtgtctaacatttgcagacccaatgttggacaccagtgtgtcttgcatttcttactggttaatgaacagatcaactgcagaactacctgagaccaaccccacagagtaaggaaaaccactgactgggttaaaaggaaattcaagaacttccaaaaatagtaggcctagccaagcagtgactgcaaagagcaggagtatgcagaaaaaaagacttgcaagactccaaaccgaatctttacaaactatttcacacgtctgtccaaaagccttagctttgacactattcctacaggtcatacacttaaatggaccaattacgaagcaccagagataccagccttatcacttcttttgcccctctaggcagcttcaacaatctaataagcattttcctcaatttaaaaaagtgatcattgcctcaataatcacgagttgacatattaaagatgattctttcccctacctcaaggttttgggaagaatctgaaatgaaacagcttggttagggactttaatatttcacagattatcaattaggtctgaaatttgaacagtcttaagagatccagctggagtaaataactcagcagattttttactcttctgtgatttcagattatctcgtcctgcactactaagccagaagaggaaatgatccagacaactcagattttaatgtaactgaaataagcacaaacttacacactagggctgatgtattacaatagagtacgatggacaataatactgggtcaaattcatccacttcatgtggacagcttgagtctccgaaagaatgcgacaatacattcaaagaacataaatgctggaatcagttcttgctagcaacacgagccagcaatgttattatgtgaaactgcatccaaaaaaaaaaaaaaaaaagctacaaagtcataaaaatagccctgagaataactaatttgaatagtgtaagtaaacagttttcttgaggaaggaaatcgggtggctggaacacaggtaggagacaccctgcaagtcaaacaagcttaatcaaaacaagagctaaaaaaaccctataaaacccctaatctgacaagtctgaagtcaagccacatactgccacatctcaagggcttcttacccatccctatctatcctgggctgggccaggccaggcagttttctaaaaaatctctgccttaggaaactagtaagtcagatataaagtcaatcaatgtctctcactttccttctacacttttgtgattctggaggtaggactctgccaggggctcctagtttaagtctgcagataagggagtgttaagggaaaactgcgagagacgacagtgctgtctcccctctcatgggtgcatcagcagatttttttttttttaagctcatcggctatcattagtgttagtgtattttatgtgtggcctaagacaattctttttttttttcttttgtcgcccagactggagtgcagtggcacgatctcggctcactgcagcctctgcttcccaggttgaagcaattctcccacctcagcctcccaagtagctgggattacaggcgtgtgccaccacacccagctaatttttgtatttttagtagagacagggtttcaccatgttggccaggctggtctcgagctcctgacctcaagggattggcccgcctcagcctcccaaagggctgggattacaggcgtgagccaccatgcccagccatgagacaattcttattccactgtggcccagggaagccaaaaggttggaaatccctgttctaaagcaatgcaggcttcacatgtgactagttttatgagagccaatacagattacctatctcctaaaaattctaccttgcttcccttcagcactatcactttttaaaaggttttatttagaaaacacttcaggtaaaatatttacaaaggaatgaagtactaatacatgctacaatatacatgaaccttgaaaacatgctaaatgaaagaagccagaaagaaaaggccacatattgtataattccatttatatgaagtgtgtacaataggaaaatccatagaattggaaagcagataaatggttgccaggggttgaaggtagagtgactgctaatgagcacagggtttttctttttggggtgacaaaaatcttctggaattagcaagtgatgatgttgtactactttgtgaatacatgaaaaaaccactaaactgtacactttgagtgggtgaattttatggtatgagaattatacctcaaaaaaataaatgaagcatttgagttttccttcaatattcagtgagattttggaatcttaccgatgaattagagattggaatagtaaaagtaagtgaagggaaaataaatatctattacttgactatttagtatataacatattcacagcatgttaacagagttttcagttttttgagataggatcttgctctgtcgcccaggctagagtatagtgacacaatcttggctcactgccgcctcaacctcccaggctcaagtgatcctcccatttcaccctcccaactagtagctgggactacagacatgtgccaccacacctggctaatttttgtatttttttgtagacatggggcttcttcatgttgcccaggcttttctcaaattcttgggctcaagcaatctacttgcttcagcctcccaaagtgctgggatcacagacatgagccaccgcacccagccaacagaaattttagtaatgaatatatattcatggactacacttctgaagaaaagaaacttcaagttaaaagattacttttgaagctaagtatctgtgatccaagcatagacatgctgactcaagttacacagtcttagttcaaatatctcctgggtctggtatgtcgacattctactcccccttttctacttatgcttcaaaattcagctcaaatatcatcctctaaaaacctttccctaaaccaaccttgagggttttccaggccagtctgtcacttctttggtgttcccattgatgcctttgtattcaatatacaaagcagtgctagctgtatgattttacttttgtctcccattctacccatctttgcattgaagccaagcacacatatgaccagtgtttctgcaaagtgtacactaaaatcataagcagctcttaaaacaacaaaaatatgttgggctggcaatgttaaatttacaaacttccccagataattccaatgtataaccatgaactaagtactcagactagaaacaagtgttcagagaaaatagcccatagattcttgtcttggcatccttgccaatacatcagcagccctgccaattaaactaggagaagaaataggcaaggtctggccaagtacttctctaagcacagtcagtgctggcccctgaacagaacttgcagcacttttagtttaacccttacctgaaccacaacaataaagacagggtcctggacagtgcactttatttgaaaaagtgtaggccaggcgcggtggctcatgcctgtaatcccagcacttttggaggctgaggcgggcggatcacgaggtcaggagttcaagatcagcctgaccaacatggtgaaaccccgtctctactaaaaataccaaaattagctgggtgtggtggtgcacgcctgtagtcccagctactcaggaggctgaggaagtagagctgcttgaacccaggaggcggaggttgcagtgagccaagatcacaccattgcactccagcctgggcgacagagggagactctgtctcaaaaaaaaaaaaagaaagaaagaaaacacaaaactcaacttgatatataaatgaatgcaagataactctaacatatttttagacttactgagaaaaaaaattctcgtttaaaattagtctgattcagtggtactttaaatacagtcatgcgctgtatgagtttcagtcaatgatcaactgcacaaaagacagtggtcccacaacattataatggaactgaaaaattcctattgcctagtatttactatactatacttttattgattattttagagtgtattccttctgcttgttaaaaaaaaaaaaaaaagttgactgtaaaacaggttcaggcaggtccttcaggaggtattccagaaggcactgttgtcacaggagatgacagctccatgtgtgttactgcccctgaagaccttcgagtaggacaagaggagctggaagacagtgatactgctgatcctgaataggcctaatatgtgtgtgtatgtcttagtttttcacaaaaaagtttttttaaaaaagattgtaagagaaaaaagcttataggatataaagaaaatatatttttgcacagctgtatgatgtgtgttttaagctaaatgttaatacaaaaaaatcaaaagtttaaaaatataagtttataaaataaaaaagttacagtaagccaaggcttattattgaagaaacattttaaaaaattttttggtgtagcctaagtgtacaatgcttataaagtctatcgtagtgtacagtaatgtcctagcccttcaaatccactcaccactcactcacccagggcaacttccagtcctgcaagcttccttcatggttaagtgccctatacaggtataccattttttatcttttataccagatttttactgtacctttcctattttgatacacacatacttaccactgcattacaactgcctacagtattaagtacagtaacatattaaacaggtttgtagcctaggatcaacagactatacaacatagcctaggtgtgtagcatgctacactatctaggtttgtataaatatactctatgatgttcacacaatgatgaaattgcctatggtgcatttctcagaaagtaactccatcgttaagtgattcaagactgtatattttgccggtaagaaagagcagcaaagagtcccttctcaccagaaccacaaaattcctcaaatccaggactggctgggtggggagggggaggaaaagaatatgccatccagaccagaggcattccatcttaaagtgaactatgttactaaacagggtctcatgtttgtaggaaagcctctaattaaattacaataaagagacttctgattaaaaaaaaccaagaaaagcggcaggctcagtggctcacgcctgtaatcccaacactgtgggaggctgagacaggaggatcacttgagcccaggagttcaaaaccagcctgagcaacatagggagaccctgtctctatgtaatatatattatatatgtatatatattttatattgtacataatatatattttatatatatataaaaaatttttttaaattagttggggatggtagtgcatgcctgtgatcccagctactcgggatgctgaggctgcagtgagccatgatcatgcctgggcaacacagtgagaccctatcttaaaaaaaaaaacacagccaagcgcagtggctcatgcctgtaatcccagcactttgggaggccaaggcgggcgaatcacaaggtcaggagttcgagaccagcctggccaacatggtgaaaccccgtctctactaaaaatacaaaaattagccgggtgtggtggcgggcacctgtaatcccagctactcggaaggctgaggcaggagaatcgcttgaacctgggaggcagagattgcagtgagccgagatcgtgccattgcactcccagcctgggcaacaagagcaaaactccgtctcaaaaaaagccaaccaaccaaccaaacaaacaaaacacaacccaaaacaagtaagctaagcacttagatcctgttcttaaacatgtttccacttcatgtgtccaaatgatacagtataaaaatacatgcactgccagttattatctaggaatagacatgttcttcagtatccacagtctacagaatcagaccacctgggttcaaatcatagctctagaaactaataagtccctctgtgcaggttcccatagctataaaataggaatgatactaatatccacacatcataaaactgcaattagaattaagtaaattaatgcacgtaacatgcttagaacagtgcctggtacacgatgccaatgaaagatgtctatttttacataataaaaactatatgaccaacctcacttcaggaacagctgccacactgcatgctagtgaatagttcacagactaaatatgaatttcataattagaaacactttgtttgcctaacaattcttgatgccaactctttgaacacagtcattaaacagtaataattatttttgatgagaccctgattctattatccatcacatactatatttctagatgatgccatgctttctgtctctccttccagctttcatatctgctgccccatgtgccaaaaactcactcacactccctccttctcttggcccagcaaactcttactcttcaagtttaaaaacacttcctcggctgggcgcggtggctcctgcctgtaatcccagcactctgggaggctgaggcgggcggatcacgaggtcaggagtttgagaccagcctgaccaacatggtgaaaccctgtctctactaaaaataccaaaattagccgggtgtggtggcgtgcacctgtaatcccagctactcaggaggctgaggcaggagaattgcttgaacccgggaggcagaggttgcagtgagccaagtcacgtcactgcattccagcctgggccacagaaatttgtttcatgactgtgttttccattacacagggatgcctttcttgttcacctggcttactggtaaatgcatattatgcattcaatgaatgtccaattaattgaactgaaaaaaaatctcatgaatggataataaagagacacgcaaatcacaaggttacagaaaactgaaatttggccttgggatcggcctatgttactaaaaccactttgtccctgcctcatagtaagatggtaatctagttgtctttaagagtcacaaaaaaaaaaaaacaaaacaaaacagctacttactaacattttcccgagtataagctataatcttaagaaagttacagagcaataaaaaaatcaccaatggtttcatgatataaatttgttagttctttctagtgtttccttaactacaatgccttcaatccctagaactgtaaagactttcaaaatataaattcatttgcccaaaattaaccaaactgacagagacataatgtgaaggtattgaaaactaaaaaaaaaattgaaaatctaaagacaacatagccagttgttttaatgcaaaatatgtcaaccttagattctgaaaccagtatctaaaattactttaaattacagtagaatcctaattattcagaagcatctcagttactggccaattcaaaaccaaaaatgtctgtgcctaagtactcaagaaattttagaatagcttcattcaggtttttttttttttttgagacggagtcttgctctgttgcccaggctggagtgcagtggggtgatctccgctcactgcaagctctgctgctcccgggttcacaccattctcctgcctcagcctcccgactagctgggactacaggcacccaccaccacgcccagctaatttttttgtatttttagtagagacggggtttcaccatgttagccaggatggtctcgatctcctgaccttgtgatcctcctgcctcggcctcccaaagtgctgggattacaggcgtgagccaccgcgcctggccaggatttttaaaaaatataaaatgcccccaatggtgtcatgtagcccttgaaagaatgaataataatgaagtatttctgttgattctgagggctcttaaccaattatccagttcttccaaccacacagtcatgtttctgccacaaaagaccctagggccatcaatcacttcacttgggaagaaattttaaaagctgctaagattttagctgaagttaaaagattccctattatttaattgcctaattggtatatccacattcattccttcatatattacatttgcaaagaaaatttcaactctaatgaaacaacagtccaactcgtttttcgcatacacacataagaattcttttccttgatataatattattacataaactatgcctctcatatttattttgtttttagaaagcagcactgtataagatacgaatttggcacctaaatcagaactctgattactataattgtaatgtcaaaagcccctgctggatgctgctgtcctcatttccttgtttctagtatttatttctatagcacatatgcatccatagttcattataacagaaaacataatgtgtgttcagaatccatacaacttgaatctgtagcatattttcttcttaaatccatttacacaggtaaactatcctataaggtatagggaaaaaagaagaagaaccgaattgtacatcaggaatctggtcatccaacttctttggcctacaaattcctcaccagagaaagaaaaggatagaacagatgttctctaatgtgtaaaactctggtggctcactcccgtagtcccagcactttaggaggccgaggtgggtggatcacgaggtcaggagattgaaaccatcctggccaacatggtgaaacccgtctctactaaaaataaaaaaaaattagctgggtgtggtggcgcgtgcctgtaattccagctactcgggaggctgaggcaggagaatcgcttgaacctgggaggtggagattgcagttagccgagttcgtgccactgcactccagcctggcgacagagcgagactccgtctcaacaaaaaaaaactctggttttaagagtggtcattaacacgtgtggaaaaaattccaaacttgagcaaagcaaatgcataacatttccagtcacagtcatttagcacagtgaatactaaagtacttgataatttgacaaaacttaatttcacttgtgcaggagttgatcaatctggactaaaggaactgcttgacacagaggagcttaaaaaagaatactgaactgactgctatttttaacttactttcagttatgctcacatttcataatcaaaacattagatagtatattaaaacagtatctttagagcctgaaagtttaatcactatcaaaagcagttcaaggattcttaacatggagcacatggagacctagggaatccacaaataaacttggcaagaatctgaatccccagaagtcatacgttaaaaaaaatagctttttttcctaggaagaggtcagaaaattcttaagtgagacaactgaaagaactaaagaaccactgttcctagtcaaattttttacaagttttttcttaaattccaaaggtgattttaattacaacttataacaaatctgtcttcatcataatgagtttgtatttatttatttatttatttatttatttaagagacagggtcttgcctctattacccaggctggggtgcagtggtgccactaatagctcactgcagccccggcctcctggattcaagggatcttcctgcctcagtcttctgttaggattactgcatgaaccaccatacctggctaagtttccctgcccccacctggaggtacatatatttctgaaacatcatggtaacttttccatgcctttttttaattggaagaaaacattatcagacaagtattttcagagcttaaaacaacagataggacaggcgcggtgactcacacctgtagttccagcactttgggaggccgaggtgggcagatcaccaaaggtcaggagttcgagaccagcctgaccaacatggtgaaaccctgcctctactaaaaatacaaaaatcagctgggcgtggtggcatacacctgtaatcccagctactagggaggctgaggcaggagaattgcttgaacccagggggcagaggttgcagttagccgagatcacgccattgcactccagcctgggcaacaaaagcaaaacttcatctcaaaataagaaaaaaaaaatgttcaaggcagagagtaaagctactccagtggctgaggcaggagaactgcttgaacctgggaggcagaggttgtagtaagccgagattgtgccattgcactccaggctgggcaacaaagcaagactcccgtctcaaataaataaaaggtgagttttctaaatcacttttcttacaaaaaaaaataccttatgcactagaatacctatcaaatgagtggcttttaaacagtaacaggaaaaaatgtgtgtacttcaaaaaatcctattaaaaaagtaaactcaagtctcaatgtaaaatcagactgtatctgatttttaagaatttgaggctaaatcacaccaaatagaagagtaaatttttccactgcacttcagcctgggtgacagagaccctgtttcaaaaaattaattaaatgtattttcttaagtaaatttttaagcaccatagacaagggaccagtggggaagggagacataaagtaaattctgcgaaagactggtaaaattctaattccagcaggttgactcactaggttttaatcaaataagtcaacccctagggtaagttaactactttttcccaagactgtattttatcattttcattattatcattattactattttgagacagggtttcactctgtcgcccaggctggagtgcagtggcgcgatctaggctcactgcagcctcaacttcctgggccaaaccaatcctcccacctgtctcctgagtagctgggactacagatgtgtgccacaacacctggctaattttcattttatctttttgtagagacaaggtctcattatgttgtacagcccagtcttgaaaccttgggctcaggggatcctcccgcctcagcctcccaaagtactgagattataggcatgagccacagtgctcagccctcatgattaattctgaaaagaccattaaaggaatgtcagtcactgtatcaacgtaacatgtaaagctgaaacagatttggttttgaccaaggccataactatagatctcacttatcggttcccgaaagtgattctcctttatgacaggattatgcagaacctctcatttgagggacattttaggtacctcctaacctttatgactttaagctttaactgctcacttttttttttttggtggagatggagatctcactatgttcctcaggctggtctcaactcctggcttcaagcaatccttgggcctcagtctcccaaagagctgttattacaggtgtgaaccaccatgcccagcttcagtcacttttattggctaaaagagctttggtccagaagataaggcagaaaaacgaaactaaagattctagcttaaaacagaactactaagactcaatatcactcacacttgtgcaaaatgccatacatacaaaacttcgttacagcattttttatatagcacaatttaggaaacattctgaaagttatgaataagcaattagttacaataaagtctaggccaggcacggtggttcatgcctgttaaccctagcactttgggaggccgaggtggaagaatcacttgagcctaggagctcgagaacagcctaggcaacatggcaagaccccatctctactgaaaaagtattaaatttccaatatttgaaaaaataaaataaagtctaaccataaggttccattaaacagccctttgagaaaaaaaaaagagccaaagcagaacactatgatgcatgtctgtaatcccagatactggaggctgaaggtagagatcacctgatattaggaattcgaggctgtatgtatatagtgtactatgatcacgcctgtgaaaagccactgcactccagcctgggcaacaaagcagcagtctgtctcttaaaaaaaaaaaaaagtcaacttgaagatacataggtggttagaggggaagagaagggaatcaaggtatttgcatgagaaggagaagacgcctaacttatagcagaaagttgctctggtcttcttgtaaggatacacaataaaaatagtggttgaagtcgggtgcagtggctcacacctgtaatcctagcactttgggaggctgaggcaggtggatcacttgagaagaggagtttgagaccagcatggccaacatggtgaaaccccatctctactaaaaattagccaggtgtggtggcacatgcctgcagtctcagctacttaagagactgaggcaggagaatcacttgaacctgggaggtggagtttgcagtgagccaaaattgcaccactgcactccagcctgggcaacagggggagactccgtctcaacaaacaaacaaacaaacaaaaacagtggttttctaagcaggggaactggaatgctgaaggacagatgagggattctctacgtatccttcagagcctttcaaatgtgctctatgtgtgcatttcctagttaataaaaaaagatacataagcagagtaggcacacaaaaaagaaataatgtaaaagattgatgtcctttttaagtgagcttatgggtggaaaacgagactagctttaacttttagctcagacattggttcagacagaatataccaaggagtaacaatgtcaaattattgctcattgagattaaggctcatctattcagttagtctattaatatttcagtatctactatgtgccaaggattggtctaggcacgaatgagcaatgcccgggatatccaagagtccctaacttcatgaaggtttaatggggaatagagagaaataaacagtaaataacataacttcgaacagtaataagcacttatacagaagaaagggagataggaggataaaattgtgggggaggaaaaagggaaactggtttatacgggacaggttaggtagagggtatgacatatgagctaagaacggaacaactggacaaagcaagcaatgcaacaaactggaggaaagtcctgtgactggaataagctcaaccacttattgttcagggtacagcaaagcaacagtgtggctacagtggagtgacccagagagagaagtgcagatgcgctcagaagtaggcatcccaaatgaatgcagggccttatagctaaggggtgggggggaaggcaagattctaatgtaagtgtgatggagaacctctacagtttttagcaggggagtaacatggtctatattttaagaagataacactagctgctgctccaaagtaggctaatacaggaggccaggcagtaaatgatggaagtgaacagaggtttgaaagacaggggggaaagtgtctgatttagtacatatattgaaagcagaacctacagaatttgctactggattagatacaggaatctaaatgagatagcaactgggtgaatagtagtccagaaaatcatcttgtatttgtagttagtcattttacagtaacaagagacaggggaatgttacactaatcaagatccaaattctgcctcttaccagctttaccttaggaaagtcatttaagtcagtttctagactgcaaaatatattgtctagttcacaaaaatgtctgtaagaatcaaatggttaagaaatctacaaatgtaaatagtgatcattataagttagaaagcatcatattaacagtcatgcaaatcaagccaccttattttaacattttcattagatgagaatgctaacactgatgttatatcaacactaaatttcatcctttgaaagtcaaaggtcaggcggggcacagtggctcacgcctgtgatcccagcactgtgggaggctgaaatgggtggattgtgtgaggtcaagagtttgagaccagcctgggcaacatggcgaaaccccgtccctacaaaaattagctgggtgtggtggcatgcaccttgcagtcccagctattgaagaggcttaagtgggaggatcatctaagaccaggagatcaaggctgtggtaagccatgatcctgccactgcactgcagcctgggagcggagtgagacgagtctcaagaaaagaaaacagaaagaaaagaagaaagtcaaagatcacccagaaataaaacaaattaacagtccaatcaacaaagtcatgtccctattgcctcaggacaataccgttacccccatccaccacacagaagtttgtatagtgattgacagaaaagaggcaacttttaaaaataaattctgattttttttaaagcattgtcactgattatggaacaacctacataacacaagcatggacacttttaaaaatctagtcttttagtcttctgtttaaggattagagaaaaccatccttttaagctataaatgacactaaactagtaagataaaacccaaatcaaggtgtcattcattagatagatgttgtcaacaagataccgtaaaattaagattatatatcacagtatgagttactgtcttagtttcaacagcaaaatgtaaatgcccagtgtaaattactgtgtgccaaatggattgaatcatgaggacttcaacttattgccttaaaccatttctgtaaatttataaacaaggttccacagaatttattttttcatccaaggctttcatattactgggcatatcttcataatcaaaaatagaaaaatgcgtgttaaatgtttagttcactatgtatttcagagaattatcatgaatgtcaacttgcattatgtacttagtcaataacctaagtaacaacgaaaacaaggatatttgatgtatggctctatcactccctattcatttttcaactggggcctcaataaacatgacctttggggaccatgtgactgcattataactaaaaccacgttgtacggacctgccaatacatatgacaattaaaactccttggacagaatcctagataaatccacacacaacaaatttcggactatgaagattcacattattagactccagtgctccctgacaatctgttctacttctctcatttctaagaatttctaccatacaaaaacgtcttatttctctacatcagcacccttaggtcagtgacatctccctcatctcagatatatttaaatgcaattggatgaagcagtatacagtacatcatcctcgaagcctaacaggtcttccacttagtatgcatctccccacagatttcacaagaatgagcaagattaacatacacgttcaccaggttatatcaagcaaaatgatgctgcaattgagtcactttaactggcgcatttagtcacataaatgtgcaactaatttccttcataaaaaccgacacaaaaatttaaggtttagttgttgtgatgacaaggaatatctcacgtctgaagacttgtcgatatttccttaagactttacaaaatcaaagaatcgaaaatgtcatggttccatacatacttgtcaaaacacagtattcataaacagccaattaataattaaaacgcacaaaattgaggggcaaaagatttcacgagatcccccacagaggccaaggtaggaagatctctgaagccaggagttttggaagccgcctgggcactatagcgaggcctcatatctacgaaaaagagaggagaggagagaagaggagagagaaagagaatcccccataactgcggccctcccccagccttgtgttaaaactatttcctcggaacagctctgaaagagtttgccaaccagagtaaaatcacttcgcagagataaacgagcggaaacgtattcagaagagagagatcgcggaagcaagggcagcggggcgcggggcccccacgtcccgggacccaggcagccgcggcaaccaggggcgagcatgtgctgaccgcggcaggacgcgcgggcctcccagagccacttcccggggcgcagggccccgcccggcctgaccctcccggttcattcattctgcacccgcggttgccgcacctccgcggccccgtcggggcggagaagaggggcttggctgccgagggaccttgtcgggccacaatccccaccaggcgcccgagccccgccgcgattcccgcgcgcccgcggcctccggcgggggggtggtctcagaagctatggaggcccgcgcccaagcccagagacccccagccttgccgccccaccctccgccggggcgtgggacagcactccctggcccgccgggcagccgcctggaagccccgggtccccgctgtccggctgccccgccgcggccggaagtctccccggcgccccctcctcagcacccgacttccctcgccgccgcggccaacccctctccgcgccgcctcgggcctcccagagcgggccgcgggccgaaggaggcgagaggccgcgctgcctgcccagctgagccgacgagagcagagcgaagagctggaggccggcctgggcggttaccttgatgatcctgcggggcagcccggccatcttgtcagaacccgagttcggcctctggtctcgtctccggctcctctcgcctcacgcacgagtggaagtcccgggctccacttccgggggacgttgccgcgcccgtcgccgcagccgccgccgaggcccctcgggaaatgtagtccctgctcgggcgcgggctcgggcacgggcgggcttccctccgacctggccccctcccccgtgcgccccgccccaaccgctgccggggatggcggaagtgacgctctgttgcggggcagggacttgggacaggccgcgaggggaggcgcggggctctggcgctcgtggccgagcctgcccgcgacggtggtacggcacgacccgcgcgcgactgcgcgcgcgtctctcttaaccgtggccacgcccgcgccggtggacgacgtaacagaggcctggcctacgacgtatcccattcattcattcacgcgttcgttctttcagctcacgcgttcgttctttcagctcagcctgcattgcgcgcgttccctgctggctctgcagtgaacgactgaggtggggctcatcgtcttgctccttcctcaaagggagggcaagaccgaaactcggtggcaaagctctgactgggggtctctccagttactcacacgctgttgggggagttttgatgtttaaattgtataaatcggacctctgacacgcccctaggcccagggtaggctgaaggaaaagggtttggagcgagttggaggcgggaagaatggttctgaacgcctagacctaaaggttgagactcagaattgttaacaggacgaatgaccaaggagaggtttaaagaacccagagtaatccgtaaagcagagattacctatagagtgcgaggtcctatgagagaattagagtgggggtgcccgaaaattgaattgttggggaagcgttttatcctgatgacggatggtttgctgtgtgatggactgtttgcaagcactttacttcatcttcacagcaatcgtgaggaggtgttgtttccattttacaaatgaggcttagatagttaaccttttccaaggagctgttttgtccccaggcagatccgccaagacctggcccttaactacttaaccacagtgtttcctagcacactaacagacagtagatggtgaataaatgaagacaagactgaccgtgccttccaggaacttagattccaatggagaagagagaccagtaaacaattagttacaatccaatgtgttaagggctgtctgtaatacaggttcctccaaggtgctattttagcagagaggcattaactgcttgagaactcagggaagccttcttaaataagtgaagtcctcaatgatgagtaagaacctacctgaccttgtagggaagagtatgccaagcataggaaatggcctgtgaaatggcattgagctatgagagagaaaaaatagtgcactaaagaaactggaactctgaatacaagaaacctactaagaacaataagaaatattttgtgctggcacgatgctaaatggttaataaatttaatacatcattcaattatgaaacagatgaagtagtctctattattaacagaacgttttagatgagaagccaaggttcagaggtaataatgagaatttcaaataaccagaagtctgcaataggtggttctgtgactagaagaatctgcaaaagtaaatgaaactggacaaagatacttttcagaatattttatagaggacccaggataattcatgctggtaggcagaaaggcagagtgctattgtgttgggagtgtgtaggtctgcagtctgggcagggcttggcaggaaggcacactctgcttgtgctgcatcagcctgtgcaaccagaagattggcttccatgatggttcacaaggcgggcaagttggtgctggctgttagtttcactc

SEQ ID NO: 170 - DNA, 1594 bp, Homo Sapiens
tttaaaaaaaaaacaatcctttaataaaattagtccatctaaaactccccaatgcctaaggttctagtcgtggaagggttagctgcagaattccagttcagaagccaacggaggctcagtccagacagggattaaccgacttgtgctggtatctaggtgcttggattgccgagttgagtttgctggaagggaaatggggcggcgtcggggggcccgacaggcctggctgccagtcggcttccgcgaaaacgactcttgctgtccacatagccagccgtgaagccaaactgcaggcctctgccctcccctaaatgtcctcctaggaggcagtcactcgggaggaagatgtgcctgttaccaagtgcttcgtcccggccccagcgcagacctatgaatgaagatggagggagagctgatgtgaaaggcctgggtcccggccgcagaaggggcgccagaccgaaatcggcgatcgcgtctctcccaccaaagcctcccggccagcggccgcgtctgaaagtcctgggctaagcaccacgccgggggggtaccagacaccccggctgcagctgccgagggcctcactcaccttcagggccgccggcctctcggcctggactgcccacctcggccctgcgtcagagcggaaggccaagtcttccagaaggtgctgcggcctccccgcagccccttagcgactcgggatggggcggctgagtcacgaacgccgaggcgggcaggtgcggcgccgccggcctccccccggcaggctcgggtcttccgcgccacggaggtccccgaagagcgcccaagccgcatccggaaggcccgaaccctaccggagggcggacggcggacagggcagggcccgaggccgacgcggcaggcggtgcgggacgggagcgggggcgggcggggactcgaggccgggcggcgaaggcgggcgaggggaggggaggggaagggagccgcggcccgcttgccccgcagtctgaagcggctcagctctttccatgagggcggtggtggcccttaaaagggcctttgtggtggcatggggaggcctggcggccggccgcggcgcgggccctcttagtactcctgggaggcctgggtggccttcttgccgcccgagggcgccttcggccccacggtggcgctggtcttcttgggcagcagcacggcctggatgttgggcaggacgcctccctgggcgatcgtcacgccgcccagcagcttgttgagctcctcgtcgttgcggatggccagctgcaggtggcgggggatgattcgcgtcttcttgttgtcgcgggccgcattgcccgccagctccaggatctcagcggtgaggtactccagcactgccgccaggtacactggcgcgccggcgccaacgcgctcggcgtagtggcccttccgcagcagccggtgtacacggcccactgggaactggaggccggcgcgcgacgagcgcgacttggccttggcgcgggccttgccgccagtcttgccgcggcccgacatgctagcgaggtagaccggtgaagcacgacggctcaaacactagaacagacgcccgccgcagtgtaactgctgt

SEQ ID NO: 171 - DNA, 45727 bp, Homo Sapiens
cgcccaattggcgcgcggactgcgggggtcgccgcggttcccgccaaatacgagcgcggcggccgcggcggcagcagcggcgcgggcgggagggcgaagagcagcggccgcctgaggggagcccgcgcctccgccgcctgagaggaggtcgagctgccgccggggcgatgctggaggagctggagtgcggggcgcccggcgccaggggagccgccacaggtcggttcgggcccgcgccgaggggaagggggggcgcggcgcgcggcctggacgggccgaggcggcgatgggaggcggacgggcctccgggcgccaagcctggtcctgcgggccgggcgttcaccccctggggccttctcatccccagcgagggcctggcgtccccaagggcacccttgttgacgttattgttgtagccgcgaccatattgtttgtttccggcgcttttgcgtcagttcgtccctccaggactctctggggcggtgggtcggaggggccgagaggggaaactgaggcccagggaagcgaaagggcttgccctgcaggttactggatgcgtttgtgtcccttgaccatgttggaccttgcagcgggtggggaaactgaggcccaaggtcgcacgggctcggggaccagtaccgatgccgctgagggtcggggtaagcccgggtaagaagaggcccagatggtagagatggccaggagggtgggactcccgagttcttgctccttcctgatatgcaccgtgacttcctcctccgtgtgccttggaatggggtctttggagcccaccacaggcctcctgaaacgtgggagggtgaaccaaggaagaccagactgtccctctcccttgctggactctgcattacataacgctttggcagcacttggcattacgctttggcacatagtaggtgctcagtaaataacgtgaacgaatgaagggctagaatggacgccagtccagtttctcagcctcagcagtgttgatatttgttgccgtcctgggcacggcactgcagggtgttaagcatcatccctggcctccgccttttgcaggccagtagcagcccctctcaccatgccttagtaacagccagaaataccattgccctgtgtcccctatggggcagattccgccttggctgaaaatcatggctgtagttccttctagcctgtgggatttcccggagacataaaattaatataaagttggtactgtcgtggagctgtgatgttttaagtcaggatgtttaactttatttatttatttattttgagactgagtcttgctctgttgcccaacctctgcctctctggttcaagcgattcttctgcctcagcctcccaagtagctgggattacaggcctgcaccaccatgcctggctaatttttgtattttttagtagagacggggtttcaccatgttgggcaggctggtctcgaacttctgacctcaggtaatccacctgcattggcctcccaaaatgctgggattacaggcatgagccaccatgcctggccaggatatttaactttaaaaaaaaaaatcgctactcgctaggaccatgctatcatgaaaggaaagtatattttagtgccaaataaaattagaaaggatgtaatcgcagaataaagagcagttagtaactttatacacacatatgtgttaatcgtgtgtatctttggatctctggattgggagtgtcccgttttatatacaagattttttaatgagggtgggtcctgtttttaatgaggttgtttctgttccacttgcaccaaagctagtgactcaaagccacacaaatagatttttgtgattgtctcgaaaataaagttaagtgactaaaaatcatatccttcagttagggggtagaaatccatggcttttggtaagtggacacttgagaatgatactgtctttatttctttgaagtggctagaaaggaaacatgaattttctcagtaccttttcttattcactaagcttggggcggtgggtgaggggtggtttcatgtatggacgatggagttttttaggaagccccagtctgcttttaaaaagtactcacttttatgtaatgcttacaaaacatacgtagattaaccaaaataactaaactaggttttgccaagccagatctcctggtaagtgtgagcttcctaaacttactctgtttaaggtatttatctaaagactcgcttctatttatgatcactgctgcatctgctttgatattattagatggtttcttgagattttttttgcaggaaaatattttgtcttatcttctcttgacagcacttcagctcctgcctggcaagctcaaagtgctttaaattgtggtaccttcatgaattctctttaaaaagaaaaggatcccttttctgattttacagatttggtggtggtatgggggcttgggttggaggaagatgtttggggatcatgggaatgaaataggtaatctgatgttttctctcctccctacttttactcattccactttcatttcatgaaacagttccggttactctcttagttggctttctgatttattccagaccctaaccaggtaccataggtgcagcatggaacaagtctttctgctgtcatagagttggcattttgtttccagagagacgtaataaacacgaaagtttcagattaaatgccacaaagaaaataaaacaagacatgacagtgtctagggtaggatttctcaacctattaacattttgaggccaagcgccgtggccagcactttgggaggctgaggcgggtggatcacgaggtcaggagttcgagaccattctggctaacatggtgaaaccccgtctctgctaaaaatacaaaaattagccgagagtggtggcatgcgcctgtagtcccagctacttgagagagtgaggcaggagaatcgcttgaacccaggaggcggaggttgcagtgagctgagactgtgccattgcactccagcctgggcgacagagtgagactctgtctccaaaaaaaaaaaaaaaattttttttttttggcccatataattcttcattgtggtgtgctgtgcattgcattgtgggacatttagcagaatccctggcctctacccactggatgtgaatagcatccctttgagccctccctgcatcatgacaaccaaaaacatctctagactgtgtcaaatggcccccgaggacagaggggtcagaattgcctccaccttgtacataattggctctacatatgtatttgctaacttgattatttgcagaatttaacagtttaccctttgacacttttatttgcagccatggattgcaaagatagaccagcttttccagttaagaagttaatacaaggtaattatttggaaatgggttaaagagttgttcgtagtttatagtcttccttgtctcttgttggagacctcagtggaagcctggagctagaggggagagaaacagtccttcttcagaccaggaagctgggaaaatgcttttcacacagtaatgtctcgtggggttcccacaagtaaaccccgaggcctccacttatgcacgattggtgttttgtaacttgcagctgggagctctcctgtatgttgtagggagcgtagcagcatccctggcctcttcccaccggatgccagtaagtgcatcctccaagtcgtaacaaccaaaaatatctctatacgtggctgatgtcccctgggaggtagaactgccccctcagagaaccactgttgtcctggaagataaatgctcccaaatccttctgcataaaacggggagtgtgttcacccttgggccagatgagcggttggattgtaatttttttttttttttttttgagacggagtctcattctgttgcccaggctggagtgcagtggtgcgatctctgctcactgcaacctccgcctcctgggttcaagcaattctcctccttcagcctcccaagtagctgggattacaggcgcgtgccaccacacccagctaatttttctatttttagtagagatggggttttaccatgttggccgggatggtctcgatctcctgaccttgtgatccccctgcctcagcctttcaaagtgctgggattacaggtgtgagccaccgcacccggcccagattgtatttttagaaactacagttttgggtttttcaaacttgggctgggtgcagtgttgcatacctgtaaaaccagctatttgagaggctggggtgggaggagtgcttgagtccaggagttcaaggctgcggtgaattataatgacaccactgctcttcagcctggatgacagaggaagactctgtctcttgaaaaaaagggggacgccagatgctaggctcacacctgtaatcctagcactttgggaagctaaggtgggcggattgtctgagctcaggagtttgaaaccagcctggccaacatggtgaaaccccgtctctactaaaatacaaaatagctgggcatggtagggggcacctgtagtcccagctactcaggaggccgaggcaagagaattgtttgaacccggaaggaagaggttgcagtgagccaagggtgcgccactgcactccagcctggtgacagagcaagactctgtctcaaaacaaacaactccccccacaccccccccaaaaaaaaacaggtttttatttggtctattacatgatgaaatagttaataaaagatgcaatggcattgaagtaagtgaacataggttctttgggaaattcactctccaaagtgtttctgtgttcctcctaaccagcccgaagcctggcagactctgggagaacagtttgattgatgagaaaagcctaacagagcctagggtgctgaggccaggagaaaaaaaaaaaaccctgtccacaaatgtgtctatattttctacttgagaaccagatgcagttattatcaaatgagattttcacccattaaaaataaatttggaatatgaactgcatctgaaataaacaaatgtctcttgaaattctggcgatggctctgctaaaaggcttgtcaggattttgttttttaagttaggatgttgaagcggggcatggtgactcacatctgtagtcccagcaccttgggaggtggaggcgggcagatcacctgaggtcaggagtttgagaccagcctggccaacatggcgaaaccctgtctctactaaaaatacaaaaattagctgggtgtagtagtgcatgcctgtaatcccagctacttgagaagctgaggcaggagaatagcttgaacccaggaggtggaggttgcagtgagctgaggtggcgccattgcactccaacatgggtgacgagcaagactgtctccaaaagaaaaaaaaataagtaaaattaggatgttagaaaaggatagaatgaaaagatagcaccccccaccccctctttttttttgagacgaggtcccttttgcccaggctgcagagtagttgcaccaccacagctcactgcagcctctacctcctgggctcaagcgatcctcctgcctcagcctcccgaagtgctgggattatagatgtaagtcagtgtacctggcttcagatagcccctgccccgtcttttttttttttttttcttttgagagtttcgctcaggtcgcccaggctggagtgcagtggcgtgatctcagctcactgcaggctccgccccccgggttcacaccattctcctgcctcagtctcccgagtagctgggaatgcaggcgcccgccacctcacccggctaattttttgtacttttagtagagacggggtttcaccgtgttagccaggatggtctcgatctcctgaccttgtgatccgcctgccttggcctcccgcacccggccttttttttttttttttttttttttttttttgagagggagtctgtctctgtcgcccaggctacagtgcagtgttgggatctcagctcacttcaacctctgcctcccaggttcaagcgattctcctacctcagcctcctcagtaactggtattacaggcgtgtgccaccatggcctggctaatttttgtagttttagaaaagacggggtttcaccattttggtctggctggtctcaaactcctgaccttgtgatctgcttgcctcggcctccccaaagtgctgggattacaggcatgagccaccacacccggcccagatagtccctttttaaactttaaaattatctcccacccccatgtcccaacaaatcagtaattttcaagctcatgagtggttgtaactttaaacgttcactagagatggctttctgtctttgtttcagcccgtctgccgtttaagcgcctgaatcttgtcccaaaggggaaagccgatgacatgtcagacgatcagggtacttctgtgcaaagtaaaagccccgatttagaggcctctttggacaccttggaaaacaactgtcatgtgggttctgacatagactttagaccgaaacttgtcaacgggaagggtcccttagataactttttaagaaatagaatcgaaaccagtattggccagagcacagtcatcattgatttgacagaggactcgaatgagcagccagacagtcttgtggaccacaataaactaaattctgaagcctctccctccagggaggcaataaatggccagcgagaagacactggggatcagcaggggttgttgaaggccattcagaacgacaagttggcatttcctggagagaccctttcagacattccttgcaaaacagaggaggagggtgttggctgtggaggtgcagggaggagaggcgactcccaggaatgttcgccacggagctgcccggagctgacgagtggcccgagaatgtgccccagaaaggagcaggacagttggagtgaagctgggggcatcctgttcaaagggaaggtgcctatggtggtcttgcaggacatcttggctgtgagaccaccgcaaatcaagtcccttccagccacaccccaaggcaagaacatgacccctgagagtgaggtgctggaatctttccccgaagaagactctgtactcagccattcgtccctgagctctccctcttccaccagctcgcccgaggggccgcctgctcccccaaagcagcacagcagtaccagtcccttccccacctccacgcccctccgcagagtgagtatctcccatggagtccctgcacatcagtgctcacggatctcagagcgctgtcagtctccactgggtcacccaggtgttttgtggcagagtgagcggggccacgggctgggtcctgggactcgacgtggagttcttcctggtatcaaaactcacagtgttcagttctgcattcgttgtgatgcccctgggacttaattcatcaacagtgtacctggtgtactgtgtgaataacaccctgctgttttgccttcgttgttcacatctaatcagtgatagcttagccgttttagggaattaggatctgagctggtgctgtaacccctcacttcagattcgaggtccagctttctctgtgcccttcctgtctaagcatagaaatgtagggacggggctgcaaagacactgagcactgaagtggcagtgagacggcaggaagcatgacttggggaattctgtagggtcagcacagccagccatcttaaaaaccttacctggggccaggcacagtggctcatgcctgtcatcccagcactttgagaggccgaggtgggaggatcgcttgaagatcacttcaaaaccaacctgggcaacatagacaccatctctatgaaaaaaaattacttttttttttttttttgacagagtcactctatcacccaggctggagttcagtggcgtgatctcggctcactgcaacctccacctcccaggttcaagcgattctcctgcctcagcatccctgatagctgggattacaggtgcgcaccaccacacttggctaatttttatatttttagtagagacagggtttcactatcttggccaggctggtcttgaatttctgacctcaagtaatctgcccgtcttggcctcccaaagtgctggaattataggcatgagccactgcacccagccctgcaaaaaaatttttaaaagttatccaggcatggtggcacatgcctgtagtcccagccacctgggaaactgaggcaggaggatcacttgagctgaggagttggaggccgcagcgagctatgatcacactgccgcgctccagcctgggtgacagagcgagaccccatctggaaccatttttaaggaccccataagggggacttttgcatggtctgtctctgttattgattttttattagcacaatggtgtccttaaggtcttagggaccaaactgataaaatcagtcacgagtcccacggtgtttagtggtgtcttttgattttataattttttactttttatcttaagtatgtagaaccagaagagacagtgcctttttatgtttttggttttgtagcacttttgtttgttcatgttgggtctttatatgagagtagtagatcctgagatgggtcatttaatctgtacctgtaagcaggtacagtagaccacctggaccataaaccaccaaccttgttcgctttcgggattttgagctctaaggaaccatttatttatttatttttgagacagagtcttgctctgtcacccaggctggagtacaatggcgccatctcagctcactgcaacctccgcctcttgggttcaagcaattctcctgcctcaccctctcaagtagctgggattagaggcacccgccaccatgcccagctaatttttgtatttttagtagagacggggttttgccatgatggccagactgatttcaaactcctgacctcaggtaatccacccgccttggcctcccaagtttctgggattataggcgtgagccactgtgcttggccaagagcatttatttttctgaatgacttcatttcttgtctttcacctgagaagatgaaaaaggaaaaaatggcttcctctttaggtttatgaaatgttgtaaaaatggtgcaaatctttttttttttttttttttttgagacatggtctcaccctgtcgcccaggctggagggcaatggcatggtctcagcctactgcagcctccaccttctaggttcaagcgattttcctgcgtcagcctcttgagtagctgggattacaggtgcccaccaccacgcctggctaatttttgtatcttttcagtagagacgggtttcaccatgttggccaggctggcctcaaacttctgacctcaggtgatccgcttgcctcggcctcccaaagtgctgggattacaggcatgagccaccgccccagtcttctactttgttttatatgtgctggtttgttatataggtaaactcttgtcgtgggggtttgttgtacagattattttatcactcaggtactaagcctagtaccctcttctaagttactaaatgtgccagactggcatgtacacatttcagcttctacctaatccaccactcaatctcccaaaatcagagttgaagtctctccccattgggcatcctgtagtgtacattcgatcacttgaatttcttccaggctgctgccgctttgcaaaatttcgtcctgtgatgtgagccatttagcaagaacgggacacatggctgggcgcggtggctcacacctgcaatcccagcactttgggacgccgaggcgggtggatcacctaaggtcgagagttcaagaccaggctgaccattatggagaaaccccgtctctactaaaaatacagaaaattagctgggtatggtgacgcttgcctgtaatcccagctacgccggaggctgaggcgggagaaccgcttgaacccaggaggcagaggttgcggtggcctgagatcgtgccattgcactccagcctgggtaacaagaacaaaactccgtctcaagaaaaaaaaaaaggacaggacacaagcacatgtttccattaagtttgtttccatgtccacagcttagtctgcaaactgggaagtcccctcgttgggcatcatggtggcacaatcctgcccgctttctaaaacaactgagcacatgaacccagtgtgcaacatttaggaaaccctgcatttaggacgctagatcttgttctgaacacagactcgaggttttgggatgcacttgaaggcaatattatcccaacttttcagataatttacaagtggtaaaggcttcaggctggcccagagcctatggcagaaagcggccacaaccacccgcagagggcctgtcagtcaccgaagctatgagggaagcgattatcgggaggcctcctcatgccctgatggcagggatccctgagatcccagctgagagagactccatccccaacccctactttatctccgaacctttaaggagtcctgcatttctggtttggttggtttgcttgcttcatagttggtacctaactcttttttattttttattttttttgaggcggaatctcactcttttgcccaggttggagtgcaatggcgtgatcttggctcctgcaaccgctgcctcctgggttcaagcaattctcctgtctcaacctcccaagtagctgggattacaggcacgcgccaccaggcccagctaatttttgtatttttagtggagatggggtttcaccgtgttggacaggctggtctcgaactcctgacctcgtgatccgcccgcctcggcctcccaaagtgctgggattacaggtgtgagccaccgcgcctggccagttggtacctaactcttaacacctttccttgccgtgacgtccaagccacccccttcccacaacccctgttcctctggggaatacactgtttttgcactttacctccctaccagcagctctttccagattgcaggggcgagctggtgggaagcttgcagattgtttcgcactgccgtgtaatctgtgtgcttgtcactggggtctgttcttccttgagttggtacagtgaaatatgcattgagagtcccagggcagtcattgccactgtactttgtgggctggcttgccttctttattatttcttctttaaaataaaagaaaatgggagtttgttccgatacaggtcctgctgtccctttgcagggagcttcatggcgtgtttttgtttgttttggtttttgttgttgttttagtactgcaggatctggagaatctcactttggagaaacaatgatttaaaaagatccccctttagatactcccagggtcctttgaatagctgaagtgttcctttttagtattagagttttctaccatgtgggaaagaaccatttctgaagtttgcaatcagacttgtgatttagcctcttctgttagtgatcgagatgattatttgacaaatgatcatgttggtgcagttgtgttactggaatctttggcttgcttctgtgcccagattgctggaacttctttccatatacttgaaattacatttgtaataaattctccatgtttaaaagaaatactggtctaggtgcagtggctcaagcctgtaaccccagcactttgggaagccgaggtgggaggattgcttgagcttaggagttcgaaaccagcttgaccaacatggtgaaactccgtctgtacaaaaaatacaaaaaatagcggggcatgggggtgcacacctgtagtcccagctccttgggaggctgaggtggaaggatcacttgagccaaggaggcagaggttgcggtgagtcatgattgcaccactgtgctccagcctgggcaacagccagaccgtctcaaaaaaaaaaaaaaacaaaaaggaaaaagaatggaaaccttgaagccctctgttctcccaggaggttgccattattatcatcatcatcaccttgtgtttttctgtgtcctgtatatccagagagatctctaggaaacacccagtatcattttgtttccttgtgtatgacatatactgtaaatatctgtctttgttactcaagggtgtcttagatgttttttatattgggatggaaagatggagctctttttaacagctgcgtgatatcccatggtgtggacatgctgtaggttacagagctgttttctcagttctgctgtttctgtgcttggctttcacaaaatgattgttcccttgagcttccttctacaagtggccttgggctgttaaggagaatgaggtcttggtagctcaaggcaatgcgtgcgttcttattttcccagcttgcactctctcatgcttgggccaattggaggttttctcttttcccccctgcctccgctcccctgctgtcaggttttagcggcttatctggtctgggcttagaaattagataccctttagtataaaatcagagtccataggctctgagaggattatctgagaaagggtgcaggaattttcatgcccacacatagtgagctctgtcgcgactccttgggattgtcggtttttgtgttttggcttccttctgggatcctggatcacgtttttggcagttgagggtgctgtctgaccgggctccagctgggtagaatgtgggagtgttgcatagaattttgagagtgagatctataaacacttgggtcaaatttcaagaagataaagttctgtcagacttcaaggtccatctgagggtttggcaaagcaaaaaagataccagttttaaattaagcagtaattgctctgttttggttgttggatattactgagcgggctcttgccagtcacatcaagtctgttatctctggactcacagcagagggggggcattgtaagaggcaggagattctgcagctgagcttcaggcatgggcaagactaaggaactgaattccccgccaccccaagaccacattccgtattataatctctgaacacaaagggcagccccggagagctgcggctcccatattctgcagttaaatccctcagcgtgggggagaggcacacagccttggcaggcagagtagatgctggagagacagatgctttttctgcagcatttggtgaggctgcctcgggctggcatttctgttgccacattctcagcaaagactgaacaccctggcctgatctcggtggtgaaagagctcctgccaacacgggcagccttctcacaacggctcggcctttccctaaagaaaggtttagtccagaaaggactcagtgggacccaggtggaaaggctgtcttgagctcattcatctgaagcttttattctgtgagaggtcctagtcaggggttcagctttcccagataaagaaatcactgttggccgggcgcggtggctcacgcctttaatcccagcactttgggaggccgaggcgggcggatcacgaggtcaggagatcgagaccatcctggctaacatggtgaaaccccatctctactaaaaatacaaaaaaattacccaggcatggtggtgggcacctatagtcccagctactgggcagactgaggcaggagaatcgcttgaacccgggaggcggagcttgcagtgatccgagatggcgccactgcactccagcctgggcgacagagcgagactccgtctcaaaaaaaaaaagaaatcacttacataattttgttgacccctcagaccattgccaggaaaatgggcctttggtttttcagtcaacttcagtcttacactgcaagtctgcaatgaacccggagaactatttcttcccactcttaagcgtctcttcccattgctcttcacttctactagtttggttttcaggattccctgccccggtgggagatagcttaggccaaagtccagactccctgttcgtcttccttcctgggaccatttaggtggatggtgagtcacaccatggatcctattggtaattcctagtagctcatgctcagtttgaaggtaggtgatagaaaatattgtgccctagaaggtagaagtcctagaaaaccccagcaagtttcccttttgtcttaagctttcactccacattctaaaaagcagagttggctgggcgcggtggctcacgcctgaattcctagcactttgggaggcgaggcgggtggatcacctgaggtcaggagttcgagaccagcctggccaacatgatgaaacccctatctccactaaaaatacaaaaattagccaggtgtggtggcacacgcctataatcccagctactcaagaagctgaggcaggagaatcgcttgaacttgggaggtagaggttgcagtgagccgagatcgtggcactcgctgcactccagcctctgtgacaggagtaagactccatctcaaaaataacattaaaataaaaagcagagttgagctagacagaatgtaaattagtggtgcacaggaaaccagcctggagacatgttttatttgattaatttagtatctttttattttttttttagacagtctcactctgtcacccaggttggacagctcagtgcagcctcaacctcccgggctcctcccaccccagactcctgggtagctaggactacagatgtgcaccacaacacccgactaactaaaagctttttttagagacagggtcttgctttattgcccaggctggtcttgaactcctgggctcaagtgatcctcccgccttgacctcccaaagtgctgggattacaggcatgagccactgtgcccgtctgtgtccatttttaaacacctaaaaaaattcatatgaaattcctaatatcagcttctcttggagaaattggaaggaccagcaaatagggatctatattcctgtaagaactccatctcctttggacaggcaggtcctctctcctttgctacaaatccatcctctccctgtcgcccaggccagctgtcgctttttttttttttttttttttaagacagagtctcaccctgttgcccaggcaggagtatggtggcgcaatctcggctcactgcaacctccttctcctgggttcaagcgattcttctgcctcagcctcctgagtaggtgggattacaggcacctgccaccacgctcggctaatttttgtatttttagtagagatggggttttgccacgttggccaggctggtctcgaactcctgacctcaggtgatctgtctgcctcggcctcccaaagtgctggaattacaggcgttagccaccgcgcccagccttgtctgttgcctttatttctgagcttgccttgtttttcttgtgcttggtgtccttcactcatttctttatctgcctccgtagtctctcttgttatctaatcccagatacacacatgtatgcacacttactggagtttgtgaccctattatgacattttggttctgttggtggaaaaactgatcacctggaaaggtttctctttttctcgaagcaattgaaataacccgtgtttaaagataaacgtcttctgttttcagataactaagaaattcgtcaaaggctctacagagaagaacaagctcagactgcaaagagtaagacattttccctgaaatagaaaattaacctgctgtgctttttgcattaaatagtaagcaaagccctttgaagttcctttggtctagtttttacattttccccagccttctctgaccatcattttgattcctgcttcattttaagtacttggacttcatggtttgtggattgtgtcattttttggcttgctgagtgagtcctaaggttttgtgtgtggccttttctaagcttttatcaatagtgctaccactgtcttaatggttcagtatcccattgtagcttcaaattaccttccaaaaacccagtccatttccttgtagtcctgtctcttttttttttttttttttttttttgagacagagtctcgctctgccacccaggctggggtgcagtggtgcgatctcggctcactgcaagctccacctcccaggttcacgccattctcctggctcagcctccccagtagttgggactacaggcatccaccaccacgcctggctaattttttgtatttttagtagagacggggtttcaccatgttagccaggatggtctcgatctcctgacctcgtgatccgcccgcctcggcctcccagagtgctgggattacaggtgtgagccgccgcgcctggccagtcctgtgtctttcacttattgctaagtgctataacatctgaatagcctctacactcgatgggtggttatcctttagtgactctctgcttagtctcctattctgtggggggcatcaccacgttttccacacagcaatgcagggggcttttgttttgttttgtctttgagacggagtcttgctctgtcaccagactggagtgcagtggcacgatctcggctcactgcaacctctgcctcccgggttcaagcggttcttctgcctcagcctcccgagtagctgggactacaggcacttgctgccatagccagctaattttttttttttttttttttttttgtattttagtagagatggggttcaccatgttgcccaggctggtctcaaactcctgagctcaggcaatcctcccgtctcagcctcccaaagtgctaggattacaggcctgagccactacacctggccgcaggggactttttacttattgcttaaaggttagagaaattgaacatcatgtcataccgaaacaaaccaaaactccagggaaggcctctgggctttgcctatgcagtgccagctcacaggaggggcctggtgaccatgggctctgcgtttactgagtgtttcctgagctccctgatgttcactgggcgtttcctgagcttcctgatggccacactgagtttttgtgtttcagatttggggttgatttttattttattacttttttttttattgagacacagtctctgttgcccaggctggagtgtagtggtgcaatctcggctcactgcagcctctacctcccgggttcaagcgattctcctgcctcagcctctcgagtagctgggattataggcacgagccaccacgcctggataattttttgtatttttagtagagacagggtttcgctatgtttgtcaggctggtctcaaactcctgacttcaggtgatccacccaccttggcttcccaaagtgctgggactacaggtgtgagccaccacgcccagcctgatttttatttttacagtttatctcattctttggaacaagagcacttttaaagctcattggaacctccgagtcccgcacaccgggttggggagcggagaaagtatccaacggcggctgaagaaatctgattcacctgcagtttctagaagccttctatttcctgcttagcaacagggtgggagactcttcacccagttatgtttatagtctccttgttcagtccagacggtcaccttcctcgtgtgtctcgtatatcagatgcagtcacacagcacactggcaggaaatgcacatcagacatcttccaggctgtgtctctgtggcttttgttaaagctaccagagatgtattggaacacatttagaatttttccttagagacaagggcagatatcctaacccaaactgaaagctgagctgtcaggctccagacgtgtgggaagcccatattggatgagaggtggtcctcatgcagtgttaggagcgggcacctgtggagctgggcaggtgagcgttttttttttttattttgagacagtctcgctctgttgcccatgctggagtgcagcggcgtgatctcggctccctgcaacctccacctcccaggttcgagcgattctcctgcctcggtctcccaagaagctgggattacaggcacgtgccttcatgcccagctaatttttgtatttttagtagagacggggtttcaccatgttggccaggctggtctcgaactcctgacctcaagtaatccgcctgcctcggcttcccaaagtgctgggattacaggtgggagcctgcgcctggctgagcatgtttaacattgaacttcagattacgtaatgactgagtgtcccaggccactgccaagtctttggaatgaggaacgtagtgatgaagtgttacttccttaaagaatttgaaacaaggctgggcgtagtggctcgcccccataatcccacactttgggaggccaaagtgggaggatttcttgagcccaggagtttgagacaagcctgggcaacgtagtgtctctactaaaaagaaaaagaattcctgggctggttgcaatgggtcatgcctgtaatcctagcactttgggaggctgaggtggacagattgcttgagcgcaggagttaaagatcagtctgggcaacatagtgagactccatctctacaaaaattagccaggtgtggtgacaggtgcctgtggtcccagctactcgggaggctgaggcaggaggactgatttgagcccaggacggaggttgcagtgagccaagatagcattgctgcactccctccagcctgggcactagaatgagactctatctccaaataaataaataatgtttttttgttttgtttttcagacagagtcttgctctgtcacccaggctgcagtgccgtggcgtgatcttgaactgccttgtgggtttaagcgatccttgtgcctcagactcctgagtagctgggactataggtgtgcgccaccacattcagctaatttttttgtatttttggtagacttggggtttcaccttcttggccaggctggtctcaaacttctggcctcaagcaatttgtctgcctcagcctcccaaagtgctgggattataggtgtgagccccctcagcccagcaggattgtgttttaaatgaatcttatattgaatttcccacaagtaccaggacacagggctaattcttaacatttttctcatgatggaaggaagcataatggattatgaaaatcacttctgtggctgggtgctggggctcatgcctataattccaacactttgggaggctaaggcagaaggattgtttgaggccacgtgttcaagaccagcctgggcaacacagcaaaaccccatctctaggaaaattacaaaaatagctgggtatagtggtgtgtgcttatagcccctgctactcaggagcctgaggtgggaggatcacttgagcctgggaggtcgaggctgcagccagctatgactgcaccactgcactccaccatgggcaacagagtagactttgtctcaagaaaaataaaatcacttctgtgtaaagttgttgactggaggctcctcctggagctggtctctgaattcttatttattcatttatttttttaactgagtctcagttgcccaggctggagtgcagtggtgtgacctcagctcactgcaccctacgtctcctggttcaagtgattctcctgccccagcctcctgagtagctgggactacgggtaccctccaccacgcctggctaatttttttttttttttttattaaatggagtctcactctgtcactgatgctggagtgcagtggcaccgtgttggctcactgcaacctccgtctcctggtttcaagcaattcttctgcctcagcctccccagtagctgggattacaggcgcccaccatgcctggctagttttttttaaaaatatttttagtagagatggggtttcaccatcttggccaggctggtctcgaactcctgacctcaggtgatccacttgcctcggcctcccaaagtgctgggattacaggcgtgaaccaccgcgcgcagccaatttttgtatttttagtagagacagggtttcaccctgttgaccaggctggtctcaaactcctgacctcaggtgatctacccacctcagcctcccaaagtgctggaattacaggcgtgagccaccatgcctagccttggtccctcaattctgttcatcccgtccaggccgtgctgtcctccatgctgtgaaccgagcttcctcctgggagttggagggagggccacctgtcacttgccacactgtcttgtaggatcaggagcgtctgggcaagcagctcaagttacgtgcagaaagggaagaaaaggagaagctgaaagaggaggccaagcgggccaaggaggaggccaagaagaagaaggaggaagagaaggagcttaaggaaaaggagaggcgggagaagcgggagaaggatgagaaggagaaggcggagaagcagcggctcaaggaggagcggcgcaaggagagacaggaagccctggagtgagtgtccttggaggccatgctgggcccgccaccctgctgctggattccgctcctggccactctgatggggcctttccacttcacaggcagatggcggctcccttcagttccttcccatttctccttcgtgaggtgcccgtggggccctgacgtgggagcggtggaaagcagctccctgctctttagtgctcccccacgtccaactcaccctggaccccttgtctctgctgtgaccatccttccagttcccaaccaacttaggcatttgcattgcaggattgtgggttttgtctgtgctaattgtgctctgactggctaaagttttttatatatattctagtcacaggaagaattttattgactgttttccatttttattgtgaagacctatgtaaaagccttatactagacatgaaaataacttatattcatttaatgtaaaatgaaatacttgccatatactaacagttgagtgctgcggtcccttccagagccaaagcaaagagtcggctgaaatgtcatttgctgtctcacagggctaaacttgaggaaaaaaggaaaaaggaagaagagaaacggttaagagaagaagagaaggtagagtgtttcccacagagcttccccgtcccagcccgttggagaagcagatgcccaaagtggaattcttgccacagccgtcacctaatattctcttggtttggggaaaccaaatggcgcccgcagggagggcgagtctgtctagatgcgttcttgttgcttcttcccagtgctggctgtcacatgcctactggccctgcaatcctggcacttctacccacaagggcaacttggacattttgagattggctggctcagttgcgggtccgtgggttttgagagctgaaaatcacagtagtgccttcaagctaaaatgcttgacgttcggttctgggggcctttgcatgttttgcaacacatactgttcctcttcctctcctctttctcatcaccatctcttaacatcacagcgcattaaagcagagaaggccgaaatcacgaggttcttccagaaaccaaagactccacaggcccccaaggtgagcagccggctgcctttgcttttgggtttcagctctgctagacttttcctttctgaaagtgaaagggtctctccccagccagcttctctcattaggagggagggagcctccagtgacctagggcacttccatttctggttaagtcttgaggctcaatattttgtccttcgctttgtcccaaagaggtaaaaagtggcatgtctgattaaacagtgctgttttcagaggttacttcatgaataattttgtgttaggcgtaagagaaattcaccatgtttttacccttgggaaacttaggcttaaggagggagcacgtttagctgtaaaacaacagtacaattcacaaaggtttactttccctgcctggcgtcggtcacctggcatctcagaccttctgagccaccatctgtgcatggaaaccacagccctccttcccctttacccagagggagcccatctccaatgttaggggtccttcagtgcctttccctgctccactcactgtatttatacacatgtgtacttagctatctcagatttgtgccatgttgccacatttagatgtatttcattctttttaatgtatctggcctttatttattttttgaggcagggtctcactgtcacccaggctgtagtgcagttgcacaatcaaagctcaccacagccttgacctctcagggtctggtgatcctgtcacctcagccttcccgagtagctgggactacaggcatgtgccaccatgcctggctaattttttatttttattttttttgagatggagtctcactctgtcacccaggctgcagtacagtggtgcgatctcagctcactgcaacgtccacctcccgggttccagtgattcttctgtgtcagcctcccaggtagctgggattacaggcacatgctaccacacctggctaatttttgtatttttagtatagacggggttttaccatgttggctaggctggtcttgaactcctgacctcaggtgatccgcccgcctcagcctcccgaagtgccgggattataggcgtgagccaccgtgcccggcctaattttttaatttttttttgtagagactgggttttgctatgttgcccaggctggtctcgacgacctggcttcaaatgatcctccaaacctcggcctctcaaagcacttggattacaggtgtgagtccctgcacctggcctgtccttttatttgtatgttgagacatttgatggcaattgtgtatcctgaaggtgcacaatgtgacattgttgtacctacacatcatattgtgacagccagagatccacatcatgtattttcactgccgcataatacttcataatgcaatgatatggtttctctctttttttacaaaaattatttatttatttagagacggagtattgctctgtcacccatgctggagagcagtggcgctatctctcggctcactctaacctttgtctcccgggttcaagcaattcttctacctcagcctcccgagtagctgggattacaggtgcctgccaccactcccagctaattttttgtgtttttagtagagacggggtttcaccatattggccaggctggtcttgaactcctgacctcagatgatctgcccatctcagcctccctaattttatttttagtagagactgggtctcactgtgttgccagggctggtctcgacctcctggtctcaagcatttctctcgctttggccacccaccgtgctaggatcacaggcatgagccacagagcctgccactatctcaacctctttgcccctcagtggtgtagggggggtccctgcacatgcttctctgcacacatgcattcctctgggacagccaagtaagcatgagttcacctctaggacaaaatagcatattgctgaagcatcatgagccatggccagagtgcgtgccagatgggaaactcagatgtacattcccggcgatgtgtggaaatttcctccccattctctgctatcactgcaatttttatgggattaattttcttttaactttgccagtctgatggatttttaaaaattgacattgttttactttccatttttacttgactcttggtgcagttgagcatctttttctgttcgtttgccattttagttcttctatgacttgccaattcctatttttttacctatttttctacaggattttctttttttttctttgcctgatctgtaagttttttttaacatagtctagtatttcattctccgtgatatttcgtctcagcctgttacctctttgtttacagtcttttttttttttttttttgagacacagtttcactctgttgctgaggctggagtgcagtggtgccatctcggctcactgcaagctccacctcctgggttcacaccattctcctgcctcagcctcccgagtagctgggactacaagcgcccgccaccatgccccgctaattttttgtatttttagtagagacggggtttgcaccgtgttggccaggatggtctcgatctcctgaccttgtgatccgcccgcctcggcctcccaaagggctgggattacaggtgtgagccaccgtgcccggcctttgttgttttttgtttgtttgttttgagacaaagtttcgctcattgcccaggctggagtgcagtggcatgatctcagctcaccacaacctctgcctcctgcgttcaaatgattctcttgcctcagcctcccgagtagctgagattacaggcatgtgctgccacgcccagctaattttgtatttttagtagagacggggtttttccatgttggtcaggcttgtcttgaactactgacctcaggtgatccgcctacctcggcctcccaaagtgctgggattacaggtgtgagccaccacgcccagctacagtgtctttcattatactgaaatttctccttttggccaggtgcggtggcttatgcctgtaatctcagcatttggggaggccaaggcgggtgaatcatctgaggtcaggagcttgagaccagcctggccaacaaggtgtctctactaaaaatactaaaaatacaaaaattagccgggcgtggtggtaggcgtctgtaatcccagctgctcatgaggctgaggcaggagaatcgcccaacccaggaggcagaggttgcagtgagccgagattgcaccactgtactccaggctgcgcaatgaagcgagactccatctcagaaaaaaaaaagaggagttgtgatctttcaaaaaaagaccctgtctttttttttttttttttttttttttttttttgagaaggagtcttgctctgttgcccaggctagagtacagtggcgtgatctgggctcactgcaacctctgcctcccagatccaaacgattctcctgcctcagcctcctgagtagctgggactacaggtgcccaccaccatgccaagctaatttttgttttgttttgttttgttttgtttttgagatggagtcttgctctatcccccaggttggagtggtgcagtggcacgatctcggctcactgcaacctctgcctcccaggttcaagcaattctcctgcctcaggcccaggctagagtacagtggcgtgatctgggctcactgcaacctctgcctcccagatccaaacgattctcccgcctcagcctcctgagtagctgggactacaggtgcccaccaccatgccaagctaatttttgttttgttttgttttgtttttgagatggagtcttgctctatcccccaggctggagtgcagtggcacgatctcagctcactgcaacctctgcctcccaggttcaagcaattctcctgcctcaggctcccaagtagctgggactacaggtgcatgccaccgtgcccggctaattttttgtattttagtagagaccgggtttcactgtgttgcccaggctggtctcgaactcctgagctcagacaatccacccgcctcggcctcccaaagcgctacaattacaggcgtgagccaccgcgcctggcctaatttttgtatttttagtagagacggggtttcaccatcttggccaggctggtctcgaactcctgacctcaggtgatccgccctcctcagcctcccaaagtggtgggattacaggcatgagccactgcccctggcctaatttttgtttttagtagagatggggtttcaccatgttgggcaggctggtctcgaactcctgacctcaggtgatccgccttcctccgcctcccaaaatggtgggattacaggcatgagccactgcccctggcctaatttttgtttttagtagagatggggtttcaccatgttgggcaggctggtctcgaactcctgacctcaggtgatccgccctcctcagcctcccaaagtggtgggattacaggcatgagccactgcccccggccttttttttttttttttttaagtgaggtttgttgagatataatttacatccaataaaataaactcttttcaggacatttgtgttgacaaatgacagggccagctaaccataatgaagataaaccctatttccatcactcaaaacagctcccttgtagtctgtccccccaccgccggcccttgagactgccaatctgccctctgccctgtagctctggaaactcggctctgtggacccacacagtgcctgggcttttgagtctgtgccttggccttagcctggatgaatcccaccagcaccctgctgtgtgcgtccatggtgcctcctttctcccattgctcgaagaccccatcgggtctcttcttgatttcagaccctggccggctcctgtgggaagtttgccccctttgaaattaaagagcacatggtcctggcccctcggcgtcggaccgctttccatccagacctctgcagtcagctggaccagctcctccagcagcagagcggcgagttctccttcttgaaagacctcaaaggccggcagcccctgaggtccggacccacgcacgtttccacccggaatgcagatatttttaacaggtcagagcctgaggaggtcggccttcacccactagtgatgctggaggccagcatcctgaaccctggggtccccggggtgggagctctgggtccttctgttgcttgcttcctagtgccctcgggccctgggcttcggtgctggctcaggcctctctccacctggccttcctgtaagctcctgaagtcttcctctccctgtcttcccagctcctcgtggaggaatcttatttccctgctggtctccagtgaaggataccccccaacacctcgctcttgcaaatctcattccacagaacctcccttgctaaaaatgctctggggctgcacctgggcagctgtcctccctctcaccctgcaggctgcaccctcctccatctgtcccttcagtccatgttcctgacctttctttggggacaggcagtgctgctttttaacaaatgcccatctttctagaattgttaggccagcttcacagggaggttcctgggaggtttgtgagcaggtctgtaaggcagcgtgatcctgagcctggggttttccttctcagtgatgtcgtcatcgtggagcgtgggaagggcgacggtgttcccgagaggaggaagtttggcaggatgaagctcctgcagttctgtgagaaccaccggcctgcctactggggtacctggaataagaagacggcactcatccgcgcgcgagacccctgggcccaggacacggtgagctagccccagagtgcctccgtccccgtacctcctcactgtgcccctttcctccagccccaaagacagttgtgagtcccatgtgtttcttttctcagaagctcctggactatgaggtggacagtgatgaggagtgggaagaagaggagcctggggagtccctgtcccacagtgagggggtaaggatgtgccccagctgtcttcactcacagacggcttgtgtttgagtctctgtcccacagtgaggggctaaggatgcagcccagctgtgttcactcactgacagctggtgtttgacctgctgtgtggtctgaaacctgaacgcacctcaacatccagacttccagcttctctcgaaaaatctcatctggtgacactcgcccacgtggctgctggggatgggatcccgtccgcatctgcaccgtggccccacagccccctcttgcctcctgcgggcctgctgcacaccatttcctcctgactgcccagctgctgtgacctagtgggctttctgccgatgctcaccgtgtctgtcgggaggccatgcaaagcagatgttcacagctttacatttttttgtttctttaagatggagtctcactctatcactcaggctggagtgcagtggcgcgatttcggctcactgcaacctctgcctcccaggctcaagtgatagtcctgccccagcctccctagtagctgggattataggtgcgtgccaccatgcccagccaagatttgtatttttagtagagacagagttttaccatgttggccaggctggtctcaaactcctgacttcagatgatccgcccacctcagcctcccaaagtgctgggattagaggtgtgagccactgcgcctggcctactttgtttttaataaggcacacactctgcttttctatctgatgaactcttttttttttctccttttgaggatgatgatgacgacatgggagaggatgaagatgaggacgatggtttctttgtgccccatgggtacctgtctgaggacgaaggtgtgacagaggtgagggagtgaagggggaggtcaccggctcagcaaaagttcatttctggactggtgctcagtggcctgacctgggagggtgacgggggtcccagcccaaccatacgagatttggactgcattccaagcacgcaagctcactcgtgggaacagctgggcctgaacttggtattacctgggagggtggcagacgtaggaggagcttgcaagcgaggggagccataggagcagacaccctggtgagggagcgtggccatggtctgtgggttagaaggctggaaaccacccgagctgacatacagtcagcatgcagcaagacatgtgcattgtaagtgttgagtttgatgacgtaacaatcaagtgaatgtgggcaaccaccgcccgaaataaaacagaacttccctatctctccagaagattgcccacgtctctgcaggcgaacctgcctgccacccctttccagattccataaggttgtggaactgtctttttttttttttttcttgagacggattctcattctgttacccaggctggagtgcaatggcccggtgttggctcactgcaacctctgcctcccgggttcaagcaattctcctgcctcggcctcccaagtagctgggactacaggcgtgtgccaccacacctggctaatttttgtatttttagtagagacgggagttcattatgttggccaggctggtcttgaactcctgacctccagtgatccacccgcctcggcctcccagagtgctgggattacaggcatgagccaccgagcccggcaggaacttgctttcaagcaagttgtttttggtcctgttttgttttgaaggcctgtcgtttgggaagtggggatttggtgggactgtctcatggttggactggaggcctaggcattccttgtgcatatctgaccaccgaggcctgaactgtcagtcagagagtggtctcaggccctgcatgtgtctgccagatgcctgggccatgtgggtagacacccaaccctgttaaacggctccacgatcacacattcaccagaaaattcagaggggtgttaaaagaggcctcatgggtgagttcagaaatatctgtgacgctcccaaaggagaccaggtgtgaattattccatctggaagaggggcagccagcgcatggtgtgctctgccctggccctgacactgtgggaagttttgtgcccctgtcctttcctcttgctccccagctggctggggactggttcctcaaaagagtgcccgggcataggggagcaagaaccccaaataaacttctgctttctaaaccacaaggagtgtgccgaccctgagaaccataaggtccgccagaaactgaaggccaaggagtgggacgagttcctggctaaggggaagcgctttcgcgtcctgcaacctgtgaagatcggctgcgtgtgggcggctgacagagactgcgcaggcgatgacctgaaggtactgcagcagttcgcagcctgcttcctggagaccctgccggcccaggaggagcagacgcccaaggcctccaagcgggagaggagagacgagcagagtgagtgtgggcggggccaggccacccacctgttcctgggcccagctaattccagggctgagggcaagagtcacaggctagtgggtccgtgatgcaaatgttctttccacaaataacagaggccagcccttttcctgtacatgtccgtacgttcaatgatgtccctagcagcaggacgaggcaggtcccttaattggcttgttttatcaaccaggacacaggcacagagagtgctggagtgggggctgtgctttctcaaaagccagggaggggccgggcacagtgcctcatgcctgtgatgccagcactttgggaggccaaggtgggaggatcgcttgagcctagtgcttcgacaccagcctgggcaacatggcaaaaccccatctctgcagaaaatgcaaaattacctgggtgtggtatcacgcacctgtgatcccagctactcaagaggctgaggtgggaggattgcttgagcctaggagtttcagaccacagtgagccatgatcctgccactgcactccagcctgggtgacagagcaagaccctgtctaaaaaaaaaaaaaaactcaaaaaactggggagggaccatggcacacaaggagagcagggcagtcatttgggtaggaacagcaggcatttgaagtcagccctggcaacacacgtgcccggccaaggctcacttctgggcaggtgcgtaggtgctaccctgtcttacacccgccctcatgaggccacctatccccgaagctggccatgccccaagcctcggtggcaatgagcttgtgtatgtgttttgttttttggcctgtggtgatgggtggctccccaagcctcatgcccacccatgttccctcctgccagtcctggcccagctgctgccgctcctgcacggcaatgtgaacgggagcaaggtcatcatccgggagttccaggagcactgccgccggggactgctcagcaaccacaccggcagcccgcggagcccctccaccacctacctgcacacccccacccccagcgaggatgccgccatcccctctaagtcccggctcaagcggctcatttccgagaactcagtgtatgagaagcggcctgacttcaggatgtgctggtacgtgcacccgcaggtgctacagagcttccagcaggagcacctgcccgtgccgtgccagtggagctatgtgacatcggtgccctcggcccccaaagaggacagtggcagcgtcccctccacggggcccagccagggcactcccatctcgctgaagaggaagtcagcgggcagcatgtgcatcacccaattcatgaagaagcgcaggcacgacggccaggtgaggtggggtgggcaggtgggggcctctgcagggcttttctttttttgtttgttttttgttgttttgtttttttttcgagatggagtcctgctctgtcacccaggctggagtgcagtggcgcaatctcagctcactgcaacctcctccctcctgggttcaagtgattctcctgccttagcctcctgagtagctgggattacaggtgtacgccaccatgcctggctaatttttgtatttttagtagagacggggtttcaccatgttggtcaggctggtctcgaactcctgacctcatgatccgtctgccttgtcctcccaaagtgctgggattacaggcgtgagccacctcgcctggtgtttttgtgttttttaaataaccttactcttagagcagttttagggtcacagcaaaatcgattggaaggtacagaaagttcccatacacctccttccccaaagccaagccaagccacccaacatcacctcccagaatggtgcattggttacaatcagtgcacctcaggccaggcactgtggctcacgcctgtagtctcagcactttgggaggctgaggcgggaggatcacttgagcccgggagttggagaccagcctgggcaacatggcaaaaccccatctctaagaaaaaatttttagattagccaagcggtggcatgcacctgtagtctcagctactcaggaggctaaggcgggaggattactggagcctaggagattgaggctgcagtgagctatgatcatgccactgcactgcaacctgggcgacagagcaagaccctgtctctaaaaataaatacataaaacgcaccttcgttgatttatcaccaccactagggtttgttgctggtgttgagggttctgtgatttgaatgaatgttggatgctgtgcgtctacctttattgttttaaacaaagaggcttctccccactgaaaggcccctgtgctctgcccgtccaatcccttggaaatcaccaacctctctatctccgtggatcagccttttccagattgccctgtagctggaatcgcatcgtgtgtggctcctttgacttggcagtatgcgttgacagttcctccgtgtctgtttgtggcttgatagctcttttttttttcacactgaataatattccatgtggtagcatttttatttttgttcaacggttcttgaattttgcattcaagcacagttattaagcacttactgtgctccaggcactctgatcggtctctcagacacaggtatatgcagaacaccgcccggtgtaaggcacagacaggagcctgtaaggggaatgaatggctgtgtgattccagccttatgggtgcctcggaggcacaagcgcatggagccctggggtgtgtgatgggggcactgtctggtcttaagaaactctcatgcccagagagccactggcccctggcacccacccctggccatagatcggctttgttaacgttcattgcatactttttgtccttaccacacagtgttcggaagtgagtttctcttttttcttttttttcctttttttttttttttttttttttgagacagtctcgcgctgttgcccgggctggagtgcagtggtgtgatctgggctcactgcaagctccgcctcccgggttcacaccattcttctggctcagcctcccgagtagctgggactacaggtgcccgccaccacgcccggctaattttttgtatttttagtagagacggggttttaccgtggtctcaatctcctgacctcgtgatccgcccgccttagccttccaaagtgctgtgattacaggcatgagccaccacgcctgtcctggcctttttttgagtcaggggtcttactctgttgcctagtctgtagtgcagtggcgtgatcaccactcactgcagccttgacctccccaggctcaggcgatcctcccaccttagcctcctcagtagctgagagggactacaggtgcatgccaccacacccagctaattttctgtagaaacagggtttcaccatgttgcccaggctggtccccaactcctgggcttaagcaatccccctgcctttgcctcccaaagtactgggattataggtatgagccaccgtgcctggctccctgagtttgatttctaatatctacacttaacgcagacctatctgtccctgtgaaccttgggctttccttcaaggccacgatctgatggagttacaggttttcagagacttgggacaaggagcaagacagtggataacccccggccccagcttgcatcctcttctctgatgttaaaggtggtcgttggctgggcacagtggctcacgcctataatcccatcactttgggaggccaaggcgggcagatcacctgaagtcaggagttcgagaccatcctggccaacatggtgaaaccctgtctctactaaaaatacaaaaattagctgggcatggtggcaggtgcctgtaatctcagctactcgggaggttgaggcaggagaatcgcttgaacccaggaggtggaggttgcagtgagccgagaccacaccattgtactcgagcctgggcaacacagcaagattctagtcccccaaaaaaaaaagaaaagaaaaggtggtcgttaggggcagggaggcgagagaaatggctcctgagatgatgctcagccatctccctgctgccagcacacagccatgggccttaatatgctgtgaatctccctcagctgtcacagcaggaggggccatcataacatcccaaagggtccagggctacgactgaaactgttcctggcactccctagagcctctgtccctgtacagtgtgtcatgtgcatagttcccctggctctgtggaggcggcttggcgccgtgggaagctcagtgcattggagctggggccacaggaggcccccacacagagctttgctggatgcattctttgttcaagccctgtgtgagcagtgcctttccctggtcacctgagcagccttagagggaaccggagctccccagcctgaaaatgatcggggcgggaaggtactatctggttgtgtcactatgcaagcagttttccagggcctttgctgatcagccctcccctgggaacccctgtgtccctcagatgttcctttggggtctcctcatgctccacacagtagtccaggccctggacggcctccttccccacccctctccactgatttgatgcagcagctgcctctcccagctggggtgcagtgccccgcccctggtcctcccaaacactgctcttgctccctgtcaacatgtggaacccatgtttccccacccggaaaatagcgccctgagccccatgtgcccagcaccacatcagagttactgtgcttcgggggcagtgagtgcctgtttatcatccctaaccacaaggaaagaagggtgcacccagtttaactagagtgggtcagagaggttgggtgggccttggagttagcaaaacacagcatctcacctgctaatggatggcagtggtggccacatgcgcgtgattggtggcctctgctgcgtggcacaggtgagggcctcctggggctcagcagtgcagcggacgcacgaaggtcacacgtgaaggaatggagacccaggcccagcttgatgcttaacccccacccctgaacctcctgcagtttgggacataaacgtccctggggagcagggtctggtcctgtgttttttttcagagcttgtgtggggaggggcacacaggtgggacccaaaggtggggctgtggaagcacatgagcccggatgggacatgtgccctggcatcctctgtttttttttgacagggtctcactctgttacctaggccggagtgcaatggtgcagtcacagctcaccgcagcctccactcctgggcgcaagtgatcctcctgcctcagcttcctaaggagctgggagtatagaggcacgtgccaccatgcccaactaattttcaaatattctgtagagacagggtctatgttgcccaggctggtctccaactcctgagctctagcgatcctctctccagcctcctggcatttaataaagctgctgactgatgcttctgcacccaaggggagggataagccattcatctgcaagtggtgtacatccatattttttactcggttacactttttttcccaatttgaaagttttcatcttttttattttattttattttattttgacggagtctcgctctgtcgcccaggctggagtgcagtggtgcgatctcagctcactgcaagctccacctcctgggttcacgccattctcctgcctcagcctcccaagtaggtgggactacaggcgcccaccaccacgcccagctaattttttgtatttttttagtagagacggggtttcactgtgttagccaggatggtcccgatctcctgaccttgtgatctgcccgcctcggcctcccaaagtgctaggattacaggcgtgagacaccacgcccggcatcttttcttgttgttaaattagaaacagggtcttgccctgttgccctttattattttaggttcaggggtacatgtgcaggttggcaaactcatgtcacgggggtttggtgtatagatgatttattgggtactaaggtattttttctgaatttctccctcccaccgtcacataggctccagtgtctgttgttcccctctttgtgtccacatgttcttataagtgagagcatgtgatatttggttttctgtgcctgcgttagtttgctgaggataatggttcccagcttcatccatgttcatgcaagaagaggtttttttgttttgttttgttttgttttgtagatattgggtcctgctgtgttgcccaggctggtctttgaacttgtgggctcaagcaatccacctgcctcggcctcccaaagtactgggattacagacctgagccagggagtctttaaatctttttacttagagctcaaaagagatattcttaaggcattctgacctagtggggtgaagtgccatgtatctgtgaagccctaggacacctcaactcttcgggcctccgttttatttaaaaattttaaaatacaaggaaggatgtgtttgcccttgccaacaaaacattatgtgatcaaaataaaactaaagaagcatagatggccgggtgtggtggctcatgcctgtaatcccagcactttgggaggccgaggtgggtggctcacaaggtcaggagattgagaccatcctggctaacatggtgaaacccgtctctactaaaaatacaaaaaattagccaggcgtggtggcggctgcctgtagtcccagctactcgggaggctgaggcaggagaatggcatgaacctgggaggcggagcttgcggtgagccgagatcgcgccactgcactccagcctgggcaacagagcgggattctgtctcaaaaaaaaagcatagatggctgggtgcagtggctcacgcttgtaatcacaaaactttaggagaccgaggcaggcggatcacttgagaggccaggagttcaagaccagcctggccgacatggtgaaaccccatctctaaaaatgcaaaaattagctgagcatggtggtgcacgcctgtaatcccagctactcaggaagccgaggcaggagaatcacttgaactcaggaggtggaggttgcagttgagccgagattgtgccactgcactccagcctgggcaacagagcaagtctgcgtctcagaaaaaaaaaaaaaagacaaaaaggcacaaatgttagtgacaccatcttcatcccatgtagtcgttaaacgttttcctgactcctgttttccgtagtctgcgctcctccgtgtctgtgtttagcacttgcagtgctgctggcgagatgacagctgtccccgtgaagcaagctgccggcagctcagcacagtgggactcggtgttatgtgttaaatcctgtcttcagcctagagggtgaagagtggtgattgctctgaaaaattttggatccaagaaaagcctaatgtgtcaacgcgtctcctgtgtggagggagggcccagtgacttgaggtggctctgaagaaattggcatgttcttttgtttaacgtccccagacacctccagatcagaatgtccctcctcagcagcgtctacaggggactcttagactcttctttgcttaactattctttcaaaaaggtagttgaaaatggccgtaggccaggctcagtggctcatgcctgtaatcccagcactttgggaggctgaggcaggaggatcacttgagaccaggagttgaagggtgcagttacctgtgattgcaccactgcaccacagcctgggtgacagagcaagatgtttctcctgtgtcctcacagggtcaacccatgctgcctggggagagggacagcctgggctcccagccactgaagagaggatccaggaggggagcccctacccaggaattgatgaggctacggtaggaacccagtctgcctggccaggcactgtgctcttacatgacagcccatgaaaccagtctatggcctgaccgttgtgttgctgtgcggtcacttttctaggtttttgtagaggaagaattcctggaattttttgaggactatcctccctactgaaataagtgtggctgtctgtcctgggatgggcttgtgttcatgcacagagagggtaagcactgacgtggaggctcatggtggcctctacgcatcctgtctttctcctttggtgaaagcaaatggaaacagctcaggaatcttactagggtcaggtgcggtggctcacaccttgtcatcccagcactttaggaggccgaggtggaaggatggcttgagcccaggttgagaccagcctgggcaacatagtgacacccccttgtctctacttaaaaaaaaaaaaattagctgggcgtgatggcgggtgcctgtagtcccatcttctcaggaggctgaggcaggagaatggtgtgaacccaggaagtggaatttgcagtgagtcgaggtctaaaaaaataataataataattcacaagtcacagtcatcacttcacatcagggacgtgttctgagaggtgtcctcaggcaatttcatggttgggtggggctaggttgctcttacacatcctagatggacagcctgccacacgcctgggccgtgtggtacatagcccagggctcctgagctgtggacctgtgcagcaggtgactgactgctccatcctgcaggcacttgtaacccagtggtatatgtgtctttaacatagaaaaggcacagcagaggccaggtgcggtggctcatgcctgtaatcccagcactttgggaggctgacgtgggcgaatcctgaggtcaggagttcgagaccagcctggccaacatggcgaaacccccgtctgtactaaaaatacaaaagattagctgggcgtagtggcgggcacctgttaaaaaaaaaaaaaaaggcacagcaaaaatatcgttgcggctggggcagtggctcacgcctgtaatcccagcactttgggaggccaaggcaggcggatcacttcaggtcaagagttcgagaccagcctggcaacatggtgaaaccccatctctactaaaaatacaaaaattagccgggtgtggtggcaggtggctgtaatcccagctactcaggaggccgaggcaggagaatcacttgaacctgggagtcagaagttgcagtgagccaagatcgcaccactgcactccagcctggatatatggcaagactctgtctcaagatttatatatattaaataaaaatacagttgtctgtaatcccaggactttgggaggctgaggtgggtagatcataaggtcaggagtttgagaccagcttgaccaacatggtgaaaccccgtctctactaaaaatacaaaaattagctgggcgtgatggcatacacctgtaatcccagctactcaggaggctgaagaacgagaatcgcttgaacccgggtggcggaggttgcagtgagctgagattgtgccactgcactccagcctcagtgacagagtgaaactcccgtctcaaaaataaaaaataaaggccaggcatggtggctcacacctgtaatcccagcactttgggaggctgaggcgggcggatcacgaggtcaggagatcaagaccatccggataacacgatgaaaccccgtctctactaaaaatacaaactgggcgtggtgtcaggcgcctgtagtcccagctactcaggaggctgaggcaggagaatggcgtgaatccgggaggcggagcttgcagtgagtcgagatcgcgccactgcactccagcctgggcaacagagcgagactccgtctcaaaaaaaaataaaaataaataaatacagttgtaatctgatggggccactatcaggtatgcggcctgtcactgactggaaattattctgcagttggcaatgatggctgtttttggagatctgaatccagttcatttgagggaacccccaaggttctctggttgtggcctcttgaataaacctctcacatttggacagtttgttaccaaattgggttctggatgttggtttccttccgtgttgggggtgggaggaaggtgtcacacctgtggagttccccccgctaccgcactggcaccagggtggctgctgcctgcagtgctgatggccgtgtaccctgtctgtccagattggtgctgaagacatggacggcttccaggcagacacggaggaggaggaagaggaggagggcgactgtatgatcgtggatgtcccggatgctgcgggtgagaagggctgtagatagcagaacgcactggtgaggtgggcgctggaggtaaacctcaacagagaagggatggggctgcctaagactagctccactgtgagcagccaggagggcttgcagctggaagtggctcctgccctgccacatcctcgggcgggctgggccgtgggtgctgaccatgccaggcatcgttctggccgcagagccacaagggcctatgctgggagtctcaggtggttgtgacgttagatgggggtcagggaaggctgcactgaggcagcaagggagggccaggtggatttctggagcactcgccaaagaggaagtacagaggccctgcagcaggctgcgtgggaggagtgtgcccgggtggtggggggcaggcagggtcaacctgagagcaggtgagcaggtcacctctagaagaggcacaacgccccagcctctgcctgtccccactgtcaggtggagggtcccgccctggggttgttgcaggccccatgaggcagcagggtggggtcttcccccagggagcccagagggcccagccagctcaagaccctccctctcttgccctgcagaggtccaagccccgtgtggagccgcttccggagctgggggtggtgtgggggtggacaccggcaaggccaccctgaccgcgagcccactgggtgcatcctgagagcaggggtgacgtatgtagaatgcttagggtgtcctccccacagagcagatacttgaaccgactcaattcctgtgtaaagagcactttgtcctgcttcacggacctccccaaagtgtgcagagttctatataggatgctggattagttcctttgatatttgtaaaaattcccccaagagccgcatatgaatctgccctttaataaagcattattgagattgctggcctattggggaagcctgcgggcacaggagcaggcgtggaatccaatacttgtaaatgaattgaagcgtcaggaccacccgcctggccacgtgcgcgggcccctggacctaacgaggcagtgtataaacttattctctagccctgagctgctctgtctgtcttttccgaaaacattgtgtttctctgagagtgcaccttgcccatggcccggccccatgtggtgcctggtgtctggggccagccttgtgccctgcaacagcaccgtcccatctgtttgtcactaagtcaccctcataccaggctgacctgggtcaaggtgcgggtttttccgcacgtgcttctgtccggcgatccctcctgccctgggttggggggttaggagagggtgttcccagagacctgctagggtcacctccctgaacccggagctgctgggagccgagtttggcttcgagtctgaggctttgtgagagcccaccccaggtcaggtgcatcttttgcgagtgctggagctagaaggtgacctcctccccgccccaggttgagtgggctttatccacactgtccgagggaggacaggcgacagccgctgtggtactgagcagctcagagcacacgcagccacggggagggtcacgctcgccagtcctgctcttcccagccacaccccacctgaagtcctaagcttcccttcagggaaccctatgtgggaaaagtgtcagctacctccatccacccagtcagggacggcagggcgcccgggccaggccttcctgctgggaagcaggattcagctgtgcctgaagcagaggctgcccctgtgccacacctttgatgagctttacaggggctcccgacaacccggaatcaggtcctggggcctgcaggacgcaggactggagtgacagcctccattctcaacaggccgggtgcccacaccagctggggcagtgccgggggcgagggagggaccaatgcaaggtcaggggcacgagcataggccccgggcacctcccccaggtgcagacctgcatccccaagtcagcagtggggccggggcacacatgccttccacactgcagggcagagtccctgtgtctcctggggctgctgtaccacaaacctggtggcttaaagcaagtcaccatctcacagcttgggggtcagagtgcacacatgccccgccaggctaacatcaagctgtgggcaggaccaggccctcctggagagtttcccagtgctcggaggcgctgcatccctcagctcggggtcccttcctccaccttcacagccatgcgcagcctcttccagtctctctctgattcaccctcctgccacctcttgtgaggacactgggtcccggaccacccaggatcatctcccagctcaagacctttcatcatacccaagcccctcttgccaggtgaagttgcgcatctgcaggttccaggaataggatgtggccgtctcaggacaccctgtccctctggccacagggaagccaggcctgtgacagcactcgcctcccctgcagggactgggcctttgtgggcacagcacagcctcccctagcgcacgggacttcctccccaggtgggtggctcatcgggcacttgtggccaggtgctggcctgagaacaggtatccacatggtcccaccttgacagggagccacacccagcccccaagccatccgctcttcagcaggtgggcctgccctgtgtcccacggtttcaacggagaaccaagaaactatattcaaacaacctgtttatttgggcttatgatttactaactgcaggtctatgtgcaggaaggccagcatcccctcctgccgttgtcacccacatccacagagcagccctagtgccaggtgcagccactgccacccacggcacacgggaacaggacccatgctgcaggcctgctctcctgcccagggagatgccacgtgtgtctgtccggcagcttcatgacacagttaccaagcagctagggagggcttagatttgttggtgtccccaggcctctccctcgggggcttgggcgcatccccacagcccccaagggatgggggctctgccacggggcccaattccacagctccacggctggcgcccctcccgtgcccatggggcagagccaagtatttccagaggtggcttggaggccctggggtggcggggagaggaacagggagagcatgagacagacccacagggctgaggccaaccctgcttttatttcacaagagcttctcgatggctgacaggagctcgggtttcaggatggagtccggctcggcccccgcggccttgatgtcctccagcacagccatgtcccacgagaaggtcaggagggcagagggcacctgcggtaggggtaggccgtcactctgagaccgagagtcggcccttgccgcggcagggaactcagcgggcaacctgggcgcggggatgccccggcctggaagccatctcagctggtggaggctgtggctcgcacccaggcctcctgccctctccctccgggactccaggacctaagcctaaacctactgcactagctaacgcacgtcaccgctcccatttgatggggaaactgaggcgtggagtagttatgaacttgctcgaggccctgctgccagtaagtgggaaagcaggattcaaacccagggacctgcccaggccccctgctctgagaacaaggaggctccctcctgggggtgtctgtgccggtcccaggagaacctgcagaggcatcgggtcagcggtgctcctgcgggccgacactcaccagcccgcactcgttcaaggccaggttctcgtcctcggacagcttctgccctcccgaggccagcagctcaaaaggcagccagtcgctctgcagggcctcccggacgaacccgtacaccgcccccagccgctcccgagcgtagaaagtgcctggggagtgggggagtcagagcgggtggggcccagggccccctaccaacccgagccgccctccacgggcatcgttggtgcccaccctgcaggaggcagccatcggggaggcgcacgcgcagcagcgtgtagttgtacttgcgcagcccccgctgctcctccttctcccgcatggccttggtccgcagcacgctcagccgctccaccgcctcggacctgcacacgcgggccaggtcacgagggctggccggggttcttccaccccgccccgccccactctgctccgcggacgtcaggcccacctgagcctctgctcccgcttgatctcctctgctgtgaggttgaagaagtccccaggcagttcgaactgcgaggccaggggcgagggctggaagacgcggcgctgcctgtccagcttggcgcgcacgggctccgcagccagcagctgttccttgtgcctctccaggctctggggctgggccaaggtggtctcgctcagcacgtagaactcctcggggtcctctacagcgtggcaggacatgggtgtcactgtgcaatggagagacccccaagccgggccctcctgccccgaggcccctcgtccccattccctactcagccaggccctgtccacttaccctgatcctgggcgggaagcaacaccttctggaacccaatggcctcaaaaaactcgtgggtcccttccaggcagttaatgcgctcctgggggtggagatgggcgtcactgggggcccctggcttcctccatggcctggccacaccccacccagtccaggggcccggctctcgctattgggagcagctgtcgacccctggatggggcccagccctgggggtgcctcagtgctggatgcaaacctgcttttctacggtgggggctgtggagtctccaacagctctgcacagaggaaagagtcacaaccaggcacgaagagtgaggctgaggagccagacactgctggggcctgatgcgaggctaacaccgcccaggaccccagtccctgccctttcccccagaagaaccagacatctggtttgcatgagaaacctccccagagtcgacatgttcccaaacaagcccagctgaagaggaggaaaaggatgcaggtgaggagaggcagaatttgttgatttggggtgaccggtgcataaaagtcttgctctccatcttgtcctgctaccttctactggccgaacccttcactgcttgtggctcaactctcgctagctcctccagggagcccaccgcctggtgtgggccaccaccggctcctgcaggccagctgcccccacccccagcctgggccccgggggccagaaggcacgcccacctgaaacaccttgttctgcagcttgatcttccggtacttctcctcctcggggtgcaggtggatgttgtccaggtacctggggtaggtggagaaggtgagtggggcacagcccaggctgcccacccggcccctctgtgcctcctgctccaggtaacagcagctcagccacacttggcctctagtcagagggaagaagcggcccagtgacgcgagggcagcagaccatctccgggtggaaggcacacctcggacaccccatggagcccacccctggtgccagcaggagccccacggaacccctcaccgtcccaccagccctggaagggcacaattaaccacagcggtggggaagccacagtgccggaagagtggagagccagagctgaagggccgcagtgccagcagggggctcctgcggggtgctccctcggcgttggcgggcagcgtggacctccaggcctgcccccgatcctgagacccggggagtggggtgggaccctgcctcctccacatgttccccaaggaagccagggtgggaaacccctgattccttcaacaccttcattttgcacacgggtaaactgaggcccaaggaggcccagccctttgcctgaggcctctgggtggagctgcctcactctcggcctatgctccttcccaacccacctcagcaggtaatgagggggccagagggggtgacagccccagtgggaggggtgctgggatgagctggaggggccaggcagggcaaaggggccacacgctcacttggc

SEQ ID NO: 172 - DNA, 17346 bp, Homo Sapiens
acaagtcccagcatccaccgcgcggcccaggactgtcagggtagtgggcgttgcgtgaggcgggtaaatgttcgcggaagcggcaaagacgacacggccttgtgggatggcggagtttaaggagaagcctgaggccccgactgagcagctggatgtcgcgtgcggccaggaaaacttgccggtgggcgcgtggcccccgggggccgcgccggcgcccttccaggtaggggcggggccaggcggcgcgggaggcgggcgcgcggctcccccacgtggtctcctcaagccgcctcgctgggacggcctcccagtcgcgaccttttgtcttctcttacagcgcacccgttggtgcgcgggaataggtgtgcatgccccggcctgggcctttttctgttgacccacggcatcaccttagcaagggtgttgtccttttcagtccattccctgaagcgcagaaccggaggccttgtgagaacctggctttttgtccagtcctgtcctcagaactcaaggaggcatcacggggggagtcatttacctccctggtctcaggtgtctctcacaggtaggataagccgtggggcctattaatggatcgcagccggtgtcgtgcataaaaacagcccctcgagtcagccttagctgtggtctccctcacgctgtgggctcttgggcgagtgtaaattagctgtggctcagccttagagtcttccagcgtacagtggaacagtacctctcttccggagtgctttgaaaatggcaaggaaaatacactttccggtttgctgtaagaactcagtaaatgtttgcttctattaactacctcaaagccctttctactctcctttttctttttgagactgagtctcgctctgtcgcccaggctggagtgcactggcgcgatctcggcccaccgcaacctccacctcccgggttcaagcgattctcctgcctcagcctcccgagtagctgggattacaggcatgggccaccacgcccggctaatttttgtatttttagtagagacagggtttctccatgttggtcaggctggtctcgaactcccaacctcaggtgatccgcccgcctcggcctcccaaaatgctgggattacaggcatgagccacgctcccagcctctactgactttcttatccctccgaccttggcctgagcgttacccaaggaataaggaatgaccaaagattttgaagtggaaagagcgctggacgtggaagttggagagtatggttcggagcttagacatcttagctacttcccagagcctgagtttcttcatctgcaaaatgaaaataataatttaaaaatgcatagcccctttaacatccattatcaacaatgaaccctatctgccctttctttttcctaggggtttttgtgaggatcagataagataagagattcaatagcagctttcaaagatgtcaaggaaaagaatcaaactctaaaatatttgaagagatttattctgagccaaatatgagtgaccatggcctgtgacacagccctcaggagatgctgagaacatgtgtcccaggtggttagggcacagcctggttttatacatgtttgggagagaggagacgtcaatcaaatacatttaacatgtacatgggtttggttcagaaggcggggcaactcaaagtggtggggggggcttccagactataggtagattttaatttttctggttaacaatttttctggttaacaattggttgagtttgtctgaagacctgggatcaatagaaatgtttaggttaagataaagggtttttttttgagacggagcttgactccatcacccaggctagagtgtggtggtgcgatcagctcactgcaacctccgcctcccaggttcaagcgattcttccacctcagcttcccgagtagctggaattacaggcgcctacaaccacgcccagctgatttttgtatttttagtagagacagggttttaccatgttgcccaggctggtctcaaactcctgacctcaagtgatccacccacctgggcctcccaaagtgctgggattacagacgtgagccaccgcacccggccatgtagagacccaagttttaattgtggggaggagactcccagctgacttcagagggagcaggttgtaaaatgtttcttatctaacttaaaaaggtgcctcggtcttagttgattatctccttgttgtggaaagaaagaaaaagagggggaaaggggattctctatagaatgtggatttttcccacaagagacaaccctccagggcaatttcaagatatggcaaggaaatatatttggggttaaaatattttgatttcttcccttatttgttatttgatgttatgccagagtcaggtagaaagcagaccatgctatatagggttaaaattaaaactcctctgatgagactttatggtttgtaaggcatgactccccaggtgccttgggtaggaatttgggcaagataagaaaaaatcagagtttagtcctcaaagagtagaataagatattaatgtcagaaattattattgttccccagactacctttggcaatttatagttaataatacagttagctggcccaatattaaacagtggtccctgaaaacttaggactaagcattgctgagttcctggtcaaaaacactgatttaaaaaaccactgttctagtccattcttaattcaacaaatatttattgagagctaaatatatgcaaggtggtgggttgggctgcaaagaatacaacaaacagaaaaacgcactctaccctcaaggtgtttacaactgtcacgattagcttcaatattcctgccgtgcgtgtgtgtgtgcgtttgagactattctataaatctgtttccaatcttgagtcatatttttctttgccatatccaagaacaatctgtaaaactatgtgcccgacgtatttttttaattaactcactttaagcgttaaattatttaaaaataaattatataagtatctcccttagaatcattgtaatcattaatgtccataaaatcatgaggttttctatttctcaaagtgtatattaaaataaatacgtctatttttaaaaggggagaaaggagtgacaagaggaagctttgtgattgattgttacatctacagttggtgggcataaatgaaaattgggagattaaaacccagtcccacagtgttctaactatctctgtatatgcacagctcccaataaagttagagttacaaaaataagacaggatgccttcctaagagagcttattgtctttcttaccaagaagatcaaacatgcttgaaacatttaagtgacaagcctaaaagtgcattcaactcgttttcttccatgtattcatggaacacaaaaccagtcttataaaaggtcaaaacagcttgcttgctccaaaccctgccttcacaggcatatgcacacataagaattaaggcatgaaaaactttcaagataaaaataactttgtgtctgttttgcctttggctactgtgtgaaaaggcaaaaagaaattcaaatgttcatattggaaacaagcatatcataatgtcatcagtgttgaaagccaagtagaaaataaactaattgattttattgagctaacagttggatctaaccatttttcaggtctctgaaaccagcttcaaacattatttttagatctcaacaggccttgacaagaattatctggctcacagtcttctaatagctgcttggaggaaaaacaaacttatgaggctagaggccaagtacaaagattcttgtagctggggtttcaacacaaccaaaaaaggaatgaagattttcacaacacttctttataattcagaggcccaggttttaagcctagaatgttacagtatcatacttcagtttctgggtcttcagtacggaatgtgattcagaaaagtcaaacttctcgttaacaagtatcaagagctgcaatctggcaatcgaaaaatgcttcttgagcacctgctgtgtgccttgtcctatggataggaaccccacccccatcaccatgccacactcgaaacctcataaccatgcttttccctgagacacgtatctgttagaaaggtaagacctacacatttaacacaattagagagccctacaatctgtgtcatttagaccctgaagttcatgctattaacagtaaatgtaagtctagttcagagaagaaagaaattgttgcagacaggaatagccaagacaagagtgtattttctcttaagttttctgtcaaaaaacttgaaatcttcacccagtgcttcaaggatctgatttccagtatatcattttgccgtgattgttttgcatttattcctagctcttgcatgagtaattctgtgctttgatacatacgaagaaaaagtaaaacttacattgtaacaatgcaggaaatttaaaaaatcccagccaggcatggtggctcactcccataatcccaacccttttggaggccaaggcgggagaatcacttgaagtcaggagtttaagaccacccttaacaaagggcaacaaagtgagaccccatctctacaaaaacattttattttaaattaaccagacatggtggtgcatgcctgtagtcccacctacttgggaggctgaccttgagcccagcagttggagcctgcagtgagctatgatcatgccattgcactccagactgggcagcaacgtcttaaaaaaaaaaaatcccattctccgtgtcctttatacttttctgactgtttctaaatcccagtatgtgcatattgcagacagtaaggtaatacttgataactgaaagaagtctagtctggatcagctcttagcttttctccactcaaatggagaagtaatggaggaaaggtatacagtccgatggcttcctagacacaattttggtttgaatatgtttgaacctggaaagtttaactccagaacttattttcttcactaccctactatgcactacctgcaaaatttttattgaacacgtacatgctaatccctagagtaagctttttaagccagttctgtcatgttttctttcacagaaacctatgaaataaataagatgtttagtaatgtaaagtaatttgccagaaacatatgttgttttaaatataacatctaaaagtaatatctagaagaattgaaagaagccaatatttttataaagtgcctgacatggagtacagcattatttcattaaaatttcatgatagccaccccaaatgtgggtattatccttgtcttatagctactaatctgaagcctagccagtcacttgtccagaatcacaatgctaataagagcctggctgtggtttgtgtctcctttagagcattccatgttctgcactaggaagctctccactgcttcctcacagttcaagaccatagtcacagagttttcctgcctggtctgcacactttgctctagtctaacctcctaattgaagacatctttgttcattgaccatttacgcctttgacttgtctatgaaaagagtcaaactctgcaaaatatttgaagagatttattctgagccaaatatgagtgagcatggaccatgacacagccatcaggagatcctgagaacatgtatccgaagtggttgggatatggcttagttttatacattttagggagacatgagacaacagtcaaatacatgtaaaacgtacattggttcagtccagaaagacaggacagttggaagcagaggcttccagtttctgattaacagtttgcttgaaggaattgttattgtctaaaaacttaggaatgccttgggtaagataaagggttgtggagaccaggggtttattatcatgcaggtgaagcctccaggtagcaggcttcagagagaatagattgtaaatgttttttatcagacttaaagagtctgttctatcagtaattccaaaagggaagagggtataatgaggcatgtctgacccctgcccccttcccatcatgacctgaactagtttttcaggttagctttggaatgcccttgctgagaggaggggtcccttcagatgatcaggggatttagaattttatttttggttaacagagtacattttctagccatttcctgaaaccattctcagcttctacccagggtgtatcagtcaggactcatttgtttgcaagaaacataacacaaactggctccaacaaaaaagggaaggaattgcctcaaatcagaaaagtccaagtggtaactataggcatgtctggacccagtaattctaaaagtattgtcagatacttcttcccaccaccttcccccttcacacccctgcttcccatttctgtggtaggctacacactcagtaggcctcatctacgtggcagaacttggaaatgccaggcaaacactacagttgaataattctagtagaaagagaatgcttcttccctaattgtttcagcagaagtctggcttaggtcatatcagctgactcccagtttgtaacccactttacattagctttcagatacaattatacttcagatacagttattatttaactatggggaaacagtctgagaaatgcatcattagacaatttcgtcattatgcaaaagtcatagagtgcacagtacttacagaaacctagatggtatagcctactacacacttaggcaatatgataatgccctatcactcctaggctacaaacctgcacagaatgttgctacactgaatactgtagatacttgtaacgcagtggtgtttgtgtatctaaacatagaaaacatacagcaaaaatactgtattctaatcttacaggactaccattgtatatgcatatatgtggtctgaccaaaaagtcattatgcagcacatgactactcgaagtttaaccgcgtggcatgtaaatatttgaatagaatgttaggacaatgacctcacattatttctgaaaataataaatagcttttcaatatgtaaatacctgaaaagatgggtaattacataatcagatgttaaattagactaaaagttttcaaaagattattcttgagtgtagtcattttttaagtcattatcatctgaaatgatattttattgaccttttatggaggagaaatggaaacatgaagacaaaatgactcaaagcaattattggtatcaggatcagtgattatatccatcacggggaaaaaatttatttaaacaggaaattttcccagaagtctctgttttcttttggaagatatctgcagttcattcggaattagctactgtctataagtccctgaaggattatagcttgtgcagcaagtttaattgcagaattttaaaaaatatatcatgagattcttcaaaatctttttaaatttgtaagtaaaaataacgaaataaaactgtttttcacctgctttcctgattagaaaactgcagttgattttaaaagaagttatccatgtcaaaaaaaaaactttagcgtttagtgatttatatagtaccttaaaaatatgtgcacctttaatgacaaatcaacttaaaagtttaacatgaaaagtttaacaaagagatcttcattttacaagtactttttaaaatgtctcagtaaccatttacatttgaacactgaacctttaaaaagctgaaagtagattctctataaaacagcagtcgttgagtttgactgatagagcatcattttctaacctatcctttatccatttaggatattcctgctaagctaaagctgtaagaaacaacacaaacaaaagctatttcctctctccacccccaaatgactttttaagcagaatgttagccttctcccacaggtcctcccactggttgtcctcctcatctttcacaagaggatgtcaatcctccccagctcagagttttttttagtgtagggttttgcacttaactacatagctccacccgaggcctccacagggagtataactatctgctgttcaatacctttctaaagcctggcctggagacaaaataataatggaggattgactggaagacgtggtgcaaacattccttcaggtgctttaaaatctatccccaatgaaaggccgtgcaactggttccttgcagaactgctcttacccgactgtgctgttgtgggatcccagcagcctttactggggaccagaataaaaaacagcccatgaaactgcttcctggaaaagaatggtttagaagaacacattggtggaattccttcctggtatcagtactgaaaaaagtcaatgccacttctgaacaatgagattattccttacaggcagggcaagctatgtatctaatcatatatccttctctgaattggcagctctcaggcagagccaaatatccagtctacttctaccacatactgtgtgtctaagctcactagacctgtttgttctatttccctttcaccttactctccttacttgttcatttatcttacctgtttataagtctcattaaatccttttaggaataaagcaggtataaaatggtttgagttctatgtaagcaagaattactatatacataaaaaaatctgctgggttcatgagagatactttaatctgaaatcagtttgaaaatatgcttcacgatgctaatgaggatctaaccagagatcaggcttcacatagagtttagattgaggattgtcttctttttatataacattttacaaatgtaatgttttgaaaatacaggtacatttaaatgacagatttttttcatattcctttcttatttaattagaatttctttacaagtgtatatctttaataaatttaaatatctagtaatatctatttaagaaatagcatttttggaattctgtgtgcaattgacttgtcatctatgactttcttatccccaaccagtatctgaggtaacccacaattaaaatacatatatgcatgtatattatcaggtaaaggtaaaagagatcaaaagctaaggataaaatgcttaactgtactcagacactaaattcagcactgagttttctgacatccaaagataagagggaaacaaaagaagttacaaagctttctatttctgataagagaaaaaaatagtatttttcttattgtccttatacatacataataatacatatatatgtccttatgtgtacctatatataacatactattatatacattaagtattataatgcccaactcatccttatacatacctaaaataaaaccacaaattctaaaaattaatcttagctggacatggtggttcccacttgtagctgtagcagctaaggaagctgaggcaggagaatcgcttgagcccaggttacagtgaactgtgatcacagcactgcactccagcctgtgcaacagagcaagaccctgtctcttaaaaaaaaaaaaaaaaaacttgttttattgaagagagatgtttttggacaatatcttagtatgctgtgttttgacagttttgtcctgtttttatatatgttagaattagaatgggtcccagtcagaagctacttggaatatataggaaatatatgacatgccgtgctgacttacagtgtgtatattttttacagtacactcctgatcatgtagttggacctggagcagacattgatcccactcaaataacctttcccggatgcatttgtgtcaaaactccctgcctccctggcacttgctcctgtctccgccatggagagaactatgatgataactcatgccttagagatataggatctggaggaaagtatgcagagcctgtttttgaatgcaatgtcctgtgccgatgcagtgaccactgcagaaacagagtggtccagaaaggtctacagttccacttccaagtgttcaagacgcataaaaaaggctggggacttcgtaccttggaatttataccgaaaggaaggtttgtctgtgaatatgctggtgaggttttaggattctctgaagttcagagaagaattcacttacaaacaaaatccgactccaattacattatagccatcagggaacatgtttataatgggcaggtaatggaaacatttgttgaccctacttatataggaaatattggaagattccttaatcattcttgtgagccaaaccttttgatgattcctgtccgaattgactcaatggtacctaagttggcactttttgcagccaaagatattgtgccagaagaagaactctcttatgattattcaggaagatatcttaatctaacagtcagtgaagacaaagaaaggctagatcatgggaaactaaggaaaccttgttactgtggtgccaaatcatgtactgctttcctgccttttgacagttctctgtactgccccgtagaaaagtcgaacatcagttgtggaaatgagaaggaacccagcatgtgtggctcagccccttctgtgttcccctcctgcaagcgattgacccttgaggtgagtctgttcagtgataagcagcttgcccctccctatagtggaagacagtggttggctagctttacctctgcctagttacataagtttaactcaggaatgtggcagagactgcaagttgtccatcagtatcctttcccctttctgtaatagaattctccatttaacaaaagtacatgactacccagaatactcactttcctagttagatttgtcttagtgactgttctagttaataggatataagcaaaaatgacaagtccttaaatggagatatcctgcccttcacctcctctttcttcctgctggctggaatgtatacatgatgactggaactggagcagtcatcctagaccccaggatgaccctgggaaaggaagccattgcatagaaaaatcaacaaggttaaaaggagtctaggtgtctggtactgtagaacatcctgtcagtcgtgatctgacacctttgtactttcaggtgagaaatagtctctcccttgcttaagtcactgttattgtaagttttctagcactaacatcgaacctaataatgatccaagaaacccttgtggctgcatacctaaaccctgcttgccaaccaattttaacagtaataaagctgactttttgatttctgtctgactcctgcgtcctacttaattgtttctaagcatggatcaaggaaaaaggcattattaactatcacctgctaaaaccctaataagtactaccagtagtgaaaaatataactatgaaaatgacttacatgttgtaaccaaaagtcagaaaaagagacacattgtaaatttttcattttcattatatacttggctgtactccaaatcttgtgaagttatgcttcaaaacttcaaacagcctcacttcatgtataaataacagaaaaataaccctgtccacaccacagaaggagacgggagttttatgatcccgtttaaacttctagagcagcaaacatctctaactaccttccttaaagcagggatgttgcaaaaatacagttactgtggaggtttatcagacattttgaaagctaaaataattactagagcccctatgatattattaagtaatttaatttcttctctagtacatttaaaccctaccactaggaggccctgcactttcaacattataggaatccatgttatatataacactattcctctgtaatataagtacattgtacactttaaatgagtgaaatatacagcgtgtgaattatatctcaataaagctaggtcgtttttaagtatcttagggtttataatgttcatataacattacatggaatggttccctgtgaacaaatggtactagagtacacataaaatgccccaaattacaaatacatagtatcaaaaattttcctccaaattaatcatttctccatgccaactgtcctctattacttcaatgcctctgaagcagtcctgcttttaataaggcagcttgtatccctcactccaaaatgtgctttttcttgctcacaagctcacctaataactgagctgcttcagacgcaatatggaagtggttagaaggaaaatgattggctcaccatttgattctgcagatacccttttctatgtccttttgcctttctatattgaacagcagagatattcccagaggacaatcttccattcagagacaaggacacaaacagccccctccaactcagtgcctctgccagagacaactgactgaatatggacccctggaaattttttgtcctcaggcactagtttattatatagcacttaatcctagaaaccagattcctaaggtaagagtcaaagagtctttattccaagtcttttctaagcagcaagttaactgcatttgtttgcttcattgccatatttttgagaatgttgacacttcttttgagagaaaacatttaaaaatatacttccacttgactattatcccatgataaaataacatttttataaattataagattcaaattttaaaagatggggctgggtgcagtggctcacacctgtaatcccagcactttgggaggctgaggcaggcagaacacttgagcttgggagtttgagaccaccctggccaacatggtgaaaccccatctctactaaaaatacaaaaattagttagatgtggtggcacatgtctgtagtcccagctactcaggaggctgaggtacgagaatcacttgagcccaggaggcagaggttgcagtgagccaagactgtaccactgcactccagcttgggtgacagagcgagactctgtctcaaaaaaaaaaaaaaaaaaaaaagtaacagtttttgcattgttggaatttggtatttgatattggaatacattcttaaatgtggtcatgttatacaccattttaatgagcatttctttatgtttttttgctaatgacatcttacttgctgtttatgtttattttagactatgaaaatgatgttagacaaaaagcaaattcgagcaattttcttattcgagttcaaaatgggtcgtaaagcagcagaaacaactcgcaacatcaacaatgcatttggcccaggaactgctaacgaacgtacagtgcagtggtggttcaagaagttttgcaaaggagatgagagccttgaagatgaggagcgtagtggccggccatcagaagttgacaacgaccagttgagagcaatcatcgaagctgatccccttacaactacacgagaagttgctgaagaactcaatgtcaaccattctacggtcgttcgacatttgaagcaaattggaaaggtgaaaaagctcgataagtgggtgcctcatgagctgactgaaaatcaaaaaaatcgtcgttttgaagtgtcatcttctcttattctacgcaaccacaacgaaccatttctcgatcggattgtgacgtgtgatgaaaagtggattttatatgacaaccggcgacgatcagctcagtggttggatcaagaagaagctccaaagcacttcccaaagccaatcttgcacccaaaaaaggtcatggtcactatttggtggtctgctgctggtctgatccactacagctttctgaatcccggtgaaaccattacatctgagaagtatgctcaggaaatcgatgagatgaaccaaaaactgcaacgcctgcagctggcattggtcaacagaaagggcccaattcttctccacgacaatgcccgaccgcatgttgcacaacccacacttcaaaagttgaatgaattgggctatgaagttttgcctcatccaccgtattcacctgacctcttgccaaccaactaccacgtctttaagcatctcaacaactttttgcagggaaaacgcttccacaaccagcaggatgcagaaaatgctttccaagagttcgtcgaatcccaaagcacggatttttacgctacaggaataaaccaacttatttctcgttggcaaaaatgtgttgattgtaatggttcctattttgattaataaaaatgcgttgagcctagttataatgatttaaaattcacagtccaaaaccgcagttagttttgcaccaacccaatatcttcatagattgaaatataaattaaaattgcatttgaagtagattccacggactttattaagaatgtagaaatgtggcctggcatggtggcttacaactgtaatcccagcactttgggaggcccaggcgggcagatcacttgagtccaattgttcaggaccagcctgggcaacatagtgagaccctgactctaataaaataattttttaaaaaaagattaaaacatgtaccttgaaaagcattttggcccaagaataataacgatcacacttgaagaacaaagcttttctttaaaaaaattttcctttaattttcaaattactattcacaaaatagcagtggctgttagattttgttcttggccaaatggaaaattttgccctaattaaaatgtagtcactctccagtgtgttaccattgaacaaatcactgaacctttccaagtcaaagtttccttagttgggaagattgagttaacacatgcaaaggggttagagcaatgcctgagtatatagaaagtattcaataaatgtaaattattagtcttgagaactgtctgtaggatgtgacccaaagttctcccttctattcaggtgtaattaggatataatgtccttcaaatggcagacttaaagggggaaaaagtcactaagaggtgaccagaagggttagagctgagcaagagaggttcctgccctgagccctgcattttagagtgcctaaggttacatacatacacacacacacgagttaaagaagacatggataccataaccagacacatgagttaaagaagacatggataccataaccaaagacattactaggaaagaaaactaataccaatatcccttttgaatacagaggcaaaaaaaaaaagtactagcaaatgaaatccagcaagatatcaaaagaattatacactgtgatccattgggatttatcccaggaaagcaagattggtttaacatacgaaaatcagtaaatccagtatattaatgggataattcacaaaagataaatacataatcatttccatagacacaaagcatttgacaacctccagtagcctttcatgataaaagcagtgaacagactagaagtaaacaggaacttcttcaacctgagaaaggatatctatgaagacccacagctaacatcatacataatgatgaaagactgaaagctcttatcctaagatatggaacaagaaaatgatctccaagctcaccacttctattcagcattgtactggaggttctagccaggacaattaggcaggtaagaacttaaaactcagggccgggttcagtggctcatgcctgtaatcccagcactttgggaggccaaagcagacagatcacctgaggtcaggagttcaagaccagcctggccaatatggcaaaaccctgtccatactaaaactacaaaaataagctgggcatagtggcacacacctgtaatcccagctactcctgaggctgaggcaggagaatcatttgaacctggggtggaggttacagcgagctgagattacaccactgcactccagtccaggtgacagagtgagactgcctctcaaaaaaacacaaaaaaagccgtaaaaataataagacaaatgacccaatttaaacatgggcaaaaggtctgaatagacatcaaaaataaacatgaatgtgaaaatgtgctcaacatcatttgtcatcagggaattgcaatttaaaactataagttatcccttagcacccactaggatggtagaaagcgaaaacactaaaaatgccaaaagatggcaaggatgtggagcaacaggaactcttcattgttcattgaaatgtgacatggtacagcctctttagaagacagtttggtgggctcttaaaagagctaggcatagccttagcattgatccagcaatcatgctcctgttaccaaaatgacagggggttcagtcctgctgctcaccacacagaatgtcaatcactgagacaatgaatgttgccatgaaagaagtatttcactgggtgctgcagccaaggagaatgggagataaagtctcaaatccctgaccaactacaactggggaggcttacatagtgagggaaggaattaaggggggtaaagaagcaattatgatgaatgagggggtctggcatcttatttcgatgtggtgatctggtgagtttaagtcccttgcctgaggatcagttccctgagggaggaactcagatgagacaaatgtaaatttcaagttttaagacctgaagggtcaatttccatgtgtgttccaaaacttttaaatgtcatttctatgggacagttggaacagtttcacttctaggtatttactgatttgaaaacttgtccacataaaaacagcacacacgtgttcataacaaggttataattggttaaaacttgaagcaacacacatttcttcaataagtgaatggataaacaaactggtacatccatatgatggaatactattcaacaataaagaaatgagctatcgagccacagaaagtcctgtatgaaccttaaatgcatactgttaagtgagagaagtcattctgaacaggctgcatactatatgagtccaactatatgacactctggaaaagacaaaacaatagagaataaaaatgtcagtggttgccagagtttgaggagagggaggaatgaataggtgaagcacaggagttttttagggcaatgaaacaattctgtatgatactgtgatggtgtatacatgacattgtgtatttgtgaaaacatatagaactttactgcacaaagggtcaaaattttatgtaaacaattttaatcatttaagaagtcagggaatcacaggaatgcagactgtgacaagagaacataactattagtacaaatgtaggaaacaaactcaaaagagtaggggtgaaaggtgctgatctaagtaactttggaaattactgaagtttgtaagactaaaggcaaaaggaactgcaagtaagcagttcctagttgatacaagttgtttcccatgggggttatagggaagcttaaacattccctctggaggtttgataattaagtctgctgaaatgaactgacaataaacagattaagaagagaaagaccattttaattacatacatgcaaatggaagcctcagaaaaatatgagactcaaaggaggaggcagatggttgaaggtttcatagcataaaatgaataggggcttgaaggggaggtgatgacagttatgagaggaaaaggagaggaactgcatggtgaacaaagattgtcttatgtaaataaagtctctcaggtcataaaa

SEQ ID NO: 173 - DNA, 98136 bp, Homo Sapiens
aatcggaataggcaagcttccggcgggaagtgagccagggcttggcgcggcggccgtggttgcggcgcgggaagtttggatcctggttccgtccgctaggagtctgcgtgcgaggtgagtaccgcgcgcgtaactacgggtcggtccgcattgatctagccctgctctggcggcccggcccggagctggaggccgctcgggttcttccgtttcctgcactggttcgcctcggcccgctgagtcctctagtctggccaacatcctgggaggacagcagatacataaatacgttcccaaatggggaaacagaggcccggggcgggggcgaactctgccaaggtctcccggggcgtcggaggccgagcatgggctaggacctggcatgttgttgcccatatactccagtgcgtaacatgatgccctgcacagagtaatcccagcccagacctctggcactactacctccgtgtccctcctgaggaacaacgaaaacactttgtactttttctgtggccttccataatcacgagctgggctactcttgtttttgagtgtctactgtgtgccatgttcctggcacccttgatcttacaactgtagctttacgatatcccagcaaagcgaagtgcttaagaatactgcatcagattgcttgggttcgaattctggctccttcacatttagctctgtgtctactgcacgttactgaaacactaagtgtcttggttttcgtctgtcatatgggggaaatggtctcttctacttcctggcgtttttgttaggattaaacgacttaatatatgcaataataaatgcttcgaaggctacctgttacatagtacacagtaagggttctgttatcattacccagagaagcggatgaaattgtccccattttagacatggagaatctgaagtacaaagaggttgtctccgtacagaaagagcatttggtgattaagtgctagagatacaggatttgaactaagcgcctgattttaaagtatgtcccacaacattaggctttctcctatagccctcacctgtccttaggtcacacagaactttaggtacctcatggcgtgagatggagcaggtgactgacagctccttgtgccacccatgcagataaataacactggtgtgtcactgtcaagattaagggacaggaattcgagagactgcatgagagatcagaagatgaagaagcgggtaggcaaaagtattctgtttggggaatagtaaatagaattaattaaatcaacattttgttagctgggctgcttatactgtcagacagtagcttataatctactgggaagaaatgaaatttctgggtcctgtgtcactttcaatgccactcaccatgacaggtaccttataagtatagtttacagtcctatcagtaacctggagaagtagttatttccttcgttttactgaggaaaccaagagttaaaaaatcaggaaaagtgttagatgtgcagtagaacatcatcatgctgggaagttctacacatccgcttcaggacaggtggtattacctatgagcaggaagggaagggaaaaaggtaaggggaatgagtgatagtttattgttttgatttttaaatttttatctgttttttcctttttcatagtcattcctggaatgagtgagtttgtttttgtttttgtttttgggggatggagtctcgctctgtcgcccaggctggagtgcagtggcgcgatcttggctcactgcaagctccgcctcccgggttcatgccattctcctgcctcagcctcccaaatagctgggactacaggcacccaccaccacgcccagctaattttttgtatttttagtagagacggggtttcactgtgttagccaggatggtctcgatctcctgacctcgtgatccgcctgcctccgcctcccaaggtgctgggattacaggcgagccaccgcgcccggccatgagtgagattttaaatatatctgaaatgaggccaggcacagtggctcacacccataatcccagcactttgggaggatgaggcgggcgaatcacctgaggccaggagttcgagacttgcctcaccaacatggcgaaactccctctctatagtaaatacaaaattatctgggcgtggtggtgtgcgcctgtggttctagctactggggaggctgaggcacgagaatcgcttgaacccaggaggctgcagttagtcaagattgcaccactgcactccagcctgggtgacagagtgagagtccgtcagtcaatctacctgaaatgttttatgcctttaaaagagagagaatagggccgagtttaactttttaaatttggttggtgggtacatgggtgtaattctattttctgtatctttatgtaagaaatattaaaaattaaaagatatacatatatattttaatttacatatatatgtgtttttttctaagagaaaaatggatagaataaagaggtccaagataatcgtagaataatcctaggacttcagtgctgaaagcccctaagggtctccactacctgtaggataaaatctaaactccttggcatgataccagaggcttttgagcattctgtatcgctaacacatactattctacctcagcctttgtaccactagttcatagactactcttcttcacaacctcagtcctgtctgtaaagttccacttgtccttcaatatccaattcagtgttctttgaaaagcttctctatcatttgcctgtttttccttaatctgggaagccatagtcttttaagaaaagacttgattgtcagacttatctcgttgcattgtaattatttgttgacatgtctattttctgctagtctataagctccttgaaggcagtaataatgtctttcccatctctgtacttcagtgcctaccatgatgcctggcacagagtagtcactgtagatattagctgaatgaaaaatacaagttgaagacagagagtgaaagttcttggagttatgacatatggactttgttctctggaatgacagggaactattgagtttactttctttaaaaattcccgtattttattgaaacatattctcaatgtcaagaaaaatattccagtcataatcctatctttcaaacacttgaactatttttattttccatgagtcctttccaaatttcagctataaaattagttatacagatttagctatacagatttcttaggtagctgtagccttaatgtattcataacttagtgtttttcttttttctttctttttaaacctgacacttgaggaattttttttttcttttctttttttttgagatagggctcactgcagctccagcctcccgggctcaagtgatcctcccacctcagctgggagtacaggggtgtaccaccatgcctggctaattcttgtatttgttgtagagatgggcttttgattttttgtagagatagggtctcgccgtgttgttcaggctgatctcgaactcgtaggctcaagcagtttgcccacggagtgctgggactacaggtttgagcccaccgcacctggcctgcttttttcaatattaaattatttcctggctgggcgcggtagcacatgcctatgatcccagcactttgggaagccaaggttggggattgcttgagcctgggagttcaagaccagcctgggcaacatggcaaaaccccgtctctaccaaaaaataaaataaaaatctaaataaattatttattttagtgaatcagtctttatgcttgtcatttgtcttataaattttcgcaatattcctctctctttggtttaataggtatgaaatgatgctccatgttattattagaaaaatttcacaattttttcataaatttacttagtgtctgtatattctggtgagctgttgtgtttatattccctgaacatttgttcactggaactggatgttctttatgtgtttttaatattaatcatttatctgttatttgttgctaatttttcttttcttttttctttttttgagatggagtctcatcctgttgctgaggctgaagtgcagtggcgtgatctcagctcactgtaacctccgtctcccgagttcaatccattctcctgcctcagcctcctgggtagctgggattacaggcacccgccaccacgcccggctaatttttgtatttttggtacagatggggtttcaccatgtcaggctggtctcaaactcctgaccttaggtgatctacccactttggcttcccaaagtgctgggattacaggtgtgagccactgcatccagcctaatttttcttttaaaaatatttttattggccgggcacagtggctcgcgcctgtaatcccagcactttgggaggcctaggtgggcggatcatgaggtcaggagttcgagaccagtgtggccaacatgatgaaaccctgtgtctactaaaaatacaaaaatcagctgagcatggtggcacatgcctgtaatcccagctacttgggaggctgaggcaggagaatcacttgaacccaggaggcagagattgcagtgagccgagatcacaccactccactccagcctggcgacagagcaagactgcatctcaaaaaaaaaaaaattttctttattatgacaaccaagatacatttgtaaaaatatacataatttcgctggaaaccaagagttaaagtggctcacgcctgtaatcccagcactttaggaggctgaggcaggtggatcacttaagggcaggagttcgagaccagcctggccaacagggtgaaaccccatctctttttttttgagacagagtctcactctctctcccagtctggagtgcagtggcgcaatcttggctcactgaaagctccgcctcccagcttcatgccattctcctgcctcagcctcccaagtagctgggactacaggcacctgccaccaggcccggctaattttttgtatttttagtagagaccgggtttcactgtgttagccaggatggtctcgatctcctgacctcatgatccacccacctcggcctcccaaagtgctgggattacaggcatgagccgccgtgcccagcaaaaagcccatctctactaaaatacaaaaattagctggccatggtggcccatgtctgtaatcccagctacttgtgaagctgaggcaggagaatcacttgaacctgggcagcggaggttgcagtgagcctagatcaggatcacgccattgcactccagcctgggcaacagaatgagactctgtctcaaaaaaataaaataatttaaaaaaagttacataatttaaagaatagttacaaagaaattacaaagtttagttatgcataaaaattatattgtattcatggtaaattgaagactcattataaaattatagttacacataactatcatctagatcaagaaagaaatagaatattaccaggatcccaggaccccagaagtgtatctttctgatacctcctccctatgttagggataactattgtcccaattatgtatttatttattttgagacggagttttgctcttgttgcccattctggagtgcagtggcgcgatctcggctcactgcaacctctgcttcctgggttcaagcaattctcctgcctcagcctcccaagtagcttggattacaggcgcctgccaccatggctggctaattttttctatttttagtagagacggggttacatcatgttggccaggctggtcttaaactcctgacctcaggtaatctgcctgcctcggcctcccaaagtgctgggattacaggcatgagccaccgctcctggccctattgtcccaatttttgtgataatgcttttcttgtcttcatagtttgccctgatctatacatctataaataatatagctcagttttgcctggttttgagctctgtaaatgggataatactatatgcattctactgagtctttctagtttgcgttattatgtttgtgagattcttccacgttgtagatatagtttttcttttctttttttttttttttaatagtaattttggctgggcatggtagctcacttctgtaatcccagcactttgggaggctgaggaagcaagatctcttgaggccaggagttcaagaccagtctggcaacaatgggagacttgtctctataaaaaatttaaaaaattagttgagcatgatgtcatgcacctgtagttccagattctccagaggctgaggcaggaggatcacttgagcttaggagtctgaggctgcagtgaactatgattgtgccactgcgctctagcctgagtgacagagcaagaccttgtctctaaaaaaaaatttttttaaattgtttttcttaacctcttaacagagttttacatgtatagtaccacacagccacaatgttgtatggcagatctctagaatgcgttcattttgcattactgaaactttatactttttgattaacaactccccatttcctgaaagcccctaccctggcaaccactgtgcccctctttgcttctatgagtttgcctattttagatacctcgttgcagtggaatcatgtagtatttgtcctgtgactggcttacttcactttgcttaatggcttcaaggttcatctgtgtcatctcatgttgcaggattttttttttaattttttattatttaacttaattgtattgtattttattatttttcagacagggtcttgctcagctatccaggctggagtgcagtagaatgatcgttgctcactgcagcctctaactcctgggctcagatgatccttctgcctcagcctcccgagaaggtgagactacaggagtgtaccaccatgcttggctaacttttttattttttgtagatactgggtcttgctttgttgcctaggctggtctcaaactcctgggctcaagcgatactcctgccttggcctcccaaagtgctgggattacaagcatgagccacttcatctagtcaatttttttctttttaaaggctgaatatttcattctatgcgtataccactgtaaagaaaactccatttcctctctactctgtacccatataataattcctcacttctgtcaccaaatgtgtggtgttttttttccccacaatagttcagttctttagcagacactgggtgtcctacatttagctcaggtctgacactaactgccaggtgttagtgcagaccccaaatgttaagtcctccctgtccacccgcattccagaccccccacttcagactacaagcacaagtggtaagtcctccacattcagtcacagaacagtttccttactagattatcagcttattataaacaactcagaagcagccagctggaagaaatacacaggacaaggtatgtgggaaggggtgtggcacttccatgccctctccaggcacaccagcctcccaccatctctacatgttctcaccaacctagaagctccctgagccctatccttctgggtttttacgtaggcctccttacctagacatgattgattaaataattggccattggtgattaagtcactccccagcccctttgtcctacccagaggaagttttgttttgttttttgagaaggagtctcactctgtcgcccaggctggagtgcagtggtatgatcttggctcactgcaacctctaccagctgggttcaagagattctcatgtctcagcctactgaatagctggggttataggtgtgcaccatcatgcctggctaatttttgtatttttagtagagagagcgttttgccatgttgtccaggatggtctcaaactcctgacctcaggtgatctgcccgtctcggcctcccaaagtgctgggattacaggcataagccaccacgcccggcccccagaggaaggttttattgaattaattacaaactgataggtcaaagagtgtgtatgttttaccttactatgtaatactaaattgttttcaaaagtgcttgcactcccaccaatgtattagattttccgttgctctgcatgctggctaatactttatatttacatttttattttccaatctggtatattcatgtatagtagtattttctggtagcattcatttctctgattattagtgaagatgagtaccctgatgtgtttatgggctatttcctcttttttacagtccctttttttttttttgaggcggagtctcactctgttgcccaggctggagtgcagtggcaccatctcggctcactgcaagctccgcctcccgggttcacgccattcacctgcctcagcctcccaagtcccaagtagctgggactacaggcgcccgccaccatgcccggctaatttttttttttttttggattgttttagtagagacggggtttcactgtgttagccagggtggtctcaatctcctgacctcgtgatccacccgcctcggcctcccaaagtgctgggattacaggcgtgagccaccgcgcccagcctacagtccctttttttctgtcttctctattaagttgtctctgttttatgtacatataaacatatttatatatagttatctacatttttatatatacgtacatacacatttacataggtgtagcagatatcttctactttggctttttaagtggatttaacataattttagtcaatgactttttttatttttacatttctttaaagtgacataattgtaccccaacaatttatggggtacatagtgatattttgatacatatactgtataatgatcagatcagggtaattagcatatctatcatcttaaaacatttatcatttctttgtgttgggagcattcaatatcctccttctagctatttgaaactgtatagtacattattgttaactgtagtcatcctgtagtgctacagaacaccagaacttattcttcccatctagctgtaattttatattcttttctttcctttttttgagatgaagtttcactcttgttgcccaggctggagtgcaatggcacaatcttggctcactgcaacctctgcctcctgggttcaagcaattctcctgcctcagcctcccaagtagctaggattacaggcatgcgccaccatgcctggctaattttgcatttttagtagagacggggtttctccatgttggtcaggctgatctcaaactcctgacctcaggtgatccacccacctcggcctcccaaagtgctgggattacaggcatgagccaccacacccagccaattttgtattctttaacaaatctgcccctacccttcccagcctccagtgtcctctgttctagattttacttctatgagagcaacgatttttaggttccacatatgagtgagaacatatggtgtttaactttctgttctttattccacttaacacaatgtcctcaggttccatgttgctgtgaataacaggattttattcttttttatggctgaatagtattctgttgtataaatgtactataatttttttattcattcatcgcttgttgaacaccttggttgattccgtatcttggctattgtgaatagtgctgcagtaagcatgggggtgcagatgtctctttgatatactgacatcttttcctttggataagtgttcagtagtgggtttgctgaatcatatggtaggtctatttgtagttatttgaggaacttccatactgttctccatagtggctgtactagtttatattctcaccatcagtggaagtgtaagagttctcttttctctgcatcctcaccagcatttgttattttctgtctttttgataatagctttcttaactggggtaggatgatacttcattgtgtttttgtttttgtttttttaatttttaaaattttttgtagagacggagtcttgctgtgttgcccaagctggtcctgaactcctagcctcaagcaatcctcccgcctcagcctcctaaagtgctaggattcaaggcatgagccactgtgcctggccctaattgtggttttgatttgcactattttttttaacatcttttattgtgaattattgtatgttatatttcatagatataacttgtacgtgaatgagctaatatagtaggcctgaaactgttaccttcagaaaagcctgcttgcaaaattggtccctggctgtgtctgagaacttggcttttgaaacctttcctacactgatcaggttgttttactaatacctgttttccttctgagagtctgaaattttggtgggaggaaggtgcctaagtgaccagccctcaataaaacccctagattcagagtctctaaccagcttcttttgggcagaaacattgcacacacatagctgcattttcactgagagaacatgcactttctcaggggttagagagcattggaagcctgcacgtgaattcctacagacactacctgatgtgtttttttttcccttgctgatctggttgtgtatccttaaagtgttgatgatataataaatgttagctgtgagtacaactgtacactgagtcccatgagttcttccagcaaaatattgaacttagctgttaagttcctccagaaaaaaaaaaagctggaattttgattagaaatgcatcaagttatagatgaatttgaggagaattagcatctccatatcgtcttccaatgtgaatgtggttcatatgattgtttcctccctccttgacttctcttaacgactttcaattttcttttctttttttgagacagggtcttgctctctcacccaggctagagcaagtggtgcaatcacagcttactgcagcctcaacctcctgggctcaggtgatcctcccacctcagcctcctaagtagctgggaccataggcacatgccaccatgaccaacaaatatttgtatttttgtagagacagggttttgctgtgttgcccaggctgctctcaaactcctgggctcaagtgatctgcccaccttggcctcccaaagtgctgggattataggcatgagccactgtgcccagcccaattttctgaatagatatcaaggacataatttgttagatgtatttttaggtatatattattttctttaaattttttttgagacagggtctcactctgtcacccagactgaagtgcagtggcgtgatctcagctcaccgcaaccaccgccttccaggctcaagcaatattcctgcctcagcctcccgggtagctgggattataggcacgtgccactactgccaccacgttcagctaatttttatatatttagtagagacggggtttcaccatgttggccaggctggtctcgaactcctgacctcaaatgatccacccaccttggcctcccaaagtgctgagattacaggcatgagccactgcacccggccgggtatttaaatttttgatgtcatcttaaaaagttttctgacattttattttttgtttattgatgatatagaaaaacaatttatttttgtatattgaccttgtctccagcagtcttcctaaacacactgtcttagttttctatagctgctgtaataaattaccataaacttagtggcttaaaacaacatagaggccgggaacattggctcatgcctgtaatctcagcagtttgggaggccaaggtgggagtatcgcgggagcccagaaattcgagaccagtctgggcaacacggtgagtccctgtctctgtttaaaaataacaataacacacggtagctcacacctgtaatcccagcactttgagaggccgaggcgggcaggtcacctgaggtcgggagtttgagactagcctggccaacgtggcgaaactccatctctactaaaaatacaaaaattagccaggcatggtggtacgcgcttgtaatcccagctactcaggaggctgaggtaggagaattgcttgagcccaggagacagaggttgcagtttgccgagatcgcgccactgtactccagcctgggcaacaagagagaaactcagtttcaaaataaataaataaaataaataaaaacaacaacaacatagatttattatcttatagttctgtagttcagaagtctgaatgggtttcattgggctaaagtcaaggtgttggcaggctgagttcccttctggaggctcaagggcagaatccatttccttccccttttcagcttttagagactattcgtattccttgactcttggctttcctcctccattatcaaagccagcaactttgagtcctcctgaagttgccatctttctggtctgtcatcttatttcctcttccacttaaaaagacacttgtgattgcattgggtccatctggttagtccaggataatcttcctattttaaggtcagcttattagcagtcttaattccgtatgacagtaattcacctttgtcatgtaaccaagcatattcacaacatccaaggatcaggatatagacatctttggatgggtatgggagatggggatagtggtggtggtcacattattttgcctcctgcattcacttaagatttttatttttatttttatttttatttttgagacgaagtctcgctctatcgcccaggctggagtgcagtggcgtgatctcggctcactgcaacctccgcctcccgggttcaagcgattctcctgcctcaacctcccaagtagctgggattacaggtacgcgccaccatgaccacctaatttttttcttattttttatttttagtagagacagggtttcactatgttggccaggctgatctcgaactcctgacctcgtgatccacccacctcggcctcccaaagtgctgggattacaggcttgagccactgcatccagccaagaattttaataatttaatctgaagattcttttagatgttccacacacaaaattatagcctttgtgaatattaatgattttacatctttccagttaacacgccttttatttattgttcatgatctactgctctggcttggacttccagtatatatctgataaaagtattgatagtgggcattctggaattgttcctgatctaaaaagaaaagtttcctaaacttcaccttactgtattctctctgtcaggttatagaagttcctttctattcctgtttgataagagttgtgtttttttttgttgtttatttttgaggtggagtcttgctctgccacccaggctggagtgcagtggcgcaatcttggcccactgcaacttccgcctcccggttcaagtgattctcctgtctcagcctcccaagtagctgagactagaggctgcgtcactgcgcccagctaatttttgtattttaggtagagacagggtttcaccatattggccagactggtctcgaactcctgaccttgtgatctgcccgtctcagcctcccaaagtgctgggattacaggtatgagccaccatgcccggcgtgataagagttttcattatgaatggatttcactgtgaatggatgtttgattttatcatatgcttattctagaagtcttgagacgatatggttgttcagctttaatgttgtggtgaattatattaattgatttttaaatgttgaaccacttctgagtcattttttagacaacacaacttggtctcggtattttttattttatttatttatttatccttttagacagggtctcactctgttacccaggctggagtgcagtggtgtgacttcagctcactgcagccttgatctcccaagtcatcctcccatctcagcttcccaagtagctgggactataggcaagtgtcaccatgcccagttaatttttataaatttttgtggagatgagatttaatcacactgcccaggctggtctcaatcctgggctcaagcaatcctcctgccttggcctccaaaagcgctgggattataggtgtgagtcatcatgcccgtggctcttggtgtattttatacatggctagatttactttgctaacatattgtttgggacttttgcatctacatttatgaaaaagaattagcctggagtttttcactgaggagttgcccttacaggacttagtatcagagttatgctagcctcacagaatgagctggggagttggttctttctatattttggaatcgtttatgtaaaactggaatattttactgccataagtgcttagaagaactcacctgcgccactctggtcttgatgctatctttgtgggtagatttttgaccatcaataggacttctttaatggttataaggctattaggttttctgtttatttttgagtgagttttgataagttaatttttaaggaatgtgtccatctcatctaaattttaaaatttattgatgcaaagttgttcataacagcctaatgttatcttttaatgtctatagcatatgtaattaaatctcgtctttcaatctcttcttttttgtctttttacagaacaaacttggtttattgatcctctctattatatatctattattttttactcttaaaaatttttttaaaaatctatttatttatttattttgagaccggtttatgaaactggctaatttttgtatttttggtagagatgaggtttcaccatgttgccaaggctggtcttgaactcctggcctcaagtgatccacctgccttggcttcccaaagtgctgggattacaggcatgagccaatgcgtctgaccctcttctctttaaaactgcctcccttctattttcatcaggcttattttttcagtttcttttctaataattagggtcatccattttcttgtaactacttctttagttgcatattagatatttttatgtgtagatttccattattcagtttaaagtatatttgaatactcactatgatatcttacttgactgatggcttattcacaagtatatttcttgattttcaatacaaagggattttctagatctcattttctttattttgaaattttaaaaatctacagaaaagaaaacctacagaaaagttgaagaattagtgcagtatatcatcttcccaagtaaacaatttacattcataaaaatagttcatatattaggtaacaaggaaaacattagtaatttcataaagtagaaatattataattctgatcaccatgcaacaaaactagaaattaaaaatgaaatttataaaaaagcagaaaggcccttccatctggaaaattgaaaacaactattggatgtaaggaaaacagaaactgaaataaaggatttctgaaaattaacgaaatgaaaacacagcatatcagattcttaaaaaaaaaaaaaaggtaaggcactagtcaggggaaaatttataatcttcagtacatattataaatgaagaaagggaaataatgaaataaattccaaacttagaaagttaggaaaagaaaaacaagtaaatcgaaagcacaagagaataaataataaagataaaaagagaaattagtaagagaacaggaaaacatctgattcaaaaattaagatttttatcttggctgggcgcagtggctcatgccagtaatcccagcactttgggaggccgaagcaggcagatcacgaggtcaggagatcaagactatcctgtccaacacggtgaaaccccgtctctactaaatacaaaaacttagccaggcgtggtggcatgcacctgtaatcccagctactcgggatgctgaggcaggagaattgcttgaacctggaaggcagagtttgcagtgagccgagatcgtgccactgcactgcagcctgggtgacagagtgagactatgtctcaaaaaaattaaaaaaaaaagatgtgtatcttgaattgtttaatgaagcaaataaattagcctaatagaaattacaaatatacagaataagaaatggtaagtggtaagtaaccactgacacaggatagtttttataacaggattaatttatgtacctttacgtaaacaaatttgaaaactaaaatgaaatggataattatgtgtgaaaatctagtttaccaaaattgactcaagtagatgttggaagttaaatagctcaatttccattgaataagtttttaaagttatgaaataactgtctcactgaaaaataaaaaacatgaggtccaaatggtttaacaggaaaattctactacatttatggagtccaaataatcctaatgctaaataaattgttttagaacgtagaaaagaaggaaaacttccaaattctttattttccaaatggcttggtattgtaaatgctgatttagttgtctgtctccagttgttgaagggctgaagtgaaataaagtaaaacatcttaaaacactttttagttcttagaccctcttttttaaagtagctttattgatatagactgcacgtatttaaagtatacaatttgttcagttttgacatacacacatcatcaccataattcagttaatgaacatatccatcactctcaaaagtttcctcatcccccttaattctgccttcttgctctcttcttgccggtcaaccacttatctggtttctgtcactgtagaataattagcatgttctaggacttttaataaatgttataatacagtgtgtattcttttgtatctcacttcttttacacagcataattattttatatcggtttttatgaagcaagtataaaacaaatatttaacataaaaattaaaggtagcacaaagaaaattacagatgaatattatgtataaaaattatgtaaaagttctaaataaaatactaccaaacagaacagaatccagcactctattacaaaactattagctcatcaccaagatgtataccaggaatgcaaagatggtttaacattagaatcatcaatgtaattcaccatattaattaacctaaggagaacagtcatatatttacttttatatatgctgaaaaagcctttgacaagattcaacaccaatatatagtaaaaactcttaagaaattatattgtaatcaatacttctttttttttttttgagatggagtctcaccctgtcgcccaggctgaagtacagtagcatgacctcagctcactgcaacctccacctcccaggttcaagccattctcctgcctcagcctcccaagtcgctgggattacaggcgcccaccaccacacctggctaatttttgtatttttagtagagatgcggtttcaccatcttggccaggctggtctcaaagtcctgacctcaggtgatctgcccacctcggcctcccaaaatgctgggattacagatgtgagccaccatgcctggccaatcaatacttcttaatgatggtattctctctctctctctctgtctctgtctctcacgcacacatacacacacacgcgcgcacgcacgcacacacacacacacacacgcagagagagagagagagagagagagagagagagagagactttattcctaaatcctgtattttatctaataggaaaatactagaggcatttttactaagattgagaaaaatatagagatactcaccaactccacttgtatttaacattgtactgggggcttagccaatgcagttagataaatcaattagaggcacaagatttggaaaataaaaagtaatattgtccctacttgcaggtgatatggtagtgtgtctggaatactgcagaaaatcaataatgaaactaactaaacagaaaaggaattttataagaatatgcaaaaatcagtagtcttcatatacacaacaagtttgaatatataatgaagggtaaaatcccatttacagcaacaagaaaaagagaaaatatttaggaatttaaaaacatgtaaaacctaggtgaagaaatctttaaaacacttctgaataacaaaaatagccttaaacaaatgaaatcttttgttctaggacaggacaacaacatcataaaagtgcctaagttaatatatatatatatatatatatatatatatatatatttaagttaatacatatacctaagttaatatataaatttaatgcaatctcaatataaatatcaacagagttctggcactagacaagttgattctaaagttcatatagaaaaataaacatataagaataggaaaacagaagagctacaaagagaaagtagacttccagatattgtaacatgttgcaaagcttctatcatgataatattgtggtatagaccaatggtatagaatggaaagtcaataattagtctcctaaacacatgaagaatttagtgtatgataaaggtagttctgaaattattagggcagagatggactctttataaatagtgctgggacaacttgttagccacttgaaaaaacaaaattatatctatactttatatcagacacaggaataaactccaaatgaaccagaaatctaattttttttaaattacctactagaagaatacatagatgagttttctgtaacctggatgtggagaagggcaataaaagagggggaaaaattggctacattgaaaagcaaattcttgattacaaaaatgaaaaacaccataagcaaatttaaaagatagatgagaaaccaggaaaaaaatctgcaaaatacattttaaagacctactatccctagtctaaattgagagaaaaaaatactaaaatttggttaaaaaggcagaatacatgagcagatacaattttttaaaaagattcaaaaaccatccttaaatatgtgaagaaaatattcaatttcacctaaacaggaagtgtaaatttaaagctgcactgaaataccgtttctcacctatcagctctgcactaattagaaagcttcacaagaagccccattggtgaggctgtgaggaatgcaaacttgtaaaacctcctttgagggagaagttggcaatccagcagactacacatgcatttgccctttgacccagccattccacttgtagaaatattccctaaagatacattttcttttctttctttcctttttttttgagacagggtcttgcttgttgcccaggctgaagtgcagtagtgtgatcttggctcactgcagctcaaactcccaggctcaattgatcccaccttggcctctggagtagctgggaccacaagtgcatgccaccacgccttactaatttaaaaattttttttatagagacggagtctcaccatgttgcccaggctggtcttgaactcctggactcaagcaatcctgtctctgcctcccaaattgctgggatgacaggtgtgagccaccgtgcccggccttacgttttcaacagtagggaaatatgaatgcacaaagttatttgttgcagcattatttgtaattgtaaaatatcagggaataccttaaatgtccatacaggaaatttgttggtaaatatctacacaatggagtactgtacagctgtaaagaagaatgaggaaaatctttgcaaacgggtgtagagtgatttctaacatgaatggaaagcgtacatacagtgtgctattttttatgtaagaaagaagggaaaatatgagactctaatgtctgcttattttgcaaaaagaaaaacaggaaagataaatcagaaattattgaaattgataacccacaggaagtagatggcaaaggatggagagggaagaacacttctctgtggggaaaaacagtcttttatgtagttttaacttttagaactatgtaaatgttttatatattcaaaaatcaaatccacaagaacagtacaaacacaaactaatctaattcaaatgatgaatgtaatcaccctgaaggtgaggtgggactgaccaatcaagtaacttttgaatatagtactttaattatgtacccttaatctgaagaaagaaatgcaactgaattttgaactcttcttagtaggttttttttttttagtgacaggagtgtagcaatttgaaattacttcctatagtttcagattgaataaatgaataaatatatgatggttttttctatgaattttaagatagatggatagatcaatggatgtatagctgtagatacagaaatagatagaagtgtttatatttcctagatctgtctactaaaagggcctaggagcaatgatatgcaagtagcagatcatatctaatggccaggtcttagattttaaagatttttcctcattaaaataaatgaaggctgtttgaggaaatggtgattctatggctgaagcaggaaaagtaaatgaagaccatgaatgttgtgccaggtaataagaaagtgcctgatgggaacactttaaaggacagaggaaccaatggattaaagaagaaaacaagagacattagagtatatcttgagacaatgaaaacgaaaacacaacatgccaaaactcatggaatacagtgaaagcagtactagaaaggaaatttatagctacaaatgcttacattaaaaaagaaagatctgaaatcaacaatttaacttcacacttaaaggaacagtaaaaagaacaaaccaaacccaaagctacagaaacaaggaaataataaatattagggcagagataaacaaaacagggactagaaaagcagtagagaaattgacaaaacagaattgattctttgaaatgataaaaaaattgataaaactttagccagatggactaagaaaaaataagacaaattactaaaatcagaagtgaacaaggggacattataactgatttacagaagtaaaaagatttataagagaatattgtgagcaaatgtatgccaacaaatttgataacataaatgaaatggataaattcctcaaaacacataaccaccaagacagaatcatgaagaaacagaaaatctgaacagacctataactagtaaggagattgagttagtaatcaggtatcacccaacaaagaaaagctcagggccagatggcctcactggtcatttctaaccaatatttaaagaagaattaagtccaattttcctcaagctcttccaattaatgatatatttgataaagggttaatacccaggatatataaagaactcctcagcactttgggaggctgccgggacgggagaatttcttgagcctaggagttggagaccagcctaggcaacatggtgaaaccctggctctacaaaaaatttaaaaatttgccaggtgtgatggtactttgctgtggtcccagctactccgtaggctgaggtgggaggaccacttgagcccgggaggtcgaggcagccgtgagctgttgcactccagcctgggtgacagagtgaaaccctgtttcaaaaaacaaaacaaaacaaaacaaaacaaaacaaaacaaaaactcatacagctcaacaaataacccatttagaaaatagagaaaggactcgaatagacacttcaccaaagaagatatacaaatggccaataagcaaatgaaaagatgcctattatcactaatcattagagaaaggcaaatcaaaaccaggagataagacctcacacctgttagaatgcctgttataaaacaaaacaacaaccagaaaataacaagtgttgctgaggatgtggagaaattaggatgtggaaaaatgggaagccctgtgcattatttatagcaatgtgaaatggtgcaaccactgtggagaacagtgtggtggttccttaaaaattaaacataaattaccatatgattcagcaattctcaaaaagatatttgtacacccatgttcataacagcattattcacaatagccaaaaggtggaagcaaccctaacgtccttgaatggataagaaaatgtggtatgtatctacagttagatattattcagccttaaaaaggaaggagcggccaggcgcggtggctcacacttgtaatcccagccctttgggaggctgagacaggcagatcacaaggtcacaggttcaagaccagcctggccaacatggtgaaaccccgtctctactaaaaatacaaaacagaaaaattagctgggcttgatggcacgcacctgtaatcccagctactcaggaggctcgggcaggagaatcacttgaacccgggaggcagaggttgcagtgagctgagattgcgccactgcaccccagcctgggcaacagagcaagactccatctcaaaaaatattaataataataaaggaaggagcctggcatggtgactcatacctgtaatcccagctactccggaggcagaggtgggaggatcattagagctcaggagattgaggctgcagcgagctctgcacacaggaaattctgacacatgtctcacaacatagataaagcttgagaacactgtgctgagtgaaataagccagtcccgaaaaggcaaatactgtatgattccacttacagtgtgaatacattatgattcccatactgtatgagtctgctgatgacaaactattgtttttttgataatctggaagtgtctctatttcttgtggcattttaaataacagctgtattgtttttaaattattatttgtttatttttttgagacagggtcttgctctgttgcccaggttagagtgcagtggtgcaatcacagctcactgcagcctcgacttcctggttgagcagtcctcccacctcagcttcccaagtagctgggacaacaggcatgcaccatcattcctggctaatcttttgtattttttgtagagatggggtttcaccatattgcccaggctggtctccaactcctgggctcaagcgatccccccgcctcagccttccaaagggctgggattacaggcatgagctactgtgtctggcctgaatgacaggtctattgaaatacattacacatataaaattcacccattaaactgtacaatccaatggctttgagtatattcacagttatgcaaccatcaccgcaatcaatgttggaacattttcatcagcccacagagaaatttgcataccccttgccatcatccccaaatcctctcatctttcccaaccctaggcaatcagtagtctacactgtatccatggatatgtctattcttatacatttcatataaatggaatcatacactagttcatcttttgtggctggattctttcacttaacataatggtttcaaggctcgtcattactgtagcatttatcagtactatatttttttgtgtggccaaataacattttgttgaatggatatacacattttatttatccattcatcacttgatggacatttgagtggtttctgaatttggctattgtgaataatgctcctgtgaacaatttgtgtacaagtatttattttgagtacccatttttcactctttcgcatatatagctaggagtgaaattgctgggttacatggtgatatggtttgcctgtgtccccattgaaatctcatcttgaactgtggctcccataatccccatgtgtcatgggagggacctcgtgggaggtaattgaatcatgggtttttcccatgctgttcttgtgagagtgaataagtctcacgagagctgatggttttataaaaggcagttcccctgcacacactttcttgcctgccaccatataagatgtgcctttgcccctcctttgccttctgccatgattgtgaggcctccccagccatgtggaactgagtccattaaacctctttttctttataaattacccactctcaggtgtttcttcatagcagtatgaaaatggactagaacacgtggtgactatgtttcgttttttgaggtactgcttgactgttttccaaagtggctgtgccattttagagtcctaccagcagtgtatgagggttctgatttccccacattgttgccaacacttatctgttgcttttattatagctactttttaaaaataacagctttattgagatataattcatataccatgaaattcacctttaaaaacctagtgtacaattcactgcccttgatttgtgaaagatattttttctgggaaaagaattctgggttaatttctatcagcacatcgaagatatcattccactgtcttttgattttcatttttgctaaagagaaatcaattttttgtccatatggtacactgatatatttgggtgtggatttctttttatctctgcttggaattttttggctttctcaaatctgaaggttagtgtctttaattagtcctggaaaagtcccagctgttatcttttcaaatattaattcttccctattttctcttctttctggaactctggctagatttatgttagactttctactctgtcttccatgtctcctaacttctcatattttccatctgttttctctatctctctgtgtgtgcatctattaagtcaaaaactatgaagggtctgagattttaccctacatttatagctatatttatctttagccacttttctgaagttctaattatctattgttatgactgattttctttgggttgtattggtatattatcaagttgtctacatataatgataatctcatctcttctagtatttcctttttcgaatatttttgcattggcaagagcatccaatatgggagtgaaaatgagagaacaatattgtttttgctgttgtttttaatggattcacccctagtgtaaaatatatggtatttgttggttctagattttaaacacttgtaattttgtgttttaatgtgtttgttagacatggtttgagttttattaggtgccttttcaaaaatgcattgataatacatactgtgtgattctatatatatgaatcaagaagtttaagaaaccatgaacgaagagaacatatgacataaaattctgtcaaaaatctctctttgtctagaaattgtgtttgatgtttaattttatcagagaacagaaagttgcttgccccagtgccccagttaaggtaaagctgaggttcataaatacctcaacttaaaaaaatacaaaaagtagattttttgatcgttcttagttaggctcaccacctttgccccagggaaagtaactcctcccctttgaacagtcactgagtgaggcttacagagcgacgctctgtttttcaggaaccaccccctaaaatctccacttttagcagaagactggaaacagaaacatctaaatgttacttggcactgaatgtcttggagtagtctttttggcagtctatcccttgatagactgaaatagccatctttgacaacaaaatgaataaaaagtaaggtttgacctagtcttaattttgatagatccccaaccagtaactttagtgtcacttatttcaaagaaaaggcactctttttttctgctgtgtttttctccatcccatgtctctctctctctctcttttttttttaaaggtttattgtgtttacttttattctttttttatttttgagacagggtctctgttgcccaggctggagtgcagtggggtgatcatggctcactgaaacctcgacctcccgggctcaaatgatccttcccacctcagcctcctgagtaactgggactacaggcatgtgccacctcactcagctaatttttgtgtttttttgtagagacaggtcgtactttgttgcccaggctgctctgcagctcctgggctcaagcgatcctcccgctttggcttcccaaagtgctagtattacaagtgtgagccgccgtgcccagcctatttgaaaaattcttaatagccagttttaaaggtaatgcttgaagcttacatttcctgtgactttttttttttttttttttaaacacagggtctcactgtcaccccagctggagcagtggcacagaattgctcactgcagcctcgaactcctgggctcaagggatactcccacctcagcctccctgagtagttgggactgtaggtgtgtgccaccatgcctggctaaagatgggatctccctgtgttgcccaggctagtctcaaactcctgggctcaagccatccccctgcctcagcctcccaaagtgctgggattataggcgtgagccaccgctcctggcctgcttatttatattcttttgtaatggcatgataacttctttcatatatgtaggagaaaattttaatcattttccagattgaacttgtgattcttgtggtcattctaattcataggtttatttttttagtttctggttgctcattgcacccagaaattgttcctttttttaatattgtgaaacttcactagcctcaatttatttgttttcagttaatttttctcctttatcactggtctttgttattgtggatgaacaattttttttaagagatggggtctcacagtgttgcccaggctatagtgcagtggctgtttacaggtgtgatcatagtgcactacagccctgaactcctgggctcatgcaatcctcctgcctcagcctcctgagtagctgagactacaggcatgttggtgaacaattttctttttgtgtccaacaattgtatcgatattttgatggagtatgtacagaagagacacccttatggttcttagtactcaccaacttcctgaaagcattcccactgaggattttgagtaagaaaattatgtactcattaccatacttcagaatatgattctggctggagggtgctacctcgtgaggaataaccaaagagcagtgcattttaaaagcaggaagaggtcccctggagttaaggttgactgcatgctagctgtgaatccatagtgtaatcactacagttataaaatagttaatcaaacaattgtactcctgggatggctaagtagacatataaaaccatgctgtggagtaatgtaggaaatctcttattaaaatatcatggctagttttgatccaaaaataagtaagttatggaaggaatgtgggaaaagggtaagtaatgatgccatagaccactttgttctgcttagtgtcattaagactgaagatctgtgtacctctgcctccttgtcagtagtctactttgttgatgttgaaattcttagagggcaatagtctgacttcactctttatcacttcgtatttattcatgtgggaaagactcccacattgtacaggaccttgaagaggggacgcctcaacaaaagatcaaggcttttattttttatttatttatttattttttgagacagagtctagctctgtcaccaggctggagtgcagtggcacaatctcggttcactgcaacctctgcctcccgggttcaagcaattatcctgcctcagcttcccaagtaactgggattacaggcacatgccaccatgcccagctaattttgtatttttagtagagacagggattcaccatattggccaggttggtcttgatctcctgacctcatgatccgcccacctcggccttccaaagtgctgggattacaggcgtgagccaccgtgcccagccaagatcaatacttttaaactggattccaaatggtgaagtgccctaggaaatgcagagattaaggtcttaaaatattctccattaaaaagaatcagggaggctgggcgcggtggctcacacctgcaatcccagcactttgggaggcggaggcaggaggatcccttgagcacaggagttcgaggccagcctgggaaacatggtgaaaccccatctctaccaaaaatacaaaaaaattagtggggcatggtggtgtgcacctgtggtccagctgtgtgggagggtgaggtgggaggaacacttgagctggggaggcggaggctgcagtgagtcaccactgcactccagcctgggcaacaaagtgagaccctgtctcaaaaaagaaaaagaaaacaagaattagggatgcttgacgaaatggccgattccaaatctggtgcaaaaaaatgcataaggtatgcctggaacatcttttgagaggaaagaagctctcaatgactcataaggttaagtcataaggactgaagagcccgcctgaaaagactcccactggccaaacatgaatcaatttgagaatcaataaggatgatcactgtattggattgaaacacacctaatatgtttaatccatgagttcataatgatactgaaaaaaaattcatcactatttgaaggtggtgaaagaatgaatatcattttttatttattattgttaatgtatgtaagggatacaagtgtagacttcttttttgttgttttttgaaacagggtcttgctctgttgcccaggctggagtgcagtggcacaatctcagctcactgcaatatctgcctcctaggctcaagcagtcctcccacctcagcctcctgagtagcagggaccacaggcccgcaccaccatgccaggctaatttttttatagttctttagagacagggttttgccatgttgcccagcctggtctcaaactcctgggctcaagcgatccgctcacctcagcctcctaaagtgctgggtctatgggcatgagccactgctgccagccacgtgaatatactgtatagtagtgaagtatgggcttttagtgtactgcatcattattttgaaacttacgataaaagtcttacagctggctacgcatggctcacacctgtaatcctagcactttggcaggctgaggtgggagaatgacttgagctcaggagttcgagaccagcctagtcaacatggtgagaccctgtctttaccaaacatttaaaaattagctgggttgtggtagtgtacacctgtagtcccagataactcaggaagctgaggtgggaggatcacttgagcccaagaggtcgaggctgcagtgagctgtgattgagccagtgtactccagcctgggcaacagatcaagaccctgtctcagaaagaaaacaaacaaacaaaaagtattcctgctaatgagtgaaagaagtaataacagaatcgaaatgtcaccattttggaggtggacttccaaaatggtggagtaaggacctcagggtgtatgtatagctgaaacaatattggatgagttgataattgttgaatctgggtgataggtatgtagggattcattccttccatctacttttttgggggtaataattaagatataattcacatgccagtgtgaattattcaatgtttattaaataactagctatattacctaaagcatgttaaagagggaaaagaagcagaaataattccttctggagaaagtgggacaaaagctgtattatgatcatgcttataaacatgaagatttctcaattggatgtaacttagtttcttctaaattctgattttcactgttatctaaagtcaagatggttgatagatatgggttaatgagtggaacacggcttatgcgaaacttcatatttctagaaatatcatctagtgttaaccctgcctcctaagatatatgctataaaataaaaatagatgtctagtaaaggtagggaaaagggtttatggggttataactatcagctaaagtgaggatttttttaactatgcatggattacagctaggatcttcctttagccccagtaattttaaggtggtttaagctgtttgttatcctgggctatagctcagcgttaccacagcttgttacacagagatataaatgtgcttggtaaacgtattctttcaggttgaaactagatgattatgaagcatagtatcttgctggtaaacctttgctctcattggtggtggtgttcctcctttccccagttctgcccttgtgcagaattcagttattcatttgttctttgggctttccgtgtgctttgatcatttcctcccacctcgctcccttccagctttcatttatccttccaggccaggtcccatttttctaaaagccctttcctaataatcccctccctaatgtcttttgtacttattttagcattgtggaggaagagagggggaacctggttattctgttattcaagtgagccttcagttagttgaagattatatatttcaagtgtcactagttgtaaatgtcaaaacagtctattgaccaaaaaaaaaaaaaaaaaaaaaaaaaagtcctattactctgggcacagttggaacaatgcctgtttgaatcaagtccttcctcccctcaaaaaacattgtgattaatgcaaagtacctaactccactgatttctttttccctcactttttaggattatggctgctgttcctcaaaataatctacaggagcaactagaacgtcactcagccagaacacttaataataaattaagtctttcaaaaccaaaattttcgtaagtgttttgactggtttgctgtcacataggcactaacttaccacattgtacacatgagatatcttctctttaaactcccccattgtacagatgaggaaatgaagctgagagattcattgattttcccactttgccaattaatggtagagtatgttttagcagcaccaggtgagattgtgtctcatctttgcatggttcctggcacataatatttgctcaataaagatttgttgagtaaatgaataattgatcttgtaaatttgggcaaataagtgttttttaagttttggggggtttttttgtttgttttgttttgttttgttttttcttttgagacggagtctcgctctgtcgcacaggctggagtgcagtggcgcgatcttggctcactgcaagctccgcctcctgggttcacgccattctcctgcctcagcctcccgagtagctgggactacaggcacctgccaccacgcctggctaatttttttttgtattttttagagacggtttcaccttgttagccaggatggtctcgatctcctgacctcatgatccacctgcctcggcctcccaaagtgctgggattacatgcatgagccaccgtgcccagcctttttttttttttcttttttgagacggagtttcgctcttcttgcccaggctggagtgccatggcacaatcttagctcaccgcaacctccgtcttccgggttcaagtgattctcctgcctcagcctcccaagtagctgggattacaggcatgcaccaccatgcctggctaattttgtatttttagtagagacaggatttgtccatgttgggcagactggtctcaaactcctgacctcaagtgatccgcccaccttggcctcccaaagtgctgggattacaggcgtgagccaccacgcccggccaattattttaatataattttatatactttcgaagaacagtttataaggaaactacagctctccagttctgcctctcctctaagctatactccagactccttctaatgatatctaataataatttatattataagtgatgcttttaccaggttgtagactttgttctgggtgcctggctttgaagtcaccactgactttgagatcattaaatccagcagatagccacgattcctgcgtcttttacttgtcctgcagattttaacagagttagcagtttttaactctttttcccctttaagttcttatcagagtagcaaaaagtagccatatttgaatctcttccgtttttcttttttctttttttttttttgagacagtctcgctctgtcacccaggctggagtgcggcagtatagtctcggctcactgtaacctccacctcctgggttcaagctattctcctgcctcagccttctgactagctagggcttcaggcatacaccactatgcccggctaattttttgtgtttttattagaggtggggtttcaccatgttggccaggctggtctcgaactcctgacctcaagcattccacctgcctcggcctcccaaagtgctgggattacaggcatgagccactgcacccggcctcttccctttttcatttatgctgtcaccccgctctggagatgctattaactaaggactactagcctgagaaataaagtagtgggaatgacctctcaaagccaaataattagcctctgaatgggaaggaccagagaacgaatacaatttaagttacctgataaatttaaaatcgagagagatggattctttgctcagttgggatacaattaatgtaacctgtgtgaattagtttaaaaaattagttttgtagagttggggggtttcttaaaatggatccatctaatctagtttttccattatttttcagaggtttcacttttaaaaagaaaacatcttcagataacaatgtatctgtaactaatgtgtcagtagcaaaaacacctgtattaagaaataaagatgttaatgttaccgaagacttttccttcagtgaacctctacccaacaccacaaatcagcaaagggtcaaggacttctttaaaaatgctccagcaggacaggaaacacagagaggtggatcaaaatcattattgccagatttcttgcagactccgaaggaagttgtatgcactacccaaaacacaccaactgtaaagaaatcccgggatactgctctcaagaaattagaatttagttcttcaccagattctttaagtaccatcaatgattgggatgatatggatgactttgatacttctgagacttcaaaatcatttgttacaccaccccaaagtcactttgtaagagtaagcactgctcagaaatcaaaaaagggtaagagaaacttttttaaagcacagctttatacaacaaacacagtaaagactgatttgcctccaccctcctctgaaagcgagcaaatagatttgactgaggaacagaaggatgactcagaatggttaagcagcgatgtgatttgcatcgatgatggccccattgctgaagtgcatataaatgaagatgctcaggaaagtgactctctgaaaactcatttggaagatgaaagaggtaacaattattttatcttcattttagtatgttcattgtacttttttattcaaagctagccattgggaatagtcatgaatatatagagcttttgtccttaaggttgttagggtctttagtggtgctttttgaataatctgttggccacatttttgaggcaggacgtactgatgaaatggaaggttttagtctgctaatatagtttccaggatagctctgtgattttatacatgaagaaaatacaggagtttccccttgtccacagctttgcattctctgaggtttcagttacccgcagccggctgaggtctgaaaatattgcatcacttctcttgcgctttgggaccattattaagaaaacacaagccctgcaataccgcgacagtcaatctgataactgagaccactactaagtgattaacagcaacccaggtggacagatcaggtcggggcaagattttatcacactatactcaaaacagcttgaaactgaacacttatgaattaatttatttctgggattttccatttacatcacaatgcctacatcattcacctctcttcatctcatcatataggcattttttatcatcttatatctttacaaaggaagggtgagtagagtaagatattttgagcaagggagaccacagtcaaataacttttattgcagaatattgttataattgtgctatttcattagttgttcaccttttgctgtgcttaattaataaattaaactctatcataggtatgtatgtataggaaaacacatagtacttatcgggtttgatactatccgagatttcaggcatccaccggggtcttgtcacatatttcctgaagataagggggttgctgccgtaagatccatagaggttaaaatggtggttagtggtaaattggaaaatgaaactaagcctttctactgtaattcctttatggcttgttgccacctaatattgatgtataatgtgctctaattgcactattaaagtattataaattacattcaaagtttttcctggctagatcttgtaattatttaatgtccaaaattgagtaactgagattacccacatggggaagtaactcaccttatgaagcagttgcaaatatgagagtaaaatttttaaacccctgaatcccattaaggttactctagggtgagagagcactgaaaagtgattgacgataagcaaaactatagtctcatcaatgatgcctctgtttctgaagggaaaatttgttaaaagatagacagcaacaatttgggttgtgttttcccacatagtccaaaagagagacttaaataactgggaaactttgtgttaaagatgatttgtacaagcagccgtgtttgtgttattatcagacttatctgttgcactttacccttatttaaatatgagtgaaaagttaaaaactagaaacgtcaatagcaaatacgtgtttcgtaattaaccagagacagacatgaaaatccctaagcaaatcttcggcctcagtcgagcattcactggacttaatccacttgactcaatagtaatcatttatgaataaataagccagcattagcatgtaaagggagaggatccatacaaagtggtgtgattgtttgtgacttgccagaagcactcattcttaatcgctcatgccctgttctttctgtctcattagtggttaacaaatctatgtttatcaactgttttactgtagataatagcgaaaagaagaagaatttggaagaagctgaattacattcaactgagaaagttccatgtattgaatttgatgatgatgattatgatacggattttgttccaccttctccagaagaaattatttctgcttcttcttcctcttcaaaatgccttaggtaaactagctaaataattagcattattatttgtttctgggatactttaaattgtttaatttagtttataatatcatttctatataaaagtattttgtgctttctacaattattttacattcaagtgaaagcctcaaaaaaaaaccctgtttatacatttaattggttgcattctaaagatgaagtcccattatgattaattacatgaaacttcaaacaattttaggtagctgatttttttttttttttgagacagtctcgctctgtcacccaggctggagtgaagtggtatgatcttggctcactgcagcctccacctcccgggttcaagtgattcttgtgcctcagcctcccaggtagctggaactacaggtgcacaccaccatgcctggctaattttttgtattttcagtagagacgaggttttgccatgttgcccaggctagtcttgaacccctgagctcaggcaatccgcccgccttggcctcccaaagtgctaggattacaggcataagccaccttgcctggccttatatagttgattttgacataaggaatatatttctaaaaatattatatttccaaacctgacctgaaatgacacaaagctaacccattatatgggaagtgaattaggacattagtactttttaaaaaaatcctacaggatagaattggccattgtatttgttattcactcaattttagcaaattggtgacatgattattgttaattggtagtattacgagaaaaatagatactccacacgactcatcaacagcttaaattgctaagtgtcaatgttaccttcgtcctcatcccagtctcactctcagaccagttgagtggtagagtatagtatatactaaactgagcaaaagtttatatagagtctcaattctaaaccagcattctcatttaccaggtgaaacagctgaggcccagggaggagcaaggaattgcccaggttgatacaatgaatgacaaatggactcagatccagtgtagtgccttccctggtgtcatactgattccttgttgaatgcctggcttttttctttactcattaaaaatgtgtgttacgcaaataatataatcattttaacaaggattctaaataagaaggaaggagcactgctgggtgcggtggcatggtagtggcctgtagtcccatctactcaggaggctgaggcaggaggatcccttaagcccaggagttcaaggctgtagtatgctgtgattatgcctgtgagtaaccattgcactccagcctgggcaacatagcgagaccctcatctctaaaaaattaaaaagagagagagaaggaatactagtagtcccacaattctgactgttttctttatccatcttcagttttgatacatgtgtgtttgatttctgcattgttgtaatcaacatgtaattataattttatattctactttatttctcttagcattatttctaaatcattttccaattgctacatatttaattccttttaatggctacataatttatcaaattgtcatatcataaataaatttacctagagtcttagcaattaaaaaagcttgttttacaaagtatttccaaggtagactctctttgtacatttcccattgtaacttagtatacatatgtgtatatattataaaactgaaatagaattttcacaatattttttgtgcaatgcacagcttaaattctatgctacattttatttcagttttaaaaaatactggttgtaacctctgaatttcagaagtcaagtggtcagacagtatataacagagaagagagacctgtttttcaaactcctcttttccaaaacctctgtagctggccctcaagattctccatcttctggccacaatttacctttttcagctttatctccacttatgcccttgcaataacccagtggttttaatgagtcaaaccaacaatctagaaagcatatcattttctttaattataatgttattgtttaaaaaataatattaaaaagttacactgttttgatttagttagaaagttgcattccaaaattattctttaggaaaatacagttgattcccagatgtcaagcaaatagaaatgtcctttttaaaatctttctttcatagtctgacactttccccatacttgtcattcagtttgcttaaatcttatctccttggcaaagccttctaaagttccaaaaaatgttacctttctttggatttccacagtatcctctctttaacactcattcagtactaatttattttgttatttgtaaagtattttttctatgtaatcagactgaccaggtttatatgttaatatgtttttgtataatctgtgtggtgaggtaattatatatgcagacacacaaaaacacatgtacatatatttgcataataagagaagtccagaaaaagtgctttgaaatctcagaaaaaagagacattaataatcacttgctggagaagtaatgctttggctggggctagaagaacaggtgtgatttgggtacgaagagattggaatggcaggttttccaaattgagaggatcagtggcaaaatccccaaaataggcaatgcagggcttatatgaagaatgtaagtggtacagtatgactgaagatttgtgttactgaaaggacataatcggagataatgttgaaaagggctctttctggacaactttgaggaccagctaaagaagttttataattgaggaaatttaaaaaactacttctcttttctgttatatattgtctgatcagtggtagaaaaatattaagggtttcaaaattatacatttattgagtctagcctatagtatgattggcttaacattttttttatttgcagtacgttaaaggaccttgacacctctgacagaaaagaggatgttcttagcacatcaaaagatcttttgtcaaaacctgagaaaatgagtatgcaggagctgaatccagaaaccagcacagactgtgacggtacaagcaatattttagacataccatgtatttcaactacttacttttgaaaacaacgtaacacaaagattgtgttttgaacctgtggctgtatgttataaaatggcagatttgtagtttcttttcttctaatgtcataaccttgtttactggttagccagcatttgcctgaacaactcatgaactcatgctctcacaagggcgttcattccccattttgaaaatgctacttgttagaaatcatctctcatactgagccaagatctgcaactttaattctaggaggtttttaaatttttatttacaaatgagaacttccacaaaatcctgtgtttcagaaacacggaccacagagcgtaatctcatcataatagagtttccctccccctccttgactaaatattattaggtcttttaactctccttgctagaaattgctttcttgacctttcatcctccggttctcccttgtatatactctgagtctaggtctgggtcttgatgttcatttaaagctaaatacttgtttgcttgttttgtttctaattcattttttattttttattaaatatctagtgtaaataatcagatagcagtgcaagactttgataaacgacagtcccccttcccactcttggtgtctgctgctcagaggcaccttcagtctgaaaatatacatcctcttgtagacatttttctggcattatttctttttaccttctttttctctttttcactcttcctggaacttctatgatttgcatgttagacttccattaattatcttttctatttttcatctcttgattttctactttttaggatatttccttgattttatctttaactcttctgtggaatttttaaatttctatcaaggcaatttccgagagctcttctttgttctctggatatctctgtcgtgcattcgagtctgagggctgctgggcttttttagcgacgtctgcatgcatgtgcgggtcatgtgtgtagtgttctctgtgtgttgtttttgtttcctccagtttttttgtggtttattttggactcaatttattttagagatattcaggaggtgactgatgtgctgggcgctcttataaagtgccttacaatattaactaattcagtcatcaccataaactacctcaaactttaaggtagtttccttttttttttttttgagacggagtctcgctctgtcacccaggctggagtgcagtggcacaacctcagctcactgcagcctccgccttccaggatcaagtgattctcctgcctcagcctcctgattagctgggattacaggtgtgtaccaccatatctggctaattttttgtatttctaatagagacagggtttcaccattttagccaggatggtcttgatctcctgaccttgtgatccgcccacctcggccccccaaagtgctgggattacaggcgtgagccaccgcgcctggcccactttaaggtagtttctgttatccccatttaacagataatgaaactaaggtacaggagcgttaaatagttacacaccgtcatagaattagcctcagagctaggatctgaacacagcagtcttgaggcttttgagttttcattgataacaactgcattatactgtctctgtatcattaagtttcactaataaaatggttagctagaacaggggcaaggacagagttctacagcatgtcaatagaggcttccctcttggcttacaacagtccattcatcaccacttcttgttcagctagttacatatctgtcttcagaccatgtttctgttctttatccatggagacacaaaagacttgactatgtgactccaaaaagttagaggtgtgaggcagcaagaaggaatgggtgggacattgactctagagtcctacagacctgtaatagaaacctgtctcctcctactcttgactatgtgactatggcaaatagttaaacttctctggacttcagttttttcttctataaaatgaggagaatgatatctaccttgctgggtagttgtcaggattcaagataaagtgcctagtacactgcaggcctttcataaatgataactattgttatctgccagtctagtaatccttttaaaaaaggaaatacattaagacggatggtttgtttttatgaacttttgctaactctattattgtttcctcccccttagagctcacaaagcagctatttgataacaggctctagaattttgctttgaatttacatcaaatcaccagcctgtagtttttggcaatcactttcaaattttttgaaaattagaacaatgtttgtctgtcctcactttccatcagttctcttattcactagatgcctcacacacgtgtcagtgacaggggctctgagatcctgtttgcaggtttcctttgtactctgaggtataatctgtctagacaaggagtcttgggctagtctctgatagctaggtacccccttttatctccctctgagcctgtcttggctttcagttccatccgaccattgtgtattctctttccaatctgatgcttgttttccttgcagagaaaacagaagtaagataggaattcagcaattccattttacatctcatacctcacatttctctcagtcaccagaagtccaaatttcccaggccattcttgtgcagatgcccctcctcaccctgccatcttcactccctgttctgtcctcacttcctgtccttcctggcttgtaaaccatttaactgactgctctgtcagcaatgtccctgtagcctcatccgcttctctgatcattttcttccccttctttctctaattgttttctgaggatatgtactgtttcccctgcagcccacctaaactgttttttactctcacagactttaggcctgagaggtggcaaaggcatctgttgtccttgcttcctattgccattttttttcctttttttcatctttttttttttttctcgctctgtcacccaggctaaagtgcactggcgcaatctctgctcactgcaacctctgcctcccaggttcaagtgattctcctgcctcagcctcctgagtagctgggactacaggcatgcaccactatgcccagcttttttgtatttttattagagacagggtttcgccacgttgaccaggctggtgtcaaactcctgatctcaggtgatcctccagcctcagccttccaaagtgctgggattacaggcgtgagccaccatacccaggcgcagctgaggttttagatgaaggaaagggctggcacggtggctcacgcctgtaatcccagcactttgggagaccgaggtgagtggatcatttgaggtttaggagttcgagtccagcctgcccaatgtggcaaatccccatctctaataaaaatacaaaaaagccgagcgtggtagcgtgtgcttgtagtcccaggcactcaggaggctgaggcaggagaatcacttgaaccggggaaacggaggttgcagtaagccgacattgcaccactgcactccagcctggaagacagagcaagaatctgtctcaaaaaataaaataaaataaaacctctactgctttgaaattctatttattagttatggcttaatttttaaaatgggagtgggctggcaggattcagttgttcaaacatcatatcaggagttgctctgtctctcacttcccttctctctcctctcttctgtcccatctctccgggtcaaacctccatttctttctatgtgctttctacttttcctttgtatcaatcttatttgaaatctgtctttctttataaggtgacagaaatggccaccagaatcatattaagcttggaaaaagggaggtactttttcccagtcagccctaagtatttccagagttaattttcactgggctgccttgtgtcagatgcctactgagggagtgggaagggtaggtctaataggaaatcttggtaacagtatatgttaccattaaagggaagcctggattccaggcagatcaaaacaacaggtagggctcttgcctgtccaacgcttaacaatacactttgtgttggcacagtgagctttgcacatgaagttagttaaaaataaaatcatagttaactgataaacctttgttccagccaatgaccttgcttaccccaagaaatattatttattaaatattatgaaattaaatgaaaacagttatgagctcttatgataaagcgtagagacaacccaatttcaagttaattcacaggaagataataggacaatatatggttgtttatgatcttgtttttacactgcttcatattttacatatgtgactttcaaaatcttaagacttgactgggcacagtggctcacacctgtaatcctagcactttaggaggccaaggcgggaggatcacttgagcccaggagtttgagaccagcctgggcaacatggcaagaccctgtctctacaaaaaataattaattaaaaaaaaaaaaaagaagaagatgtgttgtgttgctgggcacagtggcataggcctgtagtctcacctacttggggaggctgaggcaggaggatctcttgagcccaagagtttgagggttcagtgagcagtgattgcaccactgcagtttaacctgggcaacagagccagaccccctttctttctttctttctttctttcttttttttgtgagacaaagtctcacttttgtcccccaggctggagtgcaatggcacgatctcagctcactgcaacctccacctcccaggttcaagcgattctcctgcctcagcctcccgagtagctgggattacagacacgcaccaccatgcccggctaatttttatattattagtaaagacggggtttcaccacattggccaggctggtctcgaactcctgacctcaggtgatctacccttcttggcctcccaaagtgttgggattacaggcgtgagccaccgtgcccagccccactttaaaaaaaaaaaaaaaaaagaaaaagaaatcaagatcttaagacttttttttttttttttagtgacagggtctcactgtgttgcccaggctggtcttgaactcctggacttaagcaatcctcctgccttggcctccccaaagggctgggattacagtcatgagccaccatgcctagccaagacttttttttttttccctcaaagaaaaatattaacaacataattattttatagctagacagataagtttacagcagcagcttattcatgtgatggagcacatctgtaaattaattgatactattcctgatgataaactgaaacttttggattgtgggaacgaactgcttcagcagcggaacataaggtatcttaattttcccccttctggaatatatctgattatatttctaccactctaagtgaaaaatggacagggcaaaatgttcaggctttctggcctggaaatggcataaggatgatcatcatgccactatgtttttgatttgtttacttttcaaaccactcctttaacattcgtattcatgtttttaagattgggaaaaaagcgaatatattttgctacaatttctatttggtatgaaaactacagatttgcttttgtggcctaccagagtaaactacttatatttaatacgttgttctcttttctctcttcagaaggaaacttctaacggaagtagattttaataaaagtgatgccagtcttcttggctcattgtggagatacaggcctgattcacttgatggccctatggagggtgattcctgccctacagggaattctatgaaggagttaaatttttcacaccttccctcaaattctgtttctcctggggactgtttactgactaccaccctaggaaagacaggattctctgccaccaggaagaatctttttgaaaggcctttattcaatacccatttacagaagtcctttgtaagtagcaactgggctgaaacaccaagactaggaaaaaaaaatgaaagctcttatttcccaggaaatgttctcacaagcactgctgtgaaagatcagaataaacatactgcttcaataaatgacttagaaagagaaacccaaccttcctatgatattgataattttgacatagatgactttgatgatgatgatgactgggaagacataatgcataatttagcagccagcaaatcttccacagctgcctatcaacccatcaaggaaggtcggccaattaaatcagtatcagaaagactttcctcagccaagacagactgtcttccagtgtcatctactgctcaaaatataaacttctcagagtcaattcagaattatactggtaagtttaaaataaattgaatgcttatatgaaaacaaaactgtcccaaaataggaattatataagaaaaaccatagcaaatcatcattgcctgaaaacattgttgctatgcaaatttctactgatgatatgaattacaaatcacaatttcaaaagcaagttgctcttttgtctctatagcagctgtagttttataaaatgtgtaattataacctattgtagtacggctctaaagtcattacaaatgtgatgtgcctttgaattaacattttttagttcctaaaacaaactcatgagggccaagtttttaatgattttgggatgggcaaaagcaaaaatggattcgcatgctaaaaatgtattttagaattctgtactgatgagaatcgattaatacaaagtagagaagcatgttttatgtgttaaaatgttaaaatatagggtagtctataaaggatatgaagtcaggagtgtcttaaatcagtcaaactacttctttgggtctaagggctcactgcatgccatgtgctatgttgggcgccgatcatttaaagatgaataacaaatactaagtagttcctgccctcctggagctcacagcttagtgagagagaagttttgagaggaatgaaattagccactgaaggctccagagaaaagccaaaaataattttaaaaccttacatcaaccctataaagttatcaaaagtattttttagctgaaataagtttataaagtacagccctccctatttttgccattgatgacttaataccacggaggtttttcttacagttacgctgctgacctttaaaacaacgattaatggatttatttttgtatcatgttagaatgtgtcatacttgatgtttgcaattatcttgagacagttgagtgttggggttagcgtaactgccagagctccgtgagtacctcttgttctctgtgctgaaccagagttgcgacagccaggctgcagagcaggggcacgtgtgagagatgttatgaaagaagagcctgaggaagctcagatgactccaaggtttcagacactgatgactgggaaaactgtgacaccagtaacacaaacaggggagtcaggaggcggagtcagatttggagaaaagctgagaagggctagtttaagtctagaggttaaagtgctggtaagtcattcaggtaccaatgtcttgcagacaacgggagctgtgtgcaggactggaacttaggagggtgtcagttgggtcttaagagaggtgtaggcatttgctgcacacgggtcatgtttaagatcataggactaggaaagctccaaaaaagaatgtctacagagcccagtcccaaatatctgaaagactccctcccctatttatggggcagatggaggtagtagagccaggaaagggaatttaaaatgagtagaaaaccatgattgtcttggtggtcatggttggaggaagggagaagaggaaggaaagaataaaagtagtggtaggtgctgtagaaaaagtcaaggaaatacttgatttgggactttggcaagtttttggtggctttgagacttgtagggaaggaaagccagtaaagagtttaagaactgtgctgcagggaaacgtgtgccagtgattctgcagggcaagggaaatgctaaagctgtactttcactgtattcatgtactgatttttcttaacgttgattattttcctagacaagtcagcacaaaatttagcatccagaaatctgaaacatgagcgtttccaaagtcttagttttcctcatacaaaggaaatgatgaagatttttcataaaaaatttggcctgcataattttagaactaatcagctagaggcgatcaatgctgcactgcttggtgaagactgttttatcctgatgccgactggtatgtatttttagaagtgaattggcaggaatccattggcagatgttaaatgaaagctctttaatagaaataaaaagaccacctacacagtatttctatcatttagggacctcttaaacctcctgtaccatagtgagaaagcatattactttatatcctttgttctggttgttgacatcatgaagtttatagccctgtaagattttcaactcgaagctcattgtgttgaactgatctagaatttttctttgggaatttttcttttttctagtctaagcagttttggaaatcaaacagaaaaatcgctgtcagagaccatgaccatttctggcagtttatttgcaacaatctggtgttgcatagtggttaaatcatatatgcatatatgcatagtggtccatcagctatggaccaaaggcctggacttaaagaacagctctgctgctcacagcagtgtggccacatgcaaggcactttactccctgggcccattttctcatgtgtgcaatggtgatagcagtaaagtacctggttcacagagtggcatgaggattaaatgaaaatcatttagcacgatattgtgttggccccactttaaagagtctaggacattcattgtgctgttaaagcttatgacagctgttcaatgatttatagtcattcacatgagaatattaaatcaacagggcagagcgcaaggagaatttgcagtttcagtacctatgtgtagtcctccctctgtctatcacctgacttgtgacctttagcaagttagctagtgctgtcattattgtataatgttgactgggcatctgaactttttcatcctggtttttagatttagatagccttggcttaataatcagcatttcaatttttattaatttattaatcactctgtgccttcctttcaaccctattttggtgtttcagaactctaacgctggaaaaaaccttggcaatgatctaatccattgattttttttttccagggcttcccattgtcctttagggtttcaagacggcatttttaaggtccttccaccccaatttcaaccacttgtgagagagagatatatataatatataattatatataatatgtatattgtattgtatataatatgtctattatatataattataatatatagtgtgtgtgtaaatattccaaataaggtttattttatttttatttcttattatttttgagacagggtctcttgatctgtcacccatgctggaatacagtggtgctatcacagctcactgcagcttcaactgggttcaaacaatcccccccaccttagcctcccaagaagctggggctacaggcatgtgccaccacacctggctaatttttaaattttttgtagagatgggatctcactgtgttgcccaagttgatctcaaattccctgggctcaagcagtccacctgcctcaggctcccaaagtgatgggatttataaataataaaagtaaataaacattatatagaaagtaattattttaatcctagtgtcatttttagagactcttctactactagaaataaaaactttactgtattccactacattttaagtttcctgccctaattcttgcctttgctattatatatgtctatataagatgtcctaggccgggcgcagtggcttgtgcctataatcccagcactttgggaggctgaggcaggtggattacctgaggtcaggagttcaagaccagcctggccaatgtctctactaaaaatacaaaaattagcaggatgtggtggtgcatgcctatagtcctagctactggggagggtaaggcatgacaattgcttgaacctgggaggtggagattgtagtgagctcagatggcaccactgcactccagcctgggcaacagaatgagactctgtctcaaagacaaaaacaaaaacaaaaaaaacactttttttttaaagatcatttttacacattatttaaattgcctaaatataatagtttgagtcatttgagtatggcaaattgttggcaccagggacaatatgccttggtgtcctattaatgatatgatttcttttgtaacttttacattcatgctctgaagacagaacctgacagatattttttcattgttctctttcaggaggtggtaagagtttgtgttaccagctccctgcctgtgtttctcctggggtcactgttgtcatttctcccttgagatcacttatcgtagatcaagtccaaaagctgacttccttggatgtaagttataaaaatactaataaaaacacgccttagaaacaattaaatttcagtcctctggataacctttttattaaatagttcgtgatttgtaaaaaataaagcacagcagttaaatttgcagttgaacagaagtctgaaaatttgatacagataacctctagttcaatctgtttttattctacaagaatgtatcttagtaagaacttttaaccaatgctattttttgctgatgtaaatttttttaacgaatagaaaatcatttcttttttcagtactgccaggtcggcatagttctctttcccttatatcttaaagtgcatacacacatgcatgcctgcacacatatatctttttttctcatggctgagtttaaggaagtaaatgaatgcattctacttaactcttcacaatgtagttgggggtggtggctcatgcctgtaatcccagtgacttggaaggcaaaggtgggaggattgcttgaggccaagaattcaagaccagcctgggcaacacagcaagactttctctacagaaaaataaaataagctggacatggtggtgaaaacctgtggtcccagctgcttaggaagctgagggaagagggtcgctagagcccaggagtttgaggctgcagtgggtcatgatcatgccactacaatctagccttggtgaaagcgagaccccgactcaatcacattgtgattaaaaagaactgttttaagagttatgagtcaccacccctcaataagaccactagtttggttttcttccaaagaatgtcttagtgcagtggtggtagccattgttcaaccatttgtcatattatggccccttcattgtcattaatctttaaaaccctgaaatacatttatctaaaaaaaagatgccatacagtaggactggaatatcttgtataccaaattcatatttatcttatttacaaagatgaaaaataaagcaagaaaaggaaataaataatgagaagaccattttgtgttatgcttttttttgttttgttttgttttgttttaagacagtcttgttctgttgcccaggctggagtgcggtggtgcaaccttggctcactgcaacctctgcctcccaagctccagcaattttcctgccttagcctcctgagtagctggaattacaggcacctgccaccacgccaggctaatttttgtattttcagtagagatggggtttctccgtgttggccatgctagtcttgaactcctgaccccaagtgatccacctgcctcagcctcccaaaatgctgaaattacaggcgtgagccaccacgccctgcctgagttatgcttaataagggttttttaaaatgtatgtacttacatacttgttatgttgagatatgtatttcctttgataggtttgatatgtgactaataaaatatttataaaacctaaggacaaatgtaattttgtcaggttaatgtataaaattgaaattgtttactacttttatacttagattccagctacatatctgacaggtgataagactgactcagaagctacaaatatttacctccagttatcaaaaaaagacccaatcataaaacttctatatgtcactccagaaaaggtttgtatttatatcattattttaaaatatattaaagaccactagaatacatatatttttaagattttaacaaaattttgtatacgtagtgcaaagaatttttgtacaactttcatccagaaaccccaaatggtaacattttactataattgctttgtattctctctctgcatatattttcctgacacatttgattgaaaattgcagacatggtatccttttaagccctaagtacttcactgtacatttcctaaaaacaacgtattctctcatataacctcagtacaatgatcaaaattaggagatgtacattgatgcagtactattacttaatctgtaaaccttattctggtttcactagttgtcccaataatgtcctttatagcaaaagaaaatcccagatcatgcatgcattccgttgtgcttctctgtaatcttgtaaacagtttctctctcttaatatctttcgtgattttgaagtttttgaaggccagtcgttttcggaattgtccctcaatttgagtttatcttgcttcctcctgcttagattcctgttactccttgaatatcacagaaacagtgatatgttctcatgcccactgtcaggaggcacttgatgtcgattcgtcccattactgacaatgttagttaactgatcgcttggttatggtagtgtctgatagacttctccgctgtaaagttactcatttctttttggcctttgtaattagtagatatcctgttgtgggatgctttgagactacgtaaataccctgctagtgatcagaattttacccacaagttttagtatccattgatgattcttccccaaatcagttattactatgatagatataaaattattttttaaatgtagttggtgttttgccataaggaagagttttcctgttggttacactttttttttctttttttttttttgaggtagagtctcactctgtcacccaggtgggagtgctcggctcactgcaatctcggctcactgcaacctgggttcaagtgattctcctgcctcagcctcccaagtagctaggaatacaggtgtgtgccatgatacctggctaatttttgtatttttagtagagatggggtttcaccatcttggccaggctggtctcaaactcctgacctcaggcgatctgcccacctcggcctcccaaagtgctgggattacaagcgtgagccactgtgcccagcccacatatttattgatactagcatgaactcgacttcttaatttattcaatgagttacattcaattatcaagtattttgatgttctaattgtcctacatgtgaccagtgagacatctctctcaagctggcttctctgtccttttgacatgtcccggtcaagatgtgagtgctacatgtgctcgttgctactgagatgtcattgcttctaggccctgttatgaagagagctataaaatatataatttttcccccagccaacacgcatccatataacccagatatgtaaccctgttgccaatgtaaatgtatggtggccctcagatgtcttgaagcagacaaaagtttgagaaccactaacctgctaaataagctgtttgcttaatgttggtgaacattctaaaatttgatctgctattttctattacttctgctgttctcttcatagattgaaataagaaccaattttatatggaggtgtttttgtttttgtttttgttttttcgagaccgagtttcggtattgttaccaggctggagtgcagtggcacgatcttggctcactgcaacctccacctcccgagttcaagcgattctcctgcctcagccttcctgagtagctgggattacaggcatgcaccaccacgcccggctaattttgtatttttagtaaaggtggggtttcaccatgttggttaggctggtcacaaactcccgacctcggatgatccacccacctcggcttcccaaagtgctgggattacaggcgtgagccaccgcacccggccttatagaggttttaatacagcttaagttgtgatggaatttgaagaccacagaatcatgaggtgatgtgtttcagtgtttttacatgtctaatgtatttctggcctagatctgtgcaagtaacagactcatttctactctggagaatctctatgagaggaagctcttggcacgttttgttattgatgaagcacattgtgtcagtcaggtaaatactgttttttatatccggaaataccgataaatacatactaccaacaatatatgtatttactgaataaaaacccacactgagtgaacgagtctcctattttactgaagaataaggtagttcttaatacattgagcagtgttggctttttatagaaggaagctccaagtagtctgaaaagcagtatttttttttccaactagtggggacatgattttcgtcaagattacaaaagaatgaatatgcttcgccagaagtttccttctgttccggtgatggctcttacggccacagctaatcccagggtacagaaggacatcctgactcagctgaagattctcagacctcaggtgtaagttgttgcacgtcacgtatttgagaaccctggggcagtgactgccagagctgctacatgttagaatcacctgtggcgctttaacgccaccaccccacccccaccccacccccatgcccaagttgtaacccgatggcagctaaatcagaacgtttggggctgagagccagtatttttttaaaaatccccaagtgattacaatgtgcagcagagtttgggaaccagagtcctagggcttttcttcacttactgaaattaaaactccttttcagtacctactttagaagtagggataaattgcatgccatatctatcatccctggtatagtcccagtaataaattaatttttacttatctaattttggcttccatatatcctagagtatacttcttgaaatgaaagatgaccctgctttgtcatttccccctaaggtcccagttgaatccaggatgttgaaaatagtccagatactatgtcgaatagcttttttactttgttttcttctcaacaacaaaatgcttcttgttgccaccaaatccataattcttcagtaacaaaatctactataaaagaaatccccccccccttttttttttttttgagatggagtctcgctctgtcgcccaggctggagtgcagtggcctgatctcggctcactccgagttctgcctcccggggttcacgccattctcccaccttagcctcccgagtagctgggactgtaggcgcccgccaccacgccaggctaattttttttgtatttttagtagagacggggtgtcactgtcttagccaggagggtctcgatctcctgacctcgtgatccgcccgccttggcctcccaaagtgctgggattacaggcgtgagccaccgtgcccggccaatccccacatatttatctaggctgtactggattattttatacttctacctgagtttgtagagatatggattctttggtaggtttattcactcagcaaatatttatttaacaactgttgtgtgccgagtttaaagtatttttttcttctgatttattagtgtgcactttagtttcagatgtaaacattaacatggtatgcctgaaggagtaatgactgaattggatattgaggtgaatttttaaagcacggcttttgttcatttgaaaataaagacaagctggtgctataaatattataagcagtaagaatagcaacagtatctcttagagggttatgagaagaactgaaggttccttatgaaggatatgaatgggtcatgtgattaagatagctacaaaagcttttgcaggttaaactggcagcttctaaattatctgatctaaatcaaggaattcaagcattttgggtttcttccagcctttaagttgtttggttccagcctagaattattttattgctagtagcactgttatatagcacaaatgaccatactcaagtgcaaggattttagagtcctcagaattttgtgtgtgtgatcacaaagtttggaatggaatattgtaatttaatctcacttgcagaggagtatttgtattaaatttggggaaaaatattttgcgtctataattgatatgcattataatgctatatttaagatgtcgtattaggctgggtgcagtggctcatgcctgtaatcccagcactttgggaggccgaggcaggtggatcgcctaaggtcaggagttcgagaccagcctggccaacgtggcgataccccatctctactaaaaatacaaaaattagccaggcctactggcgtgcgcctgtaatcgctgctactcaggaggctgaggcaggagaattgcttgaacccaggaggcggaggttgcagtgagccaagatcacgccactgtactccagcctgggcaacagagtaaggccctgtctcaaaaacaaaaaacaaaaaacaaaaaaaaagatgtcatattatactttagattctaataaataacctatttgcaagtaagtacttctgtaagtactacattgatctataatttttttttttttttttttttggagacaggtcttaccatgttgccatgttacccaagctggtctcgaactcctgggcttaaacagtcctcccatctcagccttcctaagtgctgagattcttctgtcctcttacgccggatgcaatctactgttcttttagatcagttacatcaatggcaaatgcctatagttaaatgataaaaaaaatttcttttccttttgaatgactttttgtaagtataggatttgtgatttatgtttgagtaaacagtgtacatatttatttatttatttagaggcaggcaccttgaatctgttttcttagtactgtggggaagagatctgcctgggaaagcaaggttgtggatttccagtctccagcacttggtacataattggcactcagtaataatcaataaatgaaaaatgtgaaggaatttgggtaaatgtaaaaatgtaggcatgtctgttgactccttaatgtgtttggcacttctctgcatttggaagtaggaaattttaaggaatactttctgggactctgtttcctgatcttttctgccagtaggccctggtttggattaaatttgctcaactgctgctatgtcgtggccctggcgaagtcaggtattcctaaggttgaagccacagcccctgtgctgctctcctcccgccagtctgtaataatattcttcctctttgggaaatataaggcacacaaaaaaggctttattccatttccttagggccttaaaatatgaactggaagagagcaaagagacaggcacatagagttaactataatagaacaataataatagctaacacttacatatccagcctactcagtgtgccaggcactgttgtcattttaagtgtatttacctccttgtccacacaaaagcaaggtaggtactcctattttcctcattctacaggtgaggaaattgagacacaaagagattatataacttcatatgcctagcaagggttggagtgagaacttaaaacaccagatagctggtttcagaatcctttaaatactaggtcaaattgcagaaagaagaaagcagtgatttgagatgtaaattacagctgcaggaactgaagaagacaagataagctagaacccccagtaacagctgttacaaggaggggtcagatcaagttttgtaaaggcactgggcattgtaggaggagtagtttatttaaaagcataggttgggcatggtgactcacgcctgtaatcccagcactttgggaggccaaggtgggcggatcacctgaggtcacgagttcaagaccagactgaccaacaaggagaaaccccgtctctactaaaaatacaaaactagccgggcctggtggtgcatacctgtaatcccagctactggggaagctgaggcaggagaatcacttgaacccgggaggcggaggttgcagggagccgagattgcaccactgcaccccagcctgggcaacaagagcgagactgtctcaaaaaaaaaaaaaaaaaaaaaaaagataaaagcgtagacagcagccgagcgcagtggctcacagctgtaatcccagcactttgggaggccaagggagacggatcacctgaggtcaggagttgaagaccagcctggccaacatgttgaaaccccatctctactaaaaatataaaaattaaccaggtgtggtggtgggcgcctgtaataccagctacttgaaaggctgagacaggaaaattggttgtacctgggaggcggaggttgcagtgatccaagatcatacgactgcactccagcctgggtgatagagcgagactccatctgaaaaacaaacaaacaaaaaaaggcttaaacagctgtattgaaataaaatttacataccataaaattcacctaaagttgacacttcaatggccttttttttttttttttttttttttagtttataaggttgtgcagccatcaccattatctaattttagaacatttttgtctctgttgaaagggagagtatacccattagcagtcaattcctactttctcactttccccattcttaggcaacccctcatctactttctgtctctgtaggtttgcgcctattctggacatttcatataaatggaatcacataacatgtggccttttgtgactgacttctttcactgagcatgtttttaaggttcctccatgttgtagcctgttttcagtatttcattcctttctattttcagataatattccattttatggatcctactttctgttttatttgcccattcatcatttgatggatgttcaagctgtttcagtgttttggtttttttgaataatgctgctgtgaacatttgtgtagaagttgttctgtggtcatcagttttatttctcttgggttgctgggtctgtggtaactgtatgattaaccttttcaattcaaggactactaaactagttttcaaagtgcctccgtcttttttttttttttttttttttttttgaggcggagtctcactctgtcacccaggctggagtgcagtggtgcaatctcggctcactacaacctccacctcctgggttcaagcgattctcctgcctcagcctcccaagtagctgggactatttttgtatttttgtatttttctaattttgtatttttagtagagatggggtttcaccatgttggccaggctgttctcaaactcctgacctcaggtgatccacccatctcgacctcccaaagtgctgggcttataggtgtgagccactgcacccgaccgcctccatcattttatattaccttcagcagtgtgtgggggttgcagtttttccacatgcttatcaacacttgttactgtctttttttattacagctatatgaagtggtaggtgaacggcattttagcaggcaaagagtgaaaattcagggctgaagtttctgttataaaagtacaggtcaggccaggctcggtggctcatgcctgtaatcccagcactttgggtggccgaggcgggtggatcacctgaggtcaggagttggagaccagcctggccaacatggtgaaaccccatctctactaaaaatacaaaaattagccgggcgtggtggcatgcacctatagtcgcagctactcgggaggctgagacaggagaattgcttgaaaccagaaagtggaggttgcagtgagccgagatcatgccactacactccagccaaaaaaaaaaaaaaaaagtacaggtcaggcccaaggaatggtgaataatccattggataagtggagaaacatagagaagggatgaccctgacaaggtggcttgacgccagatcatggaggatcttgcatataacgatggtaaaatgtttggactttattcttttggcactttaacctgggaagtggcttgatctgaactgtgtggatgaatgataaccctggcaagagaatagaggagaggatgagtgagagaacagaaagttagaggtagagcagcccttcaggaacttattgcctattgcagtcattgaggagagatgatgctggtggaaacagcagaagtggaaggaagaaacagagtcaagagagagggcaggaatggtaactaaatggaatgagaagagtggatacggttgaagtttatactagttcctggggcaggtgcctagaaccattgaccataaatggaatggaggaaggaagatgagtaataaatttgattttagatgcatgatgcctgggatgtttaagggatgagtggatgaccacgatagccatcttcataccttctttggtcacatgtacctcctgaaaaaatcctggaaaactatgtacctcctgcatatatacatatatgttttaaatatatatataatatatatgtattttatatatatgtgtgtttttattttttatatatatatgtgtgtgtgtgtgtgtgtgtattttagaccaagtttcactcttgtcgcccaggctggagtgcaatgacacgatctctgcaatctccacctcccgagttcaagtgattctcccgcctcagcctcctgagtagctgggactacaggcacttgccgccatgcccggctaatttttctatttttagtagagacggggtttcaccatgttggccaggctggtctcaaactcctaacctcaggtgatccacccgccccagcctcccaaagttctgggattacttgagccaccacgcccggccataagcatacattttgattgagaatgtatctcttaatgagataggccttttgtttgtttgtttgtttaagagatgaggtctcgttatattgttcgggttagtctggaattcctggcctcaagtgatcctcccaccttaatcttctaaatagtgtggactacaggtccacacccagctaggacttttgttgttcacttagttgacatatctggatgaattgggtccatttatatttcttatttttatggatgtaagcactaagaaatattgctcacataaacatgtagatgggaatggaaggcattttttgtagctgtaacaattatttgaattccttctgatgtatatgccaagattacgtaatgatcagtcatcaaaaattatttttaattatctgtcaattgacaactcaattaggtctttcaaatttgtggtaagcaaagaattggaaactctctgggaaaataagcaagatcaatcgttattcactttactttttctaggaaaaataccctaaaaaaaagctttaccaatacttacctaatgactattaagtagtcttattattctttcaacaagaatcttgttccctgtatccaatatgtatggaagagttggggaaatcaaaatactgttagtttcagtatacctttccaatatgatatttttgacaaaatacttttattgtgtgatacgcttttctaataacttttttgttgttgttttttgagacagagtcccaatctttcacccaggatggaataagtacagtggtgcgatctcggctcactgcaacctctgcctcccaggctcaatttatcctcctgcctcaacccgccaagtagccaggactacaggcgtgcaccaccatgcctggctaatttttatgttttttgtttgtgttgtttttttcgtagagacggagtttcaccatgttgcccagactggtctcgaactcctgagctcaaaggatctgcctgccccggcctcccaaagtgctgggattacaggcgtgagccaccattcccaaccatattgtgtgacatacttttaaatagagttttgtcaaaactgtggctatagattagctctttccaaaaatgggaaatgaccaccatataacctaattggtaaagccagtctttattgctaaattagacttcttttctttgtgggttttgttttgttttgttttgtttttgtttttgttttggagatggggtcttactctcactatgttgcccaggctggtcttgaactcctgggcttaagtgatgttcctgccctagcctcctgagtagctgggactacaggcacatactaccatgcctggctggcttcattttccttttcttttttgaggggggtggggggaatggagtttcactcttgttgcccaggctggagtacagtagctcaccgcaacctccacctccgggattcaagtgattctcctgcctcagcctcccaagtagctgggattacaggcgcccgccaccatgcccagctaattttttgtatttctggtagagacagggtttcaccatattgcgcaggctggtcttaaactcctgacctcaggtgatctgcccgcctcggcctctgaaagtgctgggattagaggcgtgagccactgcacctggcctcatttttcaattcacataaactatttagtacacatcccatgacaactattgtcaattccaaaagcaacaagctgagctctaattgactttgtttcctcacacaacactttgaaaagacatgagtttgacaccccaaacaggataatatttaccattttaatggtaatatccagcagaaccttagacaagaaacagtagaatctaacttttaagaaaactttattaaaatgtaattcacacactataaaattcatccatttaaagggtacaatttagtgggttgctttttttctgtattttcacagaattgtacaaccatccccaatatctaagtttacagcatttttatcaccccagcgagaaacctggtacccattagcagctgctccgcatcttctccctcttgtttgtgcccggcttctttcactgagcgtagttttcaagggtcatccatgttgtagcattggtcagtaagtacttcattcatttttatagctgaataatattgcagtgtatcagtattttgcattttatttatccatttatcaattgatgggaactgtctgtaactaggtatttggtaattccaaacatcttattttccaacaggcagagtaagatttgttacatgtaataaactccaagggtctattaactttttcattataacaaattgtgtaaatattgctttcagttagttacccacagtccttttgcagtagagatagttgtcttggttttaattggattcatgatctacaactttatgttctaatctcatgtcatttttattatttttagtaaaagtaatttgtttgactaaattaactggtaaacagttctgagctttttcaattgtgtctacaaattttaagaaattcagattatgtgccagatgtttttagtaacagctttgttgcggtataatccacataccatacaattcccatatttaaaaagtacaattcaaagtttttagtatattcagaattgtacaaccattgccagagttttagaacatttcatcaccctccaaaaacacccatgcccattgcagttcaatctccttttcccctcacatccccatcctgccagccctaggcaaccactaatctgctttctatgtatagatttgcctactctgggtatctcgtgtaaatagaatcatccaatatgtgatcttttttgtgactgtctacttagcataatgttttcacggtttattggtgaataatattccattgtagacgtctacgacattttattcatcagttgatattgggttgtttccatttttattttttactattatgaataatgctggtataatcatacatgtataaatttttgtgtggacatatgttttcatttctcttaggtatatgcccaggagtgaaattattgggtcatatagaaactctatgtttaaccctttcttttttttttttttgagacggagtctcactctgtagcccaggctggagtgcagtggtgcgatcttggctcactgcaacctccacctcccaggttcaagtgattcttctgcctcagcttcctgagtagctgagactacaggtgtgcgccaccacgcccagctaattttcgtatttttagtagagatgggggtttccccatattggccaggctggtcttgaactcctgacctcatgatccgcccaactcagcctcccaaagtgctggaattacaggcatgagccaccgtgcccagcctatgtttaacgttttaaagaactgtcgcactgttttccaaagtggctgtgccattttacattttcactagcgatgtatgagggttctaattttttcatatcctcaccaacacttgtttttgtctctctttttgacccaaagatttttttaaattaataaaacacttttctgaaaataaatatatttttttaatgtgggaaaaagcaataaggccattgttatgcccagtcaccatagcattcctatcggtggagagactcatgcaccgtttccaacttaagcccaaatcaactcaaatgcattttaagattttcttcatcatttgtattcctagacaattctttaatctactaccttttttgccacaatctgctacacattctgccttttcaagcactaaaaggactctaggagttttttgcaaagaaatgctgtcataagagtggtggtatcaaagtattgtttaacggtagtctcaaagactttcagggtaatgcattctgtgattatagagatgaaagaaacaacatcataaagtgaaggtcatcttcattcccaccaccttattctcagtatatctgaaatcagaacatcctaataaggaccaaaatactttgttcctagttattcttcacccttaacagaaataagtaaaacaccgaaagatatgaggccctcctaccaaggatttctagtgctttaattaaagaaaatttcacctacactcatactatttttcagtttgctttgtttggtgtcctggaggtttttacatcctggaacagtgcacagtggtaaaattcagaatggatgaaaagtaggattggtttgtttgttttcaggaagtgaggcaatcgtaaaagggaaaaatgggaaaggcgaaacaagcaggatgtctttttttttttttttttctttttagacagagtctcactcttcgcccaggctggagtgcagtggtgtgatgtcggctcactgcaacctccgcctctcaggttcaagcgattctcctgcctcagcctcctgagtagctggaattacaggcacgtgccaccatgcctggctagtttttgtatttttagtagagacagggtttcaccatgttggttaggctggtttcaaactccagatctcatgatctgcccgccttggcctcccaaagtgctgggattacaggcgtgagccaccgcgcccgtccaggatgtcttttttctaattagagacgagggtctcactttgttgcccaactggtcttgaattcctgggctcaagtgatcctcctgccttggccttccaaaatgttgagattattgatgtgagccaccacccctggccagaatttcttgtctgtgggagcattctcagatcagtcttatgaaaaaggacagccagcccttcctatctgcagtttctgcatctgcagattcacccaactgtatatcaaaaacatttgaaagaaaaatagtttctgaaagtttcaaaaagcaagatttgaatttgctgagcaccaagcgctatgctgtgtccacatgaatgaagtgatgtgtaggcatactctgctgtatcctcccgccaggacagaagaaaaatgtcacatagttactgacagtacagtgtagcaactatttacatggcatttatttaatacattgtattgagtattataagtaatctagagatggtttaaagtgtgcaggaggatgtgcataggttatatacatatactacaccattttatatcagggacttgagcatccttggatttaggtatccgaggaggccctagaaccaatcccccatgggaaaccaagggatgtgaaaattgagggtctgaatttgtttaagattcacagaacagactgaaaagacaagagaggagataatggagagaacaagctcactgaggaagtgggcgggaggaaatggggcaagaatagtagaccagaggaagaggaggagcacatctgtctcagagtcagccacattttatttggggccaagaacaaaaataaagtgactgtaatcagtagggctttaactccttctgctgtcctgcagttagctttttatgtatcctggggtgtccaatcttttggcttccctgggccatactagaagaagaacgattgtcttggaccacacataaaatacactaactggccgggtatggtggctcacacctgtaatcccagcactttgagaggccaaggtgggcagatcacctgaggtcaggagtttgagaccagcctggccaacatggtgaaaccccatctctactaaaaataacaaaaatgagctgggtgtggtggcgggcacctgtaattccagctattcaggaggctgaggcaggagaattgcttgaacccaggaggtagaggttgcagtgagccaagatcgcacccttgcactccagcctgggtgacaagcgcgagactccctctcaaaaaaataataatacactaacagtaacaatagctgatgagctttataaaagaatcataaaaaatctcactgttttaagagagcttatgaatttgtgttggaccacattcaaaaccatcctgggctgcatgtggcccgtgggctgcgggttggatgagcttgagtacctggtcaaaatttgggaacattgatggcctaaaaatacgtatatttcctgtgtgatttccttaatattttaaataatgttctaaccatctctgcttttagtcagcctcatcttggagtcaagagactgggctcctgacttactttgtctttctatatgttttctcttccacaatcctaattttttgtcatctagtcccataaacattccctctttatcaccattcttttctttaacccttagccttacttccatttcagtgttctattgtgtaagctgctagcgacaatattcaacttaagactacttggtaggctgggcccggtggctcatgcctgtaatcccagcactttgggaggccaaggcaagtggattgcttgaggtcaggagttcgagaccagcctggccaacatggtgaaactctgtctctactaaaaatacaaaaattagctgggcgcgatggtgggcatccataatcccagctacttgggaggctgaggcaggagaatggcttgaacccagcaggcagaggttgtagtgagccaagattgtgccactgcactccagcctgggcgacagagtgagactctgtctcaaaaaaaaacaaaacaaaacaaaacaaaaactacttgatattagcttgggctgctatgacagaatactgtagactgggtggcttaaacaacagaaatttatttctcttggttctgaaagccaggaagtccaagatcaagatgctggcagatcccaagtcagatgaagtccctcttcctggtttgcaagtggtagtattctctttgcatactgacatatgcgggtggggagagccagcaaggtctctacttatttttgagcacttatctcattcataactccacccctcatgacctaattatctcccggaggctccaactcctaataccatcacactgggggttaggattttaggggggacacatgtagtctataacaatacctaaagtcatattttctcataataactaaattttatgtttgggacttttttaggtttagcatgagctttaacagacataatctgaaatactatgtattaccgaaaaagcctaaaaaggtggcatttgattgcctagaatggatcagaaagcaccacccatgtgagtacagccatgtgattagctgtctagaagtaacaaatgtctttttagtaccacaataagatatataaaattgcatattaaacattcctttttgcattatgacagcactaacttgctctttatagagcagactattgcaactctctcaattctggaaattataaaatctcatttggtttaataacaataaattctaacaaaaatatattaaatactccctcctacacacgtatattataacttttggtttcaatgtctttcctcaggcttctatcagtgtttgaattatacagctttttgttttagtgccttgtcccaagcctgtctgcctttgcattatgttaactaaaatgagattctgaaattcatagtagttttccatgtaaccccctttccacttttccatggagaatatttttggtatttctattttattttttagaaattagtatacatatttgtgtggacaaatcagtcagtagagatctaccaagaaaaagtcagtgatttccccgctcagactcacctcccccaggcagctaatgtcaatagcttcatgtgtatatctagacctttggctcagtcacagagagatgacttttcctttaatatcttttaatttccatttctaaaaataacacacataataataaatataatatatgctcattaaagaaaatttatatggccaggcactgtggttcacgcctgtaatctcagcattttgggaggccgaggtgggtgaatcacttgaggtcaggatttcaagaccagcctggccaaaacggtgaaaccccatctctacaaaaattatccagacgtggtggcacgcacctgtaattccagctattctggaggctgaggcagaagaactgcttgaacccgggaggcagaggttgcagtgagttgagatcgtgccactgcactccggcctgggcgacagagcaagactgtctcaaaaaacaaaaaagaaaatttagaaagcaacaaaaagaagaaacaaaagacaaacatcactcaatgagcaaaatcactgttatgttattattaatttctagtatttttctatgcatttttttctactagcatactatatacgtttctaccgttaatctactttatatatcatgagcattttcccatgtcttttaaaaacttagaaaacacttttgatagttatagtatattttatttcacagttccctgtatttgtttccctaatgttgctcagtaaaatctttgtaatttttaaagtttgaagtaaaacttttgtttatgtccttgtatcactttatttcctaatttcccagaaagaaactgagtcaaaggtatttctaagactcttgatacatactgccatatgcttttgacaaagtttgtgcaagaatggcttttcttttttttttttttttttttttttgaggctgagtctcactctatctccaggcaggagtgcggtggtgcgatctcggctcactgcaacctctacctcctgggttaaagtgattctcctgcctcagcctcctgactagctgggattacaggtgcccaccaccacacctggctgattttttttgtatttttagtgaagatagcttttcaccatgatgtccaggctggtctcgaactcccgacctcaaatgatctgccctccttggcctcccaaagtgctgggattacaggcatgagccaccgcgcccggccaaggatggcttttttatacccacatgtatctagtgtgaagtagagcccagagttcatccaggtccacctcacgagtcattagcagcgacaggattaaaagccacatctcatttccagcacacatgaattccttgcttgaattattcacgtgtgtggtcttccagcagtataagaacactacgggagatctatttatggttcatatatttctgaaaatgtagtgtaaattgtgtttttgtttatgttaaaaattcttgtttctcagtactcttggtttcttggcagatgattcagggataatttactgcctctccaggcgagaatgtgacaccatggctgacacgttacagagagatgggctcgctgctcttgcttaccatgctggcctcagtgattctgccagagatgaagtgcagcagaagtggattaatcaggatggctgtcaggtaacatttttaaagataaacaaataatagaaataatcttttatagcatataaccaaacatgcacatgtagaatgcaaactgtttttaccttgaaggtagtaaacatcaaaataagactgaaatttaaaaaacagattttctttgagacttctaaagttgctttttctttcataaaaaaaatctgcttgagatataattcacatatcataaaatttatcctttcaaagcaaacaagttagtactttttagtttatttgcaaagttgtacaataatcatctctatctaattccagaatttttgatcaccataaaaagaaacctcatacccagtcacttcccccaccccctaatgcctggaaaccacaaatctactaactactgctaacctgtttctagagtttattactctgtacattgcatgtaaatagaatcatacagtatgtggtctttgtgacttttcttttttttttttttttccggagacagagtctcactctgtcgcccagactacagtgcagtagagagatcttcgcttactgcaacctccgcctcccaggttcaagtgattctcctgcctcagcctcctgagtagatgggattacagatgtgcgccaccatggccagctgatttttgtatttaatatttttagtggagactcaaactggtctcgaactcctggcctcaagtgatccacctgcctcagcctcccaaagtgctgggattataggcatgagccacctcgcctggcctgtttgcttttatttagcataattttttcaagatttatccatattttaggatatatgagtacttcatacctttttatggtcagataatattctgttatatggatataacacagtttgtttatctactcatcagctggttagacatttggcttgtttcgtttctttctttttttttttttttttttttttgagacagggtcttactctttcattcaggctagagtgcaatggcatgatctctgctcactgcagaccgtacctcaaacaatcctcccacttcccaagtagctaggacgacaggcgcaccactatgcctggctaatttttttattttttgtatagacgaggtctccctgtgttgcccagcctggtcttgaactcctgggctcaagtgataatcctgcctcaacctaccaaattcctgcgattataggtgtgagccaccatccccgatgtgtttctacttcttggctactatgaataatggctttgtgagcattcacgtacaagtttttccacggacatatgttttcagttctcttgggtagacacctgggagtggacttgctgggtcaaatggcaactctttgtttaacttttagaggaactgtgaaactgcttttcaaagtggctctgcagttctgcattctcaccagcaatgtatgaggtgccagtgtctccacgtcttcaccaatattttttattgtccagcttttttaatgtattcatccttgtgtgtgggaaatggtatctctttgtgggtttttttttatttacatggaagaccacacacgtgaataattcaagcaaggaattcacgtcacccaggctggagtgcagtggcgcaatcttggctcactggaacttccgcctcctggttcaagcaattctcctgcctcagcctcccaagtagccgggactataggcacatgccaccacacccagcttatttttgtatttttagtagagacagggtttcaccatattggccaggctggtcgtgaactcctgacctcatgatccgcccacctcagccccccaaagtgctgggatgacaggtgtgagccaccacgcctggccctctttgtggttttgatttgcatttccctagtaactaacaatattgggcatctgtttccgagatgagaaatttgccgtcacccaggtgggtggggaggaaagctgaaaatactttaggcatctcttttttttttttttttttttttttttttttgagacgggagtctcactctgtcgcccaggctggagtgcagtggcgcgatctcagctcactgcaagctccgcctctcgggttcacgccattctcctgcctcagcctcccgagtagctgggactataggcacccgccaccacgcccggctaatttttttttgtatgtttagtagagacgagggtttcaccacgttagccaggagggtctcgatctcctgacctcgtgatccgcccgcctcggcctcccaaaatgctgggattacaggcgtgagccaccgcacccagcctactttaggcatctcttattgtggtaaatgccagccttggatagatccctctaaatgaaaggatgaatttcagcaaaacaactaataattacttggagccaatgaaaagtttcagctcaggaaaaagtatttactttgaagattcagaggaaaaatatctctcaaaattgttttctctgggaaaacagaaaattttagaggatatcagtttagtatcccgagaaagatataagaagacttaatatacgtgaactagtaacaacttccataagatcacagggtgagatgaagggagaaataaaaatccagtttatggccaggtgcagtggctcacccctgtaatcccaccactttgagaggccgatgtggacggatcacctgagatcaaggagtttgagaccagcctggccaatatggtgaaaccctgtctctactaaaaatacaaaaattagccggacgtggtgatgggcatctgtagtcccagctactcaggaggctgaggcaggggaatcacttgaacctgggagccgaaggttgcagtgagccgagatcgtgccactgtactccagcctgggaaacagaacaagactctatgtcaaaaaaaaaaaaagaaagaaaaattcagcttatccaagtaagaaaaacaaaactaagagcagaattatatattaagacacaaatggaatgactcagtctcagtggagacaatagaatcagtgatgtagtgagtagcttgagaatgcaagggaaaaaagagattaaaatggggtggggtggaaattatctttgttgacaaaaggaggtaaggattcagcctaagaatagtaagtgtacccaagcaagaaagcaggataattgaaacagataagtgtgttataaataaatacataacaaatatataacaaaaataatagaagactgtcttcagaattggaagaaggaagactgggactgaagaatttcgtacccagctcactgtcatttatgttgaaaccaacaaaaggtcattttcagatatgcaaaaagtttagaaatacatcactcatttgtcttcactgaaatactgattttagtcttcccaaattagtttatatatttaacccaaatgccagtgttttgtttttttttttttttttttttttggttttttgttcttttccctttgataaactttttctaaagtttgcctggaagaatattcaagtgaaaataactaagagagtttggcaaaaaacctaataatacaggaacactagtttgcagtacattataggcagatcagtggaacaggaaaacatgtaaaaacaatacatgataaggaaaaagtttgcatgaaagggccaggcatggtggttcacacctgtaatcccagcactttgggaggccaaggtgggaagatcacttgagcctaggagttcaagaccagcccaggcaacatggcgaaaccccatctctacaaaaaatacaaaaattagcctggcatgctggtgcacacctgtagtcccagcttctcgggagtctgaggcaggagaatagcttgaaccctggaggtggaggttgcagtgagccaaaatcacgccactgcattccagcctgggcaacagaccgagactgtctcaaaaaaaaaaaaaaatgatttttttcaagtgctttaaatggttatgtatagtataaataatctacaatggagatatatatatatatatatataactttgataaaaaatatggttaaacaataggggtttataaaaacctaattatttctgctctcagactaattaatccttacagtcagcatgtaatattagcctacaccagctcgacagacttgatctcgttagattcatgagatagaataaaacttggccattattcttcacaaagaatgattgtggcttgaagttttaaaagcgcagaaataaagaaggaaatcacaattaaacaaagccacttttcccaatttcaagaaataagagctttcagaaagagttggcagccttgcatcctcatctggaggctgcaggcggtgcctcacagccctgtgcccgccctgatactgggagatgcacctggacttcatggaaccctgtgggtcatgcttccggacctgtcggctgacacatcttgctgtgcagcttctccacctgctctccatcactagaagctacaatagtctttctgtttccaaggagatttgcctttgatcagagtgccataaatgtagatggatgactaaccgagagcgcaggccactcaccgccattcctggtgttgataaatgtacccctttactgtccacatactccagagcttgcagttccttccgctggtactcacagttactgaaatcatgtcattagtctcagtctgcctgccagatatttcagatgcctttgaaatactgttcttgcagtagcaattcatttttttaagtgctaaaaaaaaacttgcagttttatttgtgaagtgtaattttgcctggagatataacattttggtctgggttaaatagctcctaaattctcaactgaaatggatatccttgaaaactgatttatcaagctcctgagagtgaactatcaccttgcttccactaagtaatttgtaaggtctaagatccgcagtccctggtgttttttttttttttttttttttttttttttttttttggtataagtagctctcagacttttacccacatgagtttccattaaaattgtacaagctttgactttaaatcagctgatgaatagaaggagttgatgtgtgatcagctggtgctattgggaaaactgatgataagcagtggagcaggtaagaacgtattgttcctgaaccattggaggaactagcagcagtgacctctgaggagccctgggaacaccctggagctcctgagcaacacgttgcttgtgatcactgacctggatatcatgactgtgtgagcaacaccccccacacctcagtagcaaaaacagagaacagtggcagcacatcgtgggctgactgcagttgattctggctctcttacatgagaatgccaagtcatacaagaaagtgcctgccatgctgagcttctctttaccttcttgggttttaatggcattgcaagttatcagtataaaaactcatattagttatactaaatagttggaccaagttaagatattaggttgttatgtagtgtgcattttaaagtaaaacaaatgatagagcttttagaagcatctattatgaaaatgttccttcaagtctgtgccttatgaatctaataagcttttgcttttatatcaggttatctgtgctacaattgcatttggaatggggattgacaaaccggacgtgcgatttgtgattcatgcatctctccctaaatctgtggagggttactaccaagaatctggcagagctggaagagatggggaaatatctcactgcctgcttttctatacctatcatgatgtgaccagactgaaaagacttataatgagtaagctgggctccattgtagagacattctgtcatcttcagcctcatgatagtagtctactcctgctattgtggtacttctggtccagttttccttaaataatcgtagaaaaatagaggagtttatacagattggcaattttattttagttcatttttattataaaagtggtaagtgcttattttgtaaaactcaaatgatacagatgtgtacaaggcagaaaatttacaaaccatgccttgtagttttgcccccaaaataactctagttattggtttcctttgtatcctttcagaccctatttctgcatgcattcttgcatgtaacacatatttcaaacatgcaggaagataaaaaggagaaaataatgagctgtcatatactaccatctggattaagaaataaaacacaatcaatcgagctgaacccctccccaccaccccatagcctctcttgtctcatccgtcctctcccattagaggcaggcaaatatcttgtatttggtatgtaccttttccaaatgcacatattttaaaatgtaaatgggattatattatacatactttatatatataatgacccgatttttttcagtcaacagtaggatgtaattatcattccaatgaatacatacagcctgactacctagaattccgtagtatggttattccatggttattaaactaatcccctcttactagatcttgtttattgtttttcactgttatcaacaatgcagtattgaacatccctccctatacaaatatctttgggcatttttgcagttacttatataagattttttttttttcaagaccgagtctcactctgtcacccaggctgcagtgcagtggcagaatcttggctcactgcaacctccgcctcccgggttcaagcgattttctcacttcagcttccagagtagctgggactacaggcatgtgctaccatgcccaactaatttttgtatttttagtagagacagggatttcaccatggtgtccaggctggtctcaaactcctgacctcaggtgatccgcccacctcagcctcccaaagtgttgggattacaggtgtgagccaccacgcccggccttataggataaatttctagagttaaacttgctgggtgaaagtgaatacatattttagaattttattacattctttgctcatttttctcctgggttgtgagagttaaatatatttcctaaatatatgtatttcttctgagaccacttttttttttcttttttttttttttgagacggagtctcgctcttgttgcctaggctgaagtgcaaaggctggaatgcaatggcacgatctcggcccactgcaacctctgcctcccagatgcaagcagttctcctgcctcagcctcctgagtagctgggattacaggctcccaccaccacacccagctaatttttgtatttttagtagagacagggtttcaccatgttggccaggctggtcttgaactcctgacctccagtgatctgtccgcctcagcctcccaaagttctgggattacaggcgtgagccactatgcccagccgagaccacttttaaattaactctggcagaagtacagtgcataggaaatggcacttaccaagcactgtgcccaacactgcatatatcacctcattaccttatttgttcaaaacaactaacttgtgatgtagaggtactcccataaaaagtgagcttcggaaaggttttgtaacttttccccaggatcactgatatggcaggagcaataagagtcgttgtagtagtagtataacaatggtaattattatagataagtgtttatttagcccttcctatgtgccattctaaatgccttacatgtatcatcaactaatttcatcttcacaataaccctcagagataaaacctttgctttcctcattttacagaggaggaaaatgaaatgcagaactagtaaatggtagagccctgacagaacccaagttcgtctgattccaaagtccatgttccttgcactataccaaagtgattctcagtgaagaaaattaaatatttacacttggtttgcccatttgtgttttttttaaaatctatattaaagctaggcccaaacatggccaggcatggtggctcacacctgtaatcccagcactttgggaggccgaggccaaaaaaaaaaaaaatttaggcccaaacaatttaatagatatttaagtcctgatagcagcaactatttgggggaaaaatactcataaactggaagaaaaaaataatattttttaaaaattattttcttttttttttttttgagacggagttgcgcttttgtcacccaggctggagtgtgatggcacgatctcagctcactacaacctccacctcctgggttcaagcgattctcagcctcagcctcccgactagcagggattacaggctcgcaccaccacacccagctaatttttgtattcttagcagagacagggttttgccatgttggccaggctggtctcaagctcccgacctcaggtgatccgcccaccttggcctcccaaagtgctaggattacaggcgtgagccaccgtacctggtgttaaaattcttaagtaacaacagttgcttactgatggaaagtatgccactgctgttctcacacattggaatcaaatccgacactgccaccctcatttcctgtttcacattgattttcttgagatacttctttttatcatagcaactgcgaaaaacccagctttgcaaagatgagatattgctaataggaatgtagcacaatctaatgttaataccattaactacctcaagctaataatttgggtgatgttcaacagatgttaggcattgctgtgtttcccttcatgtaaaatattctgtctctgtgagttcaccacagcacccccgggcttgttggcacacaattttggaaccactggtgtaactactttgacctcagatactcagagaagtgcatggccactgccgtaatctcaggctctgcttcctcaggatgttcagttcggtggatgctcgactgataaatacagcaaatataagtcaaaccatcatcattggggataatgaagatttgaaaaaaaaaaacctaacatttattcctatagtactaaaatcttgaggatgaacattaatactcagttaattataatatagaatgccatgttgacaatgctgttaacagtaattttcttatttaatatttaaagttatatgaatctattctaaatatttctatgatatgctctatttttcccctataagtatgtcttactatagtcttcatctcttttagtggaaaaagatggaaaccatcatacaagagaaactcacttcaataatttgtatagcatggtacattactgtgaaaatataacggaatgcaggagaatacagcttttggcctactttggtgaaaatggatttaatcctgatttttgtaagaaacacccagatgtttcttgtgataattgctgtaaaacaaaggtaaaaaaagaagttttaaaattctttataattaaattttttttctcttactttaaaaatgtagatacaaattagattgcaaaaggtggtctccgacagattaacaggggaaagacagcttccttccagtagtaatttggaatggaaacatttaaaaagtaatttcatgcggtatcttttctttataattagaaccctgttaaaaaatataatggacatcagcatatccagaatattgagtttatatatgtgcactgatgattacagaatattttagaaatattaatatgcaaacatccaaaaagatccaacatgggcaggtagaatattttaaatttaatatattaatgttattaatataatacattatattaaaaatttaattgattaaattaaatatattaaaattgacgtattaatatttaatattttaaatatttaattaatatactaaaaatctcattctcaaaagagtaataactagtgtaccgtatgtttgaattcaaatcaattacattactctttttttttaactataaagaataacagtaactgcttgtggataaattcactattatctgtcctaaaatacccttggaaggttgttaaattcagtcattaggtacttattttacctatcttggtaattctacattttaatgtctactgtaacctactgcttactgagcattttcacgtttggtgtattatttacctatctgggagtattagacttatatgtgcaagatgctggagagccacaagtgaccatggtatggaccaattcatagactggagtggagaccgacatacatgtgttcatagaagtttaacactctggcttggcgcagtggctcatgcctgtaatcccagcactttgggaggccgaggcaggaggatcacctgaggtcaagagttcaagaccagcttgaccaacatggtgaaaccttgtctctactaaaaaaatacaaaattggtcggctgtggtggcccatgcctgtaatcccagctacttgggaagctgaggcaggagaatcgcttgaacctggtaggtggaggctgcagtgagccaagatcatgccattgcactccagcctgggcaacaagagcgaaactccatcaaaaaaaaaaaagtttagtactctcagtaagtatagttaaaaaatacagagcacagggcagaacagagggtagtctctctcagtgtggaactggcaaattcatgccatctcctcccaccccaccccatcccttaaacattgctatcagttccctcattcaacagatatttgttgggctgtgtaacaggcactgttgtaggaatttgggatacatcactaaacaaaatgaaaatccctgcccttgtggagcttacactctagcagagggaggccagttacaaacaatatacacaataaatatacatgaaaggataagagctgtggtgaatggcacagcagagtaaaaagacaggaggaatgggtagagtgcaggatgcagtattagacggggtggtccttggaagtctaactgagaagatgggagctgaggaaaatcttgaagaagggagttagctggcagctccctggatgtgagctttcctgcaagaagctttggctagagcaaaggccctaaggtgggggtgtgcctggtgtgttcgagagatggcaagggagcccatgtggctgagcaggattaagagccagtgaggggaagaggtgatggagagccagagcagtcagttgagggctagagtcccagagtaactggaggcctgagtaactggaaggatggagttatccttggctaagatgcagaaggctggttggcagagaagatcaggagtttggtttgggttacctaaattgggaatctaatattgaattacatattaagattcaaaaattctgaaaacagactggtggcacatgggtgatatttaaagcatggccatcagctgacagtcgggataagagaagggacggaagagaaaggagaaagtatgaaatagttgtctaggacaggggtcagtaaacttgcttttaaagggccacagcataaatattgtacacttcgcagccatagtctctgtcacaacgactcacagctttgccattgtagtctaaatgcagacataaataataaatacaccaattttctagtcatcttccatggctgtgttccaataaaactttatgcacaaaaacaggcatccagctcctgggccatagtttgctgacttctgttgtgagagaatggaggaatgataggctagggaagtataaagataatgattgcctacagcattaacagtccattcgagctttgtggccacgtagtgacagtgaaaatgccaagttcagccacataggtacagggacctatggagatggagaattggatccattatgttttgccaggtaatatgttgaagtgatctaagggcaagagagctgagggtctatgagaggtagtgattataatgatcgactggaatttcagctgagttaggaggacatctgaggttgaggatcagcagatgggcattcccaggggattgttggagtcagaataccacatggtatgagttggaaagataggatgtggtggtctgagaatggaggagttgccattattagtaagcttaaggtaggaagtgtgagcggctgatgtatgtggaggacaggatcattggagcagaggagatcaagaaccaaaagaccaaagtaagaggatcagctctgtatacctaatcaccaagaattaaggtagatggccaggtgcagtggctcacacctgtaatcccagcactttgggaggctgaggccggcggatcacctgaggtcaggagttaaagactagcctggccaacgtggtgaaaccccatctctactaaaaatacagacaaattagtcgggcatggtggcaggtgcctgtaaccccagctactcaggaggctgaggcaggagaatcgcttgaacctgggaggtggaggttgcagggagccaagattgcgccatcgcactccagcctgggcgacgagcgaaactccatctcaaaaaaaaaaaaaaaaaaaaaaaaaaaaaaattaagataggaatggagtgacagggcactttttcttgatgactctagatagggcctcagaatcacttgcagttgttagtgtaagaccagaaacctgttcatctccaggttattggtgtgtgcaaatgacaaggattagaaggtagggagggctgcatacacagaagcaccaagcatgatgcagctttttacacctgtgagtggtcagtattgatggtagagagaactaggggagagaaaggcaaaaagtcatctagtaacggggactctaaaaagtgggcaaagtttggggatagctgaaggaaatgagaaaggaaactagcaggagatgatgaaaagagcgttgactatggcaccaaagaccccagaggggttagaatccgtggatttacgtggcaccccacaggttcccacccagtatgtaacagagcactattctaggaggcatggaggatttaaattgtgtgtttgtgtgtgtgtctgtgtgttatatatgtgtttctacccacagagtgctatcaggtagttgaaagacaagacgtatctctgtgaaacagtaacaacatcgagtggtagttgttctagaacttagataagaatgaacatttgaaatttccgtaggttttggtctcggtattggtctggaaatgggttatgatgaatctactatagttaatattaaaccctagtaatctaggcattgttaccttaattatagcagaaagtattctctttttattcataggattataaaacaagagatgtgactgacgatgtgaaaagtattgtaagatttgttcaagaacatagttcatcacaaggaatgagaaatataaaacatgtaggtccttctggaagatttactatgaatatgctggtcgacattttcttgggtaagtcatctgttttgaatgtttgagttacttcaattgaaattgaacatctaaagaatttattacaagtacatagaaaaactttttgtctattttcttataaaacttgagtttctgaataaaacttttaagtaacaaaagaaagtcaattattatactgttttatataatgtatatgtcactaagttgagatggtttcacatacaaagaagaaaataataaagcttatgcgagttcatctgagtgggtggaatgtaactattaaaatgtcagtaaggaaataaaatgaggattagacccataacagcatagagaataggagagagactattatcagattagtgccttaaaaatctctcaggggctgagcacagtggctcacacctgtaatcccagcactttgggaggccgaggcgggcggatcacctgagatcaggagtttgagatcagcctggccaacatggtgaaaccctgtctctactaaaaatacaaaaaattagccaggcatggtggcatgcacctgtaatcccagctactcgggaggctgaggcaggagaatcgctagaacccgggaagtgaagactgcagtgagctgagatcgcaccattgcactccagcctgggcaacaagagtgaaactgtgtctcaaaaataataaataaacaaacacacacaaaaattagccaggtgtggtggtgggcacctgtaatcccagctactcgggaggctgaggcaggagaatcgcttgaacctgggaggtggaggttgcagtgagccgaggtcacgccactgcactccagcctggcaacagagtgagactccatctcaaaaaaagaaagaaatggacagtaaagaggaagaccaaataaatagaatatttgaccctgggtgatagaaataattgaaaatagtagtttgggagagaggggagagaagactccttagtatcgtcttaaagagtttttaaaataaatacttaaataataattgaataatggaaaagaaataaaaatgagaaagagctgtcaattttaaatgattgacaaagtaaatttagtggagaggttggaaaataaagtcaagaaaatttaggaactgatcaaaatgatatatggaaaatagagaaagcatagaaaggattaatcctcagtagatgtaaaatctgacaaaaattttggaaatagaaaataaagggaattatcaaaccaatgatctaggaaaacttcctagagtggaagagataaaagttttggattaaaatgctcactgaatgccaaataagatgcctgtaaaaaaaaaaaaaaaaaaaaaaaaattaagacatatggccacgagatttgagaatactaagagttaaagacatgtcaaagaggaaaaacttttcctcaaccctcttaggttcagtgatggggcctgcaaattaaaccaacaaaaaacagattagcaagggaaaagacagatttagtcatgtgtggataggagttcacagaaaaatgtggttcaaaggggcagttagaatgtggggcttatataccatcttaatagaggaaggggagaaggaggggggcacttatggaaaaacaaatgactgttaggaaagacagatggactgttaggagaccagatgggagatacaaagtttttatgacaatgtctgtttaagtgtggtgtgaagtcttatctctgtttaaaagggtcagccttccctggtttttcccagggaggcaatttatgacaactgagttcttttgggaggccctgctttttggcagataagagatttcagatgccttctgctcaaaataatttttatgccacagtggcatattctggaccccttcagagacaattctgaaagctctggaaagaaaacaggaacccaaaccagactgacatcagcttaatatcagcaatcctggagactagcaggcaaagaaagtgagcacaggtcgtgatttgataagtggtggaacccacccatgggtccagtgaagaaaacccatagtcacagtcaggcagcagggccagtaagcaatctatgcagactaacaaaagtcaggaggaggctgggcacggtggctcacgcctgtaatcccagcactttgggaggctgaggcgggcggatcacaaggtcaggagttcgaggccagcctgaccaacatggagaaactccgtctctactaaaaatacaaaataagctgggcgtggtggcacacaccagtaatcccagctagtcgggaggctgaggcaggagaattgcttgaacccgggaggcagaggttgcagtgagccaagatcgtgccattgcactccagcgtgggcaacaagagtgaaactccatctcaaaaaaaaaagaaggaacagggcccacccaacgtagagagagagtaagaaaggaatggttttattgataacagtgaagaatgcaaatgttacttctcaaccaaaaaaaaggagagaggcccttagaaactccagggaaaagattatacaagagagcaagatcaaatataaaacaaaggaagttgtggccaggcacagtggctcatgcctgtaatcccagtactttgggaggccaaagtgggtggttcacttgaggtcaggagtttgagaccagcctggccaacatggcaaaacctcatctctacaaaaaaatacaaaaattagccgggactgatgttgtgcacctgtaatcccagctacgcaggaggccgaggcagaagaatcacttgaatctgggaggcggaggttgcagtgagctaagatcgcaccactgcactccagcctgggtgacagagcaagactccatctcaaaaaaaaaaaagttgtaaaaaaaaaaaaagttggtaaaatgtacaaaaaagtcatccatttgacatgatgggtaaacattctccttttggttccataagagtcatgacattgttccaattagggaaggaaatttgtcatcatgtaaacaacgattgaaatcaacatacagacctaaacaaggttacaggacagaacaagatgtaaatgttaatattgatgatataaaagtaaaagtacaatcgctaaaagtaaaagaaggcatacagggaaggcttgggtactaatgacatctcacatgtgggaaggggtagtggtcagaagttctattgaaagttagaaacataattagtacatgacccaacagtatcatataactagcaaaattcagagaagaataaaacaaagtgggggtggtatgaatgagataaaacctcatctttcataataaaggggcaaggacaatagataaatgtcaggcttttggacagaaggcaagatttcaggtccttctgtgtgtaggtagccacctgaagagctgaaaacaaaaactgtttaaaaagcgattcccttggggaagggaaggatgagtcaggggaatgttgcttttaattataaacctttctgtctgggtacagtggcccatgtctgtaattccagcactttgggaggccaagacagacggattgcttgagcccaggagttcaagatcagcctgagcaacctggcgaaaccctgtctctaccaaaaatacaaaaattaatcaggcatggtagcacgcacctgtagtgccagctactccagaggctgatgtgggaggatcacctgcgcccatgagatcgaggtggcagtgagctgtgatcccgccactgcacccccagcctgggcaacagagcaagaccctgactcaaaaaaaaaaaattgtatttcagccagctttcgtagttgtcctcagcagtaaggttggtccataccattcagcctatcattagcagaacggtagttctgtttctataatgtggcctttcagggatacaaattacttaaagaaaattttgaataattcaggatatatggccagaagccatttgaaatggacaataatataattatttggaactctttaaaacagagctaaagctttacgtaataaccattaattctgatttttataaatgtcacaaggtctcttaagtagattgttacaataaagttgtgtttataatgaagacattagcagtcacagcagcttatgaatgaaacaaaggatccagccaactgtggctctcggctagtaagagaaagagggaagtgtgtgtacatattcctgtcttcatctctccccttgagcatcttatagggtgttgtgcttttcttttagaatttgaataggcttcattagtgagggtgacaaaaagaatagacttaaatacttggattataaactagtagcagttttgataaccagggccagggatcatatttagaaaactgactgtcaaaaattgtttgtagccaggctcagtggctcatgcctgtaatcccaatactgtgagaagccagggtgggaggactgcttgaggccaggagttagagaccagcctgagcaatgtagtgagaccctcgtctctacaaaaaaattaaatattataaaataatgtaaagagtgtcattggattgtttgcaactcaatggataaatacctgagggaatggatggcccattctccatgatgtgcttacttcacactgtatgcctgtatcaaaatatctcatgtactacacaaatatatacacctactatgtacccacaaaaatttaaaaattaataaatactagatgcacttaaatatttaaaatttttaaattaggtgggtgtgatggcctgcacctgttatctcagctagtcaggaggctgaggcaggaggatcacttgagcccaggagtttgaggctgcagtgaaccatgattgcaccactgcactccaacctccacaatagagtgagaccctgtctctaaaaaaaaaaaaaaaaatgtagataagtaatgcacagttatcctaatacatagcacagtgataggaagctattatggtttatgtaaactctttctttgatttatttgctccaatataattttgctgctgttttttgtccatgtgtattgtaaaaagataaggaaaagtacatacaaccatagaaattttagcgttctactcaaatactctcatttaacagaaatgagtgtctgtgccggggtttgtgatctattccatctgtccaaacctgtccataaatgactttttagcctcttctatttgagggtgatgatatacgtacatttactcatcttacttcctgtatcttcttatcagggagtaagagtgcaaaaatccagtcaggtatatttggaaaaggatctgcttattcacgacacaatgccgaaagactttttaaaaagctgatacttgacaagattttggatgaagacttatatatcaatgccaatgaccaggcgatcgcttatgtgatgctcggaaataaagcccaaactgtactaaatggcaatttaaaggtatagtatttttcatgtttattttattatctcacaatgagtgaaccaaaatatattattgtgaagtatagtgtctttgtccaagcttatagatactgaatttatatatactgttctatacgaacatattctgtttttcttaaattggaaagagatcttaaaattcaacccaagtaatatgacacctgtcaaaagtaatttaatgggttatcaggtcactaaatctttatatattcattaaagaagcatttatcaagaggctattctatgcttgacactggagatacaaagatggagaatgcacagcccctgttcccagtgggctcactatctgcatgacagaatagaattgccccccaaaaatgcaattaagcattaaataaagcccctgtatgggtacaagtgcacatatacccactcctatgatttgtttctctctcataaaggtagactttatggaaacagaaaattccagcagtgtgaaaaaacaaaaagcgttagtagcaaaagtgtctcagagggaagagatggttaaaaaatgtcttggagaacttacagaagtctgcaaatctctggggaaagtttttggtgtccattacttcaatatttttaataccgtcactctcaagaagcttgcaggtgggtacacatgtatcctttgttacgtggcacagattaataggccgaaagttaatcttgctagggaactccttaagtgataaatatatctcagtggtttgtttctttttggggtttgttttgagacggggtctcgctgtgtcacccgggctggagtgctgtggcatgatcatgactcactgcagcctcaacctcctgggctcaagtgatcttcccacctcaatttcccaagtagctgggactacaggtacacaccagcatgcccagctaatttttgtattttttcgtagagacagagtttcaccatgttgcccagtctggtctcgaactcttggcttcaagcaatcctcctgccttagcctgccagagtgctgggattacagataagcatgagccactgagcctggcctcagttgttttaattatttttatttaatctctggattaaaatctcagagaaacaattgaaacttattctttttttgtttgtttttgagacggagtttcactcttattgcccaggctggagtgcagtggcgcgatctcagctcatcacaacctccgcctcccaggttcaagcgattcttctgcctcagcctcccaagtagctgggattacaggcatgtgccaccacgcccggctaattgtgtatttttagtagagacagggtttctccacgttggtcaggctggtctcaaactcccaacctcaggtgatccacccacctcggcctcccaaagtgctgggattataggcgtgagccaccatgcgcggccgaaacttattcttttttttttaaggacatctgaagaccattgaatattaaactcattcttaagataaaatatgttctttaacatatatatagtactttgttatatatggtataatggtaccctatgtatgttatatatggtataattttaattatagctctgtgcctatatgaaaaatacatataatcaaagtaaatggtgggtgcatgcctgtaatcccagctactcgggaggttgaggcaggaaagtagcctgaacccaggaggcagaagttgcagatatttgtatataacacagctaaacactataaggcaggcaaataatcggcacaaataatgaagtgatgtctggttttagaaattacaatgatctggccggacacggtggctcacgcctgtaatcacagcactttgggaggccaaggcaggtggatcatgaggtcaggagttcaagaccagcctgcccaagatggcaaaacccgtctctactaaaaatacaaaaaatcagccaggtgtggtggtgggtgcctgtaatcccagctacttgggagactgaggcaggagaatcacttgaacccgcgaggcagggtttcaccatgttggccaggctagtctcgaactcctgacctcaggttatccccctgcctcagcctcccaaagtgctgggattacaggcatgagccaccgcatccggccggattattgtaatttctaaaacgagacattacttcattatttgtgctgattatttgcctgctttgtagtgtttagctgtgttatgtacaaatatctgcaacctccgcctcctgggttcaaacgattctcctgcctcaacctcccgagtagctgggattacaggcatgcgcccaccatttactttgattatatgtatttttcatataggcacagagctgtggataataaaaatcaatgtccaaatcagtaaaaaaaattctttcaataaaagcactgtgtcatagtttaattagcagaattttttcttccttaatagtccataaaataacagtatcttaatatagttggcatcttagatccaatgaaatattgtaatgaccaattgtaatattgtaatgggctgggggccgtggctcacgcctgtaatccctgcactttgggaggctgaggtggacggattgcctgaggtcaggagttcgagactagcctggccaacatggtaaaaccccgtctctactaagaatacaaaaattagccaggcgtggtggcgggcgcttgtaatcccggctacttgggaacctgaggcaggagaattggttgaacccaggaggtggaggttgcagtgagccaagatcgtgccactgccctccagcctgggcgacagagcgagactccatctcaaaaaaaaaaaaaaaaaaagtctgcaatgaagagctagtttccttatgaagagattatgttttatgcttctttgaatctggatctagcacactgctatgtctttagttaataaatacttactggtctgagttatttccatgggcagatagcccaacccagaatttcagtagtagagttcctggaaaacaacgtcttcatatagttggccagctgggctatattaccttccatattcttcttcataaaatctcataatcatcaccttctctcttcttcattccctctcctacgataatcggtcattacaatatttcactgactctaagatgccaactatattaagatactgttactttatggactattaaggaagaaaaaattctgctaattaaactatgacacagtgcttttattgaaaaaattgtgttttactgatttagacattgatttttattatccacagctgtgtgcctgtatgaaaaatacatataatcaaattaccgtaggtacttataaaagttcacattcaaagcctgactcttctgagtcactttttgactgagtcgtccatgtctttgtttttccctatgtcatcactaacattctcattagccataaggcatttccagagtgttccactattttccccaggatttaatcgaaatctctgttatcagttctgttttgaaggtggtggtttcttgatgataccagaaggtgtcaacagaaggttgtacatctctcagtaacaaaaatgtagtgcggcctcatctactttgggcatcttctttcttaggtcacgtaaagcacttggttgtacttgcgagaaactatggaattgggggcctgtgtcctcagagacaaatagtgcctgggttttttttgttttgctttgttttgtttttttggagataagatcttattctgtcgcccaggctgggtgcagtggttgaacacagctcactgcagcctagacctcctgggctcaagtgatcctcctaccccagcttcctgagtagctggaactacaggcatgtaccaccatgcttggctagcttttttatttttttgcagagacagggcctcactgttacccagactggtctcatactcttaggctgaagcaatccgccctgtctcagcctcccaaagtattgggattacaggcatgagctaccacgctcagccagatagtgcttttcttaataccaaatgtattccctgctactctgtttcagaacttttctgcattcacaatcacttttttaatgctaatcacagtatagtctttttgaagacatgtcatggcagttagactcaatacatgaggtacaaacagtgcagtgactttgttgacatgctgacagtactaatagctatgactaagttctcacaagcatgagcagtaacaaccgcaaggcagctgccatttagccatcagcagttctaagacatatcttgacctcaggaatgctaaattgtgaaaaggtgtgtgtcttagaattgatgaaatttggtattttatgatatgttatttctaggcgattagtgtagtttcttaactgtcctccttacctccagctgtgaatgtgatgtacattttaatctttcaaaacctagtaaaactacaacagcttcccagataaagtatacattttatcaagggtctacatttcttcctgcctctcctactttatctttcattaaacccccttcataaaccttctgttctgtccacagtctcttgcttttcctctaaacatgggaatgatgtgaaaatcacagatgggaaaggatttgaaatccactctttgctcagctcaaatacataggaatggttactccctcactacccagagccagtgcatcagtcagtcctacagagccagcctccaaaactcacccaagcttgcttcactgtgtctccactactgcattccagttcactccatcctcactcgctcctgcaatggcttccaccaggctcccggattctactctttcctttacagtcaagttcttaaacagcagccagggtggcctttaaatgacaggcttgtctagctgcaagactgatatgcgacctctatgcagaggactcagctggctgcttgttgcctcaacccacatggggaaagagtggaggaagaaaagtttgtgctggaggaagtaacaatttggttatgccgtctagggtggggtgtacaagtctggagtgcagagaagaggctggagctggaaatagaaatgcagcgttctcagtaaagagagggcacaccagtctcagctagatgagtactggccatgggaacagtgggcaagagcagatctgctccactccacgcacatggcacaggtcccaccctcagcttcctcctgccctggctcttgcccttgctctgccctggcctatgccgctggaattggatggtgggttcctgccctctgtgcctgtctgctgcctctgaggtgctaactttgccttttacaaaattggcctgtgttcccagtaccctgcagttagttggcacttagcagacgtgtgctgaatgcgtgaatgagcctgaattcagtgggttttctatgggtgataatttaaattcctaattttatgcctttgcacagaatctttatcttctgatcctgaggttttgcttcaaattgatggtgttactgaagacaaactggaaaaatatggtgcggaagtgatttcagtattacagaaatactctgaatggacatcgccaggttagtacacagccatgtgtgttctctaaaagcctgtttaatgtgaagcgacgcgtctcactgaattagaaggatgcagttgtgtgaatgcttcctacacctcgtcacactgacatccaagtcagcccccagtggtgtgccagtcacctctgagaggacactagtgcttatgccccctgtgagtgccagttctgaacttactcataggatccaaaaggggacctttgggcccaggggttgctggttcccgtaatgcaagtgctcaagggatcagagccctgggtaccagttccagatctgccaccacgtcatgctgtgtggtctctagcaggccaccaatagcctctttgtgaatcaggttcctccaccaaggaaggaacatgttatctgacaaacatgtctaaagataaaatttaagactagtgtttaaatgttttggagaaatgagcatgcagctagaatgttattattgttagtcattgatagaacctgcctgagtgcatcattatcagacgttcccggagtcacgttaggcctgtcctgtggcacttctaatcatgagcttcatcatcattacagctttagaaatcattgacctgggggaaatgagaacaacaaagcattttgttgtaggaaatattgagagcacagaagtcttctgccctctgataacatcaccacgtaataggacacaacagacaggcccggttcagtgttcttcctgcttccagacaggcagtgtgggggtcttcccaaggatgatggaaatgatgagcaggatgagatagttcaagttctctctttacctagtcgctttttttttttttgacagagtctcactccaggctggagttcagtggcacaatcttggctcactatgcctcccagattcaagcaattatcccacctcagcctccccagtagctgagactacaggcatgcaccaccacacctgacttatttttgtatttttttggtagagttggggtttcactatgttggccaggctggtcttgaacttacgacctcaagtgatccacctgcctcagcctcctgaagtgctggggttacaggcatgagccaccacacctggtcaggttctcctaaattcttctatatggtaattagtccattaaaagccttgttccgaatacattttgacagtgagccagggttggagcagccatggtggagtcctgtgccctccatgctgctcctgtagggtggcctgtaggacaaggcagaccagccaggaaatggagactgggtccccgtgtgagctatctatagggaggtttcatgctttttgggtgccttgggatgcaaatacttatggaaattaccatcttctttgcaaatgtgtgctttcatgcggtctcacctcccgcataatatgtgacatgttcagccatattgtgcaaagacaagtttttttgtctgtaaagagtaaaataggatctagaattttcttatgttcatttactaagaaactattgttcaaagatgagatacaggaccgtttgtttcccttatattgagctgattttttcagcacatttaaaataagtaaaattgcctgccatctttatagcagttgatactttttgaattgcctaccagaactaactgcccaatcaacaacaggaacacaggccatatgcgacagtatgagctaaacctcatgtctctagttaacttcaagactatcacaaatttttttaatgaattctgattctcttttgttaaaaatgaattgccattgaacactttggggctttgtgcagtaaaaaaaggtttggttcttgctgaattgttgaatccatatggcagggaagcagctaggtatctgctaaaatgggcccctgcagcgtgtctcttcatatacactaaaaacacgtggaccagtgcgacatcacctgtaaacatctgcattttccatttgtagctgaagacagttccccagggataagcctgtccagcagcagaggccccggaagaagtgccgctgaggagctcgacgaggaaatacccgtatcttcccactactttgcaagtaaaaccagaaatgaaaggaagaggaaaaagatgccagcctcccaaaggtctaagaggagaaaaactgcttccagtggttccaaggcaaaggggtatgttttgtgacatctttttcaatatagggaacaagggaagaaaggacaaaagtgcaacagctctgccttgctttgaaggatttattaaaataagccattattaaatattgctaatggaatgacagttgttaatggagtgacaattaaggtttgatccaaaacaaaaatatttgcttcaagaaacaacaaaaaatatttgcttcagatgtttaaaacatctactgactaatagttatgactaaagttttctttctttttttaatttgaggacaaagtctgactctgttgcccaggctagagtgcagtggcacaatctcggctcactgcaacctctgcctcctgtactcaagtgatcctcccacctcagcctcctgagtagctgggactccaggtgtataccatcactcctggctaatttttgtattttttgtacagatggagtttccccatgttgcccaggctggtctcaaactcctgagctcaagtgatcagcccactttggtctccccaaagtgctggattacagacgtgagccaccgcactcagcctgactaatgtttcttgtttgcaaagatgtcttccatgttgatcttcccttagatatttgtttgcctgtttgggatgattgttcttcttaagagacttttccacctacaatactataaatcatacactagctgaataaataacaaagggttttgtgtcctcgtggcttttactattctgtcagtacttgctccgctgcttttattgctgcagaatcccatggatctccaccttgaagcacgtgcacactccctgcctttcattaacacctgggagaatcgacctcccagcctttgcaggggtagcaagaagaagccacaacagagaaaccaaaagttcagtcaagccaggcctctttaggggttgcgtaaatggcttctgtcttccccttcccatgttttcctgggccgctcgtctgggacatgtctgttctgggcgctttctgcacaccaggggaacaacaaagacagcatggtctgatatgtgtgatgatcttggcagtttccttctttcttcataattgcattgtttctgacagccgctttttgattttctgccagggcaccctctgccttctggctagtaggttaggcctggcaggagggagaccattccatcagtcttgagaacttgaccccaaagtaactgtatattgtaacagagttgcttgcagaaaaaagaaaccaaaaaaaagtccacagtcaacttttgcaagctgttgtgttttcttttgcagtttttctacctcttgtccttctgagtaataaaaaacaagaactgagtggggaaagagaaaggaaggcagacattaccaaattgtcattttcttgttaagtccataaacaaaatcttgtatgtgctaatcctcctgccagagtaccgaaattaaaggcattagaaaacgttagtttaattttgtggttttgagtgcgcaagtgatcagtaagtgctcttcagtgagaacattttcttatttccatcatttattcctccactttgggaaatactcatttcctcagtaactcacacagagccggagaccttaaaaggcatctggctcaacacccagggtttttgaagaggaagcttaggcctggcctggggagggcttatcggaggacaaccctgcctggtctcgatttcaaaggtagaagcggacactggcctgcccacacctgcccagagcacgttcacttctgcatgttgcctgtggagactcctaaaaaacacgcatggtcttccatctcatctttatgtattagaacaaagcaaaccatattgctattggctcccttatttaattttcacaacttttgtttgtaagagtgaagcactttgcagcatcatctggaacctaatctgataagaagcagtaaagctcacacttgtacccatttccatgcttgttttcagtgagcctgggtgtttaagatgggatttgttgttgttgttgtcgttatggagttttgctcttgtcacccaggctggagtgcagtggcaccatcttggctcactgcagcctctgcctcccgggttcaagctattctcctgcctcagcctcccaagtagctgggattatgggtgcacgccaccacgctgggctaatttttgtatttttagatggggtttcaccatgttggccaggctggtctcgaactcctgaccccaggtgatctacccaccttggctcccaaagtgctgggatgacaggcgtgagccactgtgcccagccaagatgggattcttttttaagccctaccagctaaagccagtgcactgtgtgactttgtgttacccttggagcagcctctttttgctccactctcctttccaccgacccagtgtgctccccggattgagagtccctgtgcagtgaaagaataaatgtggctctctgccagcaacctcacctccccaccctaccctcagagtttcacatcttcagaacaacacacaatgaaccagttgtgttctgggctctctgagtgggagtaaatggatggcccaggtgaaatggaggctgctgttggccgattcattctgtaaatcaacataaacagcaggttttctctctgggcttaatttctcagcaggaaatcagcatagggaaacttcaggctgcatctctgccagtctagcagatctctgccagttctgcagtaaaactgccttggagccagagtttaagtcatggagctccatcagaatgtcattacccacaggctgtggccctataccctcaattcagacgggaggctacttgtatgccctggtgccgtggaattagtgtggggcctgacatcagccggttacagagcagcaggaaaggcttctgcgggtaatgctgcccacagccatcactgtaaacatgccggccccatggttttgtttgtttttattttacttaagggtgggaagggagctgttatcttaaggtctgcaaggaaagtgagatgctggaaggacttggtaatcggctctggcggcttcttccttggctttagaaggcagcgagtgggagggagagctggcagatctctgggtgtaggcaggtgagccagggagctgctggacacggtcctaacagaaggccgcatctgcagccttcctggggcttcctggggctggccaggaagacgcccagctttgccactcctggccacccagctccaccccatgcatgctcaccccacagctgccttgctctggactgtgcaagtccagtcattccggggtgcctgtcagcagggagctggggccttacagcaaggtgtttcacttcttttatttggtcagaatagatgaggacatgtggacctcagctcctcttgcaggctctggttgtaggctgccgaaggtgtgggtggagagaggggcggtgggttggtcacaagtcagaaaattaagaaacagtcctgcacatttcagaaagacaaatccagaacaaatttatatgaagggccgcggtcctttattccataagtagtaaaggaaacttaccttacctagggggctcgtaggcagaaaatgcacaaggacacattaggcccagggaagtggtattgtagctctgtgcaggttgagaggaaggtcattcatttttggtttcatttaacattttgatttttttctttgtcacatttcagggggtctgccacatgtagaaagatatcttccaaaacgaaatcctccagcatcattggatccagttcagcctcacatacttctcaagcgacatcaggagccaatagcaaattggggattatggctccaccgaagcctataaatagaccgtttcttaagccttcatatgcattctcataacaaccgaatctcaatgtacatagaccctctttcttgtttgtcagcatctgaccatctgtgactataaagctgttattcttgttataccatttgaagtttttactcgtctctattaatatttaaataaatgctggggggtgatagttcttctttttaaaataaacattttcttttgaataagca

SEQ ID NO: 174 - DNA, 140500 bp, Homo Sapiens
cagccgcccctcctgcggccgctgcgggggccgccgcctgacttcggacaccggccccgcacccgccaggaggggagggaaggggaggcggggagagcgacggcggggggcgggcggtggaccccgcctcccccggcacagcctgctgaggggaagagggggtctccgctcttcctcagtgcactctctgactgaagcccggcgcgtggggtgcagcgggagtgcgaggggactggacaggtgggaagatgggaatgaggaccgggcggcgggaatgttctcacttctccggattccaccgggatgcaggactctagctgcccagccgcacctgcgaagagactacacttcccgaggtgctcagcggcagcgagggcctccacgcatgcgcaccgcggcgcgctgggcggggctggatgggctgtggtgggagggttgcagcgccgcgagaaaggcgagccgggccgggggcggggaaaggggtggggcaggaacgggggcggggacggcgctggaggggcgggtcgggtaggtctcccggagctgatgtgtactgtgtgcgccggggaggcgccggcttgtactcggcagcgcgggaataaagtttgctgatttggtgtctagcctggatgcctgggttgcaggccctgcttgtggtggcgctccacagtcatccggctgaagaagacctgttggactggatcttctcggggtaaagtgtcttcctattcccgttttcccagctccgtgccccggggtatctatagtgctaggcttctgagacacgtggaggcgcttaggcccgcggagcaggcccctgggctgtgtttgggagattctggaaaaacagactttctcccttttcctttcccctctggagcagctgggaaaggcgtctctcggagcttccgccattcagaaagtgtttccccgcccctgacggccccagcttgatgtttaccttgcgcgcttagttaggattgctctttctagtacggcctttattatggcagaaattgagccactacaggtctgcacagcaaagtcgagggaaataacctgctgtctatgatttagcaagtgatgatggatatttttgagttcaaatcactcagtctttaatggattttcttttctttttttcctagttgaatctcagttgttctcaggctaggtttgatatgaaaaatactactccctattgaagagggtaatataattcttaggatgctaatacaggagtctgtaagtcggagtacttcaggctttttatggttcggtacatttctttttaggggtgggatattgggataagtaggacagttcagatcttgatgtcattgaatagtggtgtctacctaaaaggaagaggctggggcacaaaattataatttaaagtgtttacttcagccaaaatgaggacagctgcccaggactcatttcccagttgccttggggagtgctccttcagccttggttacaagcaggtttttaaaggcgaaggggaagagtgggctgagacaaagttggtcaggaattgttattggtttacagagataccattgcttagtgattggctgtacactgtaactcatagggtatgagttatcgtgtccagcatatggcattttatggcttcttggttccagtctagagcccatatagcaggtgggctttaagagataattatccagctcagaccgggagtgagacgggactgttttttcattctaatgcctctctgggcctgataatttaaaggggcttgcattcttcagctaaaattttattttcttttattttttttcccccacagtggtctccctttattaatccaacaaatgtttattaaggactgctctaggcactagagataccaacaatgaacaaaacagacaaacatctctctccttttggagcttacattttagtggaaagagacaggcaaaaagtaaaattataggatgacagaaggtgaaaatagagattaaaaaggaaagggggatgaagagtgtgtgtgtgtgttgtgggtggggggctgtagggagctgcagttttacaataagtggtcagggacgtcctcgctgagaagggaatttttgagtccagagctcaaggaagtgagagaacttaccttgacgttctctggaggagaagaaagtacaaaggccctgggggaacctgcctctttatgttcagagagcaacttaagaggcctagtgagctggagcagagcggagaggaggtcagaggtcaggccagaaagggaaaggggccagaatgtgtaggactttatgggctatattgaaaattggggctttcattctgagggagatgggaagctgttggagagttgttagggaaacgtgatctgaattatgtttctaaaaaattggagtaagatatcataaaatttgccatcttagtcttttttgtatctggccaattccactcagaattcttttttaaacagctttattgagatataattaatatatcatatgattcactcatttaaagtgtgcaatacaatggtttttagtttgtcttcagagttgtacaacctttatcacaattacctttaggactttttcattacccaaaagagaatctccataaccattagtactcaatcccacccgctttcctagcaatcacttacctatttttttgtctctatatagctctcaaaccctatgatattccttctatctaactgtatttttgtactcattaacagcctctcttcattcccaccacccatccatcccagcctctggtaatcaccattctacttactacctcaatgacatcaaattttttagctcccacatataagtgagaacatgcgatatttgtctttccctgcctggtttatttcacttaacagaatgtcttccagttccattcatgttgctgcaaatgacaggatttcattctttattatggcttaatactattccattgtatatgtatatcacattttctttatccactcatctgttgatggacagttagcttgattccatattctggctattgttgaatagtgctgcaggaaacatggaagtgcagatagctctttgacatactgatttcatttcccttgaatatataccctgtagtggatttgctggacccgcttgtagttctacatttaatattttgagttatttccataatgttagtaataatttacattcccaccaacagcgaggaaggagttcccttttctccacatcctcgccaacacttatcttttgtctttttggtaatagccattctaacaggtgtgaggtgatatctcattgtgattttgatttacatttccctgatggttattgatgagcaatgtttcatatacttgttggttatttgtatatctccttttgagaaatgtctattcaggtcttttgctcattttttaaatatggttttttaatttttttatttttttgctattgagttgtttgacatccttaaacattttggaaattaacctcttattagatgtatagtttgcaaatattttatccgattctgtagattctgtcttcagtctgttgaatttgctgtgcagagaagcattttattttgatgtaatccctttgtctatttttgcttttgttacctttgcttttgaagtcatatccaaaaaatcattgcccagatcagcagtccccaacctttttggtaccaaggactggtttcatcgaagacaatttttccatccacaggagggaggggatggtttcaggatatttcaagcgcattacatttattgtgcactttgtttctattattattacattgtaatatatagtgaaataattatacaattcaccataatgtagaatcactgggagccctgagcttgttttcctgaaacttgagggtcctatctgggagtgatgggagacagtgacagttcataaggcattaggttcttctaaggagcatacaacctagatcccttgcatgcgcaattcacagtaggttttgcgctgctatgagaatctaatgccaccgttgatgtgtcaggaggtggagctcaggtggtaacgtgaggaatggggagcagctgtaaagaaaaatgaagcttcgcttgcttgcctgctgctcacctactgctttgtggcctggttcctaacaggccatggactggtactaatctgtggccctggggttgggaacctctagccctgaccaatgttagggagcttttttcctgtgttttcttcaagtggtttcatggtttggggtcttacatttaagtctttagtccattttgagttgatgctgtatgtggtgagagataattgactactttcattcttttgcatatggttatcagttttcccaacaccgtttattgaagagcctgacctttccccattgtgggttcttggctcttttgtcaaaaatcagttggctataaatatgtggttttatttcttgggtctctgttctgttctattatctgtgtgtctctttatgccagtaccgtgctgttttaattactagagtttagtatattttgaagtcaggtagtgtgatgcccctagctttgttcttttagctcaacattgctttggctattcagagtcttttgtgaggataatgttttcaaggttcacccatgttgtggcatgtatcagaactcgatttctttttatggctgaataatattccatttgtttatattatatatatgccatatttatttattcatatgttgatggacacttaggttgtttccaccttttggctattgtgaataatgctgttattaacattggtgtacaagaatctgtttgagttcctattttcaattcttttgggaatatacctacgtgtggacttactagatcacatggtaagcttttagtttagctttttaaggaactgctaaaactgtttttccatgggagcagtgtacaagtgttccagttctccatatgctcaccaaaacttaatttccttttttaaaaattatagctatcctagtaggtggtgggaagtggtatcttactgtggttttattttgtatttctttaatgactaatgatgttgagcatcttttaatgtgcttattggccattatatgtcttctttgggaactgtctattaagtcctttgcccattttttaattgagtttttttttctgttgaattgtgggagatctttatatattctgaatattaaacccttattgggtgtatgatttgcaaataatttctcccattttgtgggttttcttcactttttgatattgttctttgattcacttttaaatttttatagagtccagtttatctgttttttcttttattacctatgcttttggcatcatacctaattcccaaatccaatgccatgaagattttctgttatgttttcttttaatagttttatagttttactttttctattggagttttaagtaaattcttgtatattagtgtgatacattttaagttatttttgtatatggtgtgaggtaggggtccaacttcactcttttccatatggagatccagttgtcccagcaccacatgtttaagagtctattctttccccactgaatggacttggcacccttgtcaaaaatcaattggtggtaaatgtatggatttactcctggaatctcaattctattctattgtatttatatttctgtccttatgcctgtaccacactgttttgattacagtagctttgtagtaagtttagaaattgggaaacatgagtcctccaactttgttcttcttttcaagattattttggctatttggggtcccttgcaattctgatgagtttgaggatcaccttttccatttctgcagaaaagccttttgatagggattgcattgaatctgtagataactttgggtagtattgacatcttaacaatattaagtctttctatgcataaacatgggatatctttccatttatttgtgttttctttaatttctttcagcagcattctgtagttttcagagtacacgtttttcacctccttggttaaatttattccttggtattttattcttttagctgctattgtaaatgcagttactttcttagtttcctttcagattgttcatttctggtgtataacaacagctgatatttcaacgttgatgttgtactctgaaactttgttgaatttacttattagatctagtagctttctttgagatttttatatgggattatgtcatctgtatatagagatagttttacttcttcctttccattatggatgccttttatttcttttccatgtctaatttctctggctagaactttcaatatgatgttgaaaagcagtggtgaaagtgggtatctttgtcttgcttcctatcttaggtggaaagctttcagtctttcaccattaagtatggtgttagctgtgggttttcataaatgccctttatcatgttgaggaaatacccttttattcctagttttctgagtttttatcatgaaagggtgttggattttgtcaaatgccttttctgtgtcaattgaaatgatcatgtatttttcctcccttatcttaatgtaatgtgttatattgattaattttcttatgttgaaccacccttgcctttctggggtaaatttcagtcacttatgttatatagtcctttaaattgtgttatcttataacagaatcactctgctactgttttgagcataggccatagggaaaagcaggtaaaaggtaatatggcttgaaccaacattgtagcagcggaagtggtgagaggaggtcgaattttggctttgttttgaagatagaaccaacagtatttgctgacagattagatgcagaatgtgaaaggaggagatgagtcaggatgaatccaaggcttttggcatgagcaaccagaaagatgaaggtgacttactaagatgggaaatatacaaaaggagcagtttggggaaactttatatctattgagtggaatatgccaattagagattcaaatatccagtaaataattggctatcaaagtttgaagttaagaggaatggtctaggctgtttatataactttggaagtcattagtgtataacagctaatttaaaagccagcagactctaagggagtgagtgtagagggagaagagtagaggtctgtgacttgaatcctggaatgctgtgatgtttagagattggggaggtaagaaggagcagcagagtatactgaaaagggattgttatactgaaaagggattgatatagatggagactcaagaattatcacagaaacctgataaaatgtttcaagaagatgggtgtgattaattgtgtcacttactgccggtacattgactcagatgagcgttgagaattggctataggatttgacaacataaaagtcattggaaaccttgacatgagcccttttcgtggagtggagtggttacagtgggtttaagagaggattaaaggagtggaaacagagatgctattatagatgactcgtttgagtagttttcctacaaaggggagaataataatggagcagttagccaaaagttgagtttttttttcttcttcttttttttagttggaaaaaattgcgtatatgttgatgggtcttttctggcagaccagtagagaggaaaaagttgatgatgtaggagatgggaaaatgtctttgagtagatgtcttcgagaaaatgtctttgagtagatgagaggtttgcacacatggagaggttggatgtaggagtactgatagttcatccatagttacataagaaaaggtagatgtattagagttctcctgagaaacagaaccaatgggagatctttatatctctgtgtccatctctatctgtatttctgtctctgtatctatgaagagattataaaagttttaagatctgccaggagacatacccacgggagctaatggtatagttccaggccagttgtgaaggcctgagaaccaggagagcctatggtgtaagttccagtctgagtccaagtctgaaggcaggagaagaccaatgtcccagctcaaagacaggcagagggagcagatcttcccttacttagcctttttatttattcaggccttcaacaaattgaaggcccacccacattagggagggcaatctgctttactcagtctactgaatcaaatgttagtctcacccagaaacatcctcacagacacacccagaataatggttagccaaatatctgggcaccccatggcccactcaaattgacacataaaattaaccaccacagtagagtatatgggtacaaatataattatgtgatatagatttcagggtaagagcctgtggaaattcatttttgattgcttctagtgaaatcggaagcaagatcatcagctaagagtgacgatcggtggaggagatatgaagtttaagtggagaggagaaggtataaaatagtcttaggaggggaggatagtaaatagattagggaaaagttgtaggattgccaggaagtagtaagggcccacttgaggctggtggtcacaaatttaaggtgagaccagtcaaaatggttgtgcttttcacctgctgcattcattcagctgcataggtacaggcacagagtaggtcaagagttcttttttattcggggttagagttttgccaggagatagtaataaagccagaagggcaatgaatttgagggagtatgcaaggaagtggctgttaacttggagtttaaactagtcaagaagagaattaaggactgcccaaggggtgaggacaatgatatggtagcagggcccttaaaagccccagttagatgaaaagattgttggaattgagtttctagagggaatgaacttgaaaaacaggaggtgttggttggagagtgggatatatggaattgagattatggaaggattcagtcgttggtaataacatagtatctttgtaggaataaataggtggagcaggatgcagacaagatcactggaggagggctggtcagaagactgggaggcactatctcccttggatattatacatcaaagcttgtgatctactagacaagtagtggggaaagggtaggatatagatattaatggctatagttttgatggtgatggtcatggtgatgatgatggtccattaacactcaactcaaataccatcaatttgatttatatctaacaccacaaagttaggtgttgagttacatgtggttatattgtaactaatagtcagcccttcatggacttctattctttgatgagactcttcttgtaggagtagtaggtgccttaaagcaccttttcatagttgtcagattgaaatccttcaccagtgttttaggttaaccctgttactgtggaagtttctcttggctttctgtgtgggctgcttctttgtctagttttaccttttggggttagcatactattgtgaataatttattggtgagaaggtaagcagagaagtagagtactctatgacctagtaatttcatatctaggaatctatcctatagaaatgataggaatgccttacaatacccacatatccacaagggtattcattgaacgttatttttggtgaaattcgcaagcaacctaattatcatcaatagggaattgttaaattatgatagataaaatggaattctattcagtcttcaaaaagtcagatcaagaagtggtcttacattttaattatcccatcctgtcaacaagagtgtcttcagttgcaagtaatggaaaaaccattcaaactgacttcagcaataaaaggttatttattggtctgtttcatggagacatctgaggtagagtggccttcaggcaagttcactcagggatccgactatttttctggccttattcttggccctcttctatgaaaacaccttcagggtggtttcttgtatgcttgtaagatggctacttgcatcaaccatgaccacatctagcaggagcaaaagcatcctttcccgtaccagaggagagtcccgaaatttgttgcaattggactgccttggaagcaataattatggccaggagatggaggctagagaactgagacctgatcatagctcctatccttgaatcagttgtatagcaaggggaattggattttccttaagacagttggatttcacctgtagtcttggtgatgaggtcagttccatccataaaactttgctgttacacattttgggatggggtgaggagggctgaatggagattaggatgctattgaaatttgctgtacacaatggatcattatcgtcttctttcttagtgttaaggtaatcagcctctttttcctcctcctatgcttgactttactaaaaccatgagacatgtttaacctcaggactccaatttgaaaaaatatagactgttatttactttattacttacagaagcccttcatactactctcagcaagaaagaggtaggcagggagtgagggaggggggatcatgcttactgagaaacaaactatcgagtattgaaactcccccttcatatgcctgacctcagtcccattcagttaccagtaggggcccctattaattggtacctcaccagcttttgctgttcgttcataaaactgagtcattgaagtacagtagaaaaataattggactacaagataacttatttccttccataattgcaaaatatctgatttttcttcttgtttgtattatgtaaacttaccctgtctgagggtcctcctggattgttctttgcatttatatatacatagaatttcattttcttttttcttgttttttttttagacggagtctcactctgtcgcccaggctggagtgcagtggcacaatctcggctcactgcaagctccgcctcccaggttcacgccattctcctgcctcagcctccccagcagctgggactacaggtgcacgccgccacacccggctaattttttgtgtttttagtagagacggggtttcaccatgatagccaggatggtctcaatctcctgaccttgttatctgcccgccttggcttcccaaagtgctaggattacaggcgtgagccgcttgcccgaccttcttttttttttttttttttttttttgagacgttgagatagagtctcactctgttgcccaggctggagtgcaatggcacgttttcagctcactgcaacctccacctcccaggttcaagcgattctcctgcctcagcctcctgagtagctgggattacaggcgcccgccaccatgctctgctaatttttgtatttttattagagatggggttttaccatggtggtcaggctggtctcgaactcttgactacgtgatccgcctgcctcggcctcccaaagttctgggattataggcgtgagccactgtgcccggccaatttcattttctattttgaaatttaaactaccactgacacttcgttttccctctgttttacttagcatttatcttagagaataatcttaatatgtatagttctattttattcttttactggcagcttagtatgccatattttggatgtgtcattgtttatttacctattaatttaccctataactgcttcccatatttttgcttttacaaagggatgtaatgaacatcctttacatacgtctttgtgcatatgtgcaaatatttccataggatagatgtaattactgacttgaaggttatgcagatttaaaattttgatgccttctatgaaacatctttcaaaatggtgatgccagtttcttctctcgtaattactgcatatggtcaatcttttaaatttttgctggtaatgatatttcaaaattataaccagttttttggcctcatttcttgaataacttgttttttctcaaagataagaaatgtctccttcatcgtatgtcaaatttccatatttacatggatctatttctggacatggcaagttttatttatttattgtatgtatttacggtgtacaacatgatgttttgatacacatatacgtagtgaaatgattcctacagtcaaacaaattaacatgttcaccaccttccatagtctctgcagtcttcaaggttttctctatatgggattagacatgctatgtctgatctgtttttgtatttttacaccaattccacactaattttttttttttttttgactgggagtctcgttcttattgcccaggctggagtgcaatggcatgatctctgctcactgcaacctccgcctcccaggttcaagcaattctcctgcctcagcctccctagtagatgggattacagcactcgctgccacacctggctaatttttgtatttttagtagagatggggtttcaccatgttggccaggctggtctcgaactcctgacctcaggtgatctgcccgcctcggcctccgaaagtgctgggattacaggtgtgagccacctcacctggcacacactattttaattactgtagttttaaaagtttcatatttagtagggtgagtttttccttgttggtcttgtttttcaaaaaaaatttgctgctcttgagtattttctcttcccagtgaactttaatgtaaactcacgtggttcaatgaaaaattctgatgactttttttcttggtattgcttcttgagtgtattgatttaattaatatatttacagttttgggtctggctgtgccgaaacgcagtgtgtcttatccagtccttttttaactgtcttaataaaatttgctggttatctttaaaatggatcttgtatattttatgttaggtttattcccaggcaggttgtcatttttgctgttactgattttggatataaattttggatataattgtataatttggacttggatataattgtatttgattctgtcttatatataaaaatgagataggataataatttatcctaggataaaaataatttgagtatccttattttgcatctggtaccttacttgctcctgttaaacaaatagataaaattacttgtcttcaaagagatcctgtggaaaaattatttattttaggagactttggagctttgataaaaattaggcttatcttttgtaaaagctggttagtgatagcaatcagactcttttaaaggtgatttttttttctttcctttgataaaatgcttaatatgagggaggattaagaaagaggatggcttttgaacagtttcttcatggggaaataagaaattagaataatttcatgttctccaaaaaaaggagaaaaatgaccttccctcctgagcctacttcaagcctctgtttctttctgactctattgttctcatctctgcatttttccaatctcttctactgttagtgttttaggctagctcctcagtggagggcagaaattcaccttctctttagctgtctttgaaaccaagaagatagaggtatgagatcttcgtagtctgtagtaagaataatagaagccatcagaaaaaaatatcaaagctttgtagctgctcctggaagttttgatgtgaagcaggagacatcacctattggtacctgacttgcttttgctgttcattcataaaacagagtctctgaaatacagtagaaaaataattagactggaggataacttttttccttccaggaattacacaatcacaaaattgctgatttttcttcttattcatgttacataaacttatcctgtccgaaaagactgtatttgaacttactatgtaagatttgctttaggtaaatttatggctgcttccagaattgtgtattaattttccagtttcttttttaccagtctccacttttacctttccctcttccccctatacttaaattggtcttactgtaaaatttatgcgtttctctttctacctggcaatgctgattttttttttttttttttttttgaggcaaggtctcactctttcacccaggctatagtgcagtggcaagatcgtggctcactgcaacctcgaatccctgggctcaagcgatcctcccacctcagtctcccaagtagctgggactacagatgtgtgccatcgcacctggctcatttttgtattttttgtagagatagtattcgccatgttgcctaggctggactcaagccagcctcctgccttagcctcccaaagtgctgggattgctggcacgtaccactacatccagccagggctgagtttctgaatcatcattgcagcaagagaaattggattacctttagaccactggctctactgtgggctgggagtgggacaccttccttaaagcgcattggacattggctttgtgggtaactgatctttacctgaatgaaatttatcagtactgtattaagggtctagggtggaacggatgctagcaaggcaaccgttaacatccacttactgatgaatcctataaaattttatttcaggccatacgaagtaacagtaataaatataaaaggaaaaatagacaacctaagcaactttttaaattgacttacttgaaaactttccctgcaatttcccggtttataatggttgatttcagctgactggctatagctacttagagaacagaggaaattcattaaaaataatgaattattcagttgggtagtgaaatccagttataaagcacttcgctgtgccatggattcagttcaggtcaagtgatgttcctggtttatgggcagtgtggcttctcactatgacacagcaaagaacgtagcttttatcctttacccttgttactaactaaaattaatggcattttattgtgtttatttgtttgattccatttacagtttatttcacttggttttattagtacaaaattgtgctttatataatatttgacagttaggaaaaattgttagatacctataaagaaacaagtctctcaaaaatcatcctactacttttaaaaattacatcgtcttactacagttaacctagatgtgaatgggtagttttatttagcttttctggtttgtttgcttggtctgtttggagggaagttaagattagcagaaatgtagtaatagattcatgaaagtcttgaaagcttctttaattagagaatttaatgagggctttggcatgcattctttggtttttctctgttttcctctaccccttcttattctttttggttcattgaaaagtagaaagaaattctcaaaaaccgtacaggagaataccttataaatgatatcttctgcaataaactatagattgtatatatgtatatgtatctagatacacaatctgtgtgtgtgtatatatatgcttgtgtgtgtataaatgtataaattagttactagtatatacgtaagtataaaacctcaatgtgcaaggttacattttcagaaaatatgtaatataataaaagaaatcaagcccagaatttttaaaaagtttattgcgctttctgttaaaaatgaaaggctttttgactggaagctgcttctcagtaaaaataacataattgtgttggtgaagcccaaagattctaatgaaaattagggtattgacaaccaaacggaattgctggagtacttaagctgctttggttttgtaatctttctgtgtcagaatatttgaaaaacacttattaatccagtcttgtaacttatccttgaaatctcttttttaatattcttttccacacacatgaaaagttagatgagtgtatgaatttctgttgtcagactagttgtaaacctcctaaatatagtttctgcagtatagttaaagagaaagaacatcctggctaacacggtgaaaccctgtctctactaaaaaaaaaatacagaaaatgagccgggcatggtggtgggtgcctgtagtcccagctactccggaggctgaggcaggagaatggcgtgaactcaggaggcagagcttgcagtgagccgagatcacgccattgcactccagcctgggcgacagtgcgagactctgtctcaaaaaaaaaaaaaaaaaaaaaaaaaaagaaagaaaataggcccagcaaggtagctcacgcctgtaatctcagcacattgggaggctgaggtagggaggattgcttgaggccaggagttcaagaccagcctgggcaacatggtgaaactccatttctacaaaaaatacaaaaattagctgggcatggtggcatgtgcctgtagtcccagctacttgggaggctgagtgggaggattgcttaagcctggggaggttgaggctgcagtgagctgtgactgagcaacagagctagactctgtctcaaaaaaaaaaaaaaaagagatgggttttgaaattcagtactttttttgagtgaggtccaatgggtcagaaagaagcattggataaatgaatccattttctcttctctgtttgaatttgtaatttgaaagaatattctacctataaagtacttcagtgcttaattagctgtcagtgaatttatatatcttatctaattcatatggatttgctatttttatctgtacctacagattcctgacctctctaaggggatcccagtatactatagggaatgaggtataatagaagtaaaagacctatcactagtcctgtcatcattccaactcatgtgtaattatagtttaaaagaagtgacatcatgtgtattgctgtttatctttacattaatcttgtggtcaagaaagcaaatactataatatataataattatataatatcataagacaagtaatataataatgggaatataatcccattttacaaatgaggaaatgaaaatttagagaaataaagtgacttgtccagggtcacatggatactaagtgaccaagtgtcaaagcagaattttccaaataacttaaagataattcttgtacaaatatagaacgaacacatgtcatatgtgttgtgttaatgagggaaccagaaggatgacaacattggttcagagagatgcaaagataaatatagacattggaggaaaaagttggaaataagattgttaggttagatacaaagctgtgttataggccaataaaaaccatagactttgaggttatcttttttactggacaggattcagttacacctttatgagaccaaaatttattatttaacatgtggatattagagtctgagttttaaaattattagtaaatgaccgtcaaataaagatatgtcccctaatgaaatactgataatcgctgggtgagcttgtgctcctatatgacattgaaatgacatactgccctctctttgtcttctaagttttggatacttttttttttttttttttgacacaaagctgcattagaacctaggtttcttgattttcagtccagatttctttccactctacttcctgcttcttcatagtataattttcaacactagagcagtctgcataacttttgcaaaatcagctagtctttcttattagttttcctttgtgcaaagtgatgtagatacagctttcttcttcagagaaacattgtgaaattcaatgaatatttgtaaaatttgcatacgtgcccaatgtgagaaattgaaattattacttaagtattgcaactgttcttttaggatattttgtttgcaaatttcagagtaattataaatattcttgcatttttattgtaatcagtatttataaaacagtgtatttcatcacattaacctttacatattttgaataaaatagtattgaaccattttaaatagtaagtggaaatttttccacattaaacagtataacgggctaacagagttaagcattgcattatttaactaataattttttcctgaacttcagattattatctgtatgtgtcatataacttgacaattttttttttttagtgctttttaaaaagagtgggatactttattcagtttagccctcaagcaattaggcaagtcagttaccatggtaacagtaggtattaatttccttacctagttagaggttttatgaacaaagaaatctctgagttcatccaccaaaacccaactttctcttgagactggcctcttgagactggtgttaaatttgtctattttctagaagatgacactattctaagtggaaaatacggttctcttgaggtgaatttctactctatcaagagtgaagtagagtatggcttaaaagttaagtgattaaaaagctaccctttcttagctaatttggaatgtaattggtcttaatttttctaaattcgttctaaccaaaatcttattggcgtgatttctattgacatgaactagaagtgacttcagcagacaacttgtcccaatatctaaatgctgtcaaatagaatcacttaagatgaatttcttccaaaacagagttcacaattttgacagataatctcttagcatttaattgactagtattaccaaccttatggaataggtccactcgtttagctatcatgaggaccattttgcaactaacttatcaaaaagccttcaccaagaagttgcatatcttattgatattttagaatgcgattatggagattaaaaatcaccacaatgggttgttaataacgccagccttgaactttcagttttagagcattttatctgtgttctgtagtcaaagttggtaaggtgtccagtgggtcatgtttgacttgctgcttgtttttgtactgtgtgctaaatggtttctacatttttcagtggttgaaaagtcaaaagaagaataatattttatgaaatttaaataaatccaggtttcagtgtctataggtaaaatttcattgtaacgttgttatgcttaagtattgtttatgacttctttgctatagtgacaaacttgagtagttttgacaaagatcatctggcctgtaaggcctagaatagttactgtctaaccctttagagaaaaaaattgctggcccttgttctatagtatgaaaaaatatagccttgattattcattaaaaaattattttcccattttattgacatacttttgtcccctgattgttaaaaggaatgcatgttcttatagaaaagttggaatatatagaaaagtataaagaacaatatgaaaaaccatttgcaattgtgagataaccactaatgttttggtatacattgctccagacttacacacaaacacacacgcgtatttattttatacaattagagtctaattttttttttgagacagtcttgctctgttgcccagggtggagtgcagtggcaagatttcagctcactgcaacctctgcctcctgggctcaagtgattcttgtgcctcagcctcttgagtaactgggattacaggcgtgcaccaccatgtccagctaatttttgtatttttagtagagacggggtttcgccatatgcccaggctggtctcgaacccctggcctcaaatcatcggcctgccttggcctcccaaagtactgggattacacacgtgagccactgcgccttaattttttaatttgcttttttcacttgaataattataagaacattatttttaatgactgtgtagtgttctgttttatggatgtaccatacttaattatttagtcataatttattattatgaggttgataaacatgataatcagattgagctcaagaagctagttatagggttgcacaattaatgaatcccaggtacctcgctgggttgctgaggctgctatttttttcctgcctgtttggaacactgtgtttgggaccaatgaggcaaaagaaattgaagagctgccattttcaattattctattagaagatacattgaagatttgtcaaatgacatagacacaacactaatccagaagattatttaatcaaaaaggcattcatttcagatatgaattcataaacatttgtaacgatcctcagtttgaagaccatatagaatccctgaagaactggaagacactatttgcttggcaaagagaagtccccagaccaactggggatgaaatattcaaagagataaatgaatactttgaaacatacaaggtactatggaaaaagagtggaagtttgggacaggtaatgacaggaagatataaaagctttacattaagttcaatctaaaactttattccaagtaacaggttgtcttattcatggagaagcagttgtaaattaaaacttgcctgtggtttggaatttcacattaaatgattacattaaaaattcaaatggtgaacctaactaaatccaagctcctacagtaccttcttttcacctttaggtgaagaaatgcggtgagctattttattactgattatgtggacagtccaaaggaaggttcataagcgaaaaggaaaaatttaaattattccatgtgagcgattcttactttgcagatttgttgaagtgtagttactggcttcaaaaagtggtatccttaactgacattttgaacacttgaattcactcaataaaaaaatgcagtgatcatgtggaaaatacattaaggtatatgacagagtttatggattcagagcaaaaattcagctttggaaaagtgaagttaaaatggttttttaagtgatgtttaattggtgttatttgaatcctaaagaagaattaatagtactagtagaggaaagtcagtgtgtctgtgacaaagctttagtattattttgaaatacttgatataaaaaagttcacgtttactcaaagcttacttaaatcatcagaataaattaacatgtttcttaattaaagaaaaggagaagctattagacttaaaaaatttttgcacccttgaaatacatacaatttgaagagattaagttgttggaatactggttaatggtgaaaaaggagttttcagtctatgaaagcaaagccttctcctttgccatttgcttttttgtagtggttgctatgtagaattcgaagaaaatattgttaaaaagtcttggtcaggagtagagtgtagcatgaacccaatgcattttaacgttaataatgaggaaaaagggaatgcatgataatttcatcaagtcagaaaaaaatggaaaaagaaaaagaggaaactgaagaaagtaactgatgaaagtaaggtgaaagggaaaacaactttttataccacctgtgaatgagattaattttcgtttccatactgaaagacaaatatattccaattaagccattcaaaataaaaaacaatttttttttggtaagagatgggatctcactatgttgaccaagttagtcttgaactcctgccctcaatcagtcctcctgcttcagcctcccaaagtgctaggatttcaggcatgagccactgtgcctggccaaaaccaaaattaagcaacaaaacaacaacaacaaaaattccagacagcctttaaaataatgataaaggttgaaaaattgtagatagtggtaggtagataagatttcaggaaaagtccaaagcaaatcataatacgttattttaaaggggggtttaaaatcctttaaaggtacaatgtgaagcattatgaaatgataaaatacatgttttttaaaaacattaattttattttaagttccaggatacatgtgcaggacgtgcaggtttgctacataggtaaatgtgtgccatggtggtttgctgcacctatcaatctgtcacctacatattaagccccgcatacattagctgtttttcctgatgctgtccctcctccaggacccagtgtgtgttgttccccatgtattctcatcgttcggctcccacttataagtgagaacatgtggtatttggttttctgttcctttgttagtttgctgaggataatggattccagttccatccatgtccctgcaaagtacatgatcgtgttcctttttatggctgcatagtattccattttatatgtaccacattttctttatctagtctatcattgatgggcatttggtttttttccatgtctttgctattgtgaatagtgctgcagtgaacatgaacatgtgtgtgcttgtatctttataataaaatgatttatattcctttgggtatatacccagtaatataattgtataacccagtaataggattgcagtgtcaaatggtatttctggttctaggtctttgaggaatcgccacactgtcttccacaatggttgaactagtttacattcccaccaacagtgtaaaagcattcctatttctccatagccttgccagcacctgttgtttcttgattttttaataaacgccattctgactggcatgagagggtatatcattgtggttttgatttgtatacaaaaaagatttgtatttctctactgatcagtgatgttgagctttttttcatgtttgatggttgcataaatgtctttttttgagaagtgtctgttcatgtcctctgcctactttttaatgggattgtttgttttttttttcttgtaaatttgtttgagttccttgtagattctggatatagacctttgtcagctggatagattgcaaaaattttctcccattctgtaggttgtctgttcactctgatttgctgtgcagaagctaaaagacatgattttagaaaaagacatgtcaaagtcatacatgctcaacgacatagcgagtacatatgtaaataaaaaattattttatgctgtgaatttgaccgaaaataacctttacctcgtcaggaattacaatcctcacgtatggtaaaggatttccctattgcaaattattccacaacattaatgttctgtgtgctttttatctatcccaagatacaagtaaatttgacaaagatattaggtttgtaaacaaatttacgttcaaatctttgcctggaagtatctagatagaattttgcatgcaaaagagtatttacatctaaaaaattacatatttcaaattaaaatgattttagtgttatagatagaaggaaagagttattgaagtttatttctgttttggcagtgtaaatgaattacttacaaaattttagaagtctacaggtgtttttataaagtttgtgttatttgtggaaacctcagttttctggcattttgccaatgaggtctactctaagtatagcagaaatttgttttccagctttataaatatatattttaagattaagaactgattttacttatataatctgggatcaacttttggcttctcctgtcaaggattttgaatttgtgacaaaatatacacttattgataaccagtgacatatataaaatgctttacaattaataaagcatatgtattttacatattttttcactacatatgacgcatgtggcaaccccaagagttgagttgtacccatcggcaaactttgatcatgattctgtgaatataggcaagcaccaattgcaggtagaacattctttttttgagtcccaaaccgtgagaaacaaattacagaaatgtacctttcttttgcattaggacacgttgtagttttgtatgaacactctagttttaagcagtatgtgcaaaaacattgcacaaaggatttgtgtgttgattttgggactcctgtattattaattatgtggtttatttgactaccccacattttcaagcataaattaataaatccataattccaggcttattaacaataaacaatctagatagttgaactctttcttgctaacattttctagatatggactgtttggtatttttctactaataaagacccttagtaagctgccttctggtttgatgtcattgggatgtttactgggaactttggtggagatcttgcagtctctctcccccagtggtgaaagaatgagttacaaaccagctttccttcccagtgtacaatagcgatggagtttgttctatatggaaaatttgtttgataaaagtattctttaaaattttttgttccataaattatcagtattttcagtttctgattcatgcttgggatagttgctgcatattgtttaattttgtcagaatttatattgttaaatatcaaatacgacagactaccctcaaatcataagtagttaatgtaattaacatcctgtttcatcatgagactcttcagtgttacattaaaaactgctacctcctgggccgggcgtggtggctcatgcctgtaatcccagcactttgggaggctgaggtgggcgatcggatcacgaggtcaggagattgagaccatcctggctaacatggtgaaaccccgtcgctactaaaacatgcaaaaaattagccgggcttggtggcgggcgcctgtagtcccagctactcaggaggctgaggcaggagaatggcatgaacccaggaggcagatcttgcagagagctgagatcgtgccactgcactccagcctgggcgacacagcaagactccgtctcaaaacaaaaaacaaaaaacaaaaaaactgctacctccttattacaaataggaactaaagttgaagtttgaggaatttgctaagaactaagccttgaactaaggctattttatttgagtatgagtcatatcagggtacggatccattttactattaacaaaacaaatatgttctgttttttttttttaaatgcacacaccacgtttgagagattcttattcactgtattttctttaattatacttgaattttggtttacattgaggagtgccctcaaagatattaacagatttttaaaaaatcctctaaaaaactcattcttagggaaatttgttcacttactaggtgaggagcaaaataaaaatccttaatatagaagagctattatctgtcttcaaaattaagtctttgagtagatttgtgaataaatctaatagttttgctgaatttacttagatcttaagacagaataatcatgtagaaaatttaaaatgtcaggaattcataatgattcatatacccaaggattttcattgatagtgaggtaaggttattcttgagaaagactcaaagtcataaaataatagaatttcgaaactaccagaattatacaagtcaattaaaatgactgatttgttttaagaggaagaaatactaaatgtataattattagatgcagcatattgtatctgttttgttttgtgattctagctcttataacctatgcttggacctaggtgtcataacttactttaaatatgtatgtttggttttcattcatattgacagtactacctctcagttttctttcagatattgttttgtatttacccatgaagacattgttttttggactctgcaaataggacatttcaaagatgagtgaaaaaaaattggaaacaactgcacagcagcggaaatgtcctgaatggatgaatgtgcagaataaaagatgtgctgtagaagaaagaaaggtatgttgttcattgactattcttttgggtgagaaatttaatttatatttgactgtgcaaagagtcagttgttacttgtaaacttcaagtcattgtttaggtcagagttgctgttgtctaaatgcaccaggacctagttgttgaaagggtaaactggaataaactttaattgggtttacaaaatgagaattcttactgtatattttctctttttcgggttgactttaccagtttgttctagttcagataatttagacaacattaactttgttgaattttttgtttgccagccggtcttcagcattttaaggcaacattattattacagttgtaatacgaatataattaccagagaaaaaactcaggaaaataaatgcttttatgaaaatgggattagaggtttgaaaataaacttgttaggagaaataatttcacaatgggatggttttttctttgttaagttttctttatgacttcattagtttataaaacattaattgataaaacttagaactataaattgaatgcttcagtgaactttattatttcagtgaacatttgttatttgatgtgaactttgtgcctgttttgaaatttactaaactcaaggcatgtgttcggaagagtgtttttgaagatgacctccccttcttagaattcactggatccattgtgtatagttacgatgctagtgattgctctttcctgtcagaagatattaggtaagtgatttgaatttcctgattttatttgaatttggacccttagaaggtactattatggtaatgtttgtgaatatactgagttttacaggtgaggtgtgttcaatagataattatttctatgtatacactatcaccaagttttacatttcaaataaaagtcactgaattaatttgtaatctgtcagtttgttcattcataagcttttctattacttcagacagtttttttttaacttttttaatatatgtgctgctgaagcgagcacgacagttttttaactttcagtacttaagatgttatatatagagctactgaacatactgtgtttattttaccaatttagggaaaaagtgcaaaaattatttaacctttaaatgcacctttatatttcattaaaaatatcaacatagtaatattgaataatggctatgatcggctctgttgtgtgtaattagtaacagttgtagcaaatgatccttaaaaaatgttctaactaaacattagaggccaggcgcggtggctcaggcctgtaatcccagcactttgtgaggccgaggcaggtggatcacaaggtcaggagattgagaccatcccggctaacatggtgaaacaccgtctctactaaaaatacaaaaaattagccaggtgtggtggcgtgcgcctgtagtctcagctactcaggaggctgaagcaggagaatcgcttgaacctgggaggcagaggttgcggtgagccaagattgcatcactgcactccagcctgggcgacagagtgaggctccgtctcaaaaaaaaaaaatccaaaaaaacaaccccacaaacaaacaaaaaacattagaaatgtctgttagtacttttaaaggttgccttgtaaaattaggactgcaatagtgcaatctaaggctctcaaagcataaaacaagtaataaggaattcattcagatattttccgaggtggttatacctgtcttttaaaaaaaaaattttgttatatattgggttaaaaaaagcagaggtgctgggcacagtggctcatgcctataacccctacactttgggaggccaaggcaggaggattgcttgagcccaggagtttgagaccagccatagtaagacccccatctctacaaaaaaatttaaaaattagccaggtgtctgtggtcccagctactcaggaggcctaggttttgggcccgagaggttgaggctgcagtgagccttgatcacaccattgcactccagcctgggcaacagggcaaaaccctgtctcaaacagacaaacaaacaaacaaaaggcagaggtaggttaagctatttattaatggtcttctactggtatagatataagctagaaataacattcaagtgtttttacttttactacagttatctggccactttgggactcattatactgaattagtttcacagaggaggtaaaatctgttgtttatgattacatattaactctaccattttaccttcagcattgctgtagtatgtcatatctgaaggcaattagcacaagtgacttgaagaattgtagttttgatgacttatatgtattttataaaaggcaggcagagtttttgtgtttgctttcccctcctctggacactttaaatttttgctaccacaggtttccaacaatttgattatgatgtgcccttgtgtaatgtggttggtgtttatttggcttggagttcgttgaatttttttgatctgtgtgggcttatacctttaatcaaatttgaaaaatgtcttcagatcctttttcctcccatcctgttattcttttctctttctgggactcttagtacacacaagtttgattgcttgatactgtgtcacaggccactgaggctctttcctttcagtcttttcttctttcttcctttttttctttctgtgcttcattttgaatagcttgaatagttttgtttcctgtcttcaagttcacttatatttttttcttctgtagtgtctggtctgtttataccatcctgtgaatttcttttttagatactacatattttgtttatctctagaagtcccatttggttcttaatttttttttccattttggctctcattattcatgtttctttcaaaattcttgaacatatttagcatatttttaatagctgttttaatgtacttgtctgttaattccattattctagggtttttttctttctattggatgatttttctcctgattatgggttatattttcctgtttattcctacagctgttaatttttttttttttaattaggcattgtgatcttactttgtggaatgttagattttattgttttcctttaaagaaaggaactttgtcagacatctaagttacctgaagatcaactttatgttttgaagcttgttttcaagcttgatcagggaaagtctacgtttgcctttagtctaaaggtaatttagccctataataagatgtgacccttctggagtctttgtagactgcctctggtgatcaacgatctcttctctgacttttcagaacgttaatgcctcttacctttgtgtaagtccgtcctaagaatcattcagcttatggttgtttgcccagccccatagagttttagtctatgcatgcttgtcttcgtattctgcaaagaccaaaggagtcccttagggagatttctggagctcttttcctgcctagcttcctcctctccagaactctgccccgtgagttccaggtccttcagcttccagggctctgaactctgtctccccaactcagtgctctccttgggattcttctccctgttctgttgtctgcaatgggtcccaggaagaatgtggggcaactgtaaggttcacccttcatttcccttcccttagagatcatagtcctgtactgcctgttgtctagtatctgaaacagttgttttatatgttttgtccaagtttagatttgtttgtggtgggagggtgagtctggcctcccttgttatatcatgttggcctgaagcagaagctgagtttcttttattttttaaatatagtttcaatttttaacaactattaaataggcaagtatcaacaacaatagataacaatataatagatatgcatattcctcccactttatcaaatcttaattttcttcaatttttttttttttttttaatagggtctcactctgttgctcgtgctggagtgacagtggtgtgatcttggttcgctgcaacctccgcctcttgggctcaagtgatcctcctgcctcagcctcctgagtagctgggactacaggcatgcaccatcatgcccagataatttatatatatatttttttatagagatggggtttttgccatgttgcccaggcggtctcaaattcctggactcaagcaatctgcctgccttggccccccaaagtgctgggattacaggcgtgaaccactgcgcctggcctgttttcttcagttctttattaagaaatgaaacagtaaaatacagctgaagccccgtgtttgttctttctgattctccctctgtgcccctctgagataacttctatgagttttgtgcatttttttttctttttaataaaaacagggtcttgctctgttatccaggctggagtgcggtggcgagatcatactcaatgcagcctcaaccttatgggctcgagtgatcctttcgcctcagcctctcaagtagctacaactactggtgtgtgctgccatgcctggctaattttttatttatagtttttaaagacagggtctcactatgttgcccaggctagttttgaactcctggcttctagtgatcctcctgccttggtctcttacttaaagcactgggattacaggtgtgagccactggctgctcacatgttttttataatagtacttaataattttatgtctgaaaatattatataatgttattttgcccatttaaaaactttaaaaaatgctaacaaactgtgtactctgtaacttgtcttttttactcaacactacgtttttgagaatttttcttgttgatctgtgtagttccattttaactgttatatcttactatgtttcattatgcaacagttggttcaatccattctcttgttaatggaaatttagtttgtttctaatttttgccagtaggaacagtgttgcaatgcatattcttaaacatgtctgtacacatctgagggtttcatttatttgtgacaaaacttgccaggtcatagtgtttatgcaccttcaactagatattgtcgttgtcaaagtttttttccaaaaggattttaccaatttatacatgaaccaccgatagatatcctcttaacacgtggtattctgaaacttaatttttaccaatcagatagatgtgaaatcacgtagacttagtttgcatttctttgacttctagtgagaagtagtgtcttcacatattttttggatttttaaaatttattttttatttttgtttttcttagagacagggtcttgaacttttacccaggctgaagtgcagtgatgcgatcatagctcacgctaacctcgaactcctggactcaagtgatcctcctgcctcagcttcctgagtagctgggactacaggtgtgtgccaccaagcccagctaatttttaatttttttttttgtagagacatgctgtgttgcacaggttggtcttaaactcctagtctcaagcagtcctcctgccttgactttccaaagtgctgggattacaggggtaaaccaccatacctggccatatcttttggatttattggtcatttggattttcttttgggaattacctgttcatatttttctccatttttctgctgaataatttgtcttttcttacttatttttcaagaaattttacatattttctggctgttcattgtcagttgtatgtgctccagataacttgaacagtctgtggttgccttttaatttttgaattatgtctttagttatgcagaagtttaaaattttaacataaattaatttacactatttttctcactttagcatgagtctatcagatggggatgtggtgggatttgacatggagtggccaccattatacaatagagggaaacttggcaaagttgcactaattcagttgtgtgtttctgagagcaaatgttacttgttccacgtttcttccatgtcaggttggtatctctacatttcatttttatatggctgataattgtaatatgtcaactttatccctataaaattaagttcttttattagctggccgttctctcattatctcaaatttatttaagtatttatgttctacctgattcactcacattccttgttttatttaattttcacaacatacctgtgaggcattgacattttttctgttttagagaagagaaaactgaaattttaagaggctaaatgaccaggatatgtactgctattgctagcaggagtggcattcaaactgattattttttcttgtcatttatcaatcaggactgtttgctttagttaagaaatactcaaggtcaatgtgtttctgaatttaaaattactgttaaatacaaatttacacataaacatggtatgtataagaagtaggacataaatccatcatacttgacagaacttatggaaataacaagaaaatgttacagtttttccccagggattaaaaatgttgcttgaaaataaagcagttaaaaaggcaggtgtaggaattgaaggagatcagtggaaacttctacgtgactttgatatcaaattgaagaattttgtggagttgacagatgttgccaataaaaaggtaaaagcaatatatatataattttcatgatgaagattattttgtgttacacagaatgtactttctatctgaatgttagatttttttttgaaaaagcttgttatataatgtttttgtagcaataaaaaagttccaagtgaatgttctttaatgaaaacctttatttatttatttatttttaacttttgtttcaagatcggggtacatgtgcatgtttgttacacaggtaaacttgtgtcatgggggtttatcatacagattattttatcacccgggtattaagcctggtacccattagttatttttcctgattttcttcctccctcctcccaccctccacctcccacagtgtgtgttgttcccctctgtgtgtccatgttttcttatcatttagctcccacttataagtgagaacatatggtatttggttttctgttcctgcgttagtttgctaaggataatggcctccagtgccatccatgtccctgcaaaggacatgatcttatttattttttttatggctgcatagtattccatggtgtatatgtaccacattttttttaatgcagtctatcattgatgggcatttaggctgattccatgtctttgctattgttaaatagtgctgcagtgaacatatgcgtgcatgtgtctttgtaacagaatgatttatattccttttggtatatacccagtaatgggattgctggggcaaatggtatttctttctttaggtctttgaggaattgctacacagttttccacaatggaaagcctttagttctaatccatgtcttggcatagagtttcttttctttttttttttttttttgaggtggagtttcgctcttgttgcccaggctggagtggaatggtgtgatctcagctcactgcaacctccacctcctgggtttaagtggttctcctgcctcaggctcctgagtagctggggttacaggcatgcaccaccatgcctagctaattttgtatttttagtagagacggggtttctccatcttggtcaggctgatctcgaactcctgacctcagataatctgcctgcctcggcctcccaaagtgctgagattgcaggcgtgagccaccgcacctggccggcagacagtttctttttttctttttgagacagagtcttgctctgtcgcccaggctggagtgcagtggtgcaatcttggctcactgaaacctctgcctcctgggttcaagcgattctcctgcctcagcctcccgagtagctggcactacaggcgtgccaccacacccagctaattttttgtattttttttagtagagacgaggtttcaccgtgttagccaggatggtcttgatctcctgacctcatgatccacctgcctcggtctcccaaagtgctgggattacatacagtttctttaagcaagccttctcttttccttcctcccagttcttggtactctttcactttcatatatttgcaaatgtaaaattgtgttttaggtgtatatttttaatccatgtataccagtaacttaaaaaaaaatttttttttttttaagggagagcataatggagctcttgtgatacggtgctcttagtggaagtttggctatcaattccatcacctgtatttcacatattttattaatgaagttcttaaattaaattctcatatttagccaagtattcatttggctgggaggtagaaagcctactaaccaactttttttcatgaacaatatttttaaagtccaagatttttaatacctacattagggaaattctagaattaaattcttacaatgtggactgcatatgaggcttttagtgacagggaatttgttgaaggctatctgtgggttgtattttggtataacatttcctaattttatttgtggtatgttcatttgatatcatttggtaatacctgaaaacaggaactgattttactgtgttgctttttcatcatttctagctgaaatgcacagagacctggagccttaacagtctggttaaacacctcttaggtaaacagctcctgaaagacaagtctatccgctgtagcaattggagtaaatttcctctcactgaggaccagaaactgtatgcagccactgatgcttatgtacgtgcttaaagatctttagaaattgtgatgtgttttaaaaacattattataaatgactttagaaaaattttattatagtagtggcagaaactctaccaaaatattttatatcaatttggcattgaaaaatgcttaggaagacatttagtgaaactattcattttcgatattaattagcaagtaccaatcaacagattgttcaatgctagtttattttcattgtcatgaagccaaattaatgtctaatttgtatgttaaaaaatgtgaacttgctgaaaacatgaaaggctaataaatccaggctgagcaagcataaatagtactgatgatggatttgatatataaacaattcagaatgaaaataattatagtacagtttctattttaaaactggccttatttcttatatataaaatgtggtgaaattttagaaaaattgcctccaaatttagcttgttgctgccattagatatatttttatatttacatgtttgtatgtagtgaaatctgggcttatctttatatatagcactattgtgtgttttttaagaaatgtattttattccacagtgaatttgttttctcctaactcatgctttcatttgtagatgaatattttattgtttctcctttgcatctatcaaaggaatggaaactcctttgaattgtaaccagcaaacaattcacttttgttagggaaattggatgataattttcctttaaaagataccgccaaacttgagactaacattctcagctgatttaagtaggatttctcttactagattgcattttgttagattccattttaagttattttatttggatattgtgtgtaatattgagtgtgaaaaagtgaaaacaaacttttaaggctcaggcacctttctcaattttcacaattggtatgattattaaatgaggacatattgatatttgtgtcacataataggttgaattccatgtttgggtgctttgtgaatcattctcttcgatttttctgaagatgggacttactgttttatttcggtgatctttagcatactttttaaatttttctgtttttttataggctggttttattatttaccgaaatttagagattttggatgatactgtgcaaaggtttgctataaataaaggtatgttaagatccataaataaaatgtgaattcactcttttgtgaggtttatctccaaaaaaggcaatattcacatatttgcaaagcatttagtactataacttcttgaatgtctgagcagtcctgacattagggtgggatccatcagggcccaagatgagtgtttcatctttgttacttgtggcaaagcagcccttacttcttttactttgtagcattgctatgtatttggcttctagagttggggctttgtggctttcttattgcagtgacacaaccagctttctcctagtctggagattatacatccttgctataagtatttaaaatgctttctatataatgctttaaaacatgtaagatggcttatccccaagatggtagctaataaacactaagtgataaagtaggtaaagatctatttattcatttattaaatattgttggtcattttacagtgctttctaacatactgatttacatttctaattttcttctgtcatttttctccaaaaataatggtcatgtcatccaacctcagtgctgtttttagaggtcttgataagccagtgagagcagaaggagccacgtagtagagtgggtgagcccaggctttttgttgcacagaccaatgtgaatcccagccatgtgacctgggatgtacctgtttctccaaacatggaatgtagatactagcataatgtccgttttaccgttttatagaataattgtgaagacttaaagggacaaactattcgaagcatctgtattgatataaagttatcactattctcgtagcttccttttggagattttaaatgattgtgtttgttaagatgttaattaaattaggccattttgctaaatgctcttaaaaatatggcatgactgcctcatataaaatgatatgatattctttataattgtcgttgagcctctgtgggtggcaggccctcctttatatgttaaggtagaagagtctttattcttacttctcctccctggagagccacttcctatgaatgcctgctggttctctgtagtcagaggtcttgtggctgtaacttagagtcagtctccatatccctgggttctgcatctgtggattcaaccaaccacagattgagaacattcaagccaaaaaaaaaaattcacagttttaaaaaaggaaaagttgaatttcttgcatggagtaccacattgaatctatatgaatgaagtgatgcgtaggcattttataaggtattataagaaatccggagatgatttaaagtatacaggacaatgtgtatagattatatgcaaatattgcagcattttatataagagacttgatcatctatggatttgatatcagtgggagggaggttcctggaaccaatccctcaaggatacagaggaatgactgtatgttaattaactgaggcaggtgatcggttttttaagctgattagggaaacagtatataagaacttacttaactcataataaaactaaaattcaacaggggagagttatgattttttggctttatggttgtggaattgcatgtaggttacatgtacaattttgttacatgtgcaattttgatgaaaatgcttccaaggaatgtttatgatatttttcactaaagtaacatatattaataacacagtactggaagtcctggtatctgtgtacttgtcattgtaatgctacattatttgaccttcactttttttcccctttattacattatatgtgtgagtatattgtgacatcttgactcagattccagtgaattgtattaggttggtgcaaaaataattgtggttttggtaatttttaatggcaaaaaccacaattacttttgcaccaacctaataactaagattaccatctttttttccttccttcctcccttccttcctttctgttattcagccagaagtatcagcatcactgttctcttattttcttcatgtacatatggatgatattttcgaatgaccacttttctcttttgctttttattattagactgtttttttcttcttgttaaaggataaaaagattagaacataaaaggatatttacacattgtttccccattgacttattcccaagatggtagctaaaaacaccaaatgatatagtagttaaagatacattgactcatttattaaatattgttgagcattttacgatatgggaataccgtagtgaacaagccaggcatactctgtttcctgaggggcctacagttttattggggatatagatgagtgaagaaagcaattgcagtgtagggagatgagtcttatgtcatgggaaaacaaggtgctgtagttgacacaccgagaggcatctgacacattgggggaaatattctagaatatttcctggagaaagtgcaggtaaaagccagacctgaaacctgagcaagagttagctaaggccaggtgcagtggctcacgcctgtaatcctagcactttgggaggccgaggtgggtggatcacctgaggtcaggagtttgagaccagcctggccaaaatggtgaaacaccatctctactaaaaatacaaaaaattagctgagtgtggtgacgggcacctgtaatcccagcttcttgggaggctgaggcaggagaatcgctttaatctgggaggtggaggttgtagtgagctgagattgcaccattgcactccagcctgcacaagagcgagactctgtctcagaaaaaaaaaaaaaaaaaagttagctagctgaagagtataggaaagaatgggtacaggaaattacaggtgccaagttacagaggtgagagaaattatggtatctataggtaattgaaagtaattcagtatagtgaacattgaatagggctgggcggatgaaggcaaagcagaaaaaggaaagcagatgggccatggtaaggagtttatatctcctcccaagagcaatcgaagtgactgagagttttaaacacagcagtgaagtgaattacattaaaaaaataagaacttgggctctagaataaaaaacggatataggaggaaggcaggagtcacagtaggaatatcttttgggaggctgtgacaataatccaagtgagaagtaatggcaacttgagtcggttaattgtgttgagaatggagagaagttgacaggttcaaaattcatttttcttctttttttgagtctcactctgtcacccaggctggagtgcagtgatgcgatcttggcttaccgcagcttccacctcctgggttcaagtgattatcctgcctcagcctcctgagtaactgggattacaggtgcctgccaccacgcccagctaatttttgtgtgtttagtggagatgtggtttcgccatgttggccaggctggtctcgaactcctggtctcaagtcttccgcccacctcagcctcccaaagtgctagaattataggcatgagctaccacacctgacctcaaaatacatttaatagagcaagcatgagccactatgcccagcctcaaaatacatttaataaaccaatggaatttgaggtaatgatgaaagacacatgtcaaggatcattcctgtgttgttggcataagcaacagggatgaaaagcattgaggaagagcaagattttgggatgcgttgtcacacagttgattttaggtatgttaagggagggagacctgtaagacagcaaagtggaggtggtgcaagaattagttgtgttggctgtagcacagaggacagtttgagttaagagagttgggactgagaatcccgaggaactcttagtgttgaacatttgcgtggaggaggggacaccaaaggagttgccatagacatcgaggaaattaggaggtgtggtgtgcagaaagccaagtgaagaacatgttttaagtaggaggatgctatcaactgttttaaattctgctgagagtttgagaaactgaggacttagaattcatcattagatttggcaatgcgccaatcatttgtaatcttttaaacaatagttttgctgtactgggtagcaaaagagtgatttgaggagtggtcatttggagcatatgctattcaaacagagaagagtccacgggctttggtaacatgaaggtcctataaccatagcaagagaatgaggtgggtggaagtcatattaacgtgaatagaggagtaggttagatctgaggaatgtgggaacagagacagggtctcattatgttgcccagcctggctcagactcgtggcctcaagcgatcctcctgcctcagcctcctgaatacctcgggtttcaggcctctgcatctggcttgaaaacaacattttctcagaagcttgttttagttgttttagaaataacgaaggcatgtgtaaacaactgttctagaagcttagtttggaaagggaacgtttattgatgcatataacacttatatgttgggtgcttatgtgtcaggcactgttagagttgctcgggaaaatttacaaaccaagcaaaccatgccccttcatttcctttgggtgaagtgagggagccatgtggttatctgaaggaagagcttagcaggattagagggaagaaagtgcaaagcctcctagggtgattggctggctcttttggaggaacagtacctataactgaatgaaatgagtgagggtaagagtggcaggaaatgaggctagaaaaggagcttgggccatatcacgtagggcctcgtaggctgtgaatctgacttcatttcttattaatgaaaataaatacgatgatgggtgatgggaaacccatagaggatttggagcagaagaatgatataattaaaattttattttagaaatatttttctggttgtcgtaagaggaaaaatatttagccccagggcattttggcagagagttaggaggctattgtaacagcccaagcaatagacaataattgtttggattaggcgggtagcaatagaggtgatgagaagtcgtagcttctgtaggtatttggaagatatatattgtgaaggatttgctgatgaattccctgtaaggggtgagatgtaaagattcatagaacattaagatattttggtcagatcatctgatcaatggaaaggtcagttatagtggacagattatgagaagaacaggtttgggtgagaaaactttagatttcagtgttggatatcctaagttttagatgattattgatatccaagagatatcaatatttgggatcaatttgggaaatatgatcccaaagttcaaggttgaggttggagatgtaattcagatccgatggtagttaaagcagtgagactgaatgagataaaatagggagtgaatgaaataaagagtaggtgtgatattgacctcaagggcacaccagcatttagaggttgggaagatgaggagagagcagcaaagaggactgggagggccactaatgaaggagggaagtacaggaggtgtttagttctgaagccacctgaagaaaatgtttggaataggaagaagttgtcagttgctttaaatcattcggggaggttgagtgagatgagagtctagaactaacagttaggtttgatggtgtggaggccatcagtaaccttttctttcttttttttttttgagacagagtcttgctcagtcacccaggctggagtgcagtggcgcgatctctgctcactgcaagctccgcctcccaggttcacactattctcctgcctcagcctccggagtagctgggactacgggtgcccgccaccatgcccggctaatttttttttttttttgtatttttagtagagacggggtttcaccatgttagccaggttggtctcgatctcctgacctcgtgatccacccgcctcggcctcccaaagtgctgggattacaggtgtgagccaccgcgcccggcccaagagtaaccttttcaaaagcagctttgctctactgatttgggtaaaagcttagttgcagttggtttgggaggaaatgggagcagaaaatttgagagagtgagtgtagacaactctttcaaggaatttcgctataaatgggagtagagatctgaagactgaataattagcaaactgaaaagtgggaagacgtaattctcttattatttcatttttcttagtgaaataagaggtgaagttctctgagtaataggagggtcaaacaggtgttagaagttcacaaagaaaggaagaggtttgaaatagtcattttgagagtgggaaatgtagaagaattaacagtcattgctgagggtgcgtttgaaatctgtcatgagtttaaaataacttgtgtcatcatcgatgtgtttattttcaactatattcaactgcttgggtgtaggcatcaggtaggtaaaaaaagtgggttttattatgagtagaggttttgccacgtaattaccatggagggagggaagagcaaaggagttgagagtatagatacaaaggaatgattactgtaatgtgggtaagagaggaatggaaggctcagtgggcagtgggagtagggatgttgataggtaaggaaaaggtgataggatcaatgcatttggttctgcaagtgtcaaagtattgttggggaaagcatgctggaaggaaagatagggatgctggtgttctcagggtggaaggcttacagttgtagtctggaagtggtgattttattggcaattataaggtcaacggtatgactatggaattgagtggctaaggtctgttgaagaaaagattgtcggaaatgcaggggtcaaggaactggcctgtggatgttgaactcactggcagtgatcaaggaatagtagtggagtgaaagtagttaatgaatcaggcactaagatctccaagggatgaaaggatgcagtttggagatgacaagataactgtagtaatcaggaatagcaggttttgtagctctgtctcataggcctcagaggagatgggcttttgaaggacaagagaaatgatgatgaataaattctaagcaggggaagtgtttgggaaagcagggcaggctttgtgctgttgatggcaaatgatgtaccagacaggatgaagttgagaatttggaagttgatcactgattagaaaggcttacattttattttggccgggggtggcagctcatgcctgtaatcccagcactttgggaggccaaggtgggcggatcccttaggccagaagttggagaccagcctggccaccattgcgaaacactgtctctactagaaatacaaaaaaaaaaaaaattagctggtcgtggtggcacatgcctgtagtcccagctactccgggggctagggaatgagaatagcttgaagccgggaggtggaggttgcagtgagccgagattgcgccactgcattccagcctgggtgacagagtgagactctgtctcaaaaaaaaaaaaaaggaagggcttacattttattttggtgctgactgggaatgaaggcaatgagggatgactgttggagaaggctgtgcttactaaacagtattattaagtagcagcatacatggtgttatactgacttctgattttgcaatagtacagacaggttcagattctcatttccaccttctccttctgcctaggtgaataactgctgggttatagtacagatgactgcagatcatttggaatttactttaaatgtaaacagtaaaaatttgaaagagagggaaagtgattgaggcaatttggggattgaataagaaggtctttttgttggaattcatttaaggaaagaaaatgaaaatttgatccctaatattatttaatgaagtggctaaatgaatatctctgctttgtggtttgaaaattaatattgattttttttccccctagaggaagaaatcctacttagcgacatgaacaaacagttgacttcaatctctgaggaagtgatggatctggctaagcatcttcctcatgctttcagtaaattggaaaacccacggaggttaaatattaccttttttttttttaacttaaatcaattctgtttatttttttatcacattttcctatatgtgaagaatactattcattaaggctgactcatagaaatttgcttgaatacacacacacagactgatgcataaatttgagaaatatctttccagttgttgaatagtgaatccaaaggtttaagccttttctgtctgctttgtaggatgttttatgaaacaaaggaatagaaattgtattcatattatacattttgaaattatatctatattatattttttgtcaaagcaaaataaattatacattaaggaaaatatttaagattcaaagttgtcattttctttctgttaatgagtatctttgatttaataacatttatagtttggtcacttgaaatctatagtgaccaaaagcaatgtcatatttagtagcctcatttctgttactatctgattattacttaagaattctacttaattaatagattattagaacaaaaggcattccaattttagagattcttttatggttaaagcactaggtaacttaaaaaatttggatcaaatgttatacagattaatagaccttggaatacaggggctatgtctttttggaatcagaccttgtcctggccttaattgcaggatgacttccttattaaatctctaaaagcaggaatgctctggaacaatgaacaattagaatgtggtaatgtaattttgggccaaaaaatactttgtagaaatgtgattctcttacttggaatagaaagaattctgactcgaaaaagtgcagttaatgtatgcttttctgggtaagatttgtgatagattttgattgagatttaaaaccatgatatataaatttagcttttttgtcaaagtaatttgccaccctagaatttgtgttggtaatttttaatgcaacttggacaatttctgaaagatgtaactttcttttttttgagacgagtctcgctttgttgcccaggctggagtgcagtgacatgatctcaggtcactgcaagctccgcctcccgggttcacaccattatcctgcctcagcctcccgagtagctgggactaccggcgcccgccaccccacctggctaattttttttttatttttagtagagacggggtttcaccgtgttagccaggatcgtctcgatctccggacctcgtgatctgcccgcctcagcctcccaaagtgctgggattacaggcgttagccaccgcgcccagcctgaaagatgaactttaaaatggggaaggatactagtaaagccatttcttactcatgtatacatttttccctccatgaaattagagcagccaccttttacatgacttttacatgcatttcagatttttgtactagcaattaaaatatctactggatgtaaatcacatgtgcttaatgctttgcttcataatatctgttgaagtcaattaaaatatagagacagatctttaaattgaacatgttttatttgggaagcaagaattaaatttgaggcatatacacagactgggtgtccttggtatctctgaagaacaaagagaagtttggaggttatagaaaaaggaaaatgtgacattgtttttccagaaagttctttggcactagtaaattttggggagttggaagctctgatgggttagtgactgtggtgggtaaaactagtcttagagtcacaacaggttgtttcagtatctattagataaaacaggttttaggttacaataggcagtttcagcagctaggcttgcagaaaattacattcttagagtaatgttatgtgccttgagtgcttttttccccttggcccttgactctgatttagttgggtatgacaagaattatcaatttatataattactttttacatattgaagctgaataggttttcttaaaacttggaaatgggaaatactgggtcttgtgaagttttagtgtgaaaacgataactagtctcttatttcatgctctttgtaacaagtctacagtaatacctaatgtatctagatgacacctcagaaccaggagggaacaaaaaagacctctgagcagtcaaaataatgctataagcatgtattccagcttactttcggcatttctgtggagtgcaggaggccacattttgttcatagatccagtttgacaagcttgggtactgagttaaagtgaaaatggtgtaaataagtaatcatattcacatgacagtaggtggaagtgacagctgacaatctgaaagagtggacaaaactataaaaattagaactaagaactcttaaaatagaacggtttgaagtttgttacagaagggagcagctttatgcttcagtggactctgaaggtattggcagtgtatagtactgcttagtcattgatttaaattcggtatatatctcttctattgctgtcatgtacttgacattctgctgggtgctaaggctgtctgcaggctactaatatgcataataacaatcctgaaaaagaaggaaaagtatactgtgccttactgaagaaggcaggacagccgttggtatttgttagagtaaatattagttatcttacataaagcatgttatattccctgatgtcagggcctgataaatgagcccttacactcttgatagtcaatctgtgccactgttgctgtgtttgtatgttacaccatttcctgtccatgtaacagttaaactgtatcacatatctgttcctactaaactatttgcatataattttaacatttgagtggctgtatataaagctaaaagttctttataagatttatagcatcttagaatgtttaaattagataacattagtgtgcttttagtttttgaatttaattttgctcttgattttgtttgtgttaatgtagactttgtctacgtaagcttgagcccaactttggagtggtgttttcagtgatggaagtaactggaaataactcatgaaaccacttagtacttttgatagtttattcccatgaaggatcaaatttttacttgagtcattaatataaaaatttaaaagacatgtcagattttattaagcatggattttaaatatataaatattagaagacctaaacaaaatcgctaatgaaagagtaaaacatgtccctgcctatcatactcccttcactttcactgatttctgcttttatgaagtactttaataagctctacaacaaataaacaagacattgtgcctcattttacactctagcagtggttttccattccaactaactagattgggtttataatatagtcatttaaacttacttagttaaaatgttatacattagcaactgcaattaaggagctaagaaattcagctcgtatttatttatatgcatcttatccatagtttctcacttgttatatttgcctactgatggcaaattgattttttctgttccaaaaatgtagtgttttgagatttttggagatgcaaaacagcatcattttcaaattagatcacaaacaatcttacttgttgcagttgagactagtaattgatcagtgaggtgaaaaaattaggcaaaacggtatcatcaaaattttctttctttttttttttgaaacagagtattgctcttgtcgcccaggctggagtgcaatggcacgatctcagctcagctcactggggcccctacctacgggattcaagggattctcctgcctcagcctcctgagtagctgagattacaggcgcatgccaccaagcccagctaatttttgtatttttagtagagacagggttttgccatgttggccaggctggtctggaacttcagacctcaagtgattcacctgcctcagcctcccaaagtgctgggattacaggcatgaaccaccgtgcccgccccaaattttcttttaacttaaagtgttaatgtttgtttgttcccaatatttttatatatgtcaaggctttttcattatatacaggccagctctttggagttctgcatagtgtttcttgtttaaaccacacctataatgtaccatctacaatttccaattctttaagacagagtgaaaaattaagacacctgaagcaatctgagtgcggagtcctaggcattatgattttccttgacacttttagggttcttttatcacagtttatcaaacacctttttttttttaacaaaaaacaaatttacaaaatctttccatgtattcaacttagaatttaatgaaatagggtttttttttttttggtggtcatgtatcatcaactttctttacatttaattaaattaatcaacaaaaaacatatagttgacataaacaaatttgggaccaagcactactgactcttagtaaacatacaagtcaactgttggtgcagaagtgccttgatgctagagagtagcctgcaagctgtaattatatatgggcattagggaatgaagaacagccttaatactattgatcttttaagtgaaggtcagcttagaaagcttttacttgttaaaaagcttcacagtttgtccttgtagttaatgcaattgaagttgaattaatctttcttaattttttttttagggtttctatcttactaaaggatatttcagaaaatctatattcactgaggaggatgataattgggtctactaacattgagactgaactgaggcccagcaataatttaaacttattatcctttgaagattcaactactgggggagtacaacagaaacaaattagagaacatgaagttttaattcacgttgaagatgaaacatgggacccaacacttgatcatttagctaaacatgatggagaagatgtacttggaaataaagtggaacgaaaagaagatggatttgaagatggagtagaagacaacaaattgaaagagaatatggaaagagcttgtttgatgtcgttagatattacagaacatgaactccaaattttggaacagcagtctcaggaagaatatcttagtgatattgcttataaatctactgaggtactaaataaagaggaagcacatttttagttattagtaggttctggcagactttattcccgtaaagagacagatagtaaatattttaggctttgtgggacatacagtctctgttgcagtaactcagttctgttattgtagtgtgaaagcagccacagacaaatgtaaacaaatgtgcctgtctttcaataaaactttatctacaaatacagatagtgggccacatttggcttgcgagctgtagtttgctgttcctgacttagtatgatatgcagcattgtgtagtggaaagattttatagtatcaacagacatttgtaggagtttgctattttataatttcgtatgcttttttcataatagatgtctctgctttttgtggattctcttcatatctactagtgtttactcttctgactttgatttttgggggtgtattttatttctttatacagaatttttttcttttttctttctttttttgagacaaggttttgctgtgtcaccccagctggagtgcagtggtgggatcttggccccctgcggtcttcaactcctgggcttaagcgatcctgtcacctcagcctccctagtagctgggaccacaggcctgcaccactacactcagctaatttttgtattttttgtagagatggggtttcgctctgttgcccagactggtctccaactcctggactcaagtgatccacctgccttggcctcccaaagtgttggaattataggtgtgagtcactgtgcctggcccagaatttctttacttgctcatgtgagagagtttctaataaactcctgatgcttttgcttgacactatagttttactgtcatctcagagtcagattttttccttaatttcttcattaaattgatttcttaatttctcatttgttttgcattagtttacaaaattacttaagatgcctatattctctgaaattttatattttatttcacgataaataagtttaaaaaattagatttgaccatttaattagagttatttccccatcatttttctaatggcaacaataattttagcatttgagcaattctctgtattttggtaactattagtaatcacttttatcagtataaacatgcatttcattttaaaatggttttcaaaatattctcataccaaccattcataaaagatgttccccttctgggaaatatcagtttttgctaacatctgcatttccctttgattttctaggaatttcttattaggtatacactttaagtgatatgtttcatataatattataggattatcaggatttcatgattttttttttttgagatggaatctatctctgtcgcccaagctggagtgccgtggcgcagtcttggctcactacaacctctgcctccccggttcaagtgattctcctacctcagcctcccgagtcactgggattacaggtgcccgccaccacacccggctaatttttgtatttttagtagagaaagtgctgggattacaggtgtgagccactgcacctggccttggatttcgtgatttgactgacatcttttacaccaattattgccatttttttattgggtactaattattagtattgctttctttattcgttaaataagaagtaaaagaacttttaaaaaataaaataactttttttcctagtacaaagcttattttcaattttttttattgcttaaattttgcaggttaattaaggctgtacttctttttcctacttcctgtttaaatatttggcattttttgagggttttctttctatggatttttgtgggggatcccatctcgttggacacttggttcctggagattgccaaattattgaaaagtttcctcatacccaaacattggcaatagactgaataaataacatctctgacattatttttcaattatatagagaatgctttttgtaaaatactgatttatttaaagatattacaatcatagtagttttttgcaatcttttttaaatcagtggatgtcaaggaacaactattgttctttgtacggcatttttcaacattgtgaagagttcttatactcaaaaagtttgggagacacagtgtgacattgtttaacctgagttgaacttgtcattttgtattcttgtttagagcagggattttattttgtctctttatctaactttgtattcctaactatttctttctttctctttggttctttgtttctttgttcattcttctctctctcccttttttatctatcatataaatatgtaaatatatattatatatccattagggaagaggaagttgtctaaagatatctagtatataggagctttgttctgcagaaaagaggatatgaagtcaattatattggaaattaatgcttaatactttttttaaagcatttatctcccaatgataatgaaaacgatacgtcctatgtaattgagagtgatgaagatttagaaatggagatgcttaaggtatgtttacaattataaaaatattacttcaagttctttccaaaggacatttaattaagtaaaatattaactaattctaaactaggttctaccacaatgaaattgctactaattatgtaacattagatttcacattttccaattcatgtttctttcatgtagtctataaataatgggttagaggtaatttactaattttaaatgtgctttccttgttccttcttattttttattttgaagacagggtctcactctatcacccaggctggagtgcagttgctccatctcggctcactgcaaccttcacctcctgggctcaagtgatcctcctgcataagcctcccgagtagctgggattatgggcgtgcaccaccatgcccggctaatttttatagttttagtagagacagggtctcaccatgttgtccttgctggtctcgaactctttacctcaagtaatccacccgccttggcctcccaaagtgctgggattacaggtgtgagccaccacacctggccttggatttcatgatttgactgacatcttttacacaaattattgccatttttttattgggtaccaattattagtattgttttctttattcgttaaataagaagtaaaataacttttttttaaaaaaagaacttttttcctagtaaaaagcttattttcaatttttttattgcttaaattttgcaggttaattaaggctgtgcttccttttcctactttctgtttaaatgtttggcattttttgagggttttctttctatggatttttgtgggggatcccatcttgttggacacttggttcctggagattgccaaattattgaaaagtttcctcatacccaaacattggcagtagactgaataaataacatctctgacactatttttcaattatatagagaatgctatttgtaaaatactgatttatttaaagatattacagtcagtagttttttgcaatctttttaaaatcagtggatgtcaaaaacagctattgttctttgtacagcatttttcaacattgtgaagagttcttatactcaaaaagtttgggagacacagtttgatattgtttaacctgagttgaacttgtcattttgtattcttgtttagagcagggattttattttgtctctttatctaactttgtattcctatttctttctttctctttggttctttgtttctttgttcattcttctctctctcccttttttatctatcatataaatatgtaaatatatattatatatccattagggaagaggaagctgtctaaagatatctagtatataggagctttgttctgcagaaaagaggatatgaagtcaattatattggaaattaatgcttaatacttttttttaaagcatttatctcccaatgataatgaaaacgatacgtcctatgtaattgagagtgatgaagatttagaaatggagatgcttaaggtatgtttacaattataaaaacattacttcaagttctttccaaaggacatttaattaagtaaaatattaactaattctaaaccaggttccaccacaatgaaattgctactaattatgtaacattagatttcacattttccaattcatgtttcttttatgtagtctatgaataatgggttagaggtaatatactaattttaattgtgctttctttgttccttcttttttttttttttattttgagacagggtctcactctgtcacccaggctggggtgtagtggtgccatcttggctcactgcaaccttcacctccagggctgaagtgattctcctgcatgagcctcctgagtagctgggattacaggcgtgtgccaccatacccggcttatttttgtattttttgtagagatggggtttcaccatgttgcccaggatggtcttaaactcctgggctcaagtgatctactggcctcagcctcccagcgtgctggggattgcaggtgtgagccgccgcatccagccctgtgttccttcttgtgttactttcttgtaattttttcctggaatatgggtagtgatttggctctccagtattgaaattgagtttcctttcttccaattcatgtgtatccatttttatttggaagttttgtttttatacattcaataatcatctttactttctttggtattatttactatggatattttatattatataattttcaaatggattaaatggttcagttttactcttattattgagattgaaaatactagtttataatttatatattttctattcctttacctctaatttctttgtcaggtgttactaaccaaagatgtataataagaaaagccaatgtagctaaattaagtaaaaaatgaagaaaaacacagaagttccccattatgcatttttttattcctaatctttaggttgatgagatttttttatttttatgaaatgagattaatttattgacttttttagttttgaggccaagtaatgagtagtgagtaagaatgtatattctagggccaggcatggtggctcactcatgtaatctcagcactttgggaggccgaggcaggaggatcacttcattccaggagtttgagaccaacctgggcaacatggcaaaaccctctctctccagaaaaatacaagaattggctgggtgtggtggcatgtgcctttagtcccagctacttgggaggctgaggtgggaggatcacctggggagcctggggaggttgaggctgcagttagccatgaccatgccactgcactctagcctgggtgacagagtgagaccctgtctcaattaaaaaattaaaaaaaaaaaagtagattgtgaattcagatgtaggtttgtatcccagcttttccagttagtatctgtgtgactttggggaagtttcttagcatctttgatactcggttaacagttgtaattattatttaaggtattgcttgagaagagcttagtatagagcctgacatttagtaagtgtttaatacatattagctaacagtaaaactagaacataaatactgaattgtattttgttattaattatccatttctctgagaagtactgttccaatagtacatttataggaaacttgtggacgtctacaaacgtatacattaaatctcttagaaggcaacctggatgcccatattagagaactctattttaaacatgcattctaagtatgtttgtggacttgaataaaataaaacaaacagaaacacttctttcttctgccttcaggcttgaaatgaacatacttttttttaaaaaaaaaccttcaaaatgaaaatattaaataaaagatttaataaaaagagaaagtaaaaactgtagtttaataaagtcttcctgtctcttcatagttaaaaaatgttatagatgaaacaattttgaaatattcttgaaatagataatctttatttaggggagaatgtcagatactgtcaagccaaaataaaaacaaataactttatttcatgtttgtaaaattccttttctaaaatgatttgaatcttttgttgttttgacaattccaaaacacatttattgtttgctcatagtttcagccttattcagaaagaatgcgactgacacatgatatagagaaacttgttccaaaaataacattaaaatccacgtttactacttgagaatcgaaaatattgaggtgcaataaagaataaaatgttttaaattatccaaatttaaaatttatgatagctttccccaggggcagtttattatatgctattaatgagccttgtttatgctggaaatgttccatctttggccttgcgccttagaaaccattcatgagcacatatttaaaccggagcacacatgttcttttgtagtatggcttgcacatctgccagctttcgacaaaattgtaggccctgttaataatagtccttttgtgtttggtgaaaaagatacgacactgtcagtggttttgcttttaagatttcttttaaactttcagtctttagaaaacctcaatagtggcacggtagaaccaactcattctaaatgcttaaaaatggaaagaaatctgggtcttcctactaaagaagaagaagaagatgatgaaaatgaagctaatgaaggggaagaagatgatgataagggtaagcactgaagtatgtttgaaatgactcacctgtgatacctaccactgactttaacttaggatccagttttggatggtttggaggtcagggactttgtggcatatagttaattattggatccttataagcttttgtctccttagtgcttttgtctccataaagcacaatcttactacttagaaaaatagagtaatagcattatgatgataaaaatatctttccctttgtttttttgtatttctccaaatcattatagctctcatttagaattattaaagctgagaactctaacaatgaacttttattgtttagtggttaattatcttgattctttgttttgccctttcttggccactcaggaatctttcaagctcactgtggacagggaaagtgacttgggtagagctaacataacttcattgtgctgtgcagttagaattttgaccaaagatgtgggtaactaacttttcctaactaaatgacatttaggtaactaaactaaacgagattttcgtaactaaattttggtgtaactacatttagctttaggtaactaaaacgaagattttattttatctgtggatttttttagtgcgggactaatgtaatttctgattaccattaattgaaggttggttatattataacatttggattggtatattgcttgccatggtttgttctaaatgttagcctttagaagtattcctgattctaaaacatcagttttttttaatagtcctggcaaagtgtgaatcacaacaaaattctaatacttaaaagtaatccaagtgtcacagatggtacccagaagaccagtttgtattggaattaaaaaatagaaaacattaacccatggtagctgtcactgtattctttcaaagaagccaatgaaataaactgttttctccctctatgtggtgtttttctacttgaacataaatgcacattttattttatttccagactttttgtggccagcacccaatgaagagcaagttacttgcctcaagatgtactttggccattccagttttaaaccgtgagtataatctcatttaatcaaatcacatatttagtattctctttaaaacaagggaaaaggcaaataacctgtctgcttaacagcaacagcacaacttcactatagttatacatgccacactgtattttctgtgtgactacaaaattatttcaaagtgatatttatataaaattcatttctgcaaattgtttttataagtgaggaaaaatggttttcctttaactgagcagttctgagtagaaactagtttaaagatacttataaataaatgttaatttaatactgacttgtttttcattaaacgagtgtctatgtgcctgttttgtgtatattacccagaacatgcagatgtactagaagttcttaatacaacaatttgaggaatagtgataatcttatctattttaatgtactcaaaatttgtttacatctaacaggcacatttttgtgaggattaaatgagatgaataagaatgagatgaacaagtaaatgtgaataaaactaataagcctgtgaaaatctagactggatttttcctattctgagaatttaaaatataatccactgaagtatttctttccttttttcttttgatcttaaacattttttatttatgtcttacatacagaaaagtgcacatgttgtagagatcaatgaattgtcataaactgggcaccctgtggccagcacttagttaagaataggtcagtaacagcatgccagaagaccacctctccaattgatttttcccatgatattttattaagaaaattttctaagatgtagtaaagttgaaagaacttttttctgtgcatgtctgtattcccaccacctaaattcaactatcattactatacttgctttatcacatatccatccattcatatgtctctatccatccattcattcattccagttttaaaatgcatctcagggtcaatcgaggacaccattacacttccacctaagtatttcagcatgtaaattattaacgagttaaatatttacttaacagttttttctttggtgtaaaatttgcacgtaaggaaatataaaactttaagtgtacatttgcaaattttaaatatacatgtgcatacccatgtaacccaaattcttatcaagagatattattatcatcaccacacagagttcccttatttcccttttcagtcagtccttgtccctgagcatttctcttattattttaaagtattgattcttttggatatctagtatgaagcttagaatctgttttttactttagatgtatgtagtgaaatttaatatatataccaaatggtagttgttagttagcttgaatgggacattggtcaaatggcattgtttgttttaaagttccaggtttgtgcatttatgtatgaagtttgaaaataaattctatgagaggaaatgaaaaattgaatggattttaatttgtaccttgggtttcttattaataaaacaaaatagctttttgcttttcaccttcaagagttcagtggaaagtgattcattcagtattagaagaaagaagagataatgttgctgtcatggcaactggtaagttgtacttaagcaaaacctaatcctttaaaaaaataaaacataaagagtttgaaatgcttaatctttcattaaactctcaaaatacaaatgcaactacaaatgatgtaaactatagaagagagtgaacaaagaacagatgctcagatttatgtatcaattagcttttaggaagatagcatactagtattgaccattcatctgtataagtacattgtaaaaagaaatgaaagcatcaaaggtttatttttatttctatatttttttcattttatttttatatttttttcatttcaaggatatggaaagagtttgtgcttccagtatccacctgtttatgtaggcaagattggccttgttatctctccccttatttctctgatggaagaccaagtgctacagcttaagtaagtcatgttatcattgccacaatatcaccctctttttttcttctgtgggtgaaacatctgatccatcatgcatgttaaaatctagttcacaataacacatttctgcaggtattgctttatctttattggtaataaatgaccctttagtggaagagcttaccttctttcttgtgttctctgtaattcaaagctaccaggtggccctgataaaatttttttaaaaaacattattactttatgctggtttacattgaatatctcaaaattcttttctctttttgttacccttgctttttagcttgataagaagtgtatacatggaagtatattttttatctatgaaacacttttcagcttcttcaacctgagcttgcaatctgttttaaattgatacataatatctttacatattcatggggtactgtagtattttgatacactcatatcaaatacacttgatcaaatcagggcatttgttcatcaacttgaacatttatcatttctttgtgctgggaacatttctaatcttttctttgagttattttgaaatacacagtgttgttgttaactatagttaccctactgttggttaatgagtacaaacatacagttagaaggaataggttctagcaacctattcctttaccccctgtcatcccctgctgccctgagcttgcagtctctttcaaagacccaccttaaaaacttgcattctgataaggcccttgaaggaatttgcttatcaagttagtaagtgacaaaaaagaaaattgcaaagaacaggaatataaattattatatttctttattctttctcacttaagagtgaaattgatatgtgtaatgtgtacatggtgccagaatatttgtttttcttcttatagaatgtccaacatcccagcttgcttccttggatcagcacagtcagaaaatgttctaacagatattaaattgtgagtaatttttttccctcaacttttattttggatttatgggggtgcatatgcaagtttgttacgtgggtgaattacatgttgctgaggaagttgtgagtaatttatgtcatttctaatcatgtggtcagatgtctgtggtatatgagagaattttgtatacaaacaaattttactaaatgcatgaaaaaaaaagtccatgattttaaaatgcactttcttttgtacctttgcaggactgttactttttaaatccttcaaacttgaagaaatctgttattctcggttcttgggctataagattagcattgtactcatagaattataaaaattttggttttggaagagaagttggagaatataaagatttgtctcattttatagatgagaaaactgaggctcagagacaagtaatttgcccaaaatcacacaatgactggctgagcagggactggattctaggtctcttgcccaaccaattctatcatgatgtaattcctaaggagaatgtcatctcagatacacatacacacacccattttgtgtgtgtgtgtgtgtgtgtatatgtacacacacacacaaacatatgtacacttatatatacatacacacacatatattaatatatatgcatatatatgcatgttctaattcagaacattttcatcactcccaaaagaacacccctgcccattaagcagttgctttctttacgtatatattagtatatacatacacacgagatacacatatatttactgagttttgataaatgcatacaaagatgtaaaccaaacctctaacaagatacagaatatcactgacactctagaaagtttcttcatgtccctccccagtctgtccttccatcctccatcctaggcaagccactgctccgattttctctaccatagtttggtagaatgccatataaatgcagtcacacaatattaactcttttgtgtaagacttctttcatttgctgtaatgtttctgagattctttcatgctgttgcatgtatcagtagttttttgttttgttttgttttgtttttgttttttcagagtcagggtctccttctgtcacccaggctagagtacagtggcgcaatcatagcttactgcagcctctaactactgggctcaagctatcctcctgcctctcaagtaggctaggctgcaggtatgttccaccatgcctggctaattattaaattttttgtagagacaggatcttgcttggttgcccaggctggtcttgaactcctggcgtcaggattgtttccagttttggattattacaaataaagctgagacacatataagtctttgtatggacatatggtttcattttattgatacatgtcaaggagtgggatgactggatcgtgtggtggatatatgtttaactttcttttttctgagataaaattagaaggcgatcctcctgccttggctttccaaagtgccgggattacaggcgtgaaccaccgcacctgatgcagttgttgttgttgttgttgttttaatatctgattattattttattgtatttcattgaatatagcacagtttgtttttacattttcttattgatagacacctaggctatttttctggttttggactgttactaataaagctgctatacacatccttataaaaatcttttttgtgaacatgttttctttttttctaagcattttaaatcacctttattgaggtgtaattgacttacaataaattttatatgctgagaatgtataatttgataagttttgacacaggtatgcactcatgaaaccatcatcacaatccagataatgaacatattcatcacccacaaagtttacctttttgttttaaccccagtcaccgggtaactgctgagctccttcctgttactgtagactagtttgcattttctaaacttatatacatggagtcattcatattttatgtgctcttttttgtctgatttaaataatgcagtataattattttgagattcattcatgttattacagtgattaatagttcattcctcttattgttaagtggattacattttatggatatccaacaagttgtttatccattcacctgatagacatttggatcgtttccagttttgggttattacaaataaaactgctatgaacattcgtatgtaagtctttgtatggacatatgttttcattttattatatatgacggagcggaatgactggaacatgtgatgcatatatgtttaactttcttttttctaattgagataaaattcacagaacataacttttaccattttaatcattactaaagtccagtgggttttggtatagtaataatatataaccatcataattaattccagaacattttcctaactcccaaaagaaattccatacccattaaggagtcattccctattttcccttttcttttctttctttttttttttttttgagtcagggtctccctctgtctcccgggctggagtgcacttgcatgatcttggttcactgcatccttgatttcctgggctcaattgatcctcccacctcagtctcctgagtagctgggactgtaggcatatgttaccatacctggctaatttgttttattttgagtggagatgagattttgctatgttgcccaggttgctctcaaactcctgggctcaagtaattgtcccacctcagccttccaaaatgctgggattacaggcgtgagccactctgcccggcctattatctctgttctgcccacttccaaccactaatctactttctgtctctatgatttgcctattctggatgtttctataaattaacttatacattatatggccttttgtgtctggcatcttccacttagcatagtgatatcagtacttcattcggtctttttttatgactgaataatattccatagtatgggcatacacattttaaaaattcattcatcagtgatggacatttgggttgtttcctttttggctgttatgaataatgatgctgtgaacatttgtgtaccaatttttttatgaacatacattttcaacgcttttgcatatatgcctaagagtggaattgctgggctatatgctaattttttaagaaactatgaagcttttgagagtgattgtatcatgggatattcccaccagcagtgtatgagaggtccagttcctccccatccttgctatcacttagtctggctgatctttaacttaagccattctaatagtatctcattgtatttttagtttgcttttccctaatgactaattatattgagcatttttcatacacttattggccatctgtatatcttctttgagggagtatctgttcaaatcttttgcctattttttcttagtgagttttgatagtcatttctatattctgaatataaattatttatttgatatatgctttgcaaacattttctcctagtttatggcttttcatactttccacacagttcttttgaagagcagcagtttttcattttgataaagtccagtttgtcgattcgttcttttagggattttgcttttagtgttttgacccaaggtcacaaagatttgcttttatgttttctcctaaaagttttatagttttaagttttacatttagatttacgattcatttttagtaaatgttgtctattgtatgaggtattgattacagtttatgtatttttcacatattgttccagctccattttttaaaaagactatgcttttacactgaattgactttgtacctttgtcaaaaataaattgactacatatatgtgggtctattgctgcactctctattctgtgttctgtggatctatttgtctgtcttgattggtgtcttgattactgtagctttataataaacctggaaatcaggtagcgcaaggcctcttgctttgctcttttctttcaaagttgttctggctattctatgtcctttgtatttctgtgagcatgtcagcatcaccttttcaacccatatgcctgctgggattttgaatgagtttaccttgaatctagatatcgaaacaattagctgtcttgatagttattgtcaccgttttataccgaagaaactaggcatactaaagtaacttggctaacatcacttaccttgtaagaagtagaactgggctgtttgacatcagagcttattctttataccatttcctatgttaattagaatacaatattaatttcataaaggtaaaggcatatctgttttgttcctatttgattccttgtgaaagcacaatgcctagcgcacaatagacacttaaacttatctgttgaatggacaggtgaatgcttttaaagtctttccatatagaaaattaagtttcattacatttgacttgatctaggttttcatttcatagaatggagagcagactctgtaaatattttgccccagacctagctttattacaaacattgtcttaattaggattctgtctacccagaatagaaattaactcaagctagcatgagtgtatattgaaatttatattaaggataaaggaatgtctcatagatcccactcaaaagaaattagccagcccttaggaagagactggaattgggtttggaaaatacaataggtctttctttttatctgtagtctttagtgagtcttcctcatttttctctctgaagagataagcattctctgcatatatatagcattcttttagattttcgtgacataaagtattatttaaactttcataaggtatcttgattttaagttgtaattccttgagatgattgttttctttattgttaatatgtttcccttcctgtttttttttttttcttttttcttttgtttgtttttacagaggtaaataccggattgtatacgtaactccagaatactgttcaggtaacatgggcctgctccagcaacttgaggctgatattggtaagtgataaagaaagatctctgtaaatacttactgagttaatatttaaagttaaacctatggatggacactggatttcacttctgttaaagtttatttcaaacattacttcctccaggaaatctctgactctctaacttgctgtttcacctatcttatcccatgatactctataattccttttgctatagaaattaggctctgttatcataattacctgtttatatatctgttttcttctgctaggctataaacttttcaagggaaaaatatcactttttaaaatttatgtttccccagtgcagtgcttggcatataggcacttaaacatattgttgaatgaatgttgaatcctaggttctgtgaaattttaatttacttgtttttcatgttctgtatctaaattaagtcagtgtagtggttttgtaccctctttgttcataagaatcacttttcaaactttaaaaaaaatgtaggtaaccaacacccaactctgaaaattctgatttaacaggcctgggttggcacctggcattggtggtttctcacaggtgattctgatatatagcccgggttggaaaccacagtacctttgattagttgccactagtgagtatgatttattacaaaaaccaaaaacttagataagtcacagtttatttcctagaacgtgtaaatatagaattagtcaaaagctgatagcactttttttgtacttaaaaatattttaagcctcagtatagtgagacctcatctctacaaataattttttaaaaaattggccgagcctggtggtgcatgcccatagtccaagctacttgggaggctgaggtaggaggattgtttgagcctgggagatgaaggctgcggtgagccaagatcatgctactgcactccatcctgggcaacagagcgagaccatgcctcaaaaaaaatttttttttcttcttggtggttaggcttaactatccaagaattgcaatcatggcttctattgcaaatgcccctatttcccaccttcagttggcctaaccaaatttaatttttcaatatcatatgatctttttgtataattatgtattcaaataattccagataggttaggttttcgaattgcaacgtctcatttaatggttactttcatataactgtaggaaagcatttgataatttttccaacaatgtaatgaaaacaaacttgtatcttttttattatgtgttaaaaccaacaaaagaatgagggcagcaattaacatttcattaaatatattagcaatgagtacatttatgagctcttaaactcccttattgacatactgtattttttgcctttaatggacaatgaatttgatatgtttcctaataggttgtatgaagttattgtgaatatttcactttggattaagaataactaccctatatataaatttcatggttgtattgcaaaagctggggtctatgtccatagtggtttgggtacgtttttactatttgctttgtttctgtgatagtgttaaatgaataataagcttaagtatttaagcaaatacttaatacttctgacaagtagttagaactctctatttttgtttttttgtaatggatgagttatggacactgcaattattagagcagcgtactttgcttatgatggatgaaaatgttctctggttgactcagtgttgaataaaaagggatacatgaaataaaaattatttttgaaatattttcctttgccttttgttgcgggaaattgtacaatgcttgcaaaaatgaatatacgcaggatattatttgtacagcagtctgacatttagctaatcagattcctcatttttaggtaaatgttaaattacttaagtagtctggatttttaacagaaacagcaaacatagttttatagggaggctccttaccaaccagacttttaacttaagtgaatgttggcaaaagcttgtctaaactgatttccagggataaggtttagctccattaaaagctagtttgtcaaacctgtaactaaagctttttaaaaaatgaaagttttaaaagagaccatcattctgttttaacctatttaatttaaaatctgggctgaagtaggagtattgcttgaacccaggagttcgagaccagcctgggcaacacagtgagaccccatctctgaaaaaaaaaaatgagctgagcatggtacctgttacagtgctagttatgaaagaaagaaagagagagagagagaaggaaggaagggagaaaggaaggaaggggctgggagtggtggctcacacctgtaatcccagcactttgggaggccgaggcgggtggatcatgaggtcaggagatcgagaccatcctggcgaacatggtgaaaccctgtctctactaaaaatacaaaaagaaaaaattagccgggcatggtggtgggtgcctgtagtcccagctactggggagggtaaggcaggagaatggcatgaacccgggaggcagagcttgcagtgagccgagattgcgccactgcactttagcctaagaaaaggaaggaaggaaggaaggaaggaaggaaggaaaaatcagtcactcactcaggtttagtttcaaaagccaaaacagtgataatattgaattttttccagccactcagtagtacccagagaattttgatacaaataactgactttgaccccatgtttagtaggttttttttttgtttgtttgtttgttttttttttttgtctttcttctccacactctcttaggactgttgtagcttgtaatgttagtgaattgtaattgtttatttgcatgtctgtctcctcttttagaattgtgaactcctcaggtcatggattgtattttattagtctttttattcctagaaaagtgtttggataataatagatatttattaaccataataggagtagtagcatttttgtgtgtgtgtgccaggccctattttagcattttatgtgaatgatataatttaatttttagagcatctagaaaatgttaggtaccattattatccacattttacttgtgagaggactgagacttggaaagcttaagtaacttgcttaaggtaatacacatggcagatggtggagccaggttctgcatctgggcagtctgactttagagctttttaatcatcctcctcctagtgtccgaacattattaatgctcagagaagtatcaaagaatgatgatactcattgagggaaaaaattattcttaagtatcaatttgttaattgaggacaaaagcactactgttactactgtgaaaaatctgaaaacattgtcacggatgattttacaataacatccttttctgacatgcattacaacacactattgattccgtttcaatgtttgtgtctggtatgggggcggagtagagaggctactacaggaagaaagaacaaataacatttcttcttactactttgtgcatcatgtgatttagctcctcccataccattttacattagaaaatgtggctgtcctcctgtgctctagtactggcatttcagaggactctttgcaatatgatatgtgatcaatcatggatggcgatgcagttaatttcagtagaaatttgctgactctttttatctcttttaatagctaatgcatgagataaaattgaaggtattaccaaggagaaatgcaggtggatagttttggaggcaaagtcacagtaagcaattcatctctccaaggaatagtgatgaaagctgagatccaataaatgtcttgtttggattaatacataaatatttccttttaaaattcttaaggcttttattcatatatctcccctctccctatttccaataatgatttttggtgttaatatgatgatatttatgcttctgtttttataggaaccaaatactttgatttggttatttattctcctttggagatgtagatgagtttattttttcctttcgagctttatcttttcctttatgtgtttttctttttttacaggtatcacgctcattgctgtggatgaggctcactgtatttctgagtgggggcatgattttagggattcattcaggaagttgggctccctaaagacagcactgccaatggtaagctttgccaagtctgatgtcccgaaattacattcttaataaggagagcattcaggattggggagtggtaaagaagctgaagacttcactataaaagagcaaatggataatgtaaaaagagaactatttttttaaaaatgctaaagttggtatataatctattgaggaatataatagaacaaggcttgacaaaccttttctgaaaggaccagataataaatatttcaagctttataggccacatgtagtctgtatcacatattcctctctctgttttttcttttagtaaccctttaaaaatataaagagttacatttttcactggtgggccataacaaaacaggctgtgggccatatttgtccgaatgtcttctcagtgatctttcatccgtatgtccttttactctaggatgctgtgaaatcctggttaccccttcttgtatcacattgaaaacctaaagtttgaactattctatagaaattttattaaagcttttggtattagaatttccctttcttccctaattataaaaaatagcaaattttggccgggcatggtggctcacgcctgtagtcccagcactttgggaggccgaggtgggtggatcacctgaggtcaggagttcgagaccagcctggtcaacatggtgaaaccctgtctctactaaaaatacaacaattagctgggcgtggtggcaggtgcctgtaatcccagctacttgggaggctgaggcaggggaattgcttgaactcgggaggtggaggttgcagtgagccgagattgtgccattccactccagcctgggcaacaagagcgaaactctgtctcaaaaaaaaaaaaaaaaaaaaaaaaagtgaatttttacatgaatattctacatgattggcatatttacatgaatggtttaaaaacccacaataatagcactgttttattttttattttgaaaattgtagattcacaagaagttgtaaaaaaaaaaatacctatatagaggtcctatgtacctttcatccagtttcctgaacagtaacatcttgtgtgactatagtacaatatcaaaactaggaatatgacatttgtacagtatctagagtttattcctatttctctagttttgtaagtactcttttgtatggcatgtgtattgttctatacagtttaatctcatgtacatttgtgtaactaccactgcagtcaggatgccaaatgttcccttaccacaaagctccctggagctgttcttcccacccctggccctagccactggcaaccacaaatctggtctctatctctaaaatattatttcaagaatgttatatacatggaatcatgcaatttgtcaccttttggaattagtttttttcactcaacataactaccttgagatctatccaagttgtttgtggtcatgtgttgcctaacaacagggatatgttctgagaaatgtgttcttaggacattttgtggttgtctgaacatggacttacacaaacctacatgataaagcttactgcacacctaggctatatgatagagcctattgctcctaggctgtaaacctgtacagatgttactgtaatgaatattgcaggcaattgtaatacaatggtaagtatttgtgtatctaaacttatctaatgtagaaaagacacagtaaaaatacagtataaaagataaaagatggtatacctgtatagggtgcttcctgtgaatggagcttgtaggactggaagttgctctgagtgagtgagggagtggcgagtgaatgtaaaggcctaggacattactgtacactactgtagactttatacatattgtacacttaggcgacactaaatttttaaaattttctttaaaaattttctttcttcaataataaattaatctcagtttactgtaactttaattcataaacctaaaacattttttgactttggactcttgtaataattcttagattaaaacatgaacacattgtacagctgtacaaaaattttttcttccttgattaatgcattccataaggctttattttaaaattttattatttttatttttaaaacttttttgttaaaaactaaaatacacacatatcagactagacctacacagggtcaggatcatcaatgttgctgtcttccacctccacgtcttatcccactggaagttctttaggggcagtaacactcatggagctgtcatctgtgataacaatgccttctcctagatacctcctgaaggacctgcctgaggctgtttttcagttaactttaaaaaatgaatacgtaggaggagtatactctaaaataatggaaaagggtataggtaaatacgtaaaccagtaacatacttgtttattattcatcaagttatatactgtatataattgtatgtgctatactttttaatgcctggtagtgcagtaggtttattgacagcagcatcaccacaaacgtgagcagtgccttgtgctaagacattatgctggctatgacatcacttggtgataggaatttttcagctccattataatcttatgggaccactgttccacatgtgctctgtcattgacagaaatgccgttaagtaccacatgactatttttcggtggtctgttcctttttattattacagagtattccacagtatggttgtaccacagtttaactgatcacctgttgaagaacttttgggttgttttccagtttttgactattatgaataaagatgctatgaacatttgttcatatctcaaaggttctttatttttttttatttatttttctttttttgagacagtctggttctgtcaccctggctggaatgcagtggcgcgatctcggctcgctgcaagctccgcctcctgggttcacgccattctcctgcctcagcctcccgagtagctgagactacaggcgcccgccactgtgcccggctaattttttgtatttttagtagaggcagcgtttcaccgtgttagccaggatggtctcgatctcctgacctcgtgatccacctgcctcggcctcccaaagtgctgggattacaggcgtgagccactgcgcccggccttcagagattctttaatgggtgaatggttaaacaacctgaaaatataaaagttttcatttctctgggataaatgtccaggagtgtatttttagtttttaaggaattgtcacaaacctgttttccaaagtggctgtagcattctacattcctgtcagcagtgtgtgaatgatctagttatccttgccaccgtttgttgttgcaactgttttttattttagccatttcgataggtgtcgagtggtatctcacttttaatttgcatttctctcatggctaatgatggtgaacgtcttttcatatactaatttgcctctggtgaaatttcttacataattggagtgcttgtttttttctgttgagttttaagagtttaaaaaatacattgtagatatgagtccttggtcagatacgtggtttcaaatatttctttcactttgtagcttgccttttcattctttttaccgtgtctttcacagagtaaatatttaacattttagtgaaatccagtttatcattttttcttttatggattgtgctcttcacctagccctagatcctgaagattttctcctgtggttctttcctaaaattgttacagttttatgttttaagtctgtgatccattttgagttaaattttgtataaggtgtgaggtttaagtcaaggttcattgttttcccaatagattaaattgcagcagatcctttgttgaataggctgtccttcccctgttaaattgcgtttgcccctttgttgaaagtcatgtgggtgtatttgtgtgggtctatttctgggttctctagcctgttatattaattttgaacgaataaagttggcttatgtttaagttttcttggtagtagcgaggcaatggtgccttctgagcccaggatttcacaattttgtgagtaaactgtgttagaaattgtttgttattcttttggtaggttgtctagttcaatttcattgctcattaatcttgcttatagatagcaaattgagaggcatctcaaaaatagtatcttttgttagcttatctcacagagtttggttggagcagatattaaaacaacaaaccaaaaataaattaaatatactagttagcaagtttatattgagggaaaatcaaaccatgtgaattgagctccaatgatgtggctggccttgggtcagattttagtatcatggttcaacaaggtagctattaaaatcttcatactttttcttgaaataattctttagtagtcacataggacagcacacactcatggatttcttctttccttactgtctctttattctcagcctcctgttccttctcatctccctgaccttttaatgttggccttccagaaactttagtctttggacctacctttgcactcattttcttggtcatttcacccaacatacagttttatgttattttattttttttatttttgagatggagtttcactcttgttgcccaggctggagtgcaatggcgtgaactcaccttactgcaacctctgcctcccgggttcaagtgattcttctgctcagcctccccagtagttaggattataggtacgtgccaccatgcctagctaattttgtatttttagtagagatggggtttcaccatattggccaggctggtctcgaactcctgacctcaggtgatccacctgccttggcttgccaaagtgctgagattacagatgtgagccaccacgtccagcctacagttttaaatatcaagtctatactgaggactcccaaatttttatctccatcatagactgatatcagcagtatatgagtgattcagttgtttttgcctctttgccagcatttggtgttgtcactattagttcattttagccatttaatagaatatatgtacatatatatgtgtgtatacacaggcacacatctatataactactcaacatgcctctggtgagatgaccaacaggtatctcaaacttaacctcttcctaattgacttctgcatagcactccagatctgctctttcctcactctcctccatcttgtttaacagcagctccattggccaaaattttggaattttcctcaatcttttctctttttcttacactccactgtttatttaaacagtaaggaaatctcgtgaggtcttcagaatatatgcagaattaaatcacttctctcttgatccctgccattccccaggtacgggccaccatctccttagggcctcctgctttcactcttcccatccctcattctgtttcaacacagcgtccagagtgatactttaaaaatgaagtctgatagatcatgtcttcggctcagaaccatctagtagcatgccatttcattctaaataaaggcaaaagtccttatgatgagttaccgatcctcatgtaatctggccttccattttccctctgatctcattctctactggtctcctcattcaccggatgcagccacaccaccctccttgtttttcttcggacattccaggcatgcttcagtgcctgggctttgcgcctgctgcttcctctccctgaatacgtttcccccacattgtctataggatgttctcccatacttctctcagatctcttggatttaggcctcctgggccaccatatttgaaatatcagattagttccccctcccccatcattcagcattcctcgtaaatctttgctgttttaaaaatagcactatcactgtctaacttactgtgttatattttgttaattttctgtgagttcttcttcactagaatattctttgtagggaggagtttttgattgtttggtttataaaatctggaacaatacctggcttataggaggtgctcaatttataatggggtgaatgaatgaatgaatgatgatgagaaagctgagaatcagtaaagtgactttccaaaacaggtagtgggcagtatagagttgggccataaatagctgcaccatacaacatcctgctagtttctaaagcaaatgatttgaaagaggcataaaacataatttctgccctcaggtagctcatagttcagtaaaggagtttagattcatacctataacagtagaagtaatagcaccaaatgaaatatggtattatgaagtggtacaaataatataaaaagatgaacagtgttagtagtacatgtttagaagggatttctgtggtgaaagtcactaggcacagtgcacctggaggaccgatttccattaatttagaatggtttaaagtaagcttttggaaactaggaagattactttctgtaatcctttcctaggcctttgattctagaaggattgtgttaaaggagttttaaatattttatacagttcttaaacattgttaagcttgaattaaatcttttattatgtctggccatggacgtcattggatcattttcatttcttgggaggattaataaagcacattccttctgttgggcctccagtgcggggagggtgttggccgagcagtggctgagaaaacgtttttcccctggtgttttcaagaaccctctttattagctaagtggtgagacatgccacctggtggttatagtagtatcatttttctcactgttcttggtgcttttcttctcgttctgattccagttatactaggacaactgctataaacctggaatgtttcacactatattatttcagtaatttcaaaaacagcagaaatcactaagctgtttggcacaaagattcctatttggaaggaatcagacaaagtgagtgttgagaaagaacagccaggcagaaagctttgcatcagtcttaaagttctttacatttcaagtaagaggaattgtgaaatccataagacatgtggggtttttctattactttctccccagtatctattacaaagatcagcacatagtaggtactcagtaactatttagaatgagtgcatgaatgaatgaagtatgtgtgatgttatggagtacaaagttagaattagcaacatgacctgaatttagaagcaggtgggatacttatacttttctcagtctgtgggcaccacaccattgaagtatatgtctaagattaatttatatttggttgtttgatttagcaaaacttgctgcctgttaaaaaagaaattaagacctgtcaacttaaagaatacattttgtgagttaagaactaaatgacagtataatttattacccaaagcagtttgcttctgaaaattaaagagttcaagctattaataattatgctgtgactgcaggcataaactgggaatgtcctggcaaatgaggatgtattgtcacctttctcagcctgcctgtgtgttgtttttaagcttcactctagtttatatattttaaatgtcataaaataccacatacttataagagaaaaggttctattcattgctgaagtggaagcttatcattaatttttatttatttatttttttttccagttttggaattcttattactttgaacccaagaaccactgataactagcacaatccagtgaaacagaggaagcagcagcttaatcaaaggaaaaatacatttaagattataagtctggttataagcttaaaaagtgacccagaaagggatatcattgctaaaaaaaaaaatccccttgtgacctgggtacattttgcaaagccacaggtttgcagtgttacacaagggccaaaggaggccatgagttgtctttggttgtggggccggagggtaactgttcatgaaaatagtgagtgtctgaagattaagaaaatcatgctgcagcagaggagaagggagaggaaggcaggaagggaaaggagatgcctgagggtcaaaagctgagcccaagcctaagcccaagctcaagttcaagccccagcatggcacaattttgtgaattaactcaggctgagttgcctccagtctttggaatgtcatcttatactggtactgctgaggcagagggcagtaattggttctttgggataggagaaggggcagttgctgaaatacaaaattaatagtcagcatcccaagttcctcaattgcagccaaaatacatgtgttcaggcctttcggcagtaccgcccccagaactaccagctgtagtgtggtctattcccagacagcaacatgcaagaataagtttacaatacactcagcccttgtggcttaagatcaggggctcagaggctgtgacaactcatgatgctgaaaatgtatccaatgaaaacgaagtactagcttgtttagtagtaacgaagtactattaatttttaatatagtctgatactttattttctaattgtagaagcaacattcttagctatatctttctagaatgttgaggcaaaagagtaaatttatagtgattttcactgttaccagattgctggaatagggaatttctggtagcaagatgggaatttttaagttggaagggtctaacacatcatatagccgtctccatctcattttttttgctgaaaaaactgagcccttgcaaatgtcagttgcaaatctgggagtagtactcatgtctctgaagttgttatatagaattctttttatttattttaataacaatatttatgatagttgaaactttttgagtgcttactatattttatttcatgcattatgttcagcactttacatgttttatctcacttgatattcacaactttatgagattggcactgttattgtagccattttatagatgaggaaactgaagcttagagagttaaataaagagctcaaaatctcacatctagtaagtggcaaaaacaggatttcagctcaagcaatctgattccaaaacagacttttttcactgtgctgccattcttttgcctggtttttctgttaacttcttaaatatatgtcatgtttcatgcttacttcctcattttcataaatatattacctgctcacttatacattatattgcttagaaacaaacccaaccctgttttcttatggactgtatcctgaaaatcactgtttttaatatgtggttaaacaagtgttttattagtgcatttatataaattatttaaccaaaacacttaaccggtgaaagtgctttactgtgtgagaatgtgcatgttctaagaacctctaatttttaaacctcccttattctcagccttatatttgttaaaacctgtgtgttaacacagatgcacccatgttaggggttaattagagaaaccaacctctttatagattagcttgttcatctttaagttgctaggcaggcactgtaaattcagagaacaatctgattgtaagccacaaatcaatgaaattaattttggggttgccttttaaaatagtgtcacaaaatttaaggataaagaatgcaaaaatgatgccaattatctcatcacattagttttgatttaatttttttaatttgaaaaaacctactcttaaacttaattgatttttttaaatataagtttggagataatttttaattcagtaaagttatagtgattgaaaaagtagtttataatttttaataaattgatcttgttttaattttgagtcatattctagaagtgcttctttgcaaattggtaaattgcacatacatttccacttatatacaagataattgctatggttggtttgtataatagatgcagtgcatctgaagagctattttatgagaatattgtttcttgtatctgtcacgagccaaaaagaatatttttaagaaagttatattcttggtgatagaacagctgataatttagaaacaactgtaagacagtccactttttctgattatgaaataataccatagttaagtgtaatttcctataatagaataaaaacacgagttctagttttaggggaggcatgttgttaccgtaccttagaatttctggaagatgacatattcatgcttttcctgataactgctgagtctcctgctctgtctgccaatccagtcaagaagcctttgctagcaatcaattaataatacgtttcatttatacatatttcctatatatagtatgttattgattatctcagtaccactgaagagaggttatctgggtcattggagctttgcttctagatttgtgaagccataaacctatatatttaaaataggaggccaaaaaaaaacgaccattgctttatatagttagattttcagtgaattgagagtttatcatttgtaattatacattaatcaaatataaggcataatatacccccctgcttatatcagcaccatttcaaatgtaatgttaaaaaataataaatggagaagtagatagctaacaagtaggcttaatttaataagacaaagtaaatggcatttggaaacctcatggatttaatgttttatttaaatgatttctgatttttaaaaagtaaatattgtttccagaaggctgagaaacaagttagtagggagattttttctttgcaaaaaaattttacagttgtgtctttaacattgtaccacaaactgttgtcctaccagtctctttgtaagaaagctatagacatgttgggaatgaatgagctctttcctttttaaaatatcagttttacatcattcaggttccaatcgttgcacttactgctactgcaagttcttcaatccgggaagacattgtacgttgcttaaatctgagaaatcctcagatcacctgtactggttttgatcgaccaaacctgtatttagaagttaggcgaaaaacagggaatatccttcaggatctgcagccatttcttgtcaaaacaaggtaaggatttaatggttgatgaattttggtaatgatttcctttttttttttttaacaacttatgtattttatgttatttacgatttccttctaatgcatatttaacatatttcaaattccacctagttttggttcaagtcaagcatgatgttatataatcaattcagtgattgagactagtgtatttttaaaagcagaaaccaattctcctaatattttaataccccattctgttgcttaaacagggcatatactatttatttttattttttaaaattttacttatttatttatagagacagggtctctctgtcgtccaggctggagtgcagtggtgtgatcacaactcactgcagcctcaaactcctgggttcaagcagtcctcctgcctcagtctcccaagtagctggaactacagtcttgcaccaccatgcctggctaggacatatacttttaatgattgataagtaaacaagcaaacataaaatgactctttcatctgaattctgtctagtttactaattacatgacttcagtcttaaggagcttagaaaaggtcaccttacaaacacagtggagcctgtattgtgttccaaggactattgtaggcgctttctatataaaatgatctaatttaatccctataactgctcagtaagttacgtattattttcattttattgttgaggaaactggcattagtacttttttctgtttattttgtttaaaggcattttaaatatatatgttaagaagttttcaaaagcctatattttactttttataagcctttattttactatttgagacagtgtcttgctctgtcacccaggctggagtgcagtggcgcaatcccggctcactacaacttccacctcctgggttcaagctattctcctgcctcagtctcccaagtagctgaaattacaggtgtgcgccaccatgccaggctaatttttgtattttttagtggagacggggtttcaccatggtggccaggctgatctcgaactcctgacctcaagtgatccacctgtgttggccttccaaagtgctggaattacaggtgttggccactgcgcctggccagtttataattttaaacattaaaataaatgcttcttgtccaatcatggtgtctcacacccagaatcccagcactttgggaggcagacgttggagaatcacttgaggccaggagttcgagaccagcctgggcaacatggtgaatccctgtctctacaaaaaatacaaaaattagctgggcatggtggtgcatgcctgtagtcccagctatttgggaggctgaggtgggaggatcatttgagcccaggatgttggggctgcagtgagctgagatcacaccactgtactccaggctggatgacagagcaaggccccgtttcaaaaaaaaaaaaaaagcttctaccaatacaaacacaaaacaagcatagacaaatagagtttaaagaacatcattggtgttttcctctaaagggaatattgatgctaggccaagaaaatcctggagttattcttgaggaccttaaggaataattgaaatgtaggatttgctcctggctttcttgtcctatattcagaataaaacaagaatggatcgaatatattctgagtgttctggccattctagtgctctctgaagtgagtactcactgtgtttcacttccctttcatcctaaagaggaaaagttcttttgaagaaggctgtttgtcctaggttagagtctccacagtcagatcattatctcctcctaatctttgatcctgttcagtctctatggtactttcccttataataacactctctatggcactttcccttataataacactctcctttttaaagcagtttgccttttttgtgtgtaatattgttctcctggttttctgacgtcctggtcctcttataatcctatgcaaatgtttctttctgtttttcatgttgactctgctaattgaggtctttgttactttttagccgagactattataatttccccaacagatacccctctccccagtgccccttgttgctttctatgcagtttacaaattattgtctgcaaacacatccttaagtctggaatacctttctggaactccttactaggaaataaagaccagactcagtgtaacattcaacagtattgaagatctaggtatttaatatgaatttttttttttaaggagatcaagaaagatttttgtacccatttttaatcctccaagaagacttaggatagcaggaaaccattgagagtcagaatgctttctacagatcttaggtgaacagaaactttcctcttcatgagcagtgaggtagagggtaattaaggcttcagagcattgcccgttatttccatcttcttcccttcctttaattctgctaaattcctttaatttgtttatcagtattcaagtatttttatccattgagctaaggtgtttcttaaactaaccctattttgttaaagtcttaattataatatattcatagtacatttaagtgagatagatgagtctctcatataatttagtggttagattagattagaattttctcccctcagaaaattaagaggaaataaaagtctgtagcaaatcacttggcaaaataatggctccttttgtaataggaatttttactcttttgatttatctgttacataagttcaaatttttacatattttccaccttttttaaaaaagagtgatatgtagtcaatatcaatttgagcaacactgttgcatataaattgaaaaggactccaattttctaattccgtacctcagttgtgatcactgttggtattttggcatttatgtagacttcctttctctgaccctactactgtgcagatatatagttgcagttttttgttgttgttaagttgatacagaaatagttgcatactatatccattatttatgcaaattttttttcatttaaagtatctgctatctttccatatattgcattttcttaaattagagccttaatatataggatattacaatatctaggttttgttgagtagttttttcttctttgaaaacatgtttttaaaataaggtttttttttttttttttttgacatggagtcttgctctgtcgcccaggctgtaatgcagtggcgggatcttggctcgttgcagcctctgcctcctgggttccagcgattctcctgcctcagcctcctgggtagctgggattacaggtgcatgccaccatgccctgctaatttttgtatttttagtagagacggggtttcaccttgttggccaggctggtctcgaacttctgagctcaggtaatccgcccgccttggcatcccaaagtgctgggattacaggcgtgagccactgtgctggccttaaaataagatttttatacactaaaagaaaacttacatttttcactccattaagtagttcactgtgaatttttgatattgaagcccatttggttgctgtcaaaaatagatttgaacagattattcagtatgactcttgtagtgaaattattgccttgtttcctctgcttaagttttcagtggcttttgccacagtccttaaaggttttataatttttttaatgtttaatttttaaatgtttgcttaatatttcttagtatgagtgtagataatgatgaacatttagatgactttttactattataatgttgcagtgaatatttgtttacatttatcttttggccaataagcaaatatttttgtaaattagaatcctaaaattgaaattggatcaaaagttatatgcacttgaaattgattaacttttcctaaatctaaaatagtatagtcttttttatattgtcagcataaatgaatgcacttatgtaaatgaatatttttaggcgttaagtaaaatattctgtggaaattgaacatttaagttgtttatacttctatggaaatcgtttacgcttttaataaagaagcacaagtttctacaaaatacattctaacagatgttttctataacattcagtctcaagattactagtaaatacttctttgaactgtaaaagcaatctttcaatattataagaaagctcttgctttagtaaacatttagaaactcagctttattatcataagcaagaataagaacagtgtaacaagttttatgcacactcctttgtaaaccctcaccagactaattgttaatctggtgccttgcattccccaaagtatttgtatctgtcgtttataagtttttatcaaggtttcagctaaaacaaataaatttgtttctggttttagctttaatttgaactgaaacagtcaaaactgagttttggggacttcacacaattcatttggatatttgattctccataatgttttaaattttcatgcacttaaatatatcattatttttgataggctttcttcctttagtcttttctttagaaggtagaaaggaagaattaaataagataaaaccaaacgggtctgaagcatgtataaagtatatatgtttgctcttttgttcttctttttctttagttcccactgggaatttgaaggtccaacaatcatctactgtccttctagaaaaatgacacaacaagttacaggtgaacttaggaaactgaatctatcctgtggaacataccatgcgggcatgagttttagcacaaggaaagacattcatcataggtttgtaagagatgaaattcaggtatgaggatcaatcatcattgctctccgttgctcatagtggaagtggatatttctcaaatgtttatttaccagatctttattgaatactttctttgtgttgaacataaagcagtccctctgataaatgtgggagaacaaacttgcagattagtataaatagcaatctgtacctagtgcttaggtgcacagaggagggaggaatagctctgtcaaggtagttgtgtaatgggggtggtccatccaggaaaattcaattagagtccaaacatgtaagtagaagtttttcaagtatgccaggccagtaggtgatgaggggaaaggaattggttatagaattccaggaagaaggactagcaggtgcaaagacactttgatatgagaacacatactgggttcaggaaatgtgactggtatggaatggttggagggaaagacaatgtggggtaggaatggcacaaagtatggacaaagaggcagggtggaaccgttagagacttgagagaacagttgaatgggtcggttggccaggttatagatggctttaaaacttgcaaagaagcagtctgggcttggtatcatatacctgttagttttcactgactactttagccttagaatttttagtttagatacaattttctgtaataggtaaaacggattaaagtagaataactctggctgaagttaatgtgagggaaaaggaggtacaagagtctcgtctctagaccttgaagacactccctgttggggtcttataatccttggagtgccgcagaatcatttgaaaaccatcttgatgtactactctgtgtttttaaataagataataggattatagaaacattagactggcagcaataagttggattgatttgaagaagagaaactgaagaagggaaagggtatcgatgcagctattgtgaaattctacagttgagattcctgacctgattggactggctcagtgggtgtcatagaggatttatttgggaggatttaagttcaaggcacatgagtaggtttaagtcaacaacttgacactgtcaacatgaaatccacactgtaactataagtccgaggaagagccctctcctgaagttaggaatttaacttcagctcttgcattttctgtcccaccggtcatccatttcttctctatccatctccttttctgatatctagttgttatcagtgttgttgaaaagcttaagtatgattcatattcactgtctataaagttcactacacatagtcatgctgtaatgcatacccgcctgaaagcatctggtctctcttttccttctttccaaagataagaataccattcacagctgtttagaatagaaattttatccaaattcttcagtgtttatatttttgttctgttatttcagtgtcttgaatattgtcaaatgacatttattagctactactggtactactgaatcttaataatcaatcttcaagccattaactgaccaatggtttcttctatcttaatgtattagtaattattcatttagagtaaaacatctcccagaacatgaaagaatacaaactttattcatgttacgttgtgacaggagactttgttggatgcgcctgattttcctgccaattcacagcttcattaaaacagtaatgctttgaaatatggcttaggaaacttcacaatgatcattaattacacctaatttctggaagagtatatgcatgtatgtgttgcggtattctcccttgctgtggcaggatgtcacaaatttttatccacattacgaaaatttaaaaattgatatggttttttctccctacgttgatatcagatattttgttttatctgacagctggcccaatgtactcctactttgccattataaagaattcaaaagcttcatatttgcattgaaagttctcaaacactttgtaaagatgatgaaagtatgtttcatcatctatgtagaatagtcaggtgttcttgcaattgattacttgctaccgagaattgaatacctactgagtgcataatgtatagaattctagatattcacttttgtgtgtttttacagttgttatataccttagtgtggctctaaaagtggaggtgacagctgtagctcttaatgtcttacactgagtgatgtttagaatcttaaattttcttttataattttagaaaaaagtatacttttctttcttatttttataaccagatccaaacacatttgcatgtagataggcatttttagtcttgaacattcatttttacttttaatcctcacttttattagtttcgtatctttttgtatttcatttcccctttcaagatgccttgagtcctttctttttaggaatgatgttgtgaataaattatttgataaaatgtctttacacctgagagtttataaggatagtttgaaaatcatgtctgtaaaataggttgatctcacctaaaaataataccatataattaaaattagaattattattgtgttgcttattgactcttacatatatcaaaaaattgctgagtcttattcagccagagcttttacttagtatgatattcattcctatatttacttttttctcacctttctcatactttcttttacttactcagcattttcctcctttcctccctcctttcttttcttctttccttcttttctcttcctttcgtattcctggtccatcttagcatgtaatctttctttatgaaatggcatgcagataggtctactgttcttacagtaaaaaacttcaaggcctcatgtctttcccacttctgtttcccattcacaacctttttagctgattcttttggtactttaccactatatcttgccatagtttatgtacctggctcctacttaattttttgtttatttgtgtattagtcgtaggcattatttatcgactcttctctctgaaagatgaaaggttagctctctttcacattcttaactgcccttttttcttaccttgtccatgtatttctaaccccctttcctcctaatatgtttatgtcataattttggctagattagtgtatacgatttacataattattactctgtaaatgctttttatgatctctgagccatgtagtatattatggctatttttctttcttatctatttgtatttttattgttattacctaaaaaaaaattttctatgtcttatcactaattcttccctaaaatttcccacaattgtgtaaacttacctcagtatattcatagatatgagacattctatcaattttaccctcttaaagatgcagagataatgcattatgtttcatcccaccatctttaatgagaagcttccatcttagattaatattagagaatgttaaaatactctgcaatcaggtaaggacgcttgaaacttcattataatgcaaaagttttctttaacacaataaatattttgaaccccttttgtgtcttgtattcataggagttcagatagaccactttatttactattttttatagagagtgaacagaaatcccatttctagtcaccagtccttaatctgtaaatcaggcagataatctgtaaatgattggttgaaatcacattgaattccactttgtgccagggacttaagttaacgaacaaattattcttacaaaaaggtataaatgtaaggttttcattctgctaaatatgtttgtcaaactgtgttgtgatttgttctcagtgtgtcatagctaccatagcttttggaatgggcattaataaagctgacattcgccaagtcattcattacggtgctcctaaggacatggaatcatattatcaggagattggtagagctggtcgtgatggacttcaaagttcttgtcacgtcctctgggctcctgcagacattaacttaaataggtaaaaaaaatttattgtttttactcttgcagatttctttctttctttccatataaacctcaaaagtgtttgaggctatttccagtatcccaagtaatttgtgagtgcatttaaagtaaaaaaaaaaaaaaagaaaaataaaacctccccaaatccagaggacatgtaagaagaacatttgtggtaagagttgccacttggagatgagctaatttcagcatgccttagttagtgtgaggaattaactaaatcaggacaatacttgggcctgtcacagagatcctatggaatactttcctaccattgtgcattaatgaacaggttcttttcctctcctcagatcctgtcaagttgcgatgtcttcagccatagttacttcaactaccactgattttgttactgattctttcttcccatgctacagtggtgattattccagaggatttctctcagtccctatttgactcttgttactatttgttttcttggttagttccatgagaccatgccagttctccttgactgtgtatgaatcattgtgttgcactgtactgacagactgccgtaagtcaatattaagtgttcagtatctaagtgcaggagaacctttctacttaagtactcaacaagtagtttgttggcacttaagttctatgagattttttgttgtaaaggaaaacattatcttgcaaagattttggggcagcatttaccaatactttgttccttcatccgtaggaaaaagaatctcaggagaaaaacctatacatggtaaccaatggggctgccaagctgatgaagtattttcagagtacacctttgtgtagctgaataaattgagatcttgaatggacatattagctcattttagtaaaatgataagagagtgcctcccactacagtttttgtttttatgcatcattaaacaatgtgtttttgattgtccactgtgttccatgaactatgctatgtgtgggagatatagtagtaaagaaaagcaaagtacctgcttccatagaattcagtataatgggaatggtaattctttagagaatcacataactatggatacataggcttcattttactgttctccttttgtgtttgaaaatgtcaacaatcaaaattttgtaaaaaaggaatcatgcaacatatttaaaattataactgtgttaagtgtaatgaagggaaattgcactgagtagtaagaatatataatggtgtgtggtatttcccaagttaaaaaggtcagataaggcttccttgtggaagtgatagttcaaatctgaaagaagaataggaattaattaggtaaaaatgtttgatgcaaattttaagattttccttctgagtagtcagtagcttttccttcttaacatagaagatgacaaaaccatcctttttttgtacataacaattcttgttttcctttagacagttgtatctgtcaagcttcttatgatctaatttaaataattgggatagaacacagctgtacatgttactattaaatatggaatatatcaaacataagttgattcctaccagttctgattttatttgtgtattttgttaaaggtactgaggacattaatatccagttttatattgtgcatttgaaggttcatcaataaatacaattcttgtttctctgggtcttaaaagatattttaaatggttatctcattaagatttaacaggaaataacagtgattcaaatcaaatagtggtgccagaaacccatacttgaattttgggtatagacaggttaccctttgcatcaatcctgaggaaactaaaactataggattaatcaggataaaaaagaattgagcaaggattcaggagggatctgtatcatcctggtgacaaccctcttctagaaaaaactagaaagtctaagaataaatgaagttgctggttctcacctggaaaggtcagttactcacaaaatttttagagtctatcttatgccataattctatcactgagagaagaaacttgtccagtcatcatgtaatcttcatgtaaatttatgtttttaattgcagaattcataccacaggcaaagtcccaatgtctgcatttgctgttaccttaaatagtcaaaccccaaagttattgtaatctttttttaacagagaataatttgcagagtaatctcggtccggtagatctttcagtggatccaaatgattgccatgaatggtttagaatttttttaattttcaagttgtttttattctgtggaatactggacttatttttgtagtcccaaaagaaaaataaatatttatttatttgccgttaagagttgtagttttgttttctcaaatttgtcctgacactgacgagattagttaaatgtaggtcatctgaaccaaatacaaggaaggaaggacccagttctgaagagtgtgggcatttcttttcttgtttttttttttttttttttttttttctataggaggggaacgaggtgaactaaacaaacaaaataaagcaaaaaagaactgatttttatcccttgaggtagaaagaatgagattacagtggacccccttgtctgcattttcactttctatgttttagttactcacaaccacgtccaaaatgttaaatagaaaattccagaaataaacaatttataaattttaaatcagtggtggctttgagtactgtaatgaaattttgtgccatcccactcagtctgcctcgacttcccttagaatcatccctttgtccggtgcattcacgttgtatttactccctgtctgttagtcacttgttgcagtatcacagtgcttgtgttcaagtaacgcttattttacttaagaatgaccccaaagcacaagagtactgtgcctaatttataaattaaactttttcataggtatatacatataggaaaaaacataatacatacaggatttggttggtactattctgcggcttcaggcatccactggacgtcttggaatgtatcccttgtggataaggaggaactgtatatggttaacctaggagctagagtcaacagttggaagagactttggggataattacatggaagggcatggtgggtggtcgtttcagatgacaagaatgtttttgaataacggatcatttgtgtcttcagactttccagaactccttgagaattatgcagaggtatttaatcagtcagaaggttgaatagtcaaattattagtgagtgaagtctattttgatgaggattttactaatgctgtcccttagatattataagtaaatcgttgttttcttttgaaatatctgaaacctagttaacatggactttcatttgttcttgtaaagatatgcaaagctatttgggagattgtcatcatctgatatttgatattcatgggctttcttcacagaagactagaaattaacagagtcatgatgaattatggctgcattgactttaaaaaacaaacacctccttaatgttatttaacaattttgaataaatttgatatggcaaacaaatcagttataatcgattgagaaaggaacttaattctaatacttgactggtgtcccataataacccataatactaagagacagttttggagggcgagaagtcctgaagagctgatagagataaaggttcaaatttgagcttctttcagtgttccttacgtcaatgcttttagtttctcatacaaaataaaataaagaataacctttttactgggaaaaggtaaaaattaataaattgtagaagcattgtttgaagccaaaaagtgtgtgacatgtaaattgaaatgaaaaaccttagagtttttgatactttttcaaagcagctaaagaattgatacttggacacaggaagaattttttttcaaaagcaatttttataaaatcagaaaaatgtttacctcttgttgggggcattgactggaaaggaatacaacagaactttctgagatgctagaaatgtttttttatcttgatggggtgtgggttttgtagataatgaaaaataaacagtaaaaaataagtaaaaaaaaaagtaagaaagttgccaatacagttttacatattcctgtgatgtttttaatcgacaggcaccttcttactgagatacgtaatgagaagtttcgattatacaaattaaagatgatggcaaagatggaaaaatatcttcattctagcagatgtaggagacagtatgtattatttattttatgccaatagtatggatttatggatgatgctcttttaagacaacaatttggctaaataattatcagtattttgaaaaaatattttgttgctgttacatgtgtgctgaatttttaaggctaacttctttgtgtctgagtaaactgaagtcaaataatgaagtcccaagtgaatcaattaatggtgattttacctcattattttcaggaatgaacttaacatatacgtttctgttcttttatttaatttaaaattttgtcttgggtagaatcatcttgtctcattttgaggacaaacaagtacaaaaagcctccttgggaattatgggaactgaaaaatgctgtgataattgcaggtccaggtaaagatttcttattatagatggacattctaaaagtctttctttctcttccttttcatgtttaactgaatttttgttgaatgataagtatttcagttttttaaacaaaacaatgaatgtgtttagatatgagaaagcaaacaatattaaagtattttgcttaaaaaatagataaagcaataaaatggtagccctaaatctaaacatatcaatagttatgttaaatgtaaatgatctaaaatattatttaaaggcgtaaattgtaagaattggtttaaaaacatgaccctgttctgtacgttgtccacaagaaatccactgtaattatatagataggtttaaaaaagaatgaaacattacattccatgaaaacattaatcaaaaggaagttggagttactttaatatcagacaatggacactttggagcaaagaatattatcaggataaagaaggatattatatgatgtaaaagaatcatttcaccaatgtatcagtcagggttcaccagagaaataggacgattgatattatggagatatatatatatatatatatatatatatatatggggagggaaaggaagaacaaatatggggagagagggatgaggcgactgattttgaagaattagctcacgaaattgtgggggttggcaagtctgaaatttgtagagcaggtcaataggctggaaactcaggcaagaggtgatgttgcagtcttgaggcagaatttcttctctagcaaacctagtttttgccctttagtcctgccactgagtggatgaggcccacccacattattgacaataatctcctttacttaaagtcaactgattataaatgttaatcacgtctacaaaatattttacagcaacatctagattagtgtttgaccaaacaactgagcatcataggctagccaagttgatgcataatattaatcatcacaaccaagaagacatcatcctaaatatatatatatatatatatatatatatctacttaacaaaaagactgacagaactgaaaggagaaatagagaaatctacagttacatttggtgacttccagcatctctcaataatcaataaaactgacagaccaaaaaatcagtaagaagacagaagaaatgaacaggattatcagcatgctggatctcattgacctttttagaacattctacccaacaacagtagagtacacattcaagtgcagatgcagtattcatgaacatggatcatattcagagtcataaaacaaaccttaacaaatttaagaatcttgtatttgtatattttttgactagaatggaattaaactagaaaacaataacagaaagataacagaaaagtctctaaaccttagaaattaaataacacacttataaataaatccatgagtcaaagaggaagtctcaaggcaaatcagaaaatgttttgaactgaatgaaatgaaaatacaaaatgtgtgagatgcagctaatgcaatactgagaaggaaatttatagcattaaatacctatgtaataaaagaagaaaggtctcaaatcagtacctaagcttacatcttaagcaacaagcaaataagagcaaaataaatcaaaatgaagtaaacataaggaaataacaaagaacataagtcaatgaatagaaaagctatggtcataccactgctgtccagcctgggtgacagagtgagaccctatgtcaaaaaaatttaaaaacaaagcagcatgcagcattcattgtcagtgaatagaaaatgggaaaacaatagagaaaatcaactcaaaagctcattctgtataaagatcaacaaaattgatataaacttctaacaagactgacggaaagagaaaagacacagaagaccaataccaggaatgaaagagggaatttcactacagacctcccaggtattactagggatgataagggaacactatgaacaactcagaacataactttaataatttagatgaaatggatcaatttcttgataatctcaagctaattaaacttacagtgaattagataacctgcatagtgttacaaccattagagggattgaattctatgttaaaaatctctgaaaataaaatcccctagcccaaagaatttcaatgacaaattctaccaaacatttagaagacaaaataataccaattctatagcatgattccatttatataatagtctttgaaacataaaactatactagagggatgaagaaaagatcagtggttattagagattgggggagggagaaggtatgattccaaaggatagtacaaggcagtattttggagtgatagatttatcgtgccctgattgtgatgggagttagatgaatctatggatatcttaaaatgtgtagaactttacacatacatacaaccaatttgcctatgttaattgaaaaaataaaataaaaacaaattatttacctggtgggttagctacgtacctaagttcaatagctgcgttactgtaagacaaaagaagcattattagggatggagttgttctctgtgtaatgacaaatacttcttcactaagaagacagaattgttttatgcacctttaaaaaaaaacaaaaacaaaaaaaatacaaccaacaaacagtaacttgctggtgcggtggctcacacttgtagtattagcactttgggaggctgaggtgggaggatcacttgagaccaggatttttaagaccagtctgggcaaaaaaccgagactgtgtctctacaaaaataaaaaataaataaaaaaaattagctaggcatagcattatgtgcctctagtcccagctactctggaggctaaggtggaaagatcgcttgagcctggaaggttgagactgcagttgcagtgagccatgatggcaccactacactccaggctgggcatcagagtaagactctgtctcacataaaaaaaataataataatgataaaaactagtctgggcatggtggctcacacctgtagtcccagtcctttggaaggccgaggcaagagaattgcttgaacccaagactttgagaacagcctgggcaacatagcaagaccccatctctatttaaaaaaaaaaacaaacttaaaaatccagcaaatacataaagcacaaagccgacagaagaggtggagaaatcaacaaatccaccatcaaagtgggagaatttgatataattttaagttattggtagggtaaacaatccaaaaattagtacactgtagaaaatttggtcaacatagtaataagtttgcttattactatttatcagtatacatagtatactgatttatcagatacatagtatatggagccctagagcaagcaactatagcagtgtatctcaagtatttttacttcatgacccacatagcaaatgatatgtgtatataacacactgggctaattgtcagagttcagtttctgtccaaaaccctaagatctggagtgattaacctttcagcactcttagaactcacttgtttgtagcacactgattgagaagcactgaaagacttcactcctcaaacatacatggaatatttctaaaaactatgtattgggccgggtgcagtggctcatgcctgtaatcccagcactttgggaggccgaggcgggtggatcccgaggtcaggagatcgagaccatcctggctaacatgatgaaacgccgtctctactaaaaatacaaaaaattagccggatgtggtggcgagtgcctgtagtcccagctactcgggaggctgaggcaggagaatggtgtgaacccaggaggcggagcttgcagtgagccgagatcgcgccactgcactccagcctgggcaacagagcgagactctgtctcaaaaaaaaccaaccaactgaacaaacaaaaaaactaaaaaacaaaaacaaaaaaactatgtattagagcatgggttggcaaactatggcctgtaggccaaatctgcatgctgttttatttttttttatttttttgacatagggtcactacaggctgtcacacaggctggagagcagtggtatgatcatagctcactgtaacctcaaattcctgggctcaagcaattctcttgcctcacctcagcttcccaagtagctacaggcatgcactaccagacccagttaattaaaacaaatttttttttggtagagacagtctcagtatgttgcccaggctggttttcaaactccttgcctcaatcagtcctcctacttcagcctcctaaagtgctgggattataggcatgagccatcacgcttgactaatgtttttgtaaataaagttttctcagaacacagccatgccttttgtttatgtgttatgtagggctgcctgagttaagtagttggctgcaaagcctatcatggcctataaagcctgaaatacttactatctggtcctttatagaaagtgttttctgaccctgtactagactagcttgtctcaaaattcttcaatgaatttggaagttttctcaccacattttctgaccataatgcacttgagttagaagtaaataagcagataaacaacaaaatcctcatgcatttggaaattaaaaataacacttaaataattcatattcaaagaaaaaatcaaactggaaattaaaaaaaattttaaacctacagataactacattaatatgcattaacatttttagaacttagggatagttacaatgatatacattaaaactggtaagaggctgggtgcgttggctcacgcctgtaatcccagcactttgggaggccgaggctgggggatcacgaggtcaagagattgaaaccatcctggccaacatggtgaaaccccgtctctactaaaaatacaaaaatcagctgggcgtggtggcacgcgcctgtagtcccagctacttgggaggctgaggcaggagaatcgcttgaacctgggaggcggaggttgccgtgagccgagattgggccactgcactccagcctggcgacagagcgacactcttgtctcaaaaaaaaaacaaaacaaaacaaaaaaaaaaactagtaagagggcccagtggctcacacctgtcattctagctctttgggagactgaggagagaggatcagttgaggccaggattcaagaccagtctgggcaacataacgagaccgcatctctacaaaattttaataacaacaacaaaaaaaactggtaagaggcaacattgaatagtactttgtgggagtttattagcttgaaatactcataatagaaaagaaaattaatcagctaagcatctcactaaagagattaggagaataaacctaagcatagtttttttcccccaaacattattatatctggaatattgaatgcattcttattgctatttcaaagatacttactctaaggaaagcaattgaattaggtagttgaactctatagtagattttctttaatgagtccttttgttctcaacctacttaaataattctcatttgaatttatgatagtttcagatctacccaaagggtgacttaggaatttaacttctaaatctatttaaatgaaaggtttataatctttttgtcatattttacagtcgttagcgtttaacaatttatagcataggatttgggtttttttttttttttcattttaaagaagaagtttatttaagcaagacacttgactaagggaagactatcttggagttattattactagagtaatttatttctacttaaagacagattgccccacaagtaacagctacataaaaacagttgtaaaattgtccttggttttacaatgataaatgaaaaacattaaaattctctaattgaacaaggtatgcaaggatttttatattgttttttgctaaaactatgacagcaaaataacatcctggagtataaagataagagctgaatgagcaggccactaggggacaaagggagtcttttcacagaaccaatgcttcttttgcccaccccatctccatcgaagtcaatctaaacatattattggccatttagttaaaaaaagaaagaaaagaaaagcaatatgcttgtggacatacaccagttactttatgtgcagtaaaagagtaggaaggggaaggtgaaagaatagagaaaactatgtagtcaggatgtggtggaaccaaattgcaactttctttttttttgagacagagttttgctcttgtcacccaggctggagtgtagtggtggcccaatcttggctcactgcaacctccgcctctcagattcaagccattctcctgcctcagccttctgagtagctgggattacaggtgcatgccaccatgcctggctaatttttgtatttttagtagagatgggttttcaccatgttggccaggctggtcttgaatgcctgacttcaagtgatccacccgcctcagcctcccaaagtgctgggattacaggcgtgagccactgcgcctggccaaattgtagctttctaattgagactgtcttcttggtctggaagagcagagttctgcagtaaaataacaggtcccccttttagtagacatctccatgtctgctgctggaacacatcagttttgtcttaagcctcacttccaaatgtgcagatgtgtctggttcattgattggctgcctgtcaaattgaaacctgatctgcctcattggcaaaccgtgccccttacaataggctttcattggtttactaagcggtgtggtgcgtggctgttcatcttaaactgcaccacagtttaagatgaaccttcaaatgaacattatccttgttctcagtcttgactttccttgggctttttgtggaccctggtgagtgtggcagtctcctcagctgctgcttcacaaaagaggtaccaggtctgccccgaatgagtgagcccctaaacaggaccaggagtggcagaagaaagaggcagcaactgagatgtgttttttctaagctgaaaggctttttttttttttttttttgcaacacacctttaacactaaagtccaatatttatataattggtcaagtaagtggagctgttctagctataaatatggcaactctgcttgctcgtcctattattgacattattcctttctgtggtctgaggtgcctcccatgaaacttgcttctaggacactaggattgagaaccatcagcgtaacatatctgttacgctacaatagtttattttcatattttagctactttacatactcgggtataatgaactttattcatagcttctgaagcagttggcacatttgagatattttttacttggctaattgttatgctaaatcttttgatttctaaagatacatgcctttgctaagctttcttcaaatgttattatttttatttagattggatcattgctattccatggatgactcagaggatacatcctgggactttggtccacaagcatttaagcttttgtctgctgtggacatcttaggcgaaaaatttggaattgggcttccaattttatttctccgaggatctgtaagtatatatctgtgaattcccttcatagatcttcttttacttctattacacttttcttcagaggtttgcagtattatgattgtagctttgacttcagatgggtgactaggaactcatagagtcttactaagttccagttaaacactacattcattactttggataaaacccgtgtgtatggcatcttctgctgttttcatgttcaagccgatgttcagctctgcagctcagtctggaagcattgtgttaatttatcacattgcatttgggtgaatccctagactagtcttgcttaggataattaggaaaagttaactttcattgtatcaagggacaggtagaacaaaattgtccttttgtccaggaaaccattaaattcttcaaggaaaactttagttatagggattattttttaaatgtctaatttcagtaacaatatttgggacatatttatttttccttctgtttcctatcagaagtatttaaagttataagaaaattgtggtttttgcctttactaatgaataaataatcaattaaattcagttacttttttttggagtgattgatgttccagtattcttctaaacaaccacgggtacaaatgtgaataagataggaccgttgcagtccaagagcttgttctgtagtcctttcctttatatgattttttcccctgatttagaagtctataaagcaaagctaagtattacacactgataatggctgaataaatcaagagcaagagataggatactttgcaaatatgcatatttattaaaaatgtactttaaaatagagattaaaattctcgtattgaatgtagaataggtaagcatttatttgtgaaatactcgaatgcttcatgtaaatactttctgagtttgtatttttagaaaggaacattttggaggctgaggcaggagaatggcgtgaacgtgggaggcggagcttgcagtgagctgagattgtgccactgcactccagcctgcgcgacagagcaagattctgtctcaataaaaaaaaaaaaagaaacatatttattaaattagttgtgaaatatttttaatgaaatatattgaaaacttctgttgatttttcatgtactgatgtttttagattctaaatggagtttaaaattttgtttgtaaatcacaagttggattagaaatttaatagtagaagtgttgcctaaggactattttaggtgctgtgagtgaaactgtattttttataacaagaattttagttgtaagggacagcttaaatataattgagatctgtgaaaatgtattctgtctctatcaccttcagaacctgtgtatctcagttgaatgtataatttataaaaattattcttgttttaatttggtgtaatccagccatatccagtatcaacaaataagtctaagtaggctccttgacaaacttgaactggccacaagagagatcagatttcacctattaaaaaaccaaatcagaccacttacactgacagtctcttctgggagtcctcaaattaagaagtctatcctttgtgaaatattacactacccttgctagataaaacttttctaaaagtaccacttaatgaaaatctgtagacactaaatgcaatgaaaataaggcattgtttttttttctccccatttcagtgatcttggtatcctgggatattgtttttaaaattatcgttataattcctttgagaatttagtgaaatgttccctttaaccaacttaggaaaaattaatatctttgtacatgattttgagctgtaaaataaacattttaaactgggaataattggagtttagttaaagagataatgtatataaatatataacatagtagcagcatataattctgtcttacacaagatttttctgaatagtataaacagttatgtagcctatctaggagtttgtgaatagagtttaaaattttgttttgaagctgcaaatttgattagaaattaaacagtgaagttattacttaaggaacttcgttttagctgtctgaacaacttactgtataaaaatctttaaacattctgtataaatatgtgataagatatgcaatgaccttaattttatagattagaaaataaaaacacactcattaatttacataactgacagattaagtgaaacttctcttctgatcacgttagcagaatgccaaatcttgtcgtggcactagaattagacggtagttttgataatacatgatttgactatagacatttgttgaaactattggtagttttaatcactcttgtaattttcaaactatctaacgggagaggattatccatcctgttttctagacaaactgtttcatctgaatgaaatatattcctagagataattatcactacttcatcttttggttttattttgcacatagaattatagttcacaatgactttctgaagctctaaagttgcagctgtgagcttctttggcctgtagggactgggaaaaagcacccccgtcctcccccaagcccccccaccaaaaaaagttaaagtgtttttaacaatagctgtgggctttttgtagtttcagaacttaggagttgcccaggctggaatgcagtggtgtgatcatagcttgatgcagccttgaactcctgggttcaagcaatcctcccacctcagcctccagagtagctgggaccacaggtgccaccccacccagctattttttttattttttaatttttttgtaggtatggggtctccccatgttgccctgcctgtctcaaactccagggctctcaggtgatacccaccacccttggcctcccaaagcaccgagagtcactgtgccaggctgagtttaaaatttcttgagttggagtttatggctattttttccactagttattaaacatgtatttttgtataaggcactgtattacattttgtggggggattcaaagctaaattagatgagacgcatcatctattatggaagatgttacttaagaagaaatgagtgtaatgtagcagagaattagataagggacgtatgaatacatataaatgctgttgaagttctgaagagagagagtgtttagagaaattagaggagtctttgtgaaggtatcactagaacttcctatttttgtggaatatatagtagattttggtgtgatactgtggatttggacattcactcagagaaggaatgagggaagaatggtggagaagaatggcattcacagtacaaaaagcaactgtgacttttaaagaagttaatatggagaagtggcaagtcttttcttctctcttctcttctcttctctcttctttttcttttttctttttttctctgtcagataccgttgtaaagactttgcttttaccggaaactgatacgttgggtcatgtaccctggccagtcagttctctttattctaacacttagccgatcagttagatttccacattccatgatatgtcagttttggtgacccttatttttccacctggtttataaagggaaagaatgtgatatgtcacccaggctctggagtacagtggcatgatcataggtcacagcagcctcaaagtttccagttcaagcgatcctacttccttggcttcctgagtatgtggcactacaggtgcatgccaccatgcccagctaacttttttgtagagacagggtctccctatgtttcccaggctggtcttgaacccctgacctcaagtgatccgcccaccttggcttcccaagatattggcattacaggcatgagccactgtgccggcctgaaaatttctcttttgagatggcatcccacagaagtatacctgcttagagctaacactggtaaaaagactatttaaccctattgccttattttactgtagttgagattgagttaaactgaaagctgaatgacctgtcctaggtcatactgttactttgtgccagagtcaggatgagcaaatggatttcctgcctgctagtctagtgtcttttctatttattgtgctgtaacatacagttttaaatttgtatttttatgcccaatggacatggtagctcacacctgtaatttcagcacttttgggaagccgaggtggggggattgctcgagaccaggagttcaagatgagcctgggcaacatagcgagactccgtctctataaaaaaaaatttaaaaattagctgagtggtgatgtgtgtgcgtgtagtcctccttgtgggaggttgaggtgggaggatcgattgaatctaggaattcaggactgcagtgagccatgattacaccactgcactccagcctgggtgacagagcaataccctgtctcgaatgaatgaatgaatgaatgaatgaatgaatgaatgcccaaatccgtaagctatgttctgtatagcagctttttcatcataggcagtttttactcttatcagtggacaacctacaaaattaactaaacacttaaacaattaacagaggaggccttgttcagagtgagaaatcattaagcatttgttgttgaaatttcttactgtactctgttttaattctgtttttttttttttttaatgttacttgttttagtttggattcctagttgaaaagggaatatgattcctttaaaacaaagatactctgctttaaagcaaaggtatatcatcctcttcatggtgattgccatggaaacaagacaatgtaaatttattcaaatagtacacagtttttatagttattgatcatgaggggaagggacagttaatccctactgatcagataaaacctcattgtttcatactaataaatggtttttttatgcttatgaaaggaaaagccagaagtgtaatttttagtgtttagagagctagtgattctagttagggaacttaatacctttgaagttattagtttgcaagcaatagaatctactactaccaaggtgacccctagcagatgtagagtaccattaacaagtgttccagggaaggaaagccaactagataccaagtcatgctttttactcttagattaagaaattcaggttgagttaaaggatcagctgttaactaataaaaagcagattaatattacagagccaggctctgtcctggttatggacttaatcttcacagcatcctcaagagataaaaatgaatatacctgcatattagatgaggaaatagaagataagtaacttgccagagctatgacgtgaactcaggtaatgtagcttaagagcccccacatgtatgtatattgggtgtgtgtgtggagggggtgcgtgtgagtgcttgtgcatgcgtgtggtataataagaaaaaattagcatttatgcctgtaatcccagcactttgggagaccgaggcacgaggatctctcaaccccaggagttcaagaccagtctaggcaacatagcgagaccctacctctacaaaaaaagttttaaaaatattagcgggcatggtggaatacacctgtagtctcagctgcttgggacgctgaggtgggaggatccttgagtccaggagattgaggctacagtgagctatgatgacacctctgcactccagcttgggtgacaaagagagaccctgtctccaaaaaaaaaaattagaactagttatctggaggcctgtgttctagtcctagctttagtacggctacacagtgacacattaggctaccatttaacatctttgaacctctgataatttgttaacaatatgggtaaaaatgactaagataaatcaaagagctccagcattccctccagctctgaaattctatgatgttttatcttattttacttacaaaaataaattatattatgtatatttaaagtatacaatttgatgttatgggttacctatagtaaaatgattactataatgaaactaattaacatatccatcatcttatattgttaaccatttttttgtttttgtggcaaaagcagctgaaatccactcatttagcaggaatcccaaatacagttcagttgtattaattgtaattctcatgttgtacattcgatctctagacttgtttatgctacatatgtttgacttttaaacattctactcaaatcaaccctaagtcagggttagcacagacaggacttgttaacaaggtagaaggtgccacattgtacctgggtgtttatatttctctaaatcttgttctgatcatattttaataaatataatcatcaggacaccaaaattcattccttagctattaaaaaattctattctattttattgttaagatttaggagagcatggtacagattctcttaactatacctatcagaagcctatgttttaagtccaatgtataggcactgctctgtttgtctctggtgggaacttaccctgctttacctaatttcatcctagcttcctttttgtgaaagatcacccttgcttagcctattttttggcaaatctacaccttggaaatagtagtaaatgacataagcatattaatatttatgatgtgatttatttttgttttcaagtcatatactggggaagattctcaaatattaaaacaatgtatctttacatttatgtatgtcgttcttgttctgttttagaaggcttgtatttgcatttttaacattccaaaaggtaaacctgtaatcataatgttttcatcaattcaataaaaccattacgtttgtaatagagagccctatagttgccttagttaagtttgctgcaactcattttatatattcttttaattttgatccctggatttttaattgattattaaaccttcattaggatatatatgaaatgtaaaaatattgagttataatctaccgttttctaaaattttatactgcatttttatatagaaattcaaattgctcataatcattctagtgaatttaagtagaaaggtatttattactaggtattaaatggcttataatattgttgacaaggttccactgcaaaatagttcaccaagggagctgtggcctcttctgtgatcaagaagccatctgtcaacttgggaagcttccactatagcacctaaccccagactacattgagtaggaagctgtaataatcaggaagcttctacctttgcatgctctgcaaaccaacgtgaacctgctgtaatttgtaaccacaaaatggatgcctgttgatacttacgaagctcatcattgtatgctgggttctttgctaatactttcttataaaaattaaatacctccacaatcatgcatgctagcagaaacagcagaggagtagccttagcctcacttcctgcttatacctgtcatgcaaatatacagaacccagaaccctagctgaaagggagtttgagaactagtatttgtattgtcccagattctgcagtggaagaattcatagtggatggaagttagaatgacccttgaattacaatcggccacattcatcacaaatacattaaataagagtaatttgccataaagctctatgtttgtatacttctttgttttttttttttttttttttttttttttttgagacagggtctcactctgttgctcagtctgtagtgcagtggtgtcatcatagctcactgcagtcttgatctcctgagctcaaacgattctcctgcctcagctcctgcttcagcctcctgagtagcggaacaacaggtacacaccaccacactttgctaattttttattttttattttttgtagagatgtgggtctcactgtgttgcccaggatggtctcgaactcctgggcttaagtgatcctcccaaagtgttgggattacaggcatgaaccactgtgcctggcccatatactacatatatttaaaagtagtatttaaatgtgtaggatgaatgaaagaggcagtaagagaacaaagtgaatgaaaaagtatttctatatgaagtgaaagcaggagagtcctctctgttagagaacaacagaattgcatatgacagactagctttcttaatatttctagaacttgatggctgtgaagagcgtcccgtaggaattctcccttcacttaggaaaacatacctcaaaaccatcagctgtttagcatgcacctgcttttcctggtatatctcagtgaagcagctaaattgtaaatgattaagtaaactttgcagtgtatcatgtgcaaaagcacagtaaaaacaaaaatgcattggaagctgtgagttgttgcactgcactcatggatgaatagctgttggttcgcattgcgtttttttgttttgttttgttttgtttttttgagatggagtcttgctctgttgcccaggctggagtgcagtggcgtgatctcggctcactgcaagctctgcctcccagattcacgccatcctcctgcctcagcctcccgagcagctgggaccacaggtgcccgccacaacacctggctaattttttgtatttttagtagagacggggtttcaccatgttagccatgatggtctcaatctcctgacctcgtgatctgcctgccttggcctcccaaagtgctaggattacaggcatgccgcattgcgttttatataattctcatggttctagtctcgagctgtaggattttgatcactgtttcaaacaataatgtgagtttgctaagaggtctaaataacaaaagctaagtgttccaaacacatatccaaacctatacactgggcaatgcatctgaattatatgtgaaatttcctgccattatttaagacacaaaaggaacattattttgataatgtatttatttgtgagtggagtgttcagaatgagcacgatgggtataacatttttgtaggtttttaaagttgaaatttagtgtaaatccaaagaatcaatagacaagtctgtgttttacttaacctatatgtttaaattagcatttttagatactgattttattcctaatttcagaattctcagcgtcttgccgatcaatatcgcaggcacagtttatttggcactggcaaggatcaaacagagagttggtggaaggctttttcccgtcagctgatcactgagggattcttggtagaagtttctcggtataacaaatttatgaagatttgcgcccttacgaaaaaggtaaacggtgtaggagtctgcctgtttgacttaattttgtttcccactccacattaaaagatcctttttgcttttaatagggtagaaattggcttcataaagctaatacagaatctcagagcctcatccttcaagctaatgaagaattgtgtccaaagaagttgcttctgcctaggttcatttttcagtttttttcttgtaacttctgcattttttgttgctatttatgtgattcaaattataccagtttataggcctctcacaagtaaaatgaattacctgtttgtttttgtatgcctattttagtcagtttgggggaagggatctgtgaggaaaggataagtcatagagcacttttcttttttaagagacagagtctctctgtgttgctcaagctggagtgcagtggtgcgatcatagcttactgcagcctcgatctcgtgggcccaagtaatcctcagccacctgagtagatgggactacagacatgcactactatgcccagctaatatattttaattttttgtatagagacagggtcttctagtgcttcctaggctggtcttgaactcctgagctcaagtgatcctcctgcctcagcctcccaaactactgggattacaggcatgatccaccgctcccagccagaacattttcttggttgatgggaagtagctgaccatggtatttagaaaacttctttctcatcgattaaagaagcagtactgaaatcaatgcggaggaatccatatatcatatttacttctggtgtgtagaagtggaaagggaatacatttgttgcttacttttttgtacctttacatgtgattgatcacttgtgagttttttctttcaaacatcttaaagcttccagagctttttctagaaaaaaaaatcagttttaagaatcaccagttctaaaagggtaatatcttattcatctttctgagaatggagtatcatgattcatgaattagatacttgcatcttaacatttgaaataatttaattttattattttttagttcgaaaactgtatcttcgggcaccaaagagcattgttataatcaagtaccagttgaattaagtacagagaagaaggtttgttttaaagaaattgttctgatttatttcattctttattgattcaaattctgtttaaaattttatattttaattcctttccaattaaagagaaaatggcatatataacaaagcataaaattcggccagggaagtgatgtgaacagactaaaatttattgtatataatttctggggctaataaagaattggaggtatttgagaaaggaattaatttgggttcttttaaacctatctgctaactcatttggcttagagtagtcacatgttataatacttatagttgatcaaaaaattgattcctaagtgttcttattaaagacacacacacacacacacacacacacacacattctctctctctctctctcacacacacacacatgcacacacacttatgtactttcttgctttttttgacctaagatcttagataactattacagattaaatactaatccactggcagacttcagctaattagaacactggaataataggcaagcatagtgaattacattttctggtgaactttttctgctttattgaagtatgcagaatgtaaatgaattgtttttataactttggcacttgctgtatcttagaacattcttttgatgatttattttctgtagttttgggagagataagacattggaatgcgtttctaactacctttagaactttagaaactgataatttaggaggttattttcaggtgattaatttgacagcttgattaggcaaagaaaaaattgtgattttgagatttttgtttcttattttcttcacatttaaaagttttttgaaactttttttaatggacctttatatgtttaaatgcagtctaacttggagaagttatattcttataaaccatgtgataagatttcttctgggagtaacatttctaaaaaaaggtacagagttccatatttctatgttctatacttgctttatgagtacttttttttctaaagagaaagaactgtcagatgttgggctatttcattggcaaaaggaagttaaatttaaaacataagcttttcagtattagaatgatcaaagtgagctataaaagaataatgttaatttaatagctaacacttcttggatattactgtttgtcaggcattatgttaaatgctaagaactttatatgtgatatctcatttaattcttacaagagtctaacagctgttactatttatcgccattttatagttgaagataccaagggttaagaagttgacaaacttgttcaagagcatacagctaatggccgagctggctttcaagtctatatttgtctacctctagcatcaagacactatttatttttctttgtatgaaatatatacaggcatactttgttttattgtgcctggctttattgtgacttgcagatattgcatttcttataaattgaaggtttgtggcaaccctgcgtcaaacaggtcatattagccccattttccaatagcatgttctgttgtcatgtctttgtgttatattttggtagttcttgactggccattcaccatttctctccctctcctcgggtctccctgttccctgagatacaacaaaattgaaattaggccaattaataactctataatagtctctaagtgtgtttttttttttttcgagactgagtctcactctgttgttcaggctggagtgcagtagcacaatctcggctcactgcaatcttcgcctcccgggttcaagcgattctcctgtcttagcctcctgagtagctgggactacaggcgccccccgatcatgtctggctaatttttgtatttttagtagagatgggtttttgccgtgttggtcaggtggatcttgaactcctgaactcaggtgatccgcctgccttggcctcccaaagtgctgggattacaggtgtgagccgctgtgcctggcccatctctaagtgtttaagagaaaggaagattcacatgtctctcaatttaaatcaaaagctaaaagtgattaggcttagtgaggaagccatgtcgaaagctgagataggccaaaagctaggccccttgcaccaaacagttagtttgcaaaggcaaaagttcctgaaggaaattaaaaatgctaccccagtgaataaaacaatgataagaaagcaaagcaggctttttgctgatatggagaaagttttagtggtctttataggagattaaaccagccacaacattcccttgagccaaagcctaatccagagcaaagccctaactctcttcaattctctgaaagctgagagaggtgaggaagctgcagaataaaagtttgaggccagcagaggttggttcatgaggtttaaggaaagaagccatctccataacataaaagtgcaaagtgaaacagcaagtgctggtatagaagctgtagcaagttatccagaagatctagctaagatcatcgatgaaggtgcctgcactaacagactttgaatgtagaccaaatgctttctaccagaagaagaagctgtctagtactttcatagctagagagaagtcaatgcctggcttcaaagcttcaaaggacaagctgactctcttgttagaagctgatgcagctggtgactttaagttgaagccagtgctcaattagcattctgaaaatcctagggcccttaagaattatgctatatctactctgcctttgctacatacatgtaacaacaaagtcttgatgatacctgtttacagcatggtttcctgaatactttaagcccattgttgaaacctgcttagacaaaagattcctttcaaaatgttattgctcattgacaacacttagtcaccaagagccgtaatggagacatacaaggagactaacgttgttttcatgcctgctcgcttaacatccattctgtagctcatggatcaagaagtaaattaaccttttaagtattattatttaagaaatacagtttgtaatgctttagcttctgtagatagtgattatcagagatgggtttttaagaggttttccagaaaaccttctggaaaatattcactattctagaagtcatgaagaatatttgtgattcaggagagtaggtcagaatatcaatattaataggaatttggaagaagtcgattcttattaaaatcaagagtttagtgatagacatactgagtttgggatacctgtggagtagtccagaagttaatttaaatatatgggcttagtgtacagaagtgagcagggtgcttatatatgaataaatattattttaagatatatttaaattttccttaaaataatacctatacttgatataaaaagttaattggaaattagtggcttatgacaagcataccagcccacactcttcccaaacccactttgctcttattcatagaagctgtcatcttcaaatcttccagctgatttccctggcgtgtgccttcttatttctgaatgacacgcttagagtactatttttttgacttagcaattttagaaattttctactcatctcctattatggtagatttcccctccttcattcctcctccaatataattatatttcgtcatattaataatttgtttatatatatttttaatataatatgataatattgtatttatattattaaaactacacaaatattatatacacactactaacccaaccgtgttattatggccaccactacctttatttttttccttgtgttagtgattgtctttgttttattttcttggttttgagtattccttttactaattttcttttttcctatttcaatctctcattatttgtttactcatttggagtgttccttgacttttatcccctcttacctagtgacattttaattttagttatcaaatttttaatttctaagaatgcttcttgttctcttcttgtttcttcttccccaccagccaaaaatctatgatgttatagcaaggatcatacattgtttcccagtaggttaagaaaccttggttaaaacctgttgtatcccagtaagttaaaagacgttaacgtgtcatcttcagtatggatgaaagaatattttctttcaaaagcagttggttgaggaagagaatgggacaaatgctctttttaaaacaccaattttgtgatgaactcaaattgcaattttaactttaccattataatgaatgtatttgatccaaaatgtttaaaatctaggctgttgtcatttaaataacaaattaccttactggtatcatgaagaataaatgtttgtactgatttggaaagacattctcatttaggggatgaaatagaaagtcaatgaggagaaagaaaagcttttattatttattttcttttaaatattttagtatcatggtacagtcaccagaaaaagcttacagttcctcacagcctgttatttcggcacaagagcaggagactcaggtaaggcttttgtaaaaaggtaattagtttatgataggatagttatgattctatgtatgcttaaaattctgtattttgccagcattttaaaaattgttcttaagctaagagtctgagtttatatttcagtttatattcattctaaggaaaaatgtggtatctgaagctctaaaaataaaggactagatcttttaagtacactttaaaaagtgttgtttctttgttttttgttcagattgtgttatatggcaaattggtagaagctaggcagaaacatgccaataaaatggatgttcccccagctattctggcaacaaacaagatactggtggatatggccaaaatgaggtaaactatcttttgcatgtgttctatttatttccttctaacaaaatagatttggaaaatatatctaagttgataatatgaccatagcttccactgtcacatctgggaggtgactcagattccccctgctgcgatgcttatctctttgccaagctttagtaccgtgtttctgtatgaataaaaaccagttacgttttcagcaatcatattcaatatttataaaatctaactcattatttacccaccctgcattttatccaaatgccgaaactcctctttttggattctttatttttgattatcttaccatcacatttgtagtcagaggttcctaatgcttaaaacctctgatctgaattttctctcctccaatataaaaccccttcgtcttcctcttcttcttcttcatttttttttttttttttgtctgaagacttgtctcactgtgttgcccaggctggagtgtagtggtgcgatcactgctcactgcagccttgaccccctggactcaagctatcctcgcacctcagcctcccgagtagctgggactacagaacatgccaccatgctcagctaatttttgtattttttgtagagacagggttttgccatattgcctaggctggtcttgaactcctaagctcaagcaatcttcccgcctcagtctccaaagttctggcactacaggtgtgagccactgtgcctggcctctttttctcatttaaatacttttcataccttttgtaaaacgggttccttgttgcctgtctatgccttcctcctccttcttaatgacaccacgttaattctgactgttttcccttggcctgttgcagaagcctcttaactattaacccttcattctctctctctgtttcatctgatatatgagtaccaaactaaatcttcctttatcatatcttacttctgcttaaatgttttttttctagcttagaattcaaggccctctatttatgaacttaaacttacttttccctctaagttacagaatttgaaatggtttatcttacctggattgtttatcacttgttgaagatccattttcaacttccatatatttatttacagtgttgcttctccttgtagtttccttgattcctcaaaactccttttaagaattcttgaagatctcgctttattactatttctcgctttattactgtaaagactatgagaaggtctttcatgatcttatcagcaaagtaattcctctctcttgaattcatagaggactttcagatgaattctaaagatgcttctgtagcacttaccacacaatgctatattttatttttttgtaattagtggtaaacaagtattattatatcttctagattttaaactccaaataaagatactagctccttacctttttgtgtgtctcctgtagcacctagcacaatgcctcataaacaggaggtgatcattaaatatttagaagaaattatttcccaagaatagttgcttggtaattgtatttgtcttttacttccttttaaaaaattgtttctgtcactaaattgcatccaatagatgttacttgagtgcagaattttctaatgacattacacagtgctacatctgacactaattcttttgttaaaaaataaatattctggccgggcgctgtggctcacgcttgtaaatcccaggactttgggaggccgaggcgggcggatcacgaggttaggagatcgaggccatcctggctaacacggtgaaaccccgtttctactaaaaatacaaaaaattagccgggcgtggtggcgggtgcctgtagtcccagttactctggcggctgaggcaggagaatggcgtgaacccgggaggcggagcttgcagtgagcggagatcgcgccactgcactccagcctgggtgacagagcgagactccgtctaaaaaaaaaataaaaaataaaaataaataaatattctaagaccatactttaatagaggtgttttttttttttttttttttttttttttttttttttggtgatagagtctcactctgtcacctaggctagagtgcagtggcgcgatctcggctcactgcaacctccgcctcctgggttcaagcaattctcctgcctcagcctccggaatagctgggactacaggtgcgcgctgccacccccggctaattttttgtattttagtagagatgaggtttcactgtgttgtccaggctggtgttgaactcctgagctcaggcaatccacccgccccggcctcccaaattgttgggattacaggcgtgagccacagtgcctggcccagaggagatatttaatgaaaaataataatcattagataggcagatttttagaaggagggcatcgaatgggttcttggatattggacacaataagaaatattgagctaaaagtctgaaggaattggcagatatactgttacaggtaaacactttgtagaagaaaataatgaatgagactttcttttgagattttcttagcctcttagttgttcccagttaaagcctcatatttttccttttcatgacaataaaaataataataaaatcagtaataaagtgaatatatgagatgttaacctgttcctttatgacaatgtcctgtttaccaattaacagtgtgtttttgtggtgatgggggcaagacaaatctttaaatggtggaaagcaaagaaagaaattataaaacatgattagttgtattatacgttgtttttggttgttggaaaaactatacatttattgagagaatcattaggaagctgaacatcagctatattgctggagtgatactgtttcagtggtttcttgacctttttgttgttgttgttgttgttgttaaacacagaccaactacggttgaaaacgtaaaaaggattgatggtgtttctgaaggcaaagctgccatgttggcccctctgttggaagtcatcaaacatttctgccaaacaaatagtgttcaggtaaaatactgtggtttgcaggagctcttagagaataagcattttttgtaaccatttcaaaagtaccctccagaagcaacatttgctcactttatttgcatttccatactggacacttagaaaatgaattaaaattgtttttacagtcaatctgttgtaaaaacatgtcagttatctacttttaaagatgatactaaaaagtagttgtccaggctgctgatgtctttctatttcattgggaggttttgtttttaaattggaaacattattttaggttgataaattataattttacattcaaatgtggtagttggaatttaaagctggaaagttatccttgctatgagttggtcaggagctcagccactttcttttggtttagcatcttctctaatctccctccccttccagtaatgctgtcttttgatagtaagtggatttcatattattctcttcagttttaatagtgtttccttcatatccttttattattgcttgttctgccctaagtgaccatttccagaaatgtcatttaggattttctctaaactccacgtagcagactctataatgcatactctgcagaaggtgaggcagtgggaggtagaggggagactactagactaggagtcacggaatcaggactttagttcttccttacagttgttcacctggtgaacctgcacatgtcctttaatttccttgggtctccatttcctcagctatacaatggaaatgacacttcctcccccacatccaggaaacaacagatgacattagaaaatagaagacatgggataagtataaaatgttgaaagagttaaacacattcaaggcaatattaagggattattttttacttccaagaagctcctggaagctttgggcaggcacagttggatcctactttagaaaaatctttctctaactataagtagaaaacccttctgctttttgaatgtagcatttccctcttttgatatagagtatctttggcaactttgaattttctttttcatactcttatataagacatcatgtgaaaattcttatttcttactgagtttttggaaatgaaattataatgtcttaatagtttgagaaagaatatcatacctaccagcggtaattgagtaagttccctctctttggacacttgaaagtagtatcttctttcatgaattagtgatattatttaataatgaatgagtgatctctcctaactccccttcagaagaggaaaatgaagtaggggaaaaggtaaattccccaagggataggtatgaaacctttatgaaccttctggatagagaagatgactgctgatttctgtgattagaaattatacttgggttattctgcaaattgaaatgaattatttaaaaaaaaacaactttaatgtttattaagcaagttttgttattcatgagtttcattagccttttattttttttttaaattttgaagtaaaatttcttgctgtcacaatacacattaaaaattacaaatatgacacatattaaacacattaagatggccgaataggaaaaatatgctaaaatatttttatataaatacattttttgagaattttgagaatttctggaacaaagtaatgatataatccataaatgtacaattaaagagtttaaggatatccaaaatacttggcaaagtaatctgaaataatactcttaggaaggtagggcaagaatgtgattctagtaagcaaaaatgtgatcaaatcgtattctagtcccagctactcgggaggctgaggcaggagaatggcgtgaacctgggaggcggagcttggagtaagccgagatcgtgccactgcactccagcctgggcgacagagcgagactccatctcaaaaaaaaaaaaagactatatgaacatgtatggcataaatatgtacaaatattatttattttaaaaaaattcaggggtagggacagggtagttagaaaatatctaaggatgttcatgaaataatactggctatgaatgacagttgatgaaaccgggtggtgcccatcttattccctcgactcgtgtatatgtttgatatatcccacaataaaccttaaaaaaaaaaagatgagtggtcaattataggaagatataaatagaaaaggcaataaggacaaaagttggcaaagcttacctaagcactcttcagataaaaagacatttttgctaactagatttgaatattatagtttaattgtcaaggaaaatgcctcaacttaatctttgttaagagactacttaaggcactatcagaagttccctcatggcaaggtgcaatccctcatgcctgtaatcccagcactttgggaggccaaggcaggcaggttacctgaggccaggagttagaaaacaacctgggaaacatagtgagacccgacctctacaaaaacaatttcttaaaattagccaggcatggtggtgctagcctgtaatcccagctatttaggatgcttaggcaggaggattgcttgagcccggggatttgaggctgcagtgagccatcattgtgccacaatactccagcctgagtgatagaaaaaaaaaaaaaaagtgtctttgttatattccaaacttgttctcaactttcaggtgagctggcttcctgtataactcttgtataggacagaacatactggttggggcaagtgaaactgtctagttgtatgcctcataaattaatgaatttcctttctaatatatacactgatatttatacacacatacacataaaaccaagctcaatagatgggtagtgcagctctattccccaaaacccaactaccctgtaacaagacacattagacttttgagattgcaaggatgaggactgaaatgctggcctagaccatggtgttgccatagtggggtgaccagtctgaatagccaacaatgcttcctcagtaaatacccattttgtcttggtgggatttctataaattgcaaaatgcagctattatgaagctgtaaaagagaaacagaaacatgtaacacctgggactgttttattaggcccaccgtatgctcagaacatgaaatctccactgctagggttatttgattgaaattatcttttgtgttgatgtgagagtttagctctgagattcttccacatgtaaaatgtaatcccccaaagtatttggcaagcacattttattgccttgggtcagataattgaaacattaggcatcatatatatagcatgtaaaaagtaaaacagaaacatttatgtttctcaccaagcagtaaattagtactcaactaataaatttcttaaactccctaataacagaatatggaaacaaaaaataaatctttccaaaagaagagctcatggacacatttcctcatatatgtatacataatatagtagaacacatgataaataacctataaaaatgataccaatatcattcatcaagagacgaggctcttctttaaattattaatttcatctgttacaggttttattatgactgtagtatgctgttttcatctaccttttatgtgtagttaaaaaaatagttttctatctctttacctttatttcagcctttaaaaagattccattattttttcattaatcttgtttttcagtttttcccattttttcttttaaacatttcttaaggaaccatatttaagattttatagaatacttagatttctagttgggatgtatcatttaaaattagatatgtagagagagtgttatgatatatttccttacgatatattagtggttatagtacctaaatttgaatagtgattctgttcattcattcattcattcattcaatattcacttccaggagattggggacttatttaaagacagagtagttcacattatagttcctttttttagtccttcttattcgttaaagaaaagactaggaaatgtttgttattacaaatattttattaaaattttgtgtgctctagcattattttaccttttaaaatcaatatgttaaaaatccaacttctttttgagctccccataaaaagggaattatttgttgcttatgggtttaacttgtgttatttttttcttaatggctaattatcatacatatattctattattgtattgatattactgatcatttgtgctacattaaaaattctgtagacagacctcttttcaagtacaaaacctcaagaagaacagaagacgagtctggtagcaaaaaataaaatatgcacactttcacagtctatggccatcacatactctttattccaagaaaagaagatgcctttggtaagtgtgactttcatgttacagggaatttttttagtttacttaaacttgtgttttatcagctttttagtattaaagttctgacttgggatcaatttcctccaaccctacaataaatctcagtttatctttaattttaaaagagaatgttgttttctttttctgttaagcctccctgttaagtaatagcagcaagtttagtttggccatgaatatcttctagagattgtatcggggtactgataaacacatttgtagctcagggatactgcatcagccatattttaaaatgggactaacagtttaaaaactataaatattcacagtgttaagaaacaatctcaagatgcattaagaaaaaggaaggtgcaaaacagaaaaacaaacgtaaacgtgtgtgcatatgcatgcttatatagtcacatattcttgtatgtgtacaaaaaatacacactggatctctgcaagcatagccaagcaactggaaatatgtttttaaaaacttgcttttcattctatctcttctagtactgttttgatgctctttgaaaacaatctaattgctgtaacaaatgaccatacgtaggccgggtgtggtggctcatgcctgtaatcccagcacttcgggaggctgaggcaggcagatcatttgaggccagggatttgagaccagttggacaacatagggagaccctgtctttactaaaaatacaaaaattagctgggcgtagtgacgcatgcctgtaatcccagatacttgggaggcggagacatgggacttgcatgaacccaggaggcagaggttgcagtgagctgagattgcgacactgcattccaacctgggcgaccgagcaagactcggtctccaaaaaaaaaaaaaaaaaagaccatatgtaatgtttcttcattgttctaagataaatctttaaggctgttgaggttttttgtatacaaaatggagagtaagttttaatgggatgggacaaaatgaggcttacagttgagtttaatttgagttcacatcctgttgacattaagttgatttggaacaagtgatatggtccaatgcctgcttttctattgtctgtggttccatccactagtgcctgtgttacacacctcttgttcaggttttatcatttaaaataaataagaataaacagtccatagcttatcttacttactgaataaatgctctaatttgacagtcatgtttcttaaagttccttacaaaggccattgcccaagaaaccaaataattccattatactatttttgaaatagaacacataataaatgggaattttaagttcagtttcttatgtaaacaataacttctatgtacatgttaaatatgcctgtatatacctaatttgaccatgtatgtatagtagaaatgaaaacagttactaagaaaatttgttattggctccaaattttctgaattaagtgtattctaatgctcagccataatatggggtttcatgtgttagtttatgtattcatggttaaaaatgtgaagactgttatatcttcatttgtgtcttttggtattatttggttgtattttattgtgtgatatggtggtataattatccttacctcccaggagtttgagagggtcttgccagttaaccgcagaattaaacatgcttaggactaattaatcaggagcaatactacaattagttggaggtaatttgaaacctggtttcaaataaccctgatattatgcacacatggtgcacacttttctagtagacatttaatgaaagtaatttaaaacctacctttgaaggatgaaaaacattgccttaaatgctctattctgtgaaagtatcaacatttatgcaaatacagtctaaattcagactttgaaaatgtattgaaagagaggatcatgaaataagttagagctgagtgacaaagctttctgagtgtttaaaagaatgttttacctaataaatatctgaaatgtatttggagccacatttgtttaaagaactgtataaatatgtagcactgttcatgtgaagttcaatagtaggaaaatgctgacagcccttgtggaactgtggttattattattttatgaatagagccaatttcaaacacctattagagtcttctcaggaacattttatagaatgcatctggagccttatgttatctctaagcattttaggatttgtcttcttggaaattcatgtaaccaaaccaccatgtgttatttcaagtgtatatagtattgggttacagtttactatgttttcagaaggttgtgacaactattagacttacagagaatgacttctctgccactaacggctttctaaagtgaatagagaggggcgaggattgaattcttcggtaaagctgggtgattttgttttattcaatacagtataataagtataaaaagtagaacctatagagagctataatgggggtagttttaaagaaattctgaaaatgaaaaacttaagtaaaggtttagttcattgtttatttcacactgagcatttactacctgaatgttttggacattttatttccatgactggagtggacacttttacaactcactgggttctttgctgatctttctctagaagagcatagctgagagcaggattctgcctctcatgacaattggcatgcacttatcccaagcggtgaaagctggctgcccccttgatttggagcgagcaggcctgactccagaggttcagaagattattgctgatgttatccgaaaccctcccgtcaactcaggtgagaggcatggcctagctctgcacccttaatgacttgatgaagtaaacaagcaatccactatatttttcactgttaacagcattaatcctttatgctattatgaaaaccttacttttgtgattctttttcttgttttaggaaaacaatctttcttcccattatcactcagaggaaagtatactgagaaatttttttgttttgttttgttttttgagacagagtcttgctctcttgtctaggctggagtgcagtggcgtgatcttggctcgctgcaacctctatctcccaggttcaagtgattctcttgcctcagcttcctgagtagctgggactacaggcgtgtgccaccatgcccagctattttttgtattttttgatagagacagggttttccatgttggctaggcaggtctcgaactcctgacctctgatgatccgcccacctcagcctcccaaagtgctgcgattacaggtgtgagccatggcacctggccaatacactgagaaatttttattttccttttcagcttaaggttacaacttccccaccatccaaaacgtgcactttcattttttttctaatttctatctcatcacttgcaaaaaccatatttttctccacattcattcccagtagcttcctgactcctagttcttccctaaatccttctgagtccttgtcattggtttcgcttgagtagcctttctaatcaacacagtcattggtatcagttactgtgacatggaagggacagaccaagttctgtgggccgctacgtagaaggatttcctgtcactttgctgcagaacctcagctcgcggagagcaagcccctttgcttgccctgtagaaatattttaaattattatcctttttttttttaacagaagtaaataggagatacgttagaggattttctctcctagatgtgtaaatacaaacttggggtcttataactcaataaatctgataaatttcttttgactgttaggatagagcagtggccataccaatagcctcatctccaaagctgcagtgaagatactttttactaccttaaagtctttcccatttgtgaacaacttgtgaacaattccccccaagaatttggaagatcactctctgaaagcacagtcaatactgtacttaaatggatctgagcaaaaataagtcacttagaagacaggattatttctagacttgagtgtgacttgactgaaggtctaaagaacaaacagctccttcacttccattgatcacggtggaagcacagggaaaggacagacacggaggcaagttggagtagtgctcatctaagttccagggatgcgggggagtggccaggggacttcaggtatagtaaataaataacctatttataagttatgtcaatgtcatgtttgaaatagaaaaccaaatactgcatgttcttacttacaagcaggagctaaagttggtgcatatggatataaaaatgagaacaggccgggcgtggtggcttgtgtctgtaatcccagcactttgggagacctagatggaaggattgcttgagctcaggagttcaagaccagcctgagcaacatagtgtgacccccatctctacaaaaaataagaaaattagccagacgtggtggcatatacctatagtctcagctacttgggagtctgagtcaggaggagtgcttgagctcaggagtttggggttataataagctgtgatcatgccactgtgctccagcctgagtgacacccagagtgagaacctgtctcaaaaggagaaaaaaaaaaaagtaacagtagacgctggggactactgaggggagggaaggaacaatggttgaaaaggtgggaagggacagtggttgaaaaactacgtgttgggtactatgctcactatctgggtgatgggatcaattgtacctcaaacctcagcatcctgcaatatactaatgttacaaacctgcccatgtactacctgaatctaaagtaaaagttataatttaaaaaaattataataaaatcagaaaataaaggtctgagatggaaaattaaaagaccaaagccacccataagcacaataaatccctccccccaaaaaattatatctattaaaaaaaggtgttgcgccaggcactgtggctcatgcctataatcctagcactttgggaggccaagacgggcagatgacttgacttgaggtcaggagttcaagaccagcctggccaacatggtgaaaccctgtctctactgaaaatacaaaaattagccagcagtggtggcatgcgcctgtaatcccagctactcaggagactgaggcaggagaatcgcttgaactggggaggcggaggttgcagtgagccgagatcatgccactgcacttcagcctgggtgacagagtgagactctgtctcaaaaaaaaaaaaaaaaaaagaccttgtaccctgacaagttttagtttgtgcaggaatgctagaatgactcaagattggaaaaatctttaaatgttaattacacaataagggtaaaaggagaaaaattacctaatgtcatctgagcaacaagaagaagaaatgaaaggcattaaaaattgggaaaaatttatatttgacagtatcttaacaacgaattctgcttctatatcacttcctagctttctgatgataacttcccgtgcagatctgtatgtaaggaatggacgtagtagtcatgctaatctgagtatttatctgtgtgatacttacgaattaacgatgtaagttaataagttagcatttcgtgaacctggttaataccatttgctaaggttaaattagccaaatcctgaagtaagctgtaaaacatccaaggtagggtagagaggcatcttatgagaaagctggccaactctcctggtcaccttctaatcttcctaacttcagaaatcaaggcagagagaggaaaatagtaattactttgtaggattagatttatggttgtcgaaacctttgtttctccagtgcagaatgagatagcgttttagggaaagccaaagactcagatgtcttcttcatgctcatcgtgtggaatttttcttcctttagaaatgtattgtctctcagggcttaaagcaatttgcatctttcgatgagacattgagtaataggcaatattctctgaaataatttgtgcaggctgggcacagtggctcacacctgtaatcccagcactttgggaggccgaggcgggcaggtcactgaggtcaggtgttggagacgagcctgaccaacatggtgaaaccccgtctctactaaaaataccaaaattagctgggcttggtggcacacacctgtaatcccagctacttgggaggctgaggcaggagaattgcttgaacccccatgggaggtggaggttgtggtgagccaagattgtgtcattgtactacagtctggacaacagagtgagactctgtctcaaaaaaaaaaaaatagaatttgtgcagttccccccacccccttttttttttctgttggcatttttgctatcatttagctgccttctttatatcctgaaacttacaggtggtgttggtctagtcagtaagagcaaaggctttgggaatagatagatctgtatttagaccttggctctagcatctcattgttatgtgacctccatcaagtgacctaatttccctaatattcaatttcctcatctctaagacagggagttaatattgcctctcttatagaattgtgagaaatatagtcatgtgtcgcttgatgatggggatgaattctgagaaatgtgttgttgggcgatttcattttgtgggaacctcacagggtggacttaaacaaacctagatggtatggcctactacacacctaggctgtacggtatagctcctgtcttcaaacctgtacagcatgtgactttactgaacactgtaggcaattataacacagtggtatttgtatatataaacatagtgaaacatagaaaaggcccagtagaaatacagtgtaaaagattttttaaaaaagctgggcatggtggctcacgcctgtaatcccagcactttgggaggccgaggcaggcagatcacttgaggtcaggagttcaagaccagcctggccaacatgatgaaactccgtttctactaaaagtacaaaaattagctgggcgtggtgttgggtgcctgtaatcccagctactcaggaggctgaggcaggagaattgcttgaacccaggaggtggaggttgcagtgagtcaagattgtgccactgcacttcagcctgggagacagagcgagactctgtctcaaaaaaaaaaaaaaaaaagagataaaaaggtacatctgtacagggcacttaccacgaatggagcttgcaccctgggagttgctctgggtaagtcagtgagtgagcggtgagtgaatgtgaagacctaggactgtgcactgctgtagactttataaaccctgtgcacttaggccacactcacccctgtgatacgagtctacctactgtataacgtacctgcatatgtacccttgaaactaaaacaaaagttaaaaaatttatcttcttttgccaataataaattaaccttagcttactgtaatgattcttctttatgaattaaaatctttttactcttttgtaataacacttggcttaaaacacaaacatattgtacagctatacaaatatattttctttatatccttcttctctaagattttttctgtttttgattttgttaaatttgtttttactttttacattttttttgttaaaaaccaagacaaaaacccacacatcagcctaggcctacatgggctcaggatcatcagtctcactatcttccacctccacatcttgtcccaccaggtcttcaggggcagtcatatgcatggggctgtcatctcctgtgataacaatgccttcttctggacacctccagaagggcctgcgtgttttacagtgaacttctaaaaaataataaaatgtatagtatagcaaacacataaacatagtaacatagtcatttattatcattttcaagtattatatactgtacataattgtacatgctagacttttacacagctggcagcaaggtgagtttgtttacaccattaccaccacaaacacatgggtgatgctttgcattgtgatgttacgatggcatgatgtcactaggtggtaggaacttttcagctccatgataatctaatggatacttgttcctgttggctgcccgtcgttgactgcaacatcattatgtggtgcatgactgtaaattagatactgttcagaaagctttggcacactggtaatagcaaatggtggtggcaaatatgatgatgatgatgatgatgattgaagacatagatggtaaaattttatggtgtcttaaaagtaccctctaaatatgattatttttatagtctgtccttttgaataggcacttaagaatgtatgaacttaataagtatataagaaagaatgttccccaaaatatatcttacagaggcatacaatttaagaattcaaacaggttgtaatggggtgtgtgtgtgtgtgcacacgcgcacgcatgcgtgctcattcacactaaagaattcttgggcatatgttcctgaatgtcctaaatggacattctaacatcacttcattatgggcagagggaaatggtaaagaaaaatttcatattatattattcagccacatattgacagcatctgttttatttgcctatggtaaagaattgaagcactgttaatttgctttttaaatcatgtaggcacaaagttatcgaactttagatttagaaatgaaactggaaatcattacactttccctttcctatccccaccctgttttggagagaaagagtgtgaggcttagagagttataaaactgttttaataccatgtctaagattaataactgaacaagtttctctttttactcgtgttaaagttgtactgccaattaacttaaaagaaagaaatatgcaatttctaatcctgatataggatatgggtatataaactctaacttgatgagtgaaacaaattaacttatttataatcagtttcatatctttatttattgagtgtctttaaataccccttacctttaaagtaagaaatattaaaatcaagcagaatataataatgaaaaattcttaagatatacttactaaaaacttatccttcggttaatacactgtatgtaggttgtacatacaatatgaaaaagtatatttttgtagcctacttttaaatccagaatagaggaggttaagaaggttgtgataaccatgagctcttttttttttttttttgagacaaggtcttactctgtttcccaggctggagtgccgtggcacaatcatagcttactgcagccttgaactcttgggctcaagcaagccttccacttcagccttccaagtagctgggaccacacctggctaatttttaagtatttttgtagagatgagttctcactacattgcccaggctagtcttgaacccctagccttaagcgatcctcccacctcagcctgcctaagtgctgggattacaggtgtgagccactgagcccagccctcttttatttcttttgatagtacactcataatcattaaactatcatttctggatgtgagattgtgcttttggattcttattttttctttataaaatactttttgttctcttactggagaaaacattgttggattataaatgatataacaaggaatgaggatatacatactataataacgattcagatatgttattttcatattttatttaactgtagccatgccacaataatttagagttttaaagaacaagtttgattgaaatctaaactttgtacaatcctgaattgagaagtttcctgtattttattatgacacaatatttacctaaaaatagagtaattatgaattgagaaaacatagctattaatttcatactcttatttgttaagtagattttgtctggaaaactgttcatatttaaaggagctttgtacctttgtattctttttgtttttccttgtttatataattttaaactctgtttatggatttgggattctaactatgctaaataataaattaaggcattgaatgaagtacctagacagtattttgattaattttattcccccattcttaatgtgcatgtaactggaaaattaagagtggcttccaagggatctactacaaaagtaaggttaatatgatctcttttaaaacactgaaggcgtgtagccagtgttgtcattaattctgcagtagatattttcagcacttatttacatgggaagttagagcagagtaagatgcacctgtaaagctaaatgccacttatttgcatatatataaaacgcaggatgaatttaccatagaaatataaagggtacttatagaaatgtattagaaaaatatatgaatttttaacttatatctagaagttaactttatacatttaactttaaatcattaatagtggtttaacaccataagcggatgtttatgcatcatcattttatgaacaaaagacattctaattttagaaataaagtgattcaaaagagaataaaatatcttactttttcttttaaaattaatttgtttagcgcattacatgataatagctcaagcttgtgtgatttttccctaaaaaattggtttataaatattacatttatagtatgaagaaattaatcatacatagtttatttatctaatttctaaatacccatggaagaaaatgaatttaatggaatgtagttgtgtattacttggtttcgagtgtgggaaaatttatatggtctttctaaaacagcactgtcagtagaaatacaatgtgagctacatatgcaattttaaattttctagtagccacattttaaaaagtaaatggatgcaatttattttgataatataatttaattagtctactatatttaaaattttatcatttcaacatgtaatcaatatgaaaattattaatgagatattttacatacttttttctgtaataagcctttgtaatcaggtatgtactttatatatacaacaaatcttctgatgctaaattttaactggaaatacttgatctgtgtttagcttttgtaaaatttactgttgaacaacgtggactaatgtgcctaagtggttccaaacatattttaaaatttgaagacaaataaaagggaactcaaagtaaattgggatacatacatacaacagaatactgagccattaaaaaatgatgaaatagtaaaattgggggaattttgatgatactaggatgatataatgaccaagagacaaatacaattttagtttggttgagagatgtgatcatcacgttgctgattttactatgtatagaggttatcttttcctttctaagattttgaaactttaattagttaacccacttacctagtttctattagctgtgtaactttctcttcctgttttttgttttgttttgttttgttttttgctttttaactgcagtattttgaggagtcttggagtagcaagctaatctttggaagaaaggaaaatataaacctgaaaactaacaatttaaagaacgtcttttcaggttgtcatttgaaaaatacttgatttctgatcactgatttgaattgagtgtcaaatatttgatatgttttgtaaattaggtgaagatgagtgagtaggttctaaactgcttgggtttaccgcactctggagcattgcagaagaatgtgatgttggaaggaagtgctgaaacataattattggcttgcctataggagggtgctacataattttagaaggtgtcaagaaattgacacagtctgaattagttctgttgagttgcaaaaaatgtaaagtttcttgattctgaaaataagaaatatgttcccagaaatctcatctagttaatgtgcttttaaaatcattgatgtctcttgttattacaataatagccattgaaagaatcttttttattagaatgttatttacaggtacgattagcttctatttaaataaattatttttatacttgatcttaggcaaaaggccaacaagtgatcagaataaattattttaagagaaaactaattataattgatatttggaattggaagcacaatttcctttagaacaattccacgaatggttgttttgattctcaaggcagcccacaaaagacagtttgaaacacaatttatgcagtgtcaatagtactgacctgactttggatcttggaggcaggggcttcaggtgatacccgagtggagtttttactccatttccattccgtaaggctataggcatttgaaagaggaaacttttctttggcaaccttccaccttcctttctacagaatatttcagtatttctagctcataggttttctaaaatattctctgtaatttattttgaaatggagtttttttatcgtttacagatatgagtaaaattagcctaatcagaatgttagttcctgaaaacattgacacgtaccttatccacatggcaattgagatccttaaacatggtcctgacagcggacttcaaccttcatgtgatgtcaacaaaaggagatgttttcccggttctgaagagatctgttcaagttctaagagaagcaaggaagaagtaggcatcaatactgaggtattaattatatatagaattttcataaagtgtcagtttgttcaatttgcatatcctagtactagaatgctgtatttttttgaactgttatgaattctgatatgattactttctctatgtgctacatttcctttgcttttcataaatatgatctgagaaaagtgattaaaaaaaagacagtaaaagggaggtttagtccatctgtttagcttattatgtagaatgtcagcttaaattttacctgtacctcatattgaccgtatagcctggaaaatctttcggaggtatagttaatggatttaagcatatggcagtttatgtagttaatgaaagtgaaaacaaattgtattataaatacctcccaaactggtttattatcattctatcattcttcatgctctgttagtatgatattgaatatctgaggtaccaggattattgttgcttgtggctctgagcatttcgtagtgcttttgcatgatgagagaaagattacaaatttagtattatgttagatggtacgttttattaaaatcaaatgcttcaaaaataattgctctgtgtatggcatgagataaatagcaatcagatatattgtttaataatatgactctattaaatgatggcataaatttgaaaatttgaccttcggtatcttccgggtctaaaattatatgactccattataaatattttggaaatgattaactaaaaaattgtttcaattcttagttggtaaattcaatgtggtagtaggtggtggtgattattttgtattagagaattaggaattacacttagttctaaggtaatctttataggatgtccagcaattaaacccctacttttttgaattgcttaaaaataagggaactgatctttttaaattctgtacttgagttacgtctgtatatatagtcatgtcctagataatctaatggaacttaattagttggaaatctttatattgtttataactgaactagctataagaggaacattaaagaaaacatattttgagtggaggtaatgaaatttagcttctaatgctcagccttttatttctgtaatctataccagatacctaagaccctcttattgtttcccagcttcaacctgtcagtatagaaaacggtgtaacttactattttttctcaatattgaagcacatttgtagtgaaatattattttaactatatattgccatttttgctttttccctatttcagtaacatttttcgctatttcagtaacattacatgtcaacaagagaatggtgggtattttggggggggttgggtggggagaaattttactaagcttgctagattctaaaaggtataccttatttggccccttttccccatttaggggaacaagggtgttggggctgggaagtagataagaggtgagtaagtcatccaaagcatatgtcttcattagcctccctgtatgaaaagctgatttctgtagagtgttggaggcctactttcagaatctgtcatatgttaacattcatcttctctactgacctgatttatatcccttagtctatttcattttataattatgacaaaggataaagtcattagaacaaattctttttattagttgacgtattgttgtgtttatatctcttgtgtttgttattaagatggaagctcaatcatgtccttgtttaacagaaaggtgatgtcttggcattgataattctgattcaatatccataggtacatggtggattctttaaatatttagtattcttttatttctggaaagttttcttaaatgatagtttttttaaaatttcatttctataaagttttcttaaatcatactttttagtgttttattccattacttcatatttcttcttcaggaactcctgctatacatgtatgttggatcttcattacccagcttcaatatttttcacttttcatgcattctttttatttcttcatttctctttaaatttttttcttccttttcaccttctatttctcttttaacataattgtatttatttctgtattccacatagcttagtattcacttattttaaaattattttaaaacgttttttagatttaaaaattctttttttatttatatatacatattttatttttaccaaaggagcaacactattaactgaagacttctataatttttttcttttatttctgattctttcttcggttttccccctcagttttgaacttttctaattttgatttgtgatgtccttttgtattttagataattttcctaatgttttccagctcatttggaaaggctacagttttattctgtacctaagcaagtctttctggtgtcaaagatttgaccttgatacttttcttttgctcattttcgtatgagattagttttcctgtactttcaaaagaaggcgtggttcaagatggctttcccaatttcacatctgtctctaatgtttttgtgtaatgtctaaaatatggaaacttggtttatgagatctactctgccatttttatctgggctttctcttccttttgtctctgttgtacctgtcctgcttggttttgatttaaccccagtggtttctcctgaatgtggagccttctcctagaaggcagcctcggctagtcccagggttcagagtagccagctgctctcttcacctaagagaccactgtggattccttgtactcacttgctattggcttggacaaaagccctcccattttcagatgctattatcagattaatctctcattaatctgtctttccagtgtatgcctgtgggctatcttggggttctcttgttatcagacacctccctgctggcctctgctttctcccgtacagatgtcagtactgtgcaggtcttaattgctgttggtggtttgcccctacattcttacagttttagtttcccaaggatacctttaaacttggttttattgtaaatgtcgacaatggattttgggttttactatctagttctgtcttaattctggaattcagaaagattaaaagctctgttgttgcagctgctgccacctcttcccagtaccctctcctcctatgtcatttttttcttcttatttttcttgactgtataagagagaatgtatgacatttcctgcttgaccgctgagtttgattataaattaaaatacacaatattttatacaaattgttttgtagaagatttatttacagatgctcattcacaggtaaaattgacttatgaaaatagttttcatgacaaatgtatcaggctcggtaactaaatatatggattgatcttgtttataaatgaaattaaatgtgaatgtaacttacatatttctgtatttgcttacatccgtatgtacacatataatcagcaaatgagttgatgtttcctattcgtaacttaatggtaatagcttggtaacagagttgggagtattaaaaagatgtaaagagccccttaaaattttgttgctgggaattttagtgttctactgatgaaggaaatagacactggaaggcgttgtttctattaggtaacttagatatcatactgaagacttcaaatacttattgttgacactcaaaagacacacttagtgtaagtaagcatttccccgcttttcccaatgaaataagatcattattataattccattataaatgctgatgatcatatttatagaaatatagaagataagacttgaaatgatattcgctaccaattaatgagtttgaagaagaaatcaggatgtgttttgctattttacatttattcttatttaactccaaagaattcagtgatgttatgtactattatttccatttctctgtgaagacgttgaagcttaagtaacacgcataataaggtcatacatttagcaagtggctcaattaaagttcaaacctggttctgcctggtttcaaagtctgtgctactccatggtattaggctacaacatgacttagggtttcttcctctgctctattgctgttcagatgtactcctcttttggcagagtgggagaaaatttttgcaatctatgcatctgacaaaggcccaatatccagaatctacaaggaacctaaacaaatttacaagaaaaaaaaaaaaacattaaaaagtgggcaaaggacttgatcagacacatctcaaaagaagacatttatgtagccaacaaacatatgaagaaaagctcaacatcactgatcattagaaagatgcaaaatgccttttctgtatgccaccttatatccccagtatttattatttctaagtcatagtatcttacagtgtatataagtctcatccgttcttttgattttctcttccctgcttgcaattgggtacctaggaacaaagttgcaatcttagccagttttttctttagcctttgctgatgtgtgaaaagcccttttttctaccctggatttctgtacttaagctggaacagctaagtttttaccttttttaaatataaagtttcagagtcttctgccaaggatcttttgctgttttcctactgttaaatatttcaaagccttttttaaacatagggaatataatcaaacatagcaagcagctgatgaacaatatctagatagtcttcattattgaaatggaataaatggtatttttgtattttaggctaacagacaccttgtaccttagataaggccaaccttctcataaaatccctcagttacttttattaataataaccaaattaactctggattccagggtgtactcatgatggaatgatttctctgtcatgttatcctgaggatctagtactctgagataacataagtgtatgacactttaggcttatgaaacacttagctacttaaattatttaattttttttcatgtgcagatggtattgtacccaaacactacctttgtgtgtgtgtgtgtgtgtgcctgtgtgtgtgtttttgagacagggtcttactctgctcaggctggagtgcagtggcgtgattatagctcactacagccttgacctcctgggctccagtgatcctgccaaagtgttgggattgcaggcgtgagccacctcacccagccttaaattatttttttttcaaggatgtttaacctgagggttagaggctctttggcacgtgagctgctgaaatgtgtgtgaaagtgttgtgcacgtgtatgtttctctttttttctgggaagtggatctgtagtgattcttagatgagtctatgagacaagaaacttttatttttttcatttatttagcgaatgtttgttaagcgtactatgccttggccactctacagggtgctgattggaccagtctgtctacctaccgttgtagatgttagaagctatattcttttcacatgcctaatataactctttgtgtatgtatacatgcccaggcatgttccttcctcagaacattaaattcaccattttggtcaactcaaagcaagtacaccatgggacacagatctgaaataatgtccagatttttacttactgaatgaggtgtgttgagtgtataagactacatgatgagatggcaagtaattgcctgaagaaatgatgtagtgattttgtgtgtcttatatttatttactttttgatccagaaataaattatatagataccactattttgtttggatgggggagaaaggatgggtgtgtattcaggaacttatgttacttttttgcaactaataccccttctcagtagtacaaagatttgatttctttttctttctatttcctacagacttcatctgcagagagaaagagacgattacctgtgtggtttgccaaaggaagtgataccagcaagaaattaatggacaaaacgaaaaggggaggtctttttagttaagctggcaattaccagaacaattatgtttcttgctgtattataagaggatagctatattttatttctgaagagtaaggagtagtattttggcttaaaaatcattctaattacaaagttcactgtttattgaagaactggcatcttaaatcagccttccgcaattcatgtagtttctgggtcttctgggagcctacgtgagtacatcacctaacagaatattaaattagacttcctgtaagattgctttaagaaactgttactgtcctgttttctaatctctttattaaaacagtgtatttggaaaatgttatgtgctctgatttgatatagataacagattagtagttacatggtaattatgtgatataaaatattcatatattatcaaaattctgttttgtaaatgtaagaaagcatagttattttacaaattgtttttactgtcttttgaagaagttcttaaatacgttgttaaatggtattagttgaccagggcagtgaaaatgaaaccgcattttgggtgccattaaatagggaaaaaacatgtaaaaaatgtaaaatggagaccaattgcactaggcaagtgtatattttgtattttatatacaatttctattatttttcaagtaataaaacaatgtttttcatactgaatatta

SEQ ID NO: 175 - DNA, 6550 bp, Homo Sapiens
cccataaaaacaaagtgagcattttttattctgcattttggagcctcctcgttcccacaccctgtggcaggttttgcccaggtcctcagtcactgccctagcctctgacaaccccagctctacccgacatcccccaatgcagtgcagtcagcgggccacctgcaggagctcttccgtggccaggcccaccagggcatggaagctcaggtgcaggtattttctccagaagcgtcggtcctgcccgtacacctgggccgggtagcaggggcttcctacggtggagccaagacacagccgtgagccccagccccagcctgcagcgggtggagcctcccaggcctcacctgccccagcccccagccccagcctgcagcgggtggggcctcccaggcctcaccgatgccgtggaagatgcgggccacagccctgctggagaacttctcctctggcctcagggacaggaactggcggatgtcgcagcggacctggtcctcccaatcctggagctgtgtggacaggcacatcaggcttcctctgagctcccgtggcactgcatccacagagcaagccccatgcagcccagggaacctgcaaccccgatgagctgcctggccttactgcactcactctggcctgccctggctcggggccctgtgcgtcctccatgcctcccggctcctgcccttcctcttcctcaaagtagcggccgagcaggtccttgagcctggtgctgcgctcctcatcctgctgctccaggcagggcccgcagctggggaaggctacgctgtggggaggagcctgtcagagctgatcactgcgggagggtggatggtcccaggccccgcccgcctcctcccaacctgtgaaaggcctggaaggttctgcgcagacgggccagggcctggcgctcccgggcctgcacacggccatagaggaagtcacatatctggtccttctcctcagcggtcaagtcccccgggctgcgaaggtggaaggccagctcactgaactccacaagcacccctgtcccacgccgcacacctgccggaaagcatgtcagatgcaggcaggcagcgtccagggcggtgtggggtggggagaggcgcacctgtcctgggctcgtggtcccactgcagctggcagagagcccgccgcacagaggccagctcccagcccatggagtccaccagcttgaccatgtcaaactccacggagctgctgccttgccctgggtcctcaggcagctgctgggccaagcacacagccaaagggggacacctgtgcccagggaaaaagggacatgtggccaacagccctgattctccaacctcgtctccaactgggcagggcgtgcttacctgtgggccagggcctggagctgggcagggcccccagggcagttcagacggcaatgggtataggtggtcgccagcagctccagccagtggtgtgggtgcagctccaggtagcacagcaaagtctcgatggctgggggcagagcagggctcagcggacgcggggacagcccctccacacccctgtggcttaccccaggttcctcaccctcctccggcatgtccaaagcctgtacggtaagctgtattgggagtgcccgctcatggcccatgcagacccttctgggtcctggggctgcttggtggctaagctgctcagcctcttgaggggggtacttgggcacaggcctctccccacccacggccccttcctgctccgagggcggcctggtgcaggtgcaggtgcaggctgggaacacgcgctgtaccagcctcttcacagccaggaagtccgtgctgtcggcgtgcacatgtctgcgcagctctcgcaggtcttcgccctgcagggcaactttcatgagggtggggtggaccactgggggctcgagcactggcagtgtggggggggggggtgccaacctggggctgcaggaagaggtggcagtgggcaggctgcccgtcacgcccggcccggcccacggcctgcacgtagctctcgaagcttgggggcagccccagatgcagcacagcccgcacatctggccggtccagccccatcccaaaggccaccgtggccaccaccacccgcaactggccctgcatgaaggctcgctgtacccgccgccgttcccggctgcacatgcccgcgtggtaggcctcggctgtggttttgggggcacgacctttggggaagacaggcagatggtcagtgggatgggaccatgtgtgcccaaggtgggtccacggggacaccagctctgtccatgccgcacctccagaccctgggacccaggctgcgtgcaggcaggttcggaggagcgcagcgatccgctctgtgtcctcgcgccggttgcagtaaatgataatggaatcgaggttttgaaaacgtttgccttgcagcagcgtcaacagtgcctgatgaggagcggttggcgtgggcagtggggagtgaggaggggtcggcgtgtgcagtggggagtgaggaggggtcggcgtggggagtgaggaggggtcggcgtgggcggtggggagtgagaaggggtcggcgtgggcggtggggagtgaggaggggtcggcgtgggcagtcagcagccagggccctgcagggtccccagagcacacacacccacctggtctgtgtccctgtccatggacacggaaaggtgcaggttggtgggaactggggctggcccgtggaggtcaggctcttcagccacagccaggtgctgtgccacgtcactggcagtgcggcgtgtggctgtggctgtgaggcccaggaagcagtgcacgcccatgcgctcccgaagcacctgcaccagaggcggcagtggtgtgaggccgcccagcccatcccggccctggccgcccaccccagttcacatatggctcaccttgcagacgcgcaggtagcagggccggaagttgtgggaccactgggagaggcagtgggcctcatcaatgcaggcaaaagcaactggaggcagctgtgcggctggagggaggcctcccgcccccaccagtgcctcaggtgtcagcatcagcacgtgtacctgggctgcccgaatctgaaggcagcaagatcagaggcacagcccaggtgcccgcccgctgcctccctcacccctaggcccatgaggcccccaccttctgcaggacagattcccgttgcttcctggtcatgcccgagtgtatgcaggccgccttgagacacggtggcaggccagacacctgcaaatgcaggagcgacagccgtcatacgccagcccagccctggcccttccccaagtcatcccagagctgctgccatgtccatcctagtccctcaggggagaggagaaccaggtcctgggtcctagggctaagggtttagagccacctgtgggccttggcccaggagccccagagcagacagactgaagtagggatggctcctttcccagcacatttcccgtaggggtggctgtggtgcctgtggagctgggctgcctttgacctgctgccaagactgggactgaggccacagacaccttgaagctcccaggggagggggtggttaggggacaagcagcagttgcccttgggagtcacaagtgctggttcttggctgtgtacgtgtgcccagggccctgtgtgcacacctggtcatccatgagtgacagcaggggagagacgaccaacgtgaggcaggggctgcgccggctgtagagcagcgctgggagctggtagcacagggacttgccggcacctgtaggcagcaccagcagcgtggagatgcctggatggggcgggagtcagcagcagggttctgcagcctggcctcagcccagcctcagccctggcagccacgctcaccagacaggatccgcatgactgcacgctcctgcccagggcgaaaggcttggtgccccagctgctccagggcctggaacacctcagccggcgtctctgcagacacagatgttgatcaccatgacttgagtcaccccaacccctcagtgaaggctctgggccagaagctgactgctcacctgccaactgccctgagggccccagggagtagagtggcagcacggtggggtccaggctgggcacctcaggtacaggttgtggtgaaggaaccagtggctcaggcccaacagcatctgtgtcttcctcacttgctggggcaggcaggagagggtagaatgggagctccaggtcgggcaagacaaccactggccacaacctctccttcccccaaagggggttggcagcaggcagtgcccttcctctgggctactttttccaaagcagaaaagagtgacagccatcgtcgtccctgccaccctccttcaggggagctagggtagggcctggaccaggggtacctggaaggcctgttgcttggaacataagtgtcccccaaaagagcactgcgccctctccacagtgttggccggacccaccctccagggcagatgtctcacctggccggggacactgggctgcccagtgatcgaactgctcgttcaggaaacaagactccttggttgtgactgtggcaccaccacccccaaaacactcccctttcttccgccacttctgcttccatgcctggggggtgcccacataggagggtcactgggcgggaaatacgggagggctgaggggagggaaagggaatgcctgtcctggcccgtcgctgtcttacctgcttgcggaggagcctgctacggagtgcccggccccgcacgtagtgtttctgcttcatgttgagccgtacgtaattgcccctgtcatggcgggccagccgagggaagatgtgcaggggggctgtgccctcagccttcccagccctagcttgactggaggggctgagtccgtggtacctggggttcgatgggctgctgcagggctgaggtggctgtgcctgtacaggttcccctggagggtcttcctcaactgctacagccccagccccctccgatgggggtccagcttggctgctctcctgctggacctgtgcggggctctcccagggctcctcgttccatctccgcttctcgcctccactgctgctgggctgggggctccccacacggatgctgacttcttggaaggctgaagcctctgggccctgggagccagcaccaggaccaaggacagccgactcaccagggatcagaagttgtgattcctctgagcctagatcaggcctgcaggctttgggggcccccagaaaatctgggacctcactgtgacatcgctgtaaccagccaggatctagggagcccagccgctggctcagggatgcctgcagatgctggagccggcctggccttggctggggctcagggagctgtggaggctcatcactgactttttctgcaaaggaggggacaggccctgtacctgggggctttggggtggatgccttagatgaggctcttcctagaggccacggtctgcggcccagggctggtccggcctgggaggggaacaacagaacagcaggaggaactcaggcccctgagctactgtagactctaaaacctacctgagtccccacgctcaattgtagagcaggctaattagcacaaggctggactagaaagggagtcaagggcgaaggccccgagaagctccctgaagactcgtgccctggttggcacaggggcccgtgcctgtctgtgtggaaaaaatgacaagagggcgacccggaccggaagcagctgtggacctagcgtggactcactgcctgcccactcctcacctgcagggtgcctttcagattggccttgagccgctgcccgtagtccggcaccgagccctggcggctccgccctggcgtagactgtggactcttggtcgcagcccgattcagatggggcccccagcagcggggctctggcgcctgcaggagacaacaggggcacaggccagaaaaggctgttgtggcggcagaagcgctcccagccacccctcccgcacctggagcgaggcccggcccttcttcactttgcccagtccccctcccaagttctgtgccccacggcggcctggccgcgactccgtggctcccgccactccgccaaacagggaagtgggaggaggctggggcggcggggcctgggtacctcttcggccgccgcggggagcgactcggagctgcggagcccgccgccggcctggcccgtggtacgcttcagagtgcggtattcccggtagagcgctgcgtgggcgagcgggaggcggggtcagggtggggcctgggcccctgccgacccggtgtcttctcgcccccgccgccccgccgcgcgctcaccgcgggtctcctccggcgccgcctccacgtcgtcctgtaaagggaacgcgtcagccgcgggccgcgccctcagcccctcggcccctgggcagcccgcacctggctcggtcgccgcccgcgctgccgtcggaacgcgcgctcccacgcctgcagccgctcccgcacgtcccgcagccgctccatggcgcgcgcgcccgcccggcctccgcgcttgcgatcgtccagcgaatct

SEQ ID NO: 176 - DNA, 146619 bp, Homo Sapiens
ccgcgtccgcgcttacccaatacaagccgggctacgtccgagggtaacaacatgatcaaaaccacagcaggaaccacaataaggaacaagactcaggttaaagcaaacacagcgacagctcctgcgccgcatctcctggttccagtggcggcactgaactcgcggcaatttgtcccgcctctttcgcttcacggcagccaatcgcttccgccagagaaagaaaggcgccgaaatgaaacccgcctccgttcgccttcggaactgtcgtcacttccgtcctcagacttggaggggcggggatgaggagggcggggaggacgacgagggcgaagagggtgggtgagagccccggagcccgagccgaagggcgagccgcaaacgctaagtcgctggccattggtggacatggcgcaggcgcgtttgctccgacgggccgaatgttttggggcagtgttttgagcgcggagaccgcgtgatactggatgcgcatgggcataccgtgctctgcggctgcttggcgttgcttcttcctccagaagtgggcgctgggcagtcacgcagggtttgaaccggaagcgggagtaggtagctgcgtggctaacggagaaaagaagccgtggccgcgggaggaggcgagaggagtcgggatctgcgctgcagccaccgccgcggttgatactactttgaccttccgagtgcagtggtaggggcgcggaggcaacgcagcggcttctgcgctgggaaattcagtcgtgtgcgacccagtctgtcctctccccagaccgccaatctcatgcacccctccagagtggcccttgactcctccctctcctcactccatctttcctggcctctctccgggtgcttagcggacttggccaataacctcctccttttaaacgccctgaattgaaccctgcctcctgcgcatcctctttttgtgtcaccttagggttcagatttaactacgcgacttgactagtcatcttttgatctctctctcgtatttagtacttttagtcagcgagcatttattgatatttcaacttcagcctcgcggttaagagcttgggctctggaatcatacggctggaattggaattctgtcagtcgtgtggccgctctctactgtcttgtgaagataagtgagataatcttgacctgtggtgagcactcgtgagcgttagctgctgtatttaccaggtacagataagacaactacagtggatgataatgtatgtggtgataggggagtactctgatggtagaggagtgactttggttctctgcaaactcagcctgagactatcaattcagtttgtggtgagacctcgcagtgttaccttggcagatggtagaagccttccagatggaaggaaaaatgcgtgtaaaggcacaaagtgtagaaggaccctgaagctccagcgtgaggcctggcattgaatgaaatatattttgtgggttttcagctgctgaagtcataggaatggatgagaccaagaaaacaaagctgtttttgaggtatgagcggaagaagagatatcaggagactttcgaaacagtcataacggaagttaatatgatcattgctaacatttgctgtgtttcaggcactgtaagcatgtatatgggtccttaaagggactcatagaggtaggtactagtattgtttttccttttatcattgagaaactgaggtttgaagagattagtgaacttgctctagattatacagtttgtaagtggctgaaccaggatttgaactaatacaatctgactacagaggccacactccttagcactagaaaagaatggcatgccaagggcagagttatttctaggaagatgggatataagcgtcattgtcaagttgtgcaaaggggtcaacttggttgagatctaaaaaggaacactgaattcgtcaattcagaggctcgtaggaagtaggaaatccttatcttttcgtttgaaccttgagtggaacctagatattctggattaatgtataaatgaagttcatctttatatggtgacactcatactctagttgactacctaatagttcctctgccttctttcagttccgccaacatactgtgttctttaacattgtagaaccctttggctatgctagtctccttccctgaagtgttggtcctctagccctttttttgattggcaccagttagttcagatcttggctttattataaactcctctgagatatatgttccctgacagtttatctaaaatgattctctctacagttattttctattactgtgtttttgtttcctcagaggcatacatcacaatttggaattatgcattggtttatcaatttacttgtttattgtcaccctgctgcccagatatgacttcatgagggtaggatttgtatctgtttagttcattatttgtctagctataagtagtaaatattgtttgcatctatcagtgaatgagcatcttctgtttatgtagataatactgaactgttttgttttcttcaaagtaatcattaagctgaaggtaagaaaaacaagttcaaggaagtcacaccatggggaaaaaaaagtcaagtttagggctgcctcttccgggaagtgtcaaatctttagtatatttaggaataaaggtgccaaaccttatggttctttggatattgctaaggtattttcattggttagattaccagtttcattttccttattgactcaagagggctttaaactgagattgaagaagtaagaagattcctagataaaaccataaggaatggaaaaacaaaaatgataatacttgtccacaggaagtatataatcaaatgaaaagaactcaaataacaatctgtaatctatagcagagtaaagcggaagttgtaatagtgttgggggatgggggaagtcagaagaaccaccagtgaatataaaaggagaagagaatcagagccatctgctaataaaatgggtagtcagctctttttgttttttttgtcttgttttgttttgagacagtctcgctctgtcgcccatgctggagtgcaattgcgtgatctcagctaactgcactttccgcctcctgggttcaagtgagtctcctacctcagtctccccagtagctaggattgcaggcacatgctaccacacctggttaatttttgtatttttagtagagacggggtttcacgatgttggccaggctggctggtctcgaactcctgacctcgtggaacgcccacctcggcctcccagagtgctgggattacaggcatgagccaccacgcctagccccggtagtcagctcttactgagaatattcaaagacagggcattcattttgtaagagacattccttccttcataggaagattggacctggtcttttagttcctcccaattttgagattctgtgagattgaatcggggcagagaaacatacttaatcttgaaagattaagtagaatttagatggatggataggagaaggactttccctacctttttacttcttgagatatagttatttgtaggtataatatacataaatatatgtattttttctctgtttacagacattcatagtttaataaaaaacttctttgtattatataaaggtttagatcagaactagtaaaacagaatgctgtttctttttttttcttttctattttactttaggttctgtgggtagatgtgcgggtttgttacatgggtaaattgcatgttgctgaggcttggtgtacgaatgatcctgtcactcaggtagtgagcatagtacctgataggtagcccttcaagccatacctccctttctttccaaccctcaaacagtccccagtctctgttcttcccatctttgtgtccatgttgaaatgctgttcttactacatttttttgaaggacatcaaaagagagtttgattatatcagaagcccccaaaagaagagagctactcagtggaatcaaggcatagtaaaatatagttgatccttgatatttgcaaaggataccaccatagcatagaatttgcttcatttccttttaaaacagaaatgtcattttactcctattgttatgtgttaaataagaaccttaataccagttgagatggaagtggtagacaaagcttactagctctgataacctcctacttatcagctccaaagcatgttttaagcctttggctcagcaaaatgacatgtctctccatataagcaagagtgcttttttttttttctttgagacggagtcttgctctgtcaccaggctggagtgcagtggcgcgatctccgctcactgcaacctctgcctcctgggttcaagcgattctcctacctcagcctcctgagtagctgggactacaagagcacactaccacgcctggccaagagtgcttttaaatagttcattgtcaatgttaaatccttgagtgctcatttccttatttacctggctgttttctattcatctttcatgtctcaatttaaatgtcatgtttctttggtctcagagtaataaaaagtaaatatacttcccccatctcccgccccgcagagccttcctctgttgcccaggctggagtacagtggctcgatcttggctcactgaaagctctgcctcccagattcaagcgattctcctgcctcagcctcctgagtagctgggattacaggcgcgcgccaccaagcccggctaatttttgtatttttagtagagacagggtttcaccatgttggtcaggctggtcgaactcctgaccttgtgatcctcccaccttggcctcccaaagtgctgggattacaggcgtgagccactgcgtccagtgtaaattatacttttattttaatcctgctactactgcaagcaaggcaaacatttttgtgttacagcattacttgtatagattttaagaaaatctcattttaaatacggaaatgttaagaaaaattattgtgcctttgaccagaatgtgcctctaattgtacagttaaatctaactataaatactgcagtataaaataattatatacacattttttcacacctctttctctctatatatgcatatatacatatacatatatatacctatatgtattttttttacagacagtgatgtgtgttctgaaattgtgaaccatgagtctagtacttaatgatctgcttatctgctgccgtcaactagaacatgatagagctacagaacgaaaggtagtaaattacttaaattcaatttttccttgaaataagtgtgattagtaacccattattatttcctttttattttcagaaagaagttgagaaatttaagcgcctgattcgagatcctgaaacaattaaacatctagatcggcattcagattccaaacaaggaaaatatttgaattgggatgctgtttttaggtattctattcaaatttattttactgtctttatttttctctttcatatttatttctgttgtgatattacttttgtgtgtaagtcttaacatttatctttgcttcctatatatcattatgccttgcatatgaatttggcatttaatatttatccaaaacataatttttaaaggttgttcatatagaaacttaaaaattataaattatttcttcaataaaatgttttagacatatctcactcaaaattgagagagaatttctttcattttagttagttcacaagacttcagattagaggaaaaaattataataaatgttaggatattattttcacacctttaaatattactctgattataagtaaatgctgtgtgttaaattgtaataaaacaagtaaaaggaagattggaatacttgtgtatgaatttggttaaaaacaaaaaatacctcgaacaatgaaaaaacacaactgattgctggacaggagtggcaaacagggttgatgcatttttacattgagacatcattttcaaccgtgaaatccatttataactagaaacagattgtaaggattaggaaagatgaataaagtattttaaatactgagagtattaaataaactagaaataacatttgtagtcaagaggaagtgtgtatttagttgtccttcagtgtttatgacagattctgttttatttttagctcctgtttggtattagattgactgttacagatttgaaagcatataaaatgaaacatgcatgctgtttttcctctgattttctagtttattttaaataccacaaatataattacaacctgaagatgaatactattttgtataagctgatctggtaggtcaaatatgcacccagcattcctggctagttatgaatatcttctaggcaggcttaatttattggctggcaacattaccaactgcctaagaaacaggtagatcctgtacagaataacagaaggagttgagagaggattgagagggtccttactagcattgtaagcttttaatgacaaatttagaaaacaggcagtaaagcaatagaaagtcatagaagattaagagctttgcagaccagatattaaattggtcttgtaggagttaggccttgaaagagagatttaattgttttatttgtttttttcagctgatgtagtaatctaagcaaggtggtttaaaagttgctctttgtgatggcatgaacagcttttgaaattattataatttaagtattcaacgagtttctgaaattgcattttgttttcttgaagatttttacagaaatatattcagaaagaaacagaatgtctgagaatagcaaaaccaaatgtatcagcctcaacacaagcctccaggcagaaaaagatgcaggaaatcagtagtttggtcaaatacttcatcaaatgtgcaaacagaagtaagtgatgttataaattataaataaatggcttaacagattactgtcgcgtgagttttttttttttttcagatcattttaaggacttaactgttgcataagtttgttctaaatagaataagataaaagttgagtgtaagtacatataatgatttttatttttattaaaaggtttttttttagggctagtcaagtgaagcagtgggagtttagaaggaacaaagaaatctgtaactggttgtgatcaattcgttgtaaacaccactgcactcaggccagcctgatttttaatattacaagttcaaatatttggggaaatttatgcaagcatagaatgacagaaatctgaggattgaagggatttatttatttaagagatagggtgtcactctgtcacccaggctggagtgcaatggtgtgatgatagctcactgcaggctgaagcttctctgttcctaagtgatcctcctgtcttggcttcctagtagctaggactacagaagtgcatcaccatgccaggctgatttttttttttttttttaagaggtgttatttcactgttctgcccaggctgatcttgaactcctggcctcaagcagtcctccccctgctcagcctccctagttattggtattacagatgtgagccaccatgcccagtgaaggaattaaaaattactgtttaaactacccagtcttggatgccctctctacgtccctagcctttaggtagaagtgcagtcttcatgattgaatatactttcaaggctttcttttccatctttgaatagcattaacagtattaaaaactggccaggcgcagtggctcattcctgtaatcccagcactttgggaggccaaggcaggcagatcacctgaggtcaggagatcgagaccagcctgaccaacatggcaaaaccccgtctctactaaaaatacaaaaattaattgggcattgtggcgcacgcttgtaattccagctacttgggaggctgaggcactagaattgcttgaacccaggaggcagaggttgtggtgagctgagattacgccactacactccatcctgggcgacagagcgagactgtcaaaaaaagaaaagtattaaaaacctgtcttttgttactgcttctcccttctgagagtatatcaaaaactcctatttatgtttttagtgtgacatccttagagatgtttgaaagtagccacaatatttcctaagtcctcatctctaaagttcataatctcactttcttcagctcacgtgacctaggttttatgctactctcctctgaatattcttcactttaattgtctgtcttaaagtgtgggcctctacttacagggaagaggccagaaaaacaaacaaaaaagtgtgggactcattttttttaatacaggctcttgctctgtagcccaggctggagtgcatgcagtggtgcaatcttggctcactgcagcctccgcctcccaggctcaggtgatcctcctgcctcagcctcccaagtagctgggactataggcatgggccaccatgtctggctaatttttgtatttttaatagagacagggtttcactgtgttggccaggctagtctcaaactcctgacctcaagtgattttcccgccttggcctcctgaaatgctgggattacaagcgtgagccactgcacctggccaggactcaatcttttaggtatattctgattagtacagagtgaagcaattcttgcttatctttcattctgtactcttactgattaattctaagatcatgtgagcttccttggctgtcagaaccaacacttaactgacattttacttgctatgatttgaggaaaaaaacaacccccaaaaatatttttttctcctgatgagccaaatagttcccatctttaacttgtacaattaatattgtgaagagttgatttttcggaaccaaaatgcaggatcctggcaagcttttgtaaggaaatgggctttacacatactgaaaagctagaggcagaagtgtgtgttcagggactcctgggctcttcacagataaggatgttgctttgtgataccaactcttaatttaagaatcaggagtgtgaggcgcggttgctcacacctgtaatcccagcactttgggaagctgaggcgggcagatcacctgaggtcaggagttcgagaccagcctggccaatatagcgaaaccccatctctactaaaagtacaaaaaatagctgggtgtggtggcgggtgcctgtaatcccagcttctcgagaagctgaggcaggagaattgcttgaacctggaaggtggaggttgcagtgagctgagattgtgccattgcactccagcctgggcaacaagagtgaaactctgtctcaaaaaaaaaaaaaaaaaaaaaaagaatcaggaaagcccccaaattggtaaatatttagtagaagtatgcagattattagtgaatatttcagattggtggtatgagacttgagtccaaagaataatggtttagtcaattttctacctcctctgagatgcgagttcgtgtggatagcttcaaccccttgtcagagactccagcagagacaaaggaaaactacaccaaaatattctgcactcacttttgctctgtgtagtagctttgtatccagtaaaatattttatttgctaataatgctgggatatagtaggtacttactgaaagagtgaatgagagaaagataacatgtcaattttgtagcccaccagaaaagtttgcaatgtgtacagtagttttgccttgcagtgaacaaaccttttaattgcaacattaacaatggagattacgtttgaaaatgcatcagcctgttggtttataagaaatagttggtgaaattatcaatgctggtcatgtaagtagttgaaaatttgtttttttatttacggcttccttttctttcaaatttgactttgttacttaaacctttttaatattggggcaaaaccagggagttactattccctcaccccacttcagttgtttttgtttgtttgtttgtttgttttttacgaaaagattggagggttgatggaaatttaacatatgtctaaactttgccattcttgcttagcattggtatccaaggtatgatgaaagaaatagagattagtaaaaaagaagtaaaaggcagctgagaagaaacaagtaagcaaatattgttgatttctctccttttttttttttttttttttttttttttttgagacagagtcttgctttgttgcctaagctggagtgcagtggtgcagtcttggctcactgcagcctcttcttcctgggcgcaagcgattctcacgtgtcagcctctagagtagctgggactataggcacacgccgccaggcccggttaatttttgtatttttagtagagacgagggttttgccatgttggccaggctggtctcaaactcctggcctcaagtgatctgcctgcctctgccttccaatatgctgggattataggtgtgagccaccacactcacacacccagcctactgttcatttcttttctttttttttttttgagacagagttttgctcttgttgctcaggctagagtgcaatggcgccatcttggctcactgcaacctccgcctcccgggctcaagcgattctcccgcctcagcttcccaagtaactgggattacaggcatgccccaccatgcccagctaattttgtatttttagtagagacggggtttcaccacattggtcaggcttgtctcgaactcctgacctcaagtgatccacctgccttgtcatcccaaactgctgggtttataggcgtgagccactgtgcccaccctgttcatttctttatgttagcatttgtctgcttttgtacaaagcttaaatagagtctagatagtgcaaaactcagctgcgaaaaatgttaagttccataagattcctgaaagtctctgtaagtaggctgggcacagtggctcatgcctctctaatcctagtactttgtgaggccaaggcaggcagattgcttgagcacaggattttgagaccagcctgggtaacatggtgagacctcatctctacaaaaacacaaaaattagccaggtgtggtggtgaccacctgtagtcccagctacttaggaggcttagggaggaagattgcttgagcccagggggcagtggttgcagtgagccacgatcatgctattgcactccagtctgggtgacagagtgagatcctgtgtccaaaaaaaaaaaaaaaaaaaaagtctctgcaggcaacttagttgtacttttaagaaagatttgatcccagaagtttgagaccaacctgggcaacatagggagaccccatctttaaaaaaactaaaaaaattagctgagtgtagtggtgcttgcctgtagtcctagctacctgggaggctgacatgggtagatcccttaagtccaggaggtcaaggctgcagtgagtcataatggggccactgcactccagcttgggtgacagagcgagatattctgtctcaaaaacaagcaaaactatgaaaaaaaagtcaacatttcttgaaatacttctcatatttggtagaggagggagatatattgggataaaggacataggaagataggattttattataatattaatttctgtagttattcaacacaaattaatttttattgagcatttgctattagggcagtcactgggcttttacgtcagaatatagagattaattcctttccttaaggatctaatcatacaatggatgttttagattagaaaaatgttacaaggactataagagaaatgcacagggtactagaaaaaaggatcacatggttgtgcatttcataactggacaatgcctaaaattatgaagtgagccataagtgaagatgattttgcagttatatcagtgtatatttgtttaccatagcctgtgaatataactagtttcatcataggaaaaccctaatccagaatatattcatatttacatgagttgtgttctgctcatagttatggcaataaatatattcaattttaagattgtcagtatggaaaaatggcatttctgctgtgacgtaaatataatttactgaaaatgataattaaattatttttaaatgtaattttgttaccttcaagaatatgtgtgtagtcatgccaagttttcagaatctctagtaagtaaataacatgctgttaaaaatgacacaggtacaggggtcaagcacagtggctcatacctatagtctcagcactttgggaggccaagacaggagaatcccttgagctcaggagttcaagaccagcctggggaacattgtgagagattctgtctctatgaaaaatttaaaaaattagctgggcatggtggcacaacatctatagtcccagttgctcaggaggctaaggtgggaggatcccttgagcctgagaggttgaggctgctgttgggtgtgatcatgccactgcacaccagcctgggtgatagagcgagaccctgtcttaaaaaaaaaaattacaacctgaggtgtttgtatgccataaatgctattataggacttagaactaattttgctttccaaggtaaatattctccttgtaatcttatgttattctaataaattcattcttcataaagagtgccaaaaaacttgggatcatttttggtctaacaccagaaattgtgaattattaaggttataattgtttaagaatgattgcttttcgagatgagcagatcacttgaggtcaggagttcaagaccagcctggtcaacatggtgaaaccctgtctctactaaaagtagaaaaattagcagggtgtggtggtgcacgcctctagtctcagctacttggaggctgaggtgggagaattacttgaacccaggaggtggaggctgcagtgtgctgagtttgtgccactgcactccagcctgggtgacagaccaagattccatctcaaaaaaaaaaaaaaaagaatgattgtttttgctatatattcctataaaagaggcgttggcaaacttactgtgtaaagaggccagatagtaaatgttcttgactttataggccatgtggtcacctctgtcttaattacaaaagcagccataaacaataagtaaatgaatggttgtgactatgttccaataaaatgttatttgcaaagaaaaaaaaaatgaattttgcttggggccataatttgccaatttcttctctacaaaagaagtttagttaatagtaatttcccaaatggaattatttaaatagttgccattccaagtgtcttatttttgttcaaatttatgtttttctttatttgtttattttgaaataggagcacctaggctaaaatgtcaagaactcttaaattatatcatggatacagtgaaagattcatctaatggtgctatttacggagctgattgtagcaacatactactcaaagacattctttctgtgagaaaatactggtgtgaaatatctcagcaacagtggttaggtatgttttgaaggttgttgtttgtgaatttttcctcatgaaatgaaacttcaccaaagaaagcactctgtctgtatctgtctatatcccccaagtgacctgacagtttaacagtactttagtaaaattatatggttatcgaactgacccttaatttttatttattatgtagcttttgaataaagtcatgaataatatatcaggtgcctgatatcagagccggaattacagttgaaaaataccatctccatcgtcaaggagttgacagtggcagaagaaaacccaagtaaaccagagttcataatgtgctgtgatacagacatatttgggttcagtaggtatacaaaacaatgacacctaaactcaaccatgatttaagtagaaagggagaaaaccaagagagggaagtaccataaaagtgaaagcaggcagggtgcagtggctcacgcctgtaatcctagcactttgggaggccaaggccggtggattgcttgagctcaggagttcaagaccagcctgggcaacatggtgaaactctgtctttaaaaaaatagcggaggtaatggctcttgcttgtagtcccagttacttgggaggctgaggcaggaggatcacctgagccctggaggttaaggctgcagtgagctgtgatcacactgcactccggcctccatgacagagtgagaccctgtttccatttaaaaaaaaaaaaaaaagtgaaagcaagagagttgaaagttcaaaggggcgtggccaacattttaagtgttgtagaaaggataagacacaaaagtatccattggatgaggcagttagcacgctacttctaaggtaatggaaatcaaatatattagaatagaatgcattagaagacaatgtacagaacccagtgattcattagatgtgtagagtgtgtgctagggaggaatctggtgttgtttcctgtttatagctgggaggtactgagagaccacaaaggaaggaagttatggtcagagattgaaatacttcagtttgttggtttcaaagatggagcatttctgggtttgagaataagtgaaagtaggatttgacattaacaagatgattttaagtcaggtgtcaaagtcttctaatacacgaactctaaaagtttagaagcttttttttttcatggaaagtatttaagctaaattttgctagctaaattaaaagacatttgtccatattctttattgccattttattatttcaaaatgagatacatgtgaaccacaaaactactacctaatcagtaccctcactcctgcattacactctactgttcccctgagaataaatgccttctcagctaatttcttaggagtcatttgtagcctttacgttactctgaacacaagataggctgtgtctgtaacagggccctcaacaagcctagagacagcctttgggaataggctggtgatatctaggttacctaaccagatctttccccagtatggctggtcatatttaggtcattttacattatcacttacaaccatggctgtcactgaaacaaaggcagtctttcccctagtctgcttactatattctgtcatctagtttgttctctgaaaccccctttttatttttaaactaactactcttacttctttttttttcttttttctttttatttaagctaacctttgccacttcttcccggatgttacttcttataattagcttttttgtcaaagtatttttttacttagcttccttttaaaacttgcttagatgaggactctgtggaagaagcgaagtctgtgctcaaaatatatatttggtacaggtggtgactgaagccatgactatggatgagatttgtatatagagtttagtgtgagatgagaagaatggcctaagattgagtcagcatttgcatataaattttggaatcagcttactgatttctacaaaagatcttgctgggattttgatactaattgcattgaatctgttgcacaatttgagaagaatagaaatcttaacaatgtggagttttccaatccatgaacactgtatatctctccatttacttaggtttttttttttttttttttttttttgcttctttgtttgtttttttgagacagagtctccctctgttgcccaggctggagtgcagtggcacgatctcacctcactgcaacctccacctcctaggttcaagcgattctcctgcctcagcctcctgagtagctgggattacaggcatgtgccaccacacccagctaatttttgtatttttagtagagacagggtttcctcatgttggccaggctggtctcgaattcctgacctcaggtgatccacctgcctcagcctcccaaagtgctgggtttatagacttgagccaccgcgtctggccacttgtcttttttgatttctttcattagtgttttataattgtcagcatatagattttttgttgtaaattgacaattttttttctttaattttatatattaaaaaaaatagagacaggatctcactgtgttgcctaggctggtctcaaactcctgggctcaagtgatacccttcccttgacctcccaaagtgttgggattataggcatgagccaacatgcccagctgcaaattgacatttatttataattgtataaacataaagattttgtatatgttttgttagatttatactgcagtagtttgtaattgcattgtttttaacattttgattttcaaattgttcaatgcacaaaaattatacagaagtccagttaatttttgtatagtgaccttgtattttgggaccttgctaaaatcacttactaaatctagtagctttctttgaatgttcttttggattttctttgtagacaaacatgtcttctgtaagcagtaatttttttttctttctttctgagccatgtggcttttattttatttttgtgctttattacattggctaggacctccagtgtgatttattgtggtaaaatatatataacatttataattttaacttttttaagtgtacagttgtgtagtattaagtgcattcatattgttgtgtaatcatctccaccatccatctccagaacttttttttctatactcagtaaacaatgatttaccattttcccctcccctatcccctggcagctaccattctactttctctctctatgaatttggctatttggggtacttcatttttatggattgaatgttgtgtcccaccaattatgttgaaatctaactcccaaagggatggtatttggaggtgtgggatttaggaggtaattaggtcctgtgggtccagccttcatggatgggattaatgcccttatgaaaagaggccagagagctaacttgctgtctttctgccatgtgaagatacagttcaaagtcagtagtctgcagccccaaagagggccctcaccagaaacccacaatgctggcacctgagctgctttcagcctccaaaattgagagaaataaatttctgtggtttctaagccacctaacctataatactttgttatagcagcctgaagtagaggactcctataagtatttgtccttttgcaacctgcttattacacttaccaaaatgtctttgaggctcatcagtgttacagcttttgtcagaatttcacccttattaaaaactgaacactattctgttctgtgtatatgccacattttgttaattcattcgtccattggtggacatgggttgtttctaccttctgattattgtgaataatgctgccgtgaacatgagtatacatctcctgagtttcctgctttcagtcttttgattatatacccagaagtagaattgctagatcatgtggtaattctatatttaattttttaaggaaccaacatcctgttttacacaggagctacgccattttacattctcaccagcagcccacaagggttccagtttctctacattctcactagcacaactaatagaaaatgaggattcctcttctaggccttgaaagtgctgcataattttgcttcttcctacctgtctaacttaactaaagcgcttctaatttctgtgctcaagctacactgtcaattattcagtttctcaaacctagtggtttccatttttttaaattgacttttatcttttagaggaattttaaatttacagcaaaacggagtggaaagtccactggacacacacagcatgccctactgtcaacatcttgcaccagtggtacatttgttaccatcagtaaacctatgctgggacacatcattattatccagagtccaaggttcacttttggtggtacatatgctatggattttgacaagtgttttgacatttttaaagatctttttctgtatctaatgagatggtcatatttttttttcctctgggagagaatggtaacaatttttcactattacagaatcatacagaatactttcactgtcagaaaaatcctctgtgcttcaccttttcatctcttccttcttgtaaactgtgggaaccatggatctttttgctatctccatggtttagccttttccagcatgtcatatacagttgtgcgtctcttaacaatgtggatatgttctgagaaatacatcattaggcaatttctttgttgcgtgaacgtcatagggtgtatttatacaaacttagatggtataacactacgcacctaagctatatggtattactgctcctgcactacaaacctgtgcagcatgttactatactgaatactgtaggcagctgtaacacaatggcaagtatttgtgtctctaaacatatataaacatagaggaggtacagtaaaagtatagtataaaggataaaacatggtacacctgtctagggcacttaaccatgaatggagcttgcaggactggaagttgctctgggtatgtaaatgtgtggtaatgtaaaggcctgggatactatatactactgtagaatttgtaaactcttattctgtaccaaatttaaaaatttatgtttttctttcttcaatactaaagtaacattagctactataacttttttactttataaactttaaaaatgtttaaactttttgactcttttgtaataacacttagcttaaaatacaaatgcattgtacagctgtacaaaaatattttttccttatatacttatagatgttttttcttttgttctataagctttttaaatgaaattattattactctattttttcctttaaacttttttgttgaaaacaaagacacaaacacacacatgagcttaggcctacataaggtcaggatcatcagtatcactgtcttctgtccctgcatcttgtccccctgggagatcttcagggacatgcacagagctttcatctcctatgataatggtgctttattctgaaatacctcctaaaggacctacctgagactgttttactgttttgttttgttttgttttttaagaagaagaaggaggaatatagtataaaatggtgataaaaagcatagtagagtaagtacataaacctaacattttaccagtaacttagtcatttattatcattatcaaggtttatgtactatacatgattgtatgtattatacttttatatgactggcagtgcagtgggttttttttacacaagtatcaccacaaatgcttgtgagtaatttcttgtgctatgacatcactaagtatttaaataggaatttttcagttctgatacaatcttacggtaccaccttttcatattgccatttgtcattgaatagaatgttgttatgtagtatgtgactgtggttggaatcataacagtatgtatcattttcagattgccttctttcatttagtaatatgcatttaaggttcctccatgtctttctctttctttctttctgtctttctttctttctttttttttttttttttttttttttgagatagggcctcactctgtcacccaggctggagtgtggtggtgagatcatggctctgcagcttcgacctcctgagctcaaatgatcctcccacccccttccaagtagctgtgaccacagacacaagccatcacaccctgctaatttttcatttttagtagagataaggtcttattatgttgcttatgccagcagcttgaactcagcctcccaaagtgttgggattacaggtgtgaaccaccgttctcagctcctcgatgtctttttatggcttgataggctgaagtgggaggatcacttgagcccaggagtccaaatctagcctgggcagtgtagtgagacttccgtctcttaaaaaaacaaaaaacaaaaaaaagaggaccaaagttactgatattagaaatgaaatgagatctaattgcagatcctatagatattcaaaggataataaggaaacactatgaacatctattaatttaaatgggccagttcctcaaaaccatacattatcaaaagtcatccaatataaaatagataatttgactagtcccataactattaggagaataaattgaatccataatttaaagcctttcataagacaaattgggaacaagataaggatgtgcactctcaccactccttttcaacattatgttggaggttctagccagggtagttagacaagaaaaataaaaggcatacagattggaaaggaagaaataacactcccctttgtagatgacatgattgtctatatataaagtcccaatatacacaagtataacattgtgaataatgttatttggggactgggcacagtggcttacacctgtcatctcagcactttcggaggctgaggcaggtggatcatctaaggtcagatgatggcttcctctaaaacaggacagatttacttgtagcctattgattataaaaagcttgaggtttctctgttataactcagtccactgttttcgcagtgtcaagtgtcccatttcaccttgcctttggtactggggaactgatgcaaaaatgaaggtagtctggctaccatcattactgggagaaataaactgtcctttttctcttatcaggaatctcaggtttcctgctagcacccaggaaactgtcatgctaatttgttaggttacaagtagataaaatctcagccaggcacagtggcttatgcgtgtaatcctagcactttgggaggccaaagcaggtggatcacttgagcccaggagttcaagaccagcctgggcaacatggtgaaatcctgtctctacctaaaataccaatcagttgggtgtggtggtgtgggcctctagacccagctacttgggaggctaaggtgggaggattacctgagtctgctgagattgaagctacagtgagccgtgatcttaccaccacacaccagtttgggtgacagagtaagactctacctcaaataaataagaaacaaaccaagcagagtaaaatttcatacccttcataggtctcaacacattttttgcatattattaatcaaacagtattattattttaaaaaactgtggaggccaggcccagtggctcatgcccataatcccagcactttgggagaccaaggtgggtagatcacttgaggccaggagtttgagaccagcctgaccaacacggtgaaaccccatctttactaacagtacaaaaattagccaggcatggttttgtgcgcctgtggtcccagctacttgggagactgaggcatgagaatcacttgaacccaggaggcagaggttgcagtgagccaagattgcaccattgcactccagcctggacgacagagcaagattctgtctcaaaaaacagaagaaagaaaaacccatggagcatgtactgtaagtgctttcttaggcctagatgatggaacagaggcttagagaagttaagtaatgtttctgcgacctggctcttaaactggtgctctcacagcagtttatagttattcctgtcttaaaggcattttatataagataaaattaaatactgatggagtacttttactatgttaaaaataaattagtgcagttttaaaatcctttttctgtatgggattatggaatatttaagttaaattgtaacatttaatacattttgatttttaaaaaatcatgactaataatttttttttttttttaagaattgttctctgtgtacttcaggctctatctgaaaccttcacaagatgttcatagagttttagtggctagaataattcatgctgttaccaaaggatgctgttctcagactgacggattaaattccaaatttttggactttttttccaaggctattcagtgtgcgaggtaatctaatctctttttcttttgttttgtattgaaatacttttgatcttgcaagaccatgttttagactcagtaactaaaaattctaccttaaaataaaacattgatccatcataacagaactagtggattcctaaagagacaaccaagtccaacactttctgaatatccaatatgcagaacactacgtgaagttttcaagggggagatgtgtcttgctgatgttctgttgaccaggaaagttaaatatcctctaagtcattgcatttcccccattttgaggatggttttaatataccgagaataaaataaaataggaaaatattttggaagtattactgttgtacattagtatggcagtactcaatgtataatgtgaaacattttataaatggtgttacaaatcagttttgtttatttttatacaatgttttagcaggagggagagctaacagaagtggtctcttaacaccaaataagaactaattttttgtcagtgtgaagtaatgctgtgatttttttttttaatgaatagttttgaaattaagactactgtttgaaaattagggttttgtttttttttctttcagcataccacttcataactgttcagtttgtacagtttgttccccctgttatacccagttgagcttgtttgtttcttcacagacaagaaaagagctcttcaggtctaaatcatatcttagcagctcttactatcttcctcaagactttggctgtcaactttcgaattcgagtgtgtgaattaggagatgaaattcttcccactttgctttatatttggactcaacataggcttaatgattctttaaaagaagtcattattgaattatttcaactgcaaatttatatccatcatccgaaaggagccaaaacccaagaaaaaggtataaaggaaatgtttactgttttgaatttgcttcttcattcaaacatagaagtctaagtataaaattagtgttctttaggaggatatgactttcctctggatttctctggttgataatgttacttagccatgagaatgtttttcatagagtttttagaatttgaagcagtggtagcagattctgttatgcctttctatttgttcaatacaatattaggtattatgggaaatacaaaaaaatctgagacattgttccctctaggagctacttatgcatcaatacttagatactaaggggtctgacacagactgtagggcaaaagaatttaaagaaagcaggatcttgtttatccacctattacttttattagaagataaaatacgtaaattggactaaaaccagtcagattattcagctcctgaggaagatacatacatattactttaataggaatttgaggcagaaacagggaaattgctgccttaagcctcatagttactctagggccctgtttgccctagagtatcacttgttaaggagaatcacttattctccttaattccttcatatatgtcctataccaagagagtattgcccagaaggtatagtgcttttctgtagttaggaactttattggctggaactggagtttcctcttgctctgtctatgattgcctttgggcttatactagcctttggaccaactcatcatggctagtatagtgactttcttaaaacagcataccacattgagtaatagcagctataatggaggaaatgtcttgtagccactttttttttttttttttttttgagacagagtctcactctgtcgcccaggctgaagtgcagtgacgcaatgttagctcactgcaacctccgcctcctgggttcaagcaattctcctgcctcagcgttctgattagctgggattacagatgcctggcaccatgcccagctaatttttgtattttaatagggatggggtctcaccatgttggccaagctggccttgagctcctgacctcaaaccatccacccgcctcagcctcccaaagtgctgagattacaggcatgagccactgtgcccggccgtgtagccactttttatcaaaagtagctgtgtatttgttttatgggctcttctaataagtatatctagataatatgtagcccatgaaactactataagtgaaagaatagtgacttttaatagtttttcatcttttactcacctcttatctccaggatgaagatcaggcttattaggaggtgatatgatatgtttagggatttagttaactgcatatttagggtgaatttaaaattggcaggatgatgaggatgccagaaaagctaatgtagtttcagactactttaatagattttgtagtaccttgtttgtgagaaataatagaccttttgtttcgcatactagtcaagccacagttggattaccatgttcaccagattttgtatagtcagcattttaagttgactggaatgtgtcttgggaaagatgactgaaatggtgagaagtctgaataatatgtcatttttacactagttgaaggaactcgtaatatttttctcttaggccagaaaaaggcatacggagaacttggtcctcatatgaaagagggaacatattaattgtatttgcctcaggtgggagaataaattggagaaagacagattttaggtcagaatatggaagaaatttataagaaacacagttatctaaatgtaaaatggacagttatgaaatagagtttgtcaaggatcttgtcagaagaggcattagtactgaatggaaggttggaccaggtgtcttctaacgctgatgcagcttgacagctgaataattttgtgggagctagcagtgtaaacagagtacatacataaaaattacattttaattttttggattacaggtgcttatgaatcaacaaaatggagaagtattttatacaacttatatgatctgctagtgaatgagataagtcatataggaagtagaggaaagtattcttcaggatttcgtaatattgccgtcaaagaaaatttgattgaattgatggcagatatctgtcaccaggtacagtaagtaggtcatgtcacatttagaaatttcctgttaattttttttttaaactgggcattttgggcttttaaaacctgtgttctcacaaaaagcctataaaatgactctgtacatgcaactattcctttcaaactatcagaaatatttggaattacccttttaacttaaaagttaatgcttttgcagatatttgaaaactaacaatgaactttttcattcttaaatgattgtctctaggaaataaggtgaccctaaccctaatgattcgattcgactcgactgtattctacaaagtgctgggattacaggcatgagccaccaagcccagtctgtttcttttttgcaattaagctagagttcacatagcataaaattcacgattttgagttgtacatttcagtggtttttagtatttttactatgttgtacaaccatcatcactaattctggaaactttttttattttatttttatttttttgagatggagtcttgctctgtcacccaggctggagtgcagtggcacaatctccgctcactgcaacctccctttcccgggttcaagtgattctcctgcatcagcctcccgagtagctgggactacaggtgcctgccaccacgcccagctaatttttgtttttttagtagagactgggtttcaccatattggccagcctagtctcagactcctgaccttgtgatcctcctgcatcggcctcccatagtgctgggattacaggcgtgagccaccgtgcccagcccagaacttttttatcatcccaaaagaaacctcatcccttcttagcattcagtcccaattccctgcatctcctagatcctggcaaccagccactaatcaatcttggtttttgtggattttcctgtttgggacagttcgtttaaatggaatcatacaatatgtgagtcttttgtgtctggtttctttcactaagcataatgttttcaaagttcatgttttaccatgaatcagtacttcattcatttttattgctgaataatattcagttgtatggatatactccattttacttacccatccatcacctgatggcctaatgtttcttaaataaaactctgttccccagagatttggttaacatcctgagtagtaatttcactctgtcaaatattttcttaatatttcttaaaatttcttaaatttaaaaacttgaatccctttgaaagtaaaggtttttgctttacttttagatttcttagtgcttttagtaaatgttcccaggaaataaaactaatgcattacttggtaatacctgctttctaaagtgccattactgtcatgcaaaatgtttgtttcttactatgttatcagatttatatgtttctgtaatgtattactcttgctttatgagttccctgtatcttcatttcagaaagaattttttttccccctaatgaaatattagaagacaatagcaatgaaaaaagtgtatttggccaggcgtggtggctcacacctgtaatcccagcactttgggaggccaaggcgggcagatcacctgaggttgggagttcaagaccagtctgaccaacatggagaaactctgtccctactaaaaatacaaagttagctgggcatggtggtgcaagcctgtaatcccagctactcgggaggctgaggcaggagaatcacttgaacctgggaggtagaggttgtggtgatacgagatcgtgctgttccactccaacctgggcaacaacagcgaaactctggctcaaaaaaaaaaaaaagaaaaaagtggatttatttttattttacaggtttttaatgaagataccagatccttggagatttctcaatcttacactactacacaaagagaatctagtgattacagtgtcccttgcaaaaggaagaaaatagaactaggctgggaagtaataaaagatcaccttcagaagtcacagaatgattttgatcttgtgccttggtaaagtgttaccattttctcattcagtgtcattttaatctcttgtatgttatttttcagaaaactttcagtggaatcctttcatctcaaccagaactaagtcatttgtctacccccaaacctattactagcaaagggatatgtgattgccatgacaaatgagatcaatcattaatggctcatttgcttgggccaagtgcagggccacctattttaatcatattgtcatagcaagttaagaaggaggactggctctctgataggcaattagaagtgtgcacctcatggaattcactgaattgtacgcttcaacaatagattttagcatacgtagcaccttctaatagaattaggaagaagttaaagataatcttaagaaatcacagaataattttgaccttatgccatgataaaaagttattttctcttattttctatcttctttattctcatgtaacgttcacatatatttaagtaatcaaataaattatggatactttggaatcccaaaatattagatctggtaaggatgtttagaatttatctagttcagcctgtttgctttactgaaaagaaactgaaacccagagaggttaagcaacttctgtagggacagagatttatagattatagtcaaactcgtgatcagtgctcttttgattaccatgttgatggaatgtttaagtgtaagtgacttctggggaaaagcatattgatttagatacctattgcttaagctcatttttatatagttaagagtagctatttaagattcttaatttgtccttttagtcaagagtaatttattgaacacctgttatgggctaagcgttagatatacagagatgaataacataagactcctattcttaagtatcacacattctagagaatacacagcaaatgtttattggattaactgaattaatgtaaaggaaaaacagttttttgggtttctttgttttcctgttttagaggaatcgtttggtgactaaagagcaaggatgtacaagataactcagaaataaaatattgctaaatatatatatatatatatatatattttctgagacggaggctcactctgtcacccaggctggagtgcagtggcacaatcttggctcactacaacctccacctcccaggttcaagcagttatcctgcctcagcgtcctgagtagctgggattccaggcatgtgccaccatgcccggctaatttttgtatttttagtagagactgggtttcaccatgttggccaggctggtctcaaactcctaacctcgtgatctgcctgccttggcctcccaaagtgctgggaaaccacctggcccaaatattgctaatttaatatcctttaaaatatttgtttaagggaaacttaacagcttacccagctagccaaacgttgacaattttcctgccaatttaggaagtaggacatagtaactattaacagccagtttatttttagagtactatggaaatgatggtgattctctaattaggatattgtaagagtaccatgtctatatatttccttttagtttgttaatgtgatggaatagttttcaaattatcctttttttttttttttaggctacagattgcaacccaattaatatcaaagtatcctgcaagtttacctaactgtgagctgtctccattactgatgatactatctcagcttctaccccaacagcgacatggggaacgtacaccatatgtgttacgatgccttacggaagttgcattgtgtcaagacaagaggtcaaacctagaaagctcacaaaagtcagatttattaaaactctggaataaaatttggtgtattacctttcgtggtataagttctgagcaaatacaagctgaaaactttggcttacttggagccataattcagggtagtttagttgaggttgacagagaattctggaagttatttactgggtcagcctgcagaccttcatggtaagttcagcatgcattatgtctgacttacagataaacacacacagacacacacacactcacatatccctgatcattttcatagtttgttacttcagttaaagatgtcaaattctatttcagatgcttttcttgtttggccgagaagacttaataaatgcataagtgaatttagtttcaaatgttgacaaattattaaagactaatgttaaggaatttcttttttagttaaaaaatttttaattgatctataatagagttatatattatcaaggtacatgtgataatttgacacactcatatgacacactcatgtagggtgatgggatatcagcaccctacgtatcttttcttcatgctaggaacgtttgaattattctcttcttgctgtttggaaatgtacaatagattaatgttaaccgtagtcaccctactgatgtatcggacaccaggtcttattccttctaattgtatacgtgtatccaaaagactttctttaaagaattatgaagagtttaaatttcttttatgtgcaatttatcattatttattaaatagccatgtttaaattgtagtactatgcactgttaataaacgagctattttttaatcaagaatcttcccaaatgtaatcagacttttaacagtttttatgttcatttagtcaccttaactaaatgtatgtgccaggcactgtcctgatagataaagtctttgcccctccaatagcttgcttttcacaattgtcctttgttttgttatagtcctgcagtatgctgtttgactttggcactgaccaccagtatagttccaggaacggtaaaaatgggaatagagcaaaatatgtgtgaagtaaatagaagcttttctttaaaggaatcaataatgaaatggctcttattctatcagttagagggtgacttagaaaatagcacagaagtgcctccaattcttcacaggtaatttaagttcattagcatgctgctgttttttttgtttgttttatcaggctctctccacttatttgatgccagatggctttattttataataataatgcagaatttcccagatctaaccttaattattaaatattatgtttgtttttacagttatctgtgtctttatgcctgattgcttctgaaataaagggttgtctcactgtgagaatatgggggatgtgcatgaaaaatgcacatataattctttgagcatttatgtgttcctttctgattttttaaataagtaagtccatatatttgagtcatgtagatcctggatcctttctcataatgggagtgtcttttgggtaaaagatgttttatgaatgaggtgaggaaacgaggaagacaaaacaggatgtaagcactaggataaaggaatggagtccctcgtccacttaacctttccacagattggtaattggaaccaaatgattggagagcagacctccgaatggatccaattaaagtacttttgctttaattttacaaccttttatttatttcagaaataatgttaaacatgctgtttctaaacagtattggaaatgataataacaatggttgtcctccttaaattgtccttttagatattaagaaatttagtatagatgaaagcaattttaatctaggatccaaattttagaagtcaagatttatagctaaacatggatgttaaagtttaaagtattctttacatggcttttggtcttctaagtgaagctttttgtttttctttgtagtaattttcctcatcttgtactggagaaaattcttgtgagtctcactatgaaaaactgtaaagctgcaatgaattttttccaaagcgtgccagaatggtatgttatctaataatgctctttatcattttaagctatagctttaattacaaagatgataattttagctgggtagtagctgcatcttaataattgtaaactaaattggtccaaaaaaattgcaactgttagccagggaagaggttgttttaattcagtgattgtaatctatgttatataacattagaccaagcttactattttttaatgctgtatagtataatatgtgacaagtgccaatgagaaaaactgaatggttatgctgggaaattaagaatataaaatttatatgaaataagttcttaaagatgttacccatttctgtacatcaactatgatttgactatttgttagctttaaaaactaatgataattgaaaacaaaaataaatctaaacctgagtttagttgattgactcaagagacttagattgtattgctgtgactgaaaatgactcactggcacaaacattccttatctccctcaagagggcaaaaggatgcgtaactgcttacctataccagatgttaaaggtttttaaacctatgctctttacttcctctgcttggtgaaaaaagggatatgtttgcagacaatgttatgcttaacatttatatctggtgtttttaaaaatactttctgaatttgcctttgagattgtaacttgtattttttctctatctattagtaaaatttgctactgaataatgacatttgatataagtaggtctcaaagtccgaagaagagaagcatttaaaagaataatctattaattatataagtagtctttgaatgatgtagatactaggttaatgttttcctttgtaatatattgctaatacatataaggcaaagcattaggtacttggtttatatattaaagatcttactttcttgaagtgaacaccaccaaaaagataaagaagaactttcattctcagaagtagaagaactatttcttcagacaacttttgacaagatggactttttaaccattgtgagagaatgtggtatagaaaagcaccagtccagtattggcttctctgtccaccagaatctcaaggaatcactggatcgctgtcttctgggattatcagaacagcttctgaataattactcatctgaggtgagattttttaaaaaaagaactaagcttatatatgattcaactttggtaaactgttaggaaggagaaataggggcaggaaaaacagcaaggatggtgggaggcttcattttaaaagcaaagtggcagtaaagggctctaaattggacaacttagcataattaaaggaaaactcaagaataataatttgagtacttcctttgtactggaaattatggtagacataaaataattccttgtgtaggttagtgaggaatagtaagagtttgagcatagggattatatgatgaaaaaaacctctaaatacaaaggagggaaatgttacagtaatagaaaagaacacgatgtaaacaaatctaatagattttggtggcatctgaagagagatgagtgattagtaaagacaataaatggactagcaattattttagacgtcatctaggaatttcctttagcctcaaaatcacgagttctcttcatgtatactattctcttgccaaaacttgcattttttaaaatgtgaaatgtctttctacctatttctgtgtattcagatcatccacatgtgaaaatccttgctaacgcctttcttagaatctcagaaagtaagattctaagaatttttatttttgagacagagcctcgctctgttgcccaggctggagtgcagtgacgtgatcttggctcactgcaacctccgtcttccagttcaagcaattctcctgcctcagtcttccgagtagctgggacaggcgagtgctaccacgcccaggtaatttttgtatttttagtagagatggggttttgctatgttggccaggctggtcttaaactcctgacctcaggtgatggacccgcctcagcatcccgaagtgctaggattacaggcgtgagccacggtgcctggcctaataatttttcatcttttaatttcatagtacttaatgtttcacatttttaatggcagttagcatcttctttataccatggatatttacatatggtttgtatacaaatatctcttgaactataactcttaaacataaactcttaaaagggcatacatgtttttatttatctttatatcctccacagtgccttattacatggtaaatgattaaataaagcctacaatccattcaaaggagtgaattcggtagccagggaaaatgacttgaggacatgagaggggacagtgtgcctctttatgatctttactgacattcttctgcaccacaattgtaaccactttcattacaaagtaatttagttttgtatattttctcctaaaatgccgtttcctaccctgtaggaacaaaaaaaatctgaacattttgtgtgtaacttagcagattcttagtaattctataaaattgtctaaactttttttttttttttttttttgagatggagtcttgctctgttgcccaggctggagtgcagtggcctgatctcggctcattgcaaccttcgcctcctgggttcaagcaattttcctgcctcagcctcctgagtagctgagattataggtgcctgccatcacgccctgctaatatttgtatttttagtagagacaaggtttcaccacgttagccaggttggtctcgaactcctgacctcaggtgatctgcccgcctcggcctcccaaagtgttggggttgtaggcgtgagccaccatgcccggccagctgtcaaaacttgtatctactagaaaaaatgttttatgctattctgtggagtctaaaaagctgaataagtcaaggttcctattcttcagaagcttaaaatgtcattttaatgtctctttatatgactgtaatttctacttgtgttctaagacttacagtcatttatttgcctgtgaagctttttttcttttctttcatccctacctcaaatatttaagggcctatgtgtacagtacaccctccaccctaagatgatatatcctgcttggccatcaggagatacttaggctatttttcttgagaatcctggttataattctacagtgatctcctagttgtttttagagctatccaggatatgccacctttaactcagttaactgaacttttgttttttaatatgtatgtagaatttgttcttacaaaagatagagtatactaaattatttatgaaatatatatatttttatttgtggtttactttaagattacaaattcagaaactcttgtccggtgttcacgtcttttggtgggtgtccttggctgctactgttacatgggtgtaatagctgaagaggaagcatataagtcagaattattccagaaagccaaggtaggagaatttatactaataaagtttcggataaatttgaatgaaatgtattcctgtgaaaattattacatttgtttggaagacattaaattttatgcaggttaaccctttctcttttatttatgtaatgtgagaagaaattatactatgtattttttaaattgttttaattgtttaatttttaattattattatactttaagttctggggtacatgatgtagagcatgcaggtttgttacatagatatacagtgccatggtggtttgctgcacccatcaactcgtcatctgcattaggtacttctcctaatgttatccctcccctagcccccgaccccctgtcaggccctggtgtataatgttcccctccctgtgtccatgtgttctcattgttcagctgccacttatgagtgagaacatgcagtgtttgtttttctgttcttgtgttagtttgctgggaatgatggtttccagcttcatccatgtccctgcaaaggacatgaactcatccttttttatggctgcatagtatatcatggtgtatatgtgccacattatctttatccggtctatcattgatgggcatttgggttgcttccaagtttttgctgttgtgaacagtgctgcaataaacatacgtgtgcatgtgtctttatagtaaaatgatttataatcctttgtgtatatacccagtaatgggattgctgggtcaaatggtatttctagttctagatccttgaggaattgccacactgtcttccacaatgattgaactaatttacactcccaccaacagtgtaaaagcattcctgtttctccacatcctgtccagcatctgttgtttcctgactttttaatgataggctgtaagcatgaaactctttcttatctcttggtagtactctgtcactggtatgatttgcaagaacagagtataagatttgccattttaaaaaattgttaatgagttttgcttatactgtatgactacgtggaacttctaaaaacatttcattttttctcttaagtgcactttattttttattttatagtatgtccaagatcaaagtacactgtaaaaagcaatactaaactataattttaactggaatttgcatttttccttctattcacaatagtctctaatgcaatgtgcaggagaaagtatcactctgtttaaaaataagacaaatgaggaattcagaattggttccttgagaaatatgatgcagctatgtacacgttgcttgagcaactgtaccaaggtaagattttcttcttcttgttttgttttttgagataggatctttctctgtcacccaggctggagtgcagtgggattgtcacaactcattgtagccttgacctcctggtttccagcaattctcctgcctcagcctcccaagtaattgggactacaggcatgtaccacctagctaaaattttctttttacttgaaagtgtagcctatgcagggaattgatcactggttggtgttactgttttggtgtccactcgtaagtttattttttacttttatttttcttttttttgagacagtctctcactctttcacccagagtgagtgatcacatcactgcgatccagcagcctcgacctcctgggctcacagcagcctcgacctcctgggctcaagtgattctcccacctcagcctccttagtagctgggactacaagtgtacaccaccatgcctggctgatttttgtatttttgtaattttttgtattgatggggttttacacattgcccaggctagtctcaaaccctgggctcaagtgatgcttacatctcaaagtgctgtgattacaggtgtcagctaccatatctgttcacattcataagttatacaaattgatttaaaattcagttgaatggtacataaaggtaatatccagacaaataagcaataggaatctgagtttctcatgaaactaattttataatttcaggaatttttctgagattgccttatgacttttatatacaaccatatagatgactcttttattcctgggacactttcattcatttaataaaaattttttgacccaaactatgtggtatgcgtagcggggctagtgagcaacacaacaataactccagcacatagtttactttcttttgctcagatcaccttacataacatttggtagaaagagtgctactgtgtttaatctttgtttttatctgcagcagcctgtgggatagccaagccaggccccagagtattgataataattggaaatatatttcaaacctagtattaggtacatggccatatagcaatattatcaacatatttcttggttttgtaatgtgtttttcctcctttttggtgtaagtggggaaggagaaaagtagaataaactctaacctataattatagctcacttatctttagggtcaatagctgttactttaatgttgttaaagcacaatgaaagatgtacagtatagttattataactctaagaaaagatgtgtttttgaagcagcatatatattggccctaatagtaaactatttatctacattccattcaagatagagaaaacactgtctgccaagaataattgtttttatttctttgttgcttggttctttgtttgtcttaattgcagaagagtccaaataagattgcatctggctttttcctgcgattgttaacatcaaagctaatgaatgacattgcagatatttgtaaaagtttagtaagtatgcttcctgttttgctatcatattttgattctaataggcataatttttttgttgaaatatctttgtaaataaggatgcatctcacaacatatagctcttaacatttttacaaatgtggaaattaaggccaggtgcggtggctcatgcctgtaaccccagcactttgggaggccgaggtgggtggatcacaaggtcaggagattgagaccatcctggctaacacggtgaaaccccgtctctactaaaaatactaaaaattagccaggcgtggtgacatgtgcctgtagtcccagctactcgggaggctgaggcagaattgcttgaacctgggaggtggaggttgcagtgagcgaagatcgtgccactgcactccagcctaggcgacagagcgagactccatctcaaaaataaaaaaatttaaaaaattaaataaaatgtggaaattaaataatttgtcttgtggggaaatatacctgattgcttcttaatatcaatacctagcatagtagtgcctgcctttagtttctcaataaataatacatttaaaaattgggaacgaatcatccaggctcacagctatatctgcgcaacattgtaccaaaatttaaaataattatttgttctttaaaagtgaccaaaaatcttgccaggcaagcaacatattcttattgtagtatttatttttcttccatacaaatgggcttatgccacatacattcttttttctggaacactgccgggcatacaaagtagttattgaaatatctattgagtgaaaacatattctgtaacttatttccattttatgacacatcttaatcattttccatgtcactgtacttattttataagctatctgctgttatactttatttatttagcagtgcatggtattctattgtgtggtgatagtgaatagtatatatgtatatgaaagcttatctgctcttttttttttttttttttttttgagacaaagtcttgctctgttgcccgggctggagttcagtggcacaatctcggctcactgcagcccccacctcctaggttcaagagattctcctgcctcagcctcccaagaagctgggattacagatgtgtgccaccacaaccggctaatttttgtatttttagtagagaccaggtttcaccatgttggccaggctggtctagaattcctgacctcaaatgatctgtccaccttggcctcccaaagtgcttggattacaggtgtgagccaccacactgagccaaaaagcccatctgctcttaattaacattttaagtggtttctagttttttgggttacaaagacttctgtggtacagattattgtacttttgtctatttgtatttgtgtgtatgatggatgtaggataatttctagcagtagacttgcttgttcaaaaggaatgtgaattttactttttgatggatattgtcattgtcctccaaaatagtcataccaatttaggcattttcctacaccctctttgggtaacactttaggtgttacaaaacttcttaatataagaaataattttgagggaggagccaagatggccgaataggaacagctccggtctacagctcccagcgtgaacgacgcagaagacgggtgatttctgcatttccatctgaggtaccgggttcatctcactagggagtgccagacagtgggcgcaggtcagtgggtgtgcgcaccgtgcgcgagccgaagcagggcgaggcattgcctcactcaggaagtgcaaggggtcagggagttccctttctgagtcaaagaaaggggggacggacggcacctggaaaatcgggtcactccccgaatactgctcttttgcgacgggcttaaaaaacggcgcaccacgagattatatcccgcacctggctcggagggtcctacgcccacggagtctcgctgattgctagcacagcagtctgagatcaaactgcaaggcggcagcgaggctgggggagggatgcctgccattgcccaggcttgattaggtaaacaaagcagccgggaagctcgaactaggtggagcccaccacagctcaaggaggcctgcctgcctctgtaggctccacctctgggggcagggcacaaacaaaaagacagcagtaacctctgcagacttagatgtccctgtctgacagctttgaagagagcagtggttctcccagcacacagctggagatctgagaacgggcagactgcctcctcaagtgggtccctgaccctgacccccgaacagcctaactgggaggcaccccccagcaggggcacactgacacctcacatggcagggtactccaacaggcctgcagctgagggttttgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagcgcctctcctccaccaaaggaacgcagttcctcaccagcaacggaacaaagctggatggagaatgactttgacgagctgagagaagaaggcttcagacgatcaaattactctgagctacgggaggacattcaaaccaagggcaaagaagttgaaaactttgaaaaaaatttagaagaatgtataactagaataaccaatacagagaagtgcttaaaggagccgatggagctgaaaaccaacgctagagaactacgtgaagaatgcagaagcctcaggagccgatgcgatcaactggaagaaagggtatcagcgatggaagatgaaatgaatgaaatgaagcgagaagggaagtttagagaaaaaagaataaaaagaaatgagcaaagcctccaagaaatatgggactatgggaaaagaccaaatctacgtctgattggtgcacctgaaagtaacggggagaatggaaccaagttggaaaacactctgcaggatattatccaggagaacttccgcaatctagcaaggcaggccaacattcagattcaggaaatacagagaatgccacaaagatactcctcgagaagagcaactccaagacacataattgtcagattcaccaaagttgaaatgaaggaaaacatgttaagggcagccagagagaaaggtcgggttaccctgagagggaagcacatcagactaacagcggatctctccgcagaaactctacaagccagaagagagtgggggccaatattcaacattcttaaagaaaagaattttcaacccagaatttcatgtccatccaaactaagcttcataagtgaaggagaaataaaatactttacagacaagcaaatgctgagagattttgtcaccaccaggcctgccttacaagagctcctgaaggaagcattaaacatggaaaggaacaaccggtaccagccgctgcaaaatcatgccaaaatgtaaagaccattgagactaggaagaaactgcatcaactaatgagcaaaataaccagctaacatcataatgacaggatcaaattcacacataacaatgttaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccactacaggagcacccagattcataaagcaagtcctgagtgacctacaaacagacttagactcccacacattaataatgggagacttttaacaccccactgtcaacattagacagatcaacgagacagaaagtcaacaagtatacccaggaattgaactcagctctgcaccaagcagacctaatagacatctacagaactctccaccccaaatcaacagaatatacatttttttcagcaccacaccacacctattccaaaattgaccacatactgggaagtaaagctctcctcagcaaatgtaaaagaacagaaattataacaaactatctctcagaccacagtgcaatcaaactagaactcaggattaagaatctcactcaaaaccactcaactacatggaaactgaacaacctgctcctgaatgactactgggtacataacgaaatgaaggcagaaataaagatgttctttgaaaccaccgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgatcccacagcaatacaaactaccatcagagaatactacaaacacctctacgcaaataaactagaaaatctagaagaaatggataaattcctggacacatacactctcccaagactaaaccaggaagaagttgaatctctgaatagaccaataacaggatcagaaattgtggcaataatcaatagcttaccaacaaaaaagagtccaggaccagatggattcacagccgaattctaccagaggtacaaggaggaactggtaccattccttctgaaactattccaatcaatagaaaaagagggaatcctccctaactcattttatgaggccagcatcatactgataccaaagccaggcagagacacaaccaaaaaagagaatgttagaccaatatccttgatgaacattgatgcaaaaatcctcaataaaatactggcaaactgaatccagcagcacatcaaaaagcctatccaccatgatcaagtgggcttcatccctgggatgccaggctggttcaatgtacacaaatcaataaatgtaatccagcatgtaaacagaaccaaagacaaaaaacacatgattatctcaatagatgcagaaaaggccttggacaaaattcaacaacccttcatgccaaaaactctgaataaattaggtattgatgggacgtatctcaaaataataagagctatctatgacagtcccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtatatctagaaaaccccactgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatattgtgaaaatggccatactgcccaaggtaatttacagattcaatggcatccccatcaagctaccaatgactttcttcacagaattggaaaaaactactttaaagttcatatggaaccaaaaaagagcccgcatcggcaagtcaatcctaagccaaaagaacaaagctggaggcatcacactacctgacttcaaactatactacaaggctgcagtaaccaaaacagcatggtactggtaccaaaacagagatatagatcaatggaacagaacagagccctcagaaataacgctgcatatctacaactatctgctctttgacaaacctgagaaaaacaagcaatggggaaaggattccctatttaataaatggtgctgggaaaactggctagccatatgtagaaagctgaaactggatcccttccttacacctgatagaaaaatcaattcaagatggattaaagacttaaacattagacctaaaaccataaaaaccctagaagaaaacctaggcattaccattcaggacataggcatgggcaaggacttcatgtctaaaacaccaaaagcaatggcaacaaaagacagaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcagtcattaaaaagtcaggaaacaacaggtgctggagaggatgtggagaaataggaatccttttacactgttggtgggactgtaaactagttcaaccattgtggaagtcagtgtggtgattcctcagggatctagaactggaaataccatttgacccagccatcccattactgggtatatacccaaaggactataaatcatgccgctataaagacacatgcacacgtatgtttattgtggcattattcacaatagcaaagacttggaaccaacccaaatgtccaacaatgatagactggattaagaaactgtggcacatatacaccatggaatactatgcagccataaaaaatgatgagttcatgtcctttgttagggacatggatgaaattggaaatcatcattctcagtaaactgtcgcaagaagaaaaaaccaaacaccgcatgttctcactcataggtgggaattgaacaatgagatcacatggacacaggaaggggaatatcacactctgtggactgttgtggggtggggggaggggggagggatagcattgggagatatacctaatgctagatgacgagttagtgggtgcagcacaccagcatggcacatgtatacatatgtaactaacctgcacaatgtgcacatgtaccctaaaacttaaagtgtaataaaaaaaataataatttttaaagtttgcatattattttgttatgtagacatattacaggttatatatccattttactattgttggacatttagtagaaaaagtactgtagttttcatacttacacatgaaccttgaattgtttgattaggtaaattttttttttttttttttttttgagacagagtctcgcttcgtcaaacccaggctggagtgcagtggcatgatctcagctcactgcaatctctgcctcctgagttcaagtgattctcctgcctcagcttcctgagtagctgggattacaggtgcccaccaccacacccagctaatttttgtattttaaatagagacaaggtttcaccatgttggccaggctggtttcgaactcccgacctcaggtgatccacctggctctgcctcccaaattgctgagattacagatgtgagccactgtgcccagcctgattaggtaaattttgactacagcatgctcctgcaagaagccatcttgaacatctttgtttctcttccttgaaggcatccttcatcaaaaagccatttgaccgtggagaagtagaatcaatggaagatgatactaatggaaatctaatggaggtggaggatcagtcatccatgaatctatttaacgattaccctgatagtagtgttagtgatgcaaacgaacctggagagagccaaagtaccataggtaaatacatatttactacttgggatttcttttacttctttatattgatttggcagtataagaggcctcattgatatcaattttgtgcttatttcattttctcttagtatagccttttaggattgttcctttcttatatactttattttttttttatttttacttgaatttattagtttcatattttattcttcatagaaggaacttaagataactattaaagaaataaaaccaggccaggcatggtggctcacgcttgtaatctcagcactttgggaggccaaggcgggctgatcatgaggtcaggagatcaagaccatcctggctaacgtggtgaaaccccatctctactaaaaacacaaaaattagatgggcgtggtggcgggcgcctgtagtcccagctactcgggaggctgaagcaggagaacggcatgaacctggggaggtggaggttgcagtgagccgagatcatgccactgcattccagcctgggcgacagagcgagactccgtctcaaaaaaagaaataaaatcatatgataggttatttcctcaatagaaagcaggaaatgaaaacacacctgtaatgccattgcttttaacctttttctattatttctctgtagaaacattcaaaattgtagtcaacatcaacattcacatgttatgaatgcctgtttaattataagtatttttccaggtagttgcttttcttgatagtcatactttttaatggcttcaccatttttctgtcataaataccataatttacttgacattttttattgtcagaaatttagattcttttctattttcctacaataaacattattgcaatgatcatttgtctaagggtttttttttctcatattttaaattatttcttgacaacagaatcttggataatttttcaaaaagacttttgaagctttcagtatataattaatttcactataattttgcttttcatatacttttttttgtgaagaggaggaaatttgagttaatatgactatatatggctgttgtgcccttctcttagtgttaatgagtgctttttatttttaggtgccattaatcctttagctgaagaatatctgtcaaagcaagatctacttttcttagacatgctcaagttcttgtgtttgtgtgtaactactgctcagaccaatactgtgtcctttagggcagctgatattcggaggaaattgttaatgttaattgattctagcacgctagaacctaccaaatccctccacctgcatatggtgagttacgttaaatgaagaagctcttggattttatctgatgttgctgactaaatgtaatgagttgacatgtaagaatcacatggtgtctttgaagaattgaaattgctttcttgagaaatgaacctgagactagttggaaaataacacttttaacgtgctgtgagcaaatttaagtggatgctgaaatattaaaacttagatgggttttggatagatttattctctttaggtttaattgttataaattattttaattaggctaagaaacatagaccctgaatgtaaaaatattacataacattgtgtttgaagttggaaccttgcctttgaccttagtttatatattttcagttttttggatttgatttcaaaatgatagtgaagttacaagaatactacagttaacgttttaccatatttgcttaatcattccctctctccacacacacactcatacgcagatacacacatcattttctctgaaccattttgagatgaaatcgcacacgtgatgctccttatacttcagtgtatatttcctaaaaacaaggatacacttctgtttagccacagtataatcatcaaaatcaggaagttaacattttgtcattgcatttaggtgtgtagtctgtttagtctccttcaatctggaacagttcttttttttatttatcatgaccttcatatatttgaatagtacaggtcccttgctctgagtttgtctgatgtttccttatgattaaatttatactttgacgagaatgttgcaaaagtaattcctcttctgccttcaccctgtccatttatctgtctgttgatagatatcttcaaatccaagccaacatcacacagtttatctttttttctgtccaaatttataaattgctttactagcagttaaaaaaaacaccccaaaacctgactatccactcaacctgaatgcatttacttatttgctcaacaaccttatatataactaatctaaccatgtgggccattttcttagccctagccccagtgtatgtggaggtagagcctctggcctagcgagtagcaagttgggtcctaggtcatgtccccagttccagcaaattgtcacacatgcctggtgagtccctaattagaacctctgatcacagtaaattgtaggctgagtcattggtggaatccctggtcatgtttcccacccttggtgaaaatgcacgtcaatcccttagagtgagaagacaagtttggttgtgccctgtttgggcccctggtttaggtcctcgcagatactcaagtctctatccctgaccaagaggaagttacatgcttttcttgaagtattgatgtttcaagtcacttcagaacattcagtaacctcatgtacatgactctcatgtcaaataatgaaaaggatcatttaatttcctttgttaatatctgaaaaggattaagaaatatattattctatatgtaaataggaaaaaaaatcccttattatttcagtatagccagaaaattatttggtagttctcggaaactggctgcccagataataactaccattataactggtcgttgcagcagccctttctgtgcatagtaccataaagagccttacaagattgccttatgggaagataggtcaaggtttttgacttcttccctgcccatgattatctctgctttccaaaattcattaatagttttcaaccactggtctattatccccaagcattattttgggagagtggagacttacagtttcagaatcttgctcaagctcttaactgcaacagtggtaataatgatcatttattgaattccacaatagaagctagacttttacgtttattttctctaatcctcacagttatctggccaggtaagtgatatatcttcactctactgatgagggtacgaaggccctagatgacataaggcaagttttttaccagaaaagttaaggctgtggtactgggatttgaattttctgtttgacttcaaagccttttgtttttactatacacctcttaaatatttacagctgtgtgtgtgtgtgtatgtgtgtgcatgtatgaatttatgtttatatacttaaaaaaaatttttttttgagacggaatctcgctctgttgcccgggctggagtgcagtggcgcgatctcggctcactgcaaccttcgcctcccaggttcaagcgattctcctgcctcagcctcctgagtagctgggattataggcgcctgccaccacccctggctaatttttgtgtttttagtagagatggagtttcaccatattggccaggctgttctcaaactcctgaccttgtgatctgcctgcttcagcctcccaaagtgctgggattacaggtgtgagccactgcacccggcctatgtttatatactttttaaagtaaatgatttgtggataaacctgatttttttccctcctaccatcttagtatctaatgcttttaaaggagcttcctggagaagagtaccccttgccaatggaagatgttcttgaacttctgaaaccactatcgtaagaaattaaaaccttatgttatgttcactttaaagttataaaataactgatgtgttctgttaagcttataaagttgaactttttttttttttttaccacagcaatgtgtgttctttgtatcgtcgtgaccaagatgtttgtaaaactattttaaaccatgtccttcatgtagtgaaaaacctaggtcaaagcaatatggactctgagaacacaagggatgctcaaggacagtttcttacagtaattggagcattttggtaggtacagtctattttgtggtcctatttttcttttgctatctgtggatacgaatgcaagttttgtatccacatcagtgatttcttctgatcttcctacatagctaatacatcttttaagaatagcagaatgtaatttgtgtttccctcagtcgcttgaagaactacattgctttttgtttaaggcttggctttctaaaccgtttaactcatttctctgcaaattttgaatcacttaataatttgacatgtatagtgaataaaggataacaagccaaaatcagttgaattgttcatgttccctaagtgaacaaattggccttgtccttatctggttattttatgcatattgtcacattccaagataacaccctgatacttacagaggagcacatacatataatttagaacccttgtactatctgattgctaagtaattctaaatcaatagactgttttttgtttttgtgtttttttgagatggagtctcactccatcacccaggctgcaggctggagtgcagtggtgctatatctgctcactgcaacctccgcctagtaggttcaagcaattgtcctgcctcagcctcctgagcagctatgattacaggctcccaccacaatgcctggctaatttttttgtatttttagtagagatggggtttcaacacgttggccaggctggtcccaaactcctgacctcaagtgatctgcccaccttggcctcccaaagtgttgggattacaggtgtgagccagtgcacccagcctgaatgtggttttgaaatcttcaatataccaaacaaagaaatcttcaatataccaaacaaagaaatttctttctaaagtaagtttactgtaatgtagtttagccattctatggtagcccccaaaaaaggacataatggtataaaacaaataatatacgctaaaatgaattcttttacactaatttcttttagcttgaatttttggcaaggtgagtatgttggcatattccacataatgacaaataagtttagcacagaaagacatattggaagtaacttacaataacctttcagtgagttttctgagtgcttttatcagaatgattatttaactttggaaaacttacttgatttcaggcatctaacaaaggagaggaaatatatattctctgtaagaatggccctagtaaattgccttaaaactttgcttgaggtgagtttttgcatttttttagtaagatctccattgaaaattttaaagcagtctttgtttgttaatgagtaatttttctctatttcatatttaaccacagttcttttcccgtaggctgatccttattcaaaatgggccattcttaatgtaatgggaaaagactttcctgtaaatgaagtatttacacaatttcttgctgacaatcatcaccaagttcgcatgttggctgcagagtcaatcaataggtaatgggtcaaatattcatgaagtatttggaatgctgcagatggcagtagaatgtcttacatagtaacagctcacagttgcaatattaaaaatagctaacacttgttgagtatatacggtgtgcctggcatttatgtttattcttaattcttatacttctgtcacttagattctattatttccttcaatttataaatgaaaactgtgacttagtgaggtaaagtaacttgcttatgccacagagctaacaagtggttgactcgagtgaggtgtgtctactatcatgtacaggagatacggactgtttggaaattactgtgattttatgtgagtttatgaaatgataattagcacattttacattgtgctaattacaattatatttacttgagtgaacatccagtgaagcactggaaggattctatcatgaggatcttttatatttgagtactggaataaacatatattaatttcattctttttttttttttttttttttttttttgagatggagtttcgctcatgtctcccaggctggagtgcaatggtgtgatctcggttcacttcagcctctacctcctcggttcaagcaattctcctgcctcatcctcctgagtagctgggattacaggcgcctgccaccatgcccagctaatttttttatttttcgtagagatggagtttcaccatgttggccaggctggtcttgaactcctgacctcaggtgatccacccaccttgtcctcccaaagtgctgagattacaggcgtgagcctttaatcatgtagtttttgtcattcgttctgtttatgtgatggattatgtttattgatttgtgtatgctgaatcagccttgcgtcccagggatgaagctgacttgatagtggtggataagcgttttgatgtgctggattcagtttgccagtattttatcgaggattttcacatcgatgttcatcacggataatggcctgaaattttctttttcttgtgtctctgccaggttttggaatcaggatgatgctggcatcataaaatgagttagggaagagtccctctttttctattgtttggaatagtttcagaaggaatggtaccagctcctctttgtacccctggtagaattcggctgtgaatccctctggtcctgggctttttttggttggtaggctattaattactgcctcaatttcagaacttgttattggtctattcagggattcgacttcttcctgctttagttgggaggttgtatgtgtctaggaatttatcactttcttctagattttctagtttatttgcatagaggtatttatagtattctctgatggtagtttgtatttctgtgggatcagtggtattatcctctttatcattttttattgagtctatttgattcttctctctttattagtcttgctagcggtctgttttgttaatcttttcaaaaaatcagctcctggattaattgatttttttgaaaggttttttttgtgtgtgtgtgtctctatctccttcactcagctctgatcttagttatttcttgtcttctgctagcttttgaatttgtttgctcttgcttctctagttcttttaattgtgatgttagggtgttgattttagatctttcccactttgtcctgtgggcatttagtgctataaatttccctctaaacactgctttagctgtgtcccagagattctggtacattgtgtctttgttcttattggtttcaaagaacttacttatttctgccttcatttcattatttacctagtagtcattcaggagcaggttgttcagtttccatgtagttgtgtggttttgagtgagtttcttaatcctcagttctaatttgattgcactgtgatctgagagactgttacgatttccattcttttgcatttgctgaggtttgttttactttcaattatgtggtcagttttagaataagtgtgatgtggtgctgagaagaatgtatattactctgttgatttggggtggagagttctgtagatgtctgttaggtctgcttggtccagagttcggttcaagtcctgaatatccttgttaattttctgtctcattgatctgtctaatattgatggtggggtgttaaagtctcccgctattattgtgtggaagtctaagtctcttcgtaggtctaagaacttgctttatgaatctgggtgctcctgtattgggtgcatatatatttaggatagttagcacttcttgttgcattgatccttataccatcatgtaatgtccttctttgtctttcttgatctttgttggatgtttgttttatcagagactaggattgcaacccttgctttttttctttctatttgcttggtaaatattcctccacccctttattttgagcctatgtgtgtctttgcatgtgagatgggtcccctgaatacagcacactgatgggtcttgactctttatccaatttgccagtctctgtcttttaactgggacattttagcccatttacatttaaggttaatattgttatgtgtgaatttgatcctgtcattatgatgctaactggttattttgcccattagttgatgcagtttcttcatagtgtcaatggtctttacaatttggtatgtttttgcagtggctggtaccagctttgcctttccatatttagtgctaccttcaggagctcttgtaaggcaggcctggtggtgacaaaatctctcagcatttgcttgtctataaaggattttatttctcctttggttatgaagcttagtttggctggatatgaaattctgggttgaaaattattttctttaagagtgttgaatattggcccccactctcttctggcttgtaaggtttctgccgagagatctgctgttaagtctgatgggcttccctttgtgggtaacccgacctttctctctggctgcccttaacattttttcattcatttcaaccttggtgaatctgatgattatgtgtcttggggttgctcttctagaggagtatctttgtggtggtctctgtatttcctgaatttgaatgttggcctgtctcgctagattggggaagttctgataatatcctgaagggtgtttccaacttggttccattctccccatcactttcaggtacaccagacaaacgtagatttagtcttttcatatagtcccatatttcttggaggctttgtttgttccttttcattcttttttctctaatcttgtcttcatgctttatttcattaagttgatcttcaatctctgatatcctttcttctgcttaatcagttcggctgttgatacttgcgtatgcttcacgatgttctcatcctgcatttttcagctccatcaggtcatttatgttcttctctacactgattattctagttagcagttcctctaaccttttttcaaggttcttagcttccttgcattgggttagaacatgctcctttagctcagaggagtttgttattacccatcttccgaagcctacttctgtcaattcgtcaaactcattctccgtccagttttgttcccttgctggtgaagaattgtgatcctttgcagcagaagaggcattctggtttttggaattttcagcccttttgcgctggtttttcctcatcttcgtggatttatctacctttggtctttgatgttggtgacttttgtatggggtttctgtgtggacatcctttttgttgatgttgatgctattcctttttgtttgttagttttcctttttacagtcaggcccctctgctgcagatctgctggagtttgctggaggtccactccagaccctgtttgcctgggtatcatccatggaggctgcagaacagcaaagattgctgcctgttccttcctctgggaaggttcgtcccagagcggcacccgccagatggcagcgggagctcttctgtatgaggtgtctgtcgacccctgctgggaggtgtctcccagtcaggaggcacgggggtcagggacccacttgaggaggcagtctgtcccttagcagagctcgagcgctgtgctgggagatccgctattctcttcagagctggcaggcaggaacgtttaagtccgctgaagctgtgcccacaaccacccctttccccaggtgctctgtgtcagggagatgggaattttatctataagctcctgactggggctgctgcctgtctttcagagataccctgcccagagaggaggaatctagagaggcagtctggctacagtggctttgtggcactatgttgggctccacccagttcgaacttcctactggctgtgtttatactgtgaggggaaaacatcctactgaagcctcagtaattgcagacgcccctccccccaccaagcttcagtgtcccaggtcgacttcagactgttctgctggcagcgagaatttcaagccagtggatcttaacttgctggtctccatgggggtgggatccgctgagctagaccacttggctccctggcttcagccccctttctaggggagtgaatgggtccgtctcgctggcgttccaggtgccactggggtatgaaaaaacactcttgcagctagctcagtgtctgcccaaatggccgcccagctttgtgctttaaacccagggccctggtggtgtaggcacccaagggaatctcttggtctgcgggttgcaaagactgcgggaaaagcgtagtatctgggcaggaatccaccattcctcacagcatagcccctcacagcatagtccctcacggcttcccttggctaggggagggagttccccgaccccttgtgcttcccgggtgaggctacaccccaccctgctttgactctccctccgtgggctgcacccactgtctaaccagtcccaatgagatgagccatctacctcagttggaaatgcagaaatcaccaccttctgcgttgatctcactgggagctgcagaccagaactgttcctatgttgccatcttgctgttcccttgttttatttttctctagtatttatgataacgtgaaacatattttaatatatttacttctccgtattccactagtatatatgttcctaaaggcactggtttttgtctgttctgttcattgttgtatttttagcacctaaaacaatacttggcatgtgataggtatccaataactgttttaaaataaatgaatgtacttgaaaaaaaattacatgatgcttcaaaaacatcaaagctgaaaatcatttgagtaactttaaaatgtaagcaatcaataataaaagattactatattgttcagcagtcacataaagtattaaaactaatatttcagtatttgaatatgccgacagtaatgttttcataaactagattttgtgtctaactcctcaggtttggaactgtttttagtaagaccataatgcattgcaaggatttctaatgaatatgtttagtagttcaagcccttattaaatttcacagataaaagcaaatgtatgctgaactttaaggactgaggtaatataagactgaattgaatgtaataaggcggcagtgtagtggtggcattaaaaaaactgaagattcaaaaagtataaattcaagaataacatgcaagtagcattcttttttttaattttacacttgttagattttgtcttagtccctttgtgttgctataaaggaatacctgaggctggatatttacaaagaaaagaggtttatttggcatatggcgtctacatctggtaagggcctcagactcatggcagaaggcaaagaggaatcagtgtgtgcagagatcacatggtgagagaggaagcaagggtggaggcggggaaggccatgccaggctcttttttttaataaccagcccttgtgggaactgaatagtgagaactcactcattccttaccctcaggccttaatctattcgtgagggatctgcccccatgactccgacacctcccattaggcataacctaatggggatcagatttcaacatgacatttggaggggttaaacattcagacaatagcagatatctaatgttcagctattttaagagcagtgagtgaaactagaagaatcagaggaacataaacaattataaaagcttcgattactaaaaaaggataaaagacaaagttgattaaagagttatccttaaatatgtgggtgttacgcaaaaggtgtactgatcaacttttttccatcacataaaacaaaatttaaatggtacataaaaacattaacttacccgctttcagagtgattaaatgttagagcaggttgacattggaatctgtggactcaactaattggtgttcggccagagaacagtttatcttttctggctagtttgagttcagtgctgttcaaatttgagcaatagttaaaatatattttgagaccctcttcagttctaggagaaaatagattttgtattcaagaccttaatactaagctgctggtctgaacctctttaaataaactcaggttttgttagtctttaagaaagagctagtatgttattatgtctcacagagtgatttatttttgttctggaatatgctttggaaagtagggtttgaaattagaaaattatttcactttttgtttgtttgtttgcttgcttgttttaagattgttccaggacacgaagggagattcttccaggttactgaaagcacttcctttgaagcttcagcaaacagcttttgaaaatgcatacttgaaagctcaggaaggaatgagagaaatggtaattttaagtaacatgtatttgctgttatcatatgcttgctatgaatatcccataaattacttcaccaagtttggtataagagagtttataatccagtagtttacagtataaagctgctctaaaacaactgtatgaattgattgaaactgcattctttctgggtcacaatgggtcaaatcatagcaatttcttttggtttagcatttttatggagaaacccaaaatttaactgagtttttatgggagtataaatggctcccttttttattttaaaaatccttttatatgtgatctgattaaaagctaattaagggaacaggtgacaatgggaagaaatggattgaggagaagaatctcacacaaaatcaaatcattgtggtgtttacagtgaaacttgtgatatttcacgtttctgtagaataatatattttttatggtaatgattatcttagagttcaaattttttcatttatttatgccctggtttgtttcttacaagtatttaaggtagttaaataactgtcaagtctgtgatagcaggaaattgaaaggaacaattgaaagaatgtgagtttagaaaagaatttcaatagattagaaagataagtgtaaataacataaaatctaatgagataatgtatattatacattttaaatcagcctgtcatctgcaaaaagggaaaatactgatctgacagcaattcatttagaaaaagacctaggaagttttgtatcttgtgattatagtatgaatcaacattgtattacagttaccaaaaaggctaactctgtcttacactgcattaatagaagcatattgtcatgaacaaagttaatacaagaacttggatcttttatactttttgctttatttttagatcttttaatttttatgggtacatagtaggggtgtgtgtgtgtgtgtgatacgggtatacaatgtgaaataatcacatcatggagaatggggtatccatcccccaaacaaatatcctttgtgttacaagcaatccaattacactgttttagttattaaatgtttctgtattttttagaggataactataatgtttggtttggttctgagtaaagtaaaagatttttagccagaatgttatagatctgtgtcttataaaaaatggatgaaggaattgacttagtggaaagctcacatttgtttttaaacatgtcagtgcttgtgatttagcaaaggtattggtccttactctttcttgtaccaaaagacagaactaggattagtgagtaggaggtttctgaaatgtgtatagcttgtcaaaaaatctggagttcagttgggattttataattgattgttaaacatttacattttacattacattttttttttaatttctttttaagtcccatagtgctgagaaccctgaaactttggatgaaatttataatagaaaatctgttttactgacgttgatagctgtggttttatcctgtagccctatctgcgaaaaacaggctttgtttgccctgtgtaaatctgtgaaagagaatggattagaacctcaccttgtgaaaaaggtatatatggatgagtattttattagaagcttccttaggtcactgtgaaataatttaaaaagttaaagctagattttctgagtggcacttatttaagactaggaaacaattttattttttaggttgggaatattggaaagcagttatacaaaaactattcaaatggtatatttatggtatgcactgtttcttacattccatttaagagcatttcacaaggctttcattgtactaacaagagtgaatgacttgtccaccagactgaccaggcttttggaaatagtatttattgagggaaacacatggagacaagagcagcataggtgttttgcccggtagattctggggcagcacattgggatccagcagggccagaagtcaaattttagagctatcaggcttttaagttcagttatcaggggagaaggactagggtccaagccttataattactacatcagcacagtattatagaatgttggccccgtctcttttccatcacctcagcatttatggtttaggaagttccagacctttccattgcaaatttttatgtgataaatcagtggtaggtcagtggactgatattatgccagttaacattctaccagcatagtttccatggtgctttggagtaagccagcctataatcagttagccttttacctctcagtataagacttgttcggtgtttcttaaaagtatacaaatacattacctaataatcataagtgttatgtattgtttggatttttcttatttggatttaagcctaagagaaataattttactttatatttatttatttattttgaaagacagggtctcactctgtcacccaagctggagtgcggtgatgtgatcatggctcactgcagtcttgacctcctgggctcaagcgatcctcccaagcctcctgagtagctgggactacaggcatgtgccaccacacctggctaatttttttttttttttttgagacggagtctcgctctgtcgcccagactggagtgcagtggcatgatctcggctcactgcaagctccgcctcctgggttcatgccattctcctgcctcagcctcccgagtagctgggactacaggcgcccgtcgtcacatccacacacctggctaatttattatacagacgggctcttgctatgttgcccaagctggtcttgaactcttgggcttaagcaaccctccctcctcagactcccaaagcgttgggattacaggtgtgaaccaccactggccagtaattttacattaaatcttcctttaagtataaccaaatgttggaaactcttagcatatttttatatttttatttacttaacatttattaagggtttgctatgtgtcagatactgtgccagttgagtacattttcttaattattattcccatctcatagatgaggaaatcaagaaaagttgaatgaatgttgtttctaggtcctactctaaataatattaacaagcatttaaatgatttatttttttcatttttcttaacacattgactttttggttcgtgcaggttttagagaaagtttctgaaacttttggatatagacgtttagaagactttatggcatctcatttagattatctggttttggaatggctaaatcttcaagatactgaatacaacttatcttcttttccttttattttattaaactacacaaatattgaggatttctataggtaagtttatacatgacatatgtgaaatttgtttaatttaaaattagttaacaatacttagcaagtcccctcaccagcaacacacataccatacccatacacatgtgtgtgtgggagcctacatagtatgagaagcaggacagcttcttttaataagaatgtattgaagggagtcactggacttcagatctggtcctagctgtgccaacaaccagctatctgactttggtcaaaccacataaagaccctctatgccttggttttttaatatgtaaagtaagcaagttacacaaggagatctttcaggtccttttcagctttaatatttgatcatctttcctttggaaaaaattgaagataaattactagtagctggttatttctgccttgtttttcttttctgttgcttgactataggcctcttagttattacttctattagatttagaaacttaatgtaaaactttattttgctaactttaactctgtagaagaaaaatttgaaaatggagaggtttgaaacaactaaaaagtaatgtttaggtatcaggatgatgggaaggcatctcatatttgttgaacatgctctgtgttatggactttgctatgcattttacatgtagtgtatcacagatctgagtttcagacttatcctaatagagttttctaatagattatgagttgtatgtaggtagtttcctttaagaaggatattcctacaaaagtaaatttagtggtccttatagttcattcattttggcaagaacaatatagctatatctctgtatatgcgagggattcattccaggatcccccatgtatgcctaaatttacgcgtactcaagtcaccaagttggccctgcagaacccacgtatatgaaaagtcagtcctctgtatatacagactttcacatcctgtgaatactgtttttctatctgcatttggttgaaaaatatgcaagtataagttcaaacccatgtttttcaagggtcaactgcatttatgttagttgattatgcagaagaaataaatataaattcaagtctccatttttatttgtttattgttttgttttttctttttgctaagggtgctactgaacaaggtcccatttttaaatcccataattatggtggtggtatgttctaagctttctaatttttttaatgtgactatttagaatttacttaatttttccatttataaaattaaagaatgtttaataatctggataaagtatgatactttaatgctgatggtattaaaacagtttttaagaactattttataaaattttacttggaaaagttatatataacctgtattttaaatttttctatttttagatcttgttataaggttttgattccacatctggtgattagaagtcattttgatgaggtgaagtccattgctaatcagattcaagaggactggaaaagtcttctaacagactgctttccaaagattcttgtaaatattcttccttattttgcctatgagggtaccagagacagtgggatggcacagcaaagagagactgctaccaaggtctatgatatgcttaaaagtgaaaacttattgggaaaacaggtatggcttcaatttttatgtacttttcattccctgaatgatatgagatataacctttaagttttaaggctatttattcgatttattcgtatttatatattgaaacttagcttgtggtaatcattatctagcatagccaacccatgaatttttttggttatgtcgtgttgtctccctctgattggcttttaactaagtagaaatgttttaaattagaaataatccaaaaaaccatttgaataattttcttctgccatttaaaaatttattttaactgttgtaatacacgaatgcaaactggttgttaaagtcaaggaatactaaacagtgtacagaaaaccttcactccctcttcaatctcaccaagctttccacttttcaagaaaaacaaccgtccctcattcctatagttctcataccctgctgtttgtttttttgtgacacttattaccttctaatgtatgatacaatttaccttttttttctgtctttgcttttgtttttgagacagagtcttactcttttgccaagactggagtgcagtggcatgatctcagttcactgaagcctctgtctcctgggttcaagcaattctcctgcctcagccacccaagtagctgggactacagctgcgcaccaccacacccagctaattttcatatttttagtagagacggggtttcaccatgttggccaggctggtctttaactcttgacctcaggtgatcttcccacctcagcctcccaaagtgctgggattacagatgtaagccaccttgccagaccataatttacttttgaattatgtttattatttaccagtcttctccagtatacatttttctctctttttttttttttggctgatgtatctctaatatattttgagtattcattaaatgtttgtcaaaagaaggagtcaagtaaggaaggatttaaaaagcttcgtttgttttataatcatttatatacatttccaaaattttttgaagcaacttatattaaaacatacatacaaattttttaagataaaaaagctgtggtcaccccacatttatgtatgtatttatttattttggatataagtaagggataagtaaccaaacttggtcaatattagataaacttcaagggaccttttttttttttagtttcctagttatctatattgaaccaagaaatggaacagcaagttccttagttgcttaggtggacctattcagaactggttgtaagtctgcagtctgaagggaaatggtgagcagaggactcctttcccaaagacagctggaacagaaataggcactccagaggttatggaatttgagagagatactcagcctctagccactcccattcaatctcccagcttagtcttctgagcattcttaatcttactattcttttcttaatgtattcaaaccaaaagacagcaatttttagagcctgaataggttttggagggaaaagtaattacgttcaacttcgattgaaactcttgcctcaagaatgaagaacagcaaaaattaaatcacagtttcttagctttttggttaaagatgtaagttaaattcttggccgggtgcggtggctaacgcctgtaatcccagcactttgggaggccaaggcgggtggatcacctgagatcaggagttcaagaccaacctggccaacatggtgaaaccccatctctactgggtgtggtggtgtgtgcctgtaatcccagctgtttgggaagctgagtcaggagaatcacttgaacccgggaggtggaggttgcagtgagccaagattgtaccactgcattccagcctgggcaacagagcaagatttcgtctcaaaaaaaaaaaaaaaaaaaaaaaaaagaattgtataaaacacacaaacaaagcaaggaaagaatgaagcaacaaagccagagatttactgaaaatgaaattatactccacagagtgggagtgggccctgagcaagtggctcaagggcctggttacagaattttctggggtttaaatacccttcagaggttttccattggttacttggtatacaccctatgtaaatgaagtagtggtctgtaatcagtctgattggttataggaggggaccaatcagaggtactttcaatttcttatctgccacagtaaaagggagggggttgcaaagggagtagcctcttgtccttttgttacttgagcatggaaagttggggttttccttttgatttcgttctaggaggtcagcatggattgaccttaggttccctgcctccagaccttattgccctgcctcatttacgttaggtttctttcttgtcaccttctaaaatattttttgttattaggaagtatgtttttgaacttccttatgcattaagtaaattagccatttatcactgtaattccttatttggaaagttgttatattcacccttaagacttcacaattctcattcatttaactaaagtgcaacatagcagacttattctttatatttagagaatttgtgtcttttgtgaagctacctgtctatagtgggaagtagattaatgaaaagtccaaatctgttggggagggttttattctactattgatgaaaggggatgtggatcgcagctagccttagaatttgggatggcactcaagtagaagtctgggaagaagttacgcagggaacaaagatgacattgttcgcagtccctgggaattcttaacagtaaagttctgtaattgagacagaattcccaaataaagtcaagagtaaaattcagatagaggagcagttatacatcagtgggaaatttggttggcagaaaaattaccaggtcatacaacttaatgatagacctgaagtcttatttaaaatgattctctaaaattgaagaattggattaagggggccttgtttggctgattttcatactttttcctcttagtctacaggttggctgcatagaagaaaaaggtagagttatttataatcttgtaaatcttggactttgagtcatctattttcttttacagtcatcgaatacttttggaaataaggtaatatatgccttttgagctgtcttgacgttcacagatataaaatattaaatatattttaattttgtgcccttgcagattgatcacttattcattagtaatttaccagagattgtggtggagttattgatgacgttacatgagccagcaaattctagtgccagtcagagcactgacctctgtgacttttcagggtatgtacattttaaacttagagaactagctctaacttcacaagtttttaaagaagtttattggttgacaccttcaatgtctatttcaatttatagacatcactctttttaaaaaattttctttaaaaatagccacctttgaattgaggtaattacctatcctcttttaccatagtctccccacagtaattactctttctaaattgaccacttggttggccaacccaataaccttttcttagtctttctgtaatatttgaacattgtgccatctgttggcccttgaaatttttttcttcatacacattattcctagttctcttctctttatctaggtcttgcctttctagatcaccttttctttttttttttgagatggagtctcactctgttgccctggctggagtgcagtggcataatctcggctcactgcaacctctgtcttccaggctcaagctatccttccttccacctcagcctctcgagtagctgggacgacagatgcacatcactgcgcctggctaattttttatatttttggtagagacggggtttcactgtgttgcccaggctggtcttgaacttctggcctcgaatgattcccccgtgttggccaaccaaagtgctgggtctacaggcatgagccgccgtacccagcctcaccttttctttattgtgcgttattatctgtacaatttaatttggatgtgaatgtctctgagttgtatatgaacatcagagttgtttccctggcttgattgtaagctacttgaaaatatgctttacttttttttttttttttttaatgtgccctactgtgctgggcatataaaatagtaataatatctgagaaagtactttcacatatgtaatttcatgctgtctaaataagtgttgattgccatgtcttaaagtactgcttttacagtactggcatagagctttgattctgatctgaagtaatactgaggctcatttattgaactgccttttaactttataagattttttaagaaaatcattataagatcatttaagattatttaagttactgagggtgaaaggtatttagataatctgatttatatatctggactgtgatatgtcatttgtgattttattgaaagtatagtttttcagtagaaaaatggtttttgaatttgggggttattaaaatctaaattttcattttggaagttcactggtctatgaacaaaactttttaaaacgatgactgtattttttcccttaactctgttagggatttggatcctgctcctaatccacctcattttccatcgcatgtgattaaagcaacatttgcctatatcagcaattgtcataaaaccaagttaaaaagcattttagaaattctttccaaaagccctgtaagtatacatgatgagtttaataatagaacattccttcttttttagctaaaaaaactttgtaaatacatcttaaagaggaaaagtaaacaaatgaaaaatttatctcataattaaaaaggaaaacattcatttacaagtttaaatggtattttacttgtcagcattaattgaaatatgttacatatgagaacagaatcttgtgacactttagtgatatattagctcagggaatatatctactttttcataggaatatactatttaattgtagtttactttctgaaaattaaataaattggcaatagtttaagatagtaattttcttaatgtaacattttgtacttgatatcaaacccaaatctaaattctgttatttagttattttaaatataaaatgtgtaggtattcaaatatttgaagaaaaaatataaagtgtatttattgtagccgagtatctaattaaacaagtttttactaaatctgtttattttctaggattcctatcagaaaattcttcttgccatatgtgagcaagcagctgaaacaaataatgtttataagaagcacagaattcttaaaatatatcacctgtttgttagtttattactgaaagatataaaaagtggcttaggaggagcttgggcctttgttcttcgagacgttatttatactttgattcactatatcaaccaaaggtaaataacatatttagaccaatatataagcagtctttctatcctgttcttcctgtttttttgctttgttttgttttgttttgagacaaagactcactctgtccgcccaggctgggtgcagtcacggctcactgcatcctcaacctcctgggttcagattatccttcctcctcaccctgccgggtagctggggctacaggagcataccaccatgcctgactaattttttgtgttttttgtagaggtggggtttcaccatattgcccagggtggtctcaaactcctgggctcaagcgaactgtcagcctcagcctcccagtgtgctgggattacaggcatgagctactatgcccaacctatcctgttcttttaattgaaagtttatatgcttctaagaggtagataccagaatgttgctttctgaattttgctttttaagatgtctattatatttacttattagtttttaaaaattgcgctacttgcctgggaaacatagcagacctcgtttctactaaaaattttttaaaaaagaaaattagggcaaggtgtggtagctcacacctataatcccagcactttgggaggttgaggtaggtagattgcttgagcccaggagttagagaccagcctgggcaacatgatgtgaaaacccatctctacaaaaattttttaaaaaataagccagggattgtggcatgcacctgtagtctcacctactccagaggctgaggtgggaggatggcttgcgctcaggaggcagaggttacaggttacagtgagcaaagattgtgccactacactccagcctgggagacagagcgagactcttgtctcaaaaaaaaaaaaaaaaaaaaaaaaaaaaagaaaattatccaagtatgatgatatgcgcctgtagttctagctacttaggaggctgaggtaggaggatggcttgagctcaagagtttgaggctgccagtgagccttgattgcaccactgcattcatgcctgggcaacagagtgagactttcactcaattaaaaaaaaaaaaaaaagcactacttctccaattctagaaatcttaagaaggatcttcaacattttaatactaatattctagctattgatggcctcaaataaatgttactatagaattggggttgttcggccgggtgtagtggctcacgcctgtaatcccagcactttgggaggctgaggcgggtggatcacaaggtcaggagatcgagaccatcctggctaacacagtgaaaccccgtgtctactaaaaatacaaaaaaattagccaggtgtggtggcaggtgcctgtagtcccagctactcaggaggctgaggcaggaaaatggccagaaccaggtaggcagatcttgcagtgagtctaattcgcaccactgcactccagcctgggcgacagagcaagactccgtctcaagaaaagaaagaaaaaacaaaaacaaaacaagaattggggttgttcaatttagcatctctgatcttttccattgattttaatgagatttctattttttaaggtcttttttattgtggtaaactatataacataaaattttttattttcgccattaaatggccagttcagtagcatcaattacatttccattgttgtgcaaccatcaccactgtctatgtccaaactttcattatctcaaactgaacctctctactcattccacaataactccacattcctcctccccactggccattgagaaactaatctattttctgtctcaatgaatttgcctattgtagatattttaatctagagttgtacaatatatgtccttttgtgtcttgccttgtgtggtcactgaaaactttgtaccttagcttgtgtttagatagtgtttgatagagatttccttggataccaagagtgttgggatgaggaagcatgagaggagaaaacttttcctagtgtttgcagattggctttatgctaggattcttcttcaacacttagccatgcttgcattgcttgggatcagccccaaatacaagcttagggtcttctctggtcttttctgagcaagagtcttatcttgagcatgtgtgtggctttctgaattccccctaatttgtgggtgcttttgaatatactaatttcccaaagaaatacgctccccagctactcctaggctttaggcagcctcttgtatgtctcaacagtaatcttttgccctatgcacctgcaggttgttggtctgccttacaaagtttcaagcaacacccatatcttttgtagctggtatgaagttaaacaaaacagagctacgcactttacatcagtccttggttccagacaggttagaatagacatatacaatagtttgcaactaatctacttagctccatgaactaccatgagccagtgtctcacaccgaggatataggccactgcttttgtgattgttgccacgctggggtaggggtgggcaaggacaagtaaagttaccacaaagctttcctgctgtttttcagttggatttttcttgattcaatattttcctgattactgtaaacctttgactattttacagaattctaacaaaattagttctgacaattttgcctgtttttcaatgtttctattaaaggatggaagcttagagctgcctattctgcattttgctgatgtgacttctctttttggcttataagccattaaaatatttatgtcaaggcatataagaattagagatgctgaacaaaaggacttctgaatgaatttatttcagagtaattttccagaacttactggttgttgttgtttttttttctccctatattaggccttcttgtatcatggatgtgtcattacgtagcttctccctttgttgtgacttattaagtcaggtttgccagacagccgtgacttactgtaaggatgctctagaaaaccatcttcatgttattgttggtacacttataccccttgtgtatgagcaggtggaggttcagaaacaggtaattttctgactcatcttcaaaatggtatttaaaatatataaagtattgttagaaggatttgagtgttttatgtttatttggtataattggtgattttattgagaatattttttgtaaaatgattggaaaaatattcttaatgaattaacctttgtaatcaattacagagcacttggtacttttgatagttttatctactgtgctgaagtagagaggtagtcaaaactagggatagcagttcgcaacgttatggtggtatttgagttactacttatataaactgtttcattaatattggcattttttttaacctcagtacccatcttgtagtagtaccttacatagttattgaattatttgaaaacacagaaactaaaagctgggtatcttagacgtaattagaacatttaatctgatctaggttaatagattttatcatttattacagtaagttttgttggcttactttaaaattatttctctccttataattttttctttttaaattatatttaggtattggacttgttgaaatacttagtgatagataacaaggataatgaaaacctctatatcacgattaagcttttagatccttttcctgaccatgttgtttttaaggatttgcgtattactcagcaaaaaatcaaatacagtagaggacccttttcactcttggaggtaataaaaatttcatcatctactattttttattagagaacatagtagtacttttcaaaaatctgtaatgctctagcagtaaaaaatggaatcttttctttaattgtgattaaaaatatatacgtaggccaggcacattggctcatgcctataatctcagcactttgggaggctgaggcaggaggattgcctgagcccaggagttcaagaccagcctgggcaacatggcgaaaccccgtctctacaaaaaattagtcgggcatggtgatatgtgcttgtagaatcagctactcaggtagctgagatggaaggatcacctgagccctggaggtcaaggctgcaataagccaagattgctccactgcattccagcctggatgacagagtgagaccctgtctcaaaaaaaaaaaaaaaaaatatatatatatatatatatatatatgtgtgtgtatataaacacatacttgtgtgtgtgtaacgtgagatctacctacttaagaaataaaaaaatgaatcttaatgtatctctttgcattgaagccaaagtataaataacaaaacttcctggtaaagatccaaattgtaagttttcaaggaatgtgatgtaaaatagttttgattttaacacataagatcctaaggtccactgatagctcaaaactaccaatggatcttttcaatgtcaatttaatgtttgtgttagagataacgtttaacttttgaaagcatattttaagttttaatctttataaacctcgaaattatgtttaggtatattcttccatacatatcttaattataatttttaaatgatagtctgtatttgactctatgtaaatataaaaacatatttaagtatgttaagatgtaaagttatactactaaagagaaatttaagcatttccttccagttgagtatgctataacaatcttgaagtctgtgttaccatgagagagtctattagaatttaaaggattaggctgggtgcagtggctcacgcctgtaatcccagtgctttggaaggctaaggcgggcagatcatctgaggtcaggagttcgagaccagcctggccaacatggcaaaaccccatctctactaaaaatacaaaattagctgggcgtggtggcacattcctgtaaatgccaccttttcaggaggctgagacattagaatcacttgaaccggggaggcggaggtagcagtgagccttgatagcgccactgcactctagccttggtgacagagcgagactctgtctaaaaaagagtattaaaacattgtagggtttgcagtggaagaaatcatttatttcttccttgattagtagtaatagagacatgagtcagtgtctataaatggcacttaactaatttttttcttttattaagttttatttcacaggcttaaccaatacgtgttaaaagcaagttacattttctcttttaggaaattaaccattttctctcagtaagtgtttatgatgcacttccattgacaagacttgaaggactaaaggatcttcgaagacaactggaactacataaagatcagatggtggacattatgagagcttctcagggtgctaattttaaatgacatgggctatttctacctgtttctttttgaaagaatattttgcaaagtcttgctcttggtttcattgtcacagacttagttcagactctcatcatttagttcagaccctcatttctcatctaactgtaaaactggtcctaactggtcttctcaccctgaactcttcctgttttattcatcctctgccagatgatttctctaaacccaaatatgatcatgtttttctactgcctaaattttttttttaagagacagagtttttttttttttttaagagtctcactctgtcacctaggctggagtgtagtggcaccatcataacttactatgaccttgaattcctgggtacaaggaattctcctgtctcagccttctgaatagctggaacaacaggcacacaccactacacctagctactttatttattttttttattttttgtagggacaggggtcccactatgttgcctaggttggtctcgaattcttggcctcaagtgatcctcctgccttagcctcacaaagcattgggattagaggtgtgagccacggcatctagccatgcttaaacatttttcatttctttttctttttttttaagacggagtttcgctcttgttgcccaggctggaatgcagtggcactatcttagctcactgcaacctccacctcctgagctcagattctcgtgcctcagccttcctagtagctaggattacaggcacctgccaccatgcctggctaattttttgtattttttttagtagagacggggtttcaccatgttggccagggtggtctcaaactcctgagctcaggcaatccgcccacctcagcctcccaaagtgctgggattacaggcatgagccaccgcggctggcccatgcttaaacatttttaacaccttccaaccatgtaaaagaaaattttaattccttagagccagacatacaagttagtcttgtcttctagtccagtttacctgaatgaaagaaatatgtctcattttaatactttagtcatatgtgttatgtgtgtctatatatatgtaagtatgtatttgtaagtttttctagcttgcttgttaatttgatttgaaatgtacattattacagtatttgggaaactttctactttgtgttttgattttcatcttcctataccaattaatttcatatttcttttttttttttgaaacgaagtctcactctgtcgcccaggttggagtgcagtggcacagtctcagctcactgcaacctccacctcctgggttcaagtgattctcctgccccagcctcccaaggagcagggattacaggtgtgtgccaccatgcccagctaattttttgtatctttagtagagacggggtttcaccatgttgtccaggctggtcttgaactcctgacctcaagtgatccatctgcctcggcctcccaaagtgctgggattacaggcgtgagccaccacgcctggcctaatttcatatttctcttgtgttgtttttactctcagtactttttaaaatgaattttagttttgactatctgagcatagagtttctaatacatttgagatatataaaatgtatgtaaatagaaacaccattatttcttgtacttgtgttcttgagtattttatgggctagagatctgccttgtgcattacagccactagccatttggctatttaaatgaagtaaaattaaatgaaatttgaagttcagttttttcattggtactgaacacatatcaagttctcagtagtacatttggtcagtagtgatcattggacagtgtagattatagacatttccatcattgcagaaagttctgtgggacagtgctggtctaaactctaaatgttagatgttaaaaagccaagcaggctcccaaagtcccttctagctttagtgttgaatgattcttgtgcttctgtttgtgattttgctaaggtgttgacttatctgcacaatttgtttaagacattttattttctctgttgtcacatattgctaatcactttcaaaagaatctgttgtattaaggaagttcagattcattccctacatattttttgagctactcatgacttaaaaccttttttaaactttatagaagttttctagtcagataatttaatatatatgcaattataaacaaaagtgttgtcttcatgctagtttaaactaatttttaaaaaattatttctagataatccgcaagatgggattatggtgaaactagttgtcaatttgttgcagttatccaagatggcaataaaccacactggtgaaaaagaagttctaggtaaactacagtcatgcgctgcgtgacatttcagtcaactgcggatcacatataggacagattataatactgtatttttactgtatgttttctgttgcctgtagtattcagtatagtaacatgctatacaggtttgtagcctaggtgtgtagtaggctataccatctaggtttgtgtaagtatattctgtgatgttcacgcaatgacagaattgcccaatgacacatttctcagaacatatctgtgtcattaagcaaagcatgattgtattggcggaatgaatgtgagttatgcggtggtcatctttattatatgagtggttatctttattatatcttcaaaataagtgagggtttgtcatttgggatattggggaaatatgagatgctagctaagttacatgcctatttaattaaaatgtccctaaaaaggccccttttgtacttttcttccttaaatattcatataaaatgaaaagttagagatttacatatgtgtataacttaatttgaaaatgccttgtaaatatttaggaaagtcagaaatacttgtttttagagttaagttgcaaataaattgactgccgatatattttataaatacattataactgacaggtactcagtgtcttttgttatgtagcagacataagaatgaagacttggagggctagattaaacttaaataattaaaaaccattcaagtcctttcctacagccatttgaggggaaacctaatgtaaaataagaagccaacatcatctctagtttaggtgtttagatttagtgaccacgggatggagaaatcacctggttaaagtcagcttgaagctctcgtgatggtttttgtttctaattagaaaaataggaataagtagtgtttcacagattctactatctttcttcaacagccttaacttctcattaggagcctaatatctacagtacttccttttttgtagattttaaaaaattgagatatatcctaatatagaaaagtatacagatcaaaaatatctagcttgaagaatgtttgcagagtacgcttgtacatgtagcacccagactaaaaaacagaatcttaccagaactgtagaagttttctttaaccaacatacttacctccttgtccatagtggcactgcttttatggacagacctgatttacaacagaagccctaagtggctttcctgtgtagcataaaattaatgtggtttgttctcacagctttccccctaagatcaggaatgagacaaggctgtccactttcactactgctgttcaacagtgtactggaagttctagccagagcaattaaacaagaaaaagaaattaaaagcatgccaattagaaaggaagtaaaactatctgtatttacagacgacatgatcttatgtatggaaaatcccagagaatccacaagaaagctactgtagtgctaataaatgaatttagcaaagttgcagggtacaagatcaacacataattagtggtgtttgtatatactagcagtgcacaatccagaaagaattagaaaagcaattccatttacgatagcatctaaaagaaataaatagccaggaataaatttaatcaaagaggtgaaaaacttatatacattctgtttgttagacgtgagtcactaagtacagaccacactcaacgggagggaagttaggctctaccctttgaaagaagggctctcaaaaaatttgtgaacatattttagtaaataccatcatgatggaaagagcacgaagagccctctgggttgctgaaaatgtcctgtcttcatctggttagggagaacacaggcagaaaaaaatgtgtatttgtatgtataaattttcattgaactgtgtgtttaagattatggaatttgtgtgatacctcaacaaaaattttaacagttttaaggttgattctctctctctttttttttttttcttttgtcacccaggctagagtgcagtggtgccatcttggctcactgcagcctccgcctcctgggttcaagtgattctcctgcctcagcctcctgagtagctgggattacgggcctgcgccaccacgcctggctaattttgtatttttagtaaagatggggctttaccatgttggccaggctggtctcgaactcctgacctcaggtgatccgcccgcctctgtctcccaaagtgctgggattacagtcgtgagccaccgcactcggccttaaggttaattcttgaagtacagaaaaacagcattatagttttgaaattagaaaatttcagttttatgtatgatctcttacctatgactctactgaaatagaatttctatatgtagaggctgttggaagctgcttgggagaagtgggtcctatagatttctctaccatagctatacaacatagtaaagatgcatcttataccaaggcccttaagttatttgaagataaagaacttcagtggaccttcataatgctgacctacctgaataacacactggtagaagattggtgagtatttattgataccttatatgtaatctcaatatgacattcatggagaatgatacttcacacaaatagatattctcagtaactaaagctttgtccttttttaaatctcagtgtctttatgaaaattcttatatttttattaattcacataattatttaccctactatgtgccagacacttgatataatggtgaacattccagacaaggtccctgttaaaattttagtgggactagacaaataaacgataaataagaaaaatgccagatggttctacacagaaaattaagataggggaatataaagggagatgttttaggctcttgtcagtatcagaggtgccactctcctctaagcgaggccttattttgatccttttaaaataagtcgtaaagcagagaggttgttttataatcctagaagtcttaagctaatcagacagggtcttctattacttattctctgtgcaaagcagaattgcaccacatatcaaaatttcaactggttggttgagattacttttgcgtgcatgctctttctctctcttatttatttgttgattgattgattggtatctttgagtactccatcaccaccatatttgatggtagcctcaaagggttttcctcacaaccaggcacctttctaagataaatacgtgttttgatttttttctgtacttcccttcctccttctcttgaggaataaatgattggcaataatgtctaactgccatgtttccgttattgatttaatgtacctgtatatttctttcttttgttgttgtttttgtttcattaaacaaatttgtatggtttctttccaaacattttattataaaaagtttcaaacatacagcacaatggaaataattttatagtaaacacccatatgcttatcatatagtatctatattttatgctgtccttgcttaatcacttctagccatccgtctatccttgtgttaacatgtattaattcatctctctcttttttttttttttttttttttgagacagggtctcgctctatcacccaggctggagcgcagtggcatgataatacatcatagatcatagctgactgtaaccccaaattcttgggctcaagcagtcctcctgcctcagcctcctaatgtgcaaagtttatgtgcttgagccacaccacactcagccagttcatctcattttttaaatgtatatcaaggtatatcaagcacagtttttgaagagagtgccacagaaaatttgcgagcattaaatgtttcattcatttcatagtaattcgaaattggtttttctgaaacagatgcacagaaatattagtgtgacttcaacttaagaatactaggaagcaggtacaagttttttgtatttttctttaacagggaaaaactttagatcttcaagggactttagcatatgaagatgtggacaaaaggattcccagaatttttattacttatatgtattagaacatattattttcaagtatttcttgagtctttttaatttatagtagtcacaattaaactgtattgaatgaagggaattgcagttgcagtgattagtaattcaagtttactgaatgactagtgaaagtcctttgatacttttatttgatattggagaattttgtaaatgtaaagtttcctaatacaaattttaaattttagttttgaaattttttcagtggaggttaacattcatcaagattaataactggtgtacttgataggcatttgaattgtttttttcagtgtcaaagttcgatcagcagctgttacctgtttgaaaaacattttagccacaaagactggacatagtttctgggagatttataagatgacaacagatccaatgctggcctatctacagccttttagaacatcaagaaaaaaggtctcttaagtaataaatgtttattgaatacccagcatatctaaaacagttctgtttgctgtgggtcatgactgttaaattgcttgaaatagtattgtactaactattaacctttcctataagtaatttaagccatatttcataaatccagggaatgtgttatttttaatttattatggcagtgtggaaaagctcagataggtaacctgaggaaatagtagttgatttttgggggaggggaaattcttaaagacagaccttgtttttttagaaatagaaagcgctactttgctcccatgaaagctgttagctctgggtatggtttatagttattgtgatccacaagtgtttatttccatgtcaagttaacatatcacaatcccctggtgaaatataggaagacccatagatttctccctttttccatgttgatatcgtaataaggttccactgtaagtattctgtgaagcatgtttaagaacacttgttccttccttagtctaagcattcctctttactatcttcttttcataaagtgactgagaaatacacagtttagttttcaccaatttaatttcagggcagaaacccaacattgaagcagtactttcagtgcatcataaatataattttagtgttagtaaaattactggtaatataaactgttaatgaaactaataatataacctggaaggcattataattctaacattttaaaatctcatttcattttgaaatcaagtctctgtggtagatgtggtctagttttgttcaagagacagatgagtcagagtttgtgatttgtgtaatatgctactaatgagtgacagagctgagagtagaacctaatttttctgctgcctaaagcagcagtttttgccataccactctgcctcttgtataaacataaatgttttcatcttaaaaggtaaacattgcctccagatttagttttaactgtatttagctttattcagaaagatttgttatactcattttgtgtaggaaaggtacaatgatttccacttctcttatttacattttctaatccctttctttctagtttttagaagtacccagatttgacaaagaaaacccttttgaaggcctggatgatataaatctgtggattcctctaagtgaaaatcatgacatttggataaagacactgacttgtgcttttttggacagtggaggcacaaaatgtgaaattcttcaattattaaagccaatgtgtgaagtaagaagattaattagtctgatataattccttgtttatgacctgtttatctaaagagtgctgtgatactgcacatcatcttcacataatatcacccccactcaaactgttgtaaatttattaaagtgagcatccgtatttagtcataactttatgcattaggtttcagcttcgggatagcaacatactagaggagttctaaggggtgccttgaataatttgttactaatgatagttaaaatactgctgattataaattatttgcattaaccaagagcctgttctaactttgtttacgtcttctgataagagcacctttattttccctgatatgctttcttgaataagaaaaaggagtggggcagcaatcagcatagcttttttatttttgaggatatagtacaatttatctcaacgaagagtaaaggtacataccaaatgaaacaaagtttgtactcttccatcaaatgtgtaatctaaaacagcatactatgatgctctaagatttacagagttaatttatagcactgtcaaatgtgattcaacagaaatgtgaaaatacaacatctgatgaggtcaaacatctgctgattacagataactgatagagaagtattttcgtaatgtactcacattgaaagcaatgtaagaagcagttcttattttctacagaaaaagtagtgacagtgaataaaacatcaccttctctgcaatactacaccgcactcataccaattcagcagagtggtaccctgaacacacatacagcttatttctcattagtgaacaaagctaagatttttataaagttttacctttgagccagaaaataaaatgttccaaatatacatatgtacacaccccatttgtggtactttaaattctctagctctaaaactggtgttttgccttgtctttggtttgaaaaagaaaaagggtgcaattagtaatctataacctgtcttatgtgtgtgaagtatgatgaatatgatggatatggagtgtaatgattcattcatatgttaaatatggagtgcggtgaatagcaaaagtaaagctgaatactgttttaatgtgccagatgtattggagcacttttctgctctttggaatataccacaaataattacccaaattttatgcccagaagttgggcttattaaaaaataaacatttttaacatgactgttgtagttcttcactgaggttagaaaatgcataaaaatcagatttccaacttttgtcttaaacttttgatacctttttccctcttctatcatatcagaaaactccttctgttactaacgcttttcaactctgaaattgtatttaaagtggtgatataatttcatttgtaagcaatattctgtttcattatggtaatggcctagactggaaataaacagttacagtgtcactaacatatatatttgatattgatatactagcctagtgtggttttttaaacaccacctaatacatgttttttgtttgtttttttagcagtatgttgagtttatggcagattaatctatcatcttttagaaatttaatatgtcaacggggcatgaaaattttaagtaaaatgtattaattttactcatttttactcaaactattgggtggatttgtttgtatattctaggtgaaaactgacttttgtcagactgtacttccatacttgattcatgatattttactccaagatacaaatgaatcatggagaaatctgctttctacacatgttcagggatttttcaccagctgtcttcgacacttctcgcaaacgagccgatccacaacccctgcaaacttggattcaggtattctattaaatttttaacattaatactgtaaactcagttctagagaaagatggatttaagatggaatcccactaaaagcactttacaggattaaatctataacctctaaatttgtttcttcatctatggaatggagataaaagttgccaacagttgcaacaagttttcaatgaaataatgtgtgtaaagtgcctaggatagtacttgatgtatagtattccctcagtacattttggctattgataatgggtcaactaattgagctttcaatatgtgtcaggcactgtgcttgcactggcaatattaatgtgaaaaagaaacacccacattctagcaatggaaaaaacaaacacaatcagatattttaggtactgtggtgcagatacgatagaattttcatattttcagagctctggccaactcaatttaaaaagcagcctttggccgggcacagtggctcacgcctgtaatgccagcactttgggatgccaaggttggtggatcacttcaggtcaggagttcaagaccagcctggccaacgtggtgaaaccccgtccctactaaaaatacaaaaattagccgggcatggtggcaggcgcctataattgcagctacttgggaggctgaggcaggagaatcacttgaactcaggaggtagaggctcctgaggctcactagccaagattacaccactgcattccagactgaacgacacagcgagactgtctaaaaaaagaaaaaaaaccctttgtataactataattaacatttagtgtatatccttctaattgtttaaaacaaaaattgaactgtactttatttactcttataacctactttccttctatgacatataatgggtatttctcatgccaagagcataatagcaaaagaaattccaccaagggttgggtatgtataatacatatatgcatgcttgaaggctcattatgggtcagttttttaaacctaaattttataaaaggatacaaaattcacagatctttattgttaactgtctttattatatattattaatgtgttttatatgcaaacataaagctaggtgcaaattcacttgttgtacttaaagaccaatcaattctaatacaaatgttgatttaatgtgatattttgccacaactaatctgctcctcccaatccttccagtcacttcagcaaaggttgtgattactcagttcttccaattgtttcttttagttttactgctacaaccttcatttgacatgactctaatgtcatttagacttcagtttgctatgctttatattttatgtattttattttctgttggctaacagcaattacaaatctactatttggaaaaatataaattataaacatagacatagatgcccatcctgtgatcctactagattataggctgttctctaaatgatctagaatgtgcttatatgaattttccttaggccactgaaatgaaaatcctaaaataaaaattctcatagaggctttgtaaactatctaaaatgtatctcttatctttaattgggaaaatacaggtataagtgatttaagcatttaaaactttaatatgtaatttacagtactattaaaaacaatttttattacatagtttaaggtaatcattgtttatgataatctggtaatttgttatcatgaacatggccaagacttttttcatgtttatcacttatgtatttatgtcacaaccattggaaggtaaagtaactgttttattttatctgtatacagtgccaatatttttattaccttaagtgaaaatttaaacttcacatataaaattctgttattgaaaaggaaatacatatttttgtaaaatttaaatggtgtatcttttctgatggctataagcctcattgccttcactaaacgtcccatgtgcatctcaaactcagctgtccaaaagcaaacgtgtcatcttcttcatcccttcccccagcctacttttttaaatgtgtacctttttgacaaatggcactcagttgcttactctagaaacctctctcacgtatttcatctgattaccaaatcttgccaattccatattatgaataacttagtccatttgtttctctctgcccttagcatccttactgctttctagctccatgatttagcacagttgaaattctttcattaaattttccaagttatttcttgcttccagccatctcagatattattattattgcctgtagcactatcctttcctgctctgatgactattactcttctttcagatatcactttttcttttttcttttttttttttctttttttctcttgagacagagtctcgctgtgtcacccaggctggagtgcagtggtgcaatctcggctcactgcaacctctgcccctcaggatcaagcaattcccgtgcctcagcctcctgaatagctgggattacagatgtgtgccagcatgccctgctaatttttgtgtttttaatagagatagggtttcaccatgttggccaggctggtctcaaacttggcctcaagtgatccgtccgcatcagcctcccaaagtgctgggattacaggcatgagccattgcacttggccagtatcactttttctatgaaacttttcttgtctaggtgaggttccctctgctaagcttctgtagcattttaaactttcctattataacacttatcatattgtgttgtaatgtcccaggctagtcagtgagttctgtgtggtctgacatgatctgtcttgttcatgcttatatactgaggacctagcacataaaagatcttattgaatcaattaattagtcctcctttgaaataaaatataaattacaatgtaagttctcactttttttaagataacagtttcttttaaaagcaaaagaaatcctattaaattccttcagaaccaattttgtgttaggtactgcccaccagaaccttatagcatagtgggagacagacacataaacaagaaggaagaaggtgtgtaagcaagaatgcctgggactgaggggagatatttttgtttgtcagagtcagagcactttttccgatgctgtttggataaaaaatcacaaagaacaatgcttgctgttgtggactacatgagaagacaaaagaggtaatgtaatgagtgttgcttcttacgtttaggatctagagtgtaacttgttaactatcggctgaattttaacatgattattttaggtgaaggtgttgcaaagtgttatatttaatttgtgtgatatttatatctccttgcagtaatccatattcaggatagcagtttggttaaatcagtgtcaagaactctcaattctagtaccagctgtaccagtaaccatgttacctttgttaaattatgcagccttcttggctccaatttatttcatctatgttagggataggagcaagtgtttttccaagttacatttagctgtattacccctctttttacttttctctttgctttagttctaagaagtaaatagagttgtgtaaatgtcttctttatgtatctttattttaagatgtaagtttctttactgtgtgcagtggtctcaaaatctgtggcaatactgtgctgtgacaatgtttattttcttgtttctggtaaattgttttatagtatagtatctttgttcctgttatttctcatgagatttttaacagtgcatacagaaattgctagaatggatggtctgactgatgagtactgcttgagagttgaccagaactctgaagaaatagtgtagtaggcctataatttgaataggtaggaatcgatgtctcataagtgtgtatggtggtggtaggggtggttggtaaagaatgagagggagaggtgagtgaaaaatgaaatgtttttaagcctaaatgcattaatatcttaaaaaattaattcctatgtagtcttaaaccattcttcttctctagtagaaaaagaagttttatgcttttcagtgtctttgcttctggttattttaccttagagttttataccagattatcttctgaggaggcctatcagaagctttaatgtagtggagagcatttgttttcttggtgttgggaggcagttttacctttgagtcattcatttcagacttaccattggggtagaatggtgttgacattagcaggagttggagaagataaaaattcttcatattccattttaatgctgaataagatcctgaagaatattcctggagaaagtatgaatgggatatagaaaaacgggtaaagacatgcattcaagtccaagcttgtgctgtgtaaaaattacttgttatcctgtacagtatgttgggcaaaaacaaagaacaacaataaaacaacaacaacaaaaaaattgcttgctgtctttgaacctcagtcttatcatctttcaaaatcagaataatgtctgtagtgtcttcctttccatggggaaattatttcacttctctgaacttaacattcatcggaaaattaactttagttgagtgcttgctgtgtagtagggtgtgccttattcatcagctttgcaggcattatttaattgttgcacccattctccaaggtccatgttgttccagcatttgcaagtaaggaaactaggaaactgaggtttaagaagttaagttgctgaagatcacacagctggtagtaggcaatatagctagatttgaacctacctgtattgtacttcaacactagtgctcttaagcactaccatgtcccatctctacaatgctagttttgaaaaagatactatctatggtccctttcaatcttgacctacctattaacacagtggaagatttttattaagtaactcaacctaggcaatacattaaggagaaaataagtcacaataggaaagacatgtatttgtgtcttagatgaaacaatattttttattaaattgactgttttaaagtgtgtgttggggggtgcttgtgtgcatttgtattagctattctgtgtatcctattcttagtctgtggtacatggatttcttggtagagagcagatatgaaccccaattttgtatcaggtgatagtctacaggttttatcagattctctgataggtttgagggaaaaaagaaaaaccaaaaagattaattaaataggactcttcagccatgttatcttataatgtttataggtatatattggggaaatgtggtttttgggaatttgtaattttctgttaagcagtcactaccattgtattctatatcaacatgcttttattttgatattgaagtttaaaaaagtgaatgacattatatctcatttttctttagaccttcttcaggaacaatttttaatgatgctttctggctggatttaaattatctagaagttgccaaggtagctcagtcttgtgctgctcactttacagctttactctatgcagaaatctatgcagataagaaaagtatggatgatcaagagaaaaggtaatggaatttagaatttttggtttttaaaattaatgttggcattgtctcaataagggtatatagtaaagatttattttgcctcctgttccccatttaaaagatattttagatagaaattttgttttaaagtgaaattataataaatttttaaaaaggaatatgtaattcctgttctgaaataataggaatgcttattacttaggtattataaaaatttaacagatagcaaattcctataggacagagtccatacttaattttctgtatattccccataatagccctagcattgagaacttaatttaagggtgataaatatttttcaaatgattaaattatttcctaacttcagtcagattagatttaccactaatttctaaactattcaagattcattttggatataaaatatccaaaattataatccaaaatggctataatgtgactgatttatttctgtgactaattaagtttcatttctttatctacctatatttctagtgaatttaattcgctttcctctgactgagttagaactgtcataagaatctaataaatatactcctagatcatggggaagaacaaaaaataagaaagtaagagtaaaaaataaagtaaaacactttattatcccaactgctcttttcaaatgtttgttcgtttgaaatggcctgggtctcattatttcgcccaggctgtggtgcagtggtgcgatcatagctcactgtagccttgatcttccgggctcaagtgatcctcctgcctcagcctccaagtagctgggactataggcacacaccactgcatccaactcattttttttaatttttatttttaatagagacaagatcttgctatgttgctcaggctggtcccaagctcctacgttcaagcagtcctcccacctcagcctttcaaagtgctgggattacaagcatgagccgctgcacctggtcccaaattgttttttaaagcggttatacccatttgtgtacagaaatgtagttgataaggaagtggatcggtaggaagccttatatttgaagaagggtgccaaagtataactgttcctagtttagttaaaaaagtaaagaaggttgggcacagtggctcacgcatgtaatcccagcactttgggaggccaaagtgagaggattacttgtgaccaggagactgagaccagcttgggcaacatagtgagacctcagctctactaaaaataaaaataaatcagctgggcatagtggcctgcacatgtagtcccagcaactcaggaggctgagggaggaggatcgcttgagcccaggagggagaggctgcagtgagccatgattgtgccactgcactccagcctaggcgacagagcgagaccctatctcataaacaaaaaaaaaaaaattaagaaactggaatatgtatataggtaaatattagaggcagtatcacttatgatagtatttattttatgtactagattattactgttatagacaccacagctgtcatggttttagaattgaagttacttacagaactgaatgttatatgtataaaatgcataaagttaaggccttgaagtaggcaaatctgagttctaatcctgactgtcaaactttctagttttatagtcttggtttaagtggatcctactgatctacttccttttcaatagttaatatcagatgtcttaaatttatatctgttaagtattaaattctgtcttattgtggtctttatttgtgtgtctgtaattattgattgggttgaatttcaggtgaaaccactgacagagtatatagtacctgaattggatggcatctgctctatttttaaacaatccaatctctttataaataatcatatttttgcatataggcttcccatatgtagattattcttaaaatataattttcattcacaaattccttttccatcctaggtataaatggtattatgttttaaagtataagtgatttattctgttttgtttgccaccttcattagtttttttctgtcaaagtctatagtatatgtattcaggagcttccaaatagtatgttctcattaaaagaggtgttcttgtgacaaacagaagtcttgcatttgaagaaggaagccagagtacaactatttctagcttgagtgaaaaaagtaaagaagaaactggaataagtttacaggtaaatattagaggctctattatttatgacagtatttatctcatactttgggttattttgttatagacactgtacagatgccatgtgatttttaaactgaatttacttactggactaagcatcatatatataaaattatggtctgaagcttaagccttagagtagacagacttgagttctaatactgactctgccacttcttgagttccttatctgaaagacgaaggtaaaaccacctgtctcagagtttatgccatgcattttctgccatagcaccctgttcatttcctttatagcacttagggtttataattatatatttatttgtttgcttgtttattgtatgttacagaagaagcagattgcctcttctataaatttcttgatatccattcttaaattggctcatgttactgtctgggatgcttgccgaatttctttggtcaactcattcctccacaatgacaatttcagcttctccattctgcttaaacctctcatcttctcttctatgccgctgctttcagcctgcctcctacttggagaaaatagaaggcatagagaggaaatctcgccacatcccactctcaaacattgaaatctcctggcatctcctcctttaataatcttccgtcatgttacagaaacagtttatccttctatttgagactaattcttcctgtgctttgtttttttatctgctctttctcaggtgctttattttttaatatgctgttctccctctgaactatgttctgaacattttaaaacctctcctgtttaaaaattccctttctcacaaagacaaaataatttccctcttccctatgttctcttttaggtatcaccctctctcttccttcctctcacagacaaactttgtgaaagagttgtccatatttgctgtctgcatttcccccccttccatttattccagtaaaatagcacttgctaatgtctctcataaacttcatgttgctaagtctggtggtcacctttcattcttccttttccttaatgttttattaatacttcacatcatcaaccatgccttgcttgaactgtgttctgtttacctttttgatccactctcctgatttttctcctttcacttttgccttcttcataggctcctcctctctactgagtttttggaatatcgtgtgtgtactaagcactgtgctaagcatgggtactgaacttttctactctgaggacttgatttcacgttatgaatagaaacatttgagttggaactatagaattatgccaatataaatgaatttgtgtgtagaaaatatttcacagagcaagcaccatataggcagttcaattgcttgatcaattttctatgcagtatagttcctagttttttctattttattttttttatgttttcatttttatttaactgagattgttttaaacagaatatatcttttctgtgtaaattttacaacaaagatttcagtaaccaaactactttatccatatcaaattttaccaattccaatacagttttgtgctatttttcaaagaaaaatccacgacctttattcttaccaaattgagttttcaagagtcagactttgtaggactgtattttctaatgtacagtttttttgtttttttttccagacaggatctggctctgttgcccaggctggagtgcagtggtgcagtcataacacactgcaagctctgcctcccaggctcaagccatcctccaacctcagcctcacaagtagctgggactacaggcatgccccaccatctccagctaatttttgtagagatgggtttagccatgttgcccaggccgatcttgaattcctgagctcaagcagtctgcctgccttggctacccaaagtactgggattaaagatgtgagccactgcacccagcccatgtacagttttaggtgttgacaagattgtttggttttgtttgtgtgatttttttttttttatgtgatataagcctggtaggtcggtacttatttcttatctaattcatgaaattgtaggcaattcttctcgggtagactacagtcctcctgttgtctaggaccagtctactgtgttgctgatccaaatcattagtatatacagttgacccttgaacagtgtaagggttagaggtgctaaccccctgtgctattaaaaatcagggtaaaactaaattagtagtcaaaagttaactactaatagtctactgttgaccagaagccctaccgatgatataaacaacacaattttgtatatgtattatatactgtattcttaaataaagtagcttgagaaaagaaaatgttattgagaaaatgataaggaagagaaaatgcatttacagaactgtactgtgtttatcaataccgtaagtttatatcatctgtttacaaagaatcatctgtctgaaattgtaggcaaccactgctggttgatatgtactttaggcctcaatctacagaatgtatcaaacaattcacctttttcttgtaatggcatgacttttctctgcatcttggaagcacctccagccactgtggtgttaatcaaggcttatagtattgcagtaaacacagtgaaaaaatacatgagaacctggagagattacttttcatttctggatacaatttactagagaaatgaactgctcatgtggaaattattagtgtcacatggcattttaagcagatactcacaacacaataatgcttaccacagtagcaactgaggtagctgcaaaattattacaatagtacaatatgtacgatagttaatcttatgcaattatgatttaatactgcatctttacatttgtttatatttgtcttaaccacaaataatgctgtgtacagtgtgtgtgtgtaagttttgataaattttaactctttgtaatagatttgtgtatattttatggtagtaaatgatgaaatgtatcatatcaaatgtatacaaatgatggaatgtgtagactagttgtacatttattttatgcattcatgacataacttttaaaaaatttttcagtagttctaaactgtgtggtttgtgaattttttcaaattgtggcaaacctccaaaaagttttcaatatatttattgaaaaaaaaatccacatataagttgtcctgcacagttcaaactcgtgttgtttgaactgtatttcagaactgtatttcagaatcattacattttatttctataacataacatttagagttgggagttacatattggtaatgatacaatttaaaatttgctaaatttatagaccgattttttttccttcttcaatttttgttgtttccatgttttcaggatcttctcttagaaatctacagaagtataggggagccagatagtttgtatggctgtggtggagggaagatgttacaacccattactaggtaaattgcatttttctaaacaacggtatagtaattctgtttatgaaggagttatgtgtgtgtaaaacccaaagctattttcacaatcttttcttatagactacgaacatatgaacacgaagcaatgtggggcaaagccctagtaacatatgacctcgaaacagcaatcccctcatcaacacgccaggcaggaatcattcaggtacattttttcccagatttggtaaagccatcactagtgtagtgctgaggttatttcagtatgttggtggatatttacacagccagataaactctagagataagactagaacttatctgtttttcagaggattaggctaaacattcagggatactcctgaagcagagggatgcaaaaaaaagagaaaaaattcagggagacacaggaaagtcagacaggtcattgacctaaaagatagtgtagatttcttgatcatagtgttgttggataacaacagaagacattgctcgagcatatacaatgtgccaggtagtgtacttactgcttcacatggaaaatcttatgtaaactatttctcatagtttgcaacagagttggtcccagaacctgttgtttctattactggctaatactccttagccattcttccatgaaatattagagccctttgagctctatttttgtgttttttgggaaacattaaacgatattttgggattaaaaaaatgtttttggccaggcgtggtggcttgcgcctgtaatcccagcactttgggaggccgaggcgagcagatcacgaggtcaggaggtccagaccatcctggctaacacggtgaaaccccgtctctactaaaaatacaaaaaaaaaaaaaaaaaaaaaaattagccgggtgtggtggcgggtgcctgtaggcccagctacttgggaggctgaggcaggagaatggcgtgaacctgggaggcagaggttgcagtgagccgagatcgcgccactgcactccagcctgggcaatagagcgagactccatctcaaaaataaataaataaataaattttagagataaggtgtcaccctgttactgatgctggagtgcattagcgtgatcatagttcactgcagccttgacctccctggctcaagggcacctctcgcttcagccacccaagtagctggggctacaggtacacactaccatacccagctattttaaaaaaaaaaaaaaattgtagagacaggtcttggtttgttgtccaggctggtctcaaactcctgggctcaagtgatcctcctgcctcagcctcccaaagtgctgagattacaggcatgagccaccacacccagctgatattttgggattttaaatgatattgtgaactaaaatttgtctaagttaatttgtatctttgctgtttttttctctggttttctgttgatatctttgattacttaacttaaaaacaaaataactcctgtttaggccttgcagaatttgggactctgccatattctttccgtctatttaaaaggattggattatgaaaataaagactggtgtcctgaactagaagaacttcattaccaagcagcatggaggaatatgcagtgggaccattgcacttccgtcaggtaagaaatttgacttgatttttttttttttgcctctctcctcattctaaacaacaactgtttttctcttctatgaatataacaggagttgttttatatatatatatatatatatatatatatatatatatacacacacacacacacacacactatatatatatacataccatatatatagtgtgtatgtgtgtatatatatataaaaaaatatatagtagatgttgcaagctatagatagccctaaatccttcagtaagatagcaataagcagttaatgcacctaggcttgaattttactctcttattccattaggacaacttcaccccacccctaaatatttctaaaaacagaaatatgaaaagggttttcgaaatgagtatcatctcgcatagtttgttggactgaggcatgccaagaaaagtataggcattcctctttctacttcctgctacaaacattttagtcagtaagatagcacttatattggctggaggatccacaaaggactgcttatctttatttatgaaatattttcttttattaaaaaataatacggccaggcacggtggctcatgcctataatcctagcactttgggaggccaaggcgggtggatcgcctgagctcaggagtttgagaccagcctgggaaacacggtgaaaccctttctctactaaaatacaaaaaattagccaggcgtggcagcatgcgcctgtagtcccagctacttgggagcctgaggcaggagaattgctagaacacgggagacggaggttgcagtgagctgagatagcaccactgcactccagcctggacaacagagcgagactctgtctctaaaaaaataaataaaataaaaaaaataatatgcctactcagggctgggcacagtgtggtggctcacacctgtaatcccagcacttggagagctgaggcagatggatcacttgagatcaggagtttgagaccagccgggccaacatggtgaaactccatctctactaaaaatgcaaaaattagctgggtgtgctggagcatgcctgtaatccaagctactcgggaggctgaggcaggagaatgcttgaacttgggaagcagaggttgcagtgagccaagattgcaccactgcaccccagcctgggcgacagagtgagactctgtctcaaaaaaacaaaaaaaacactcagttacccaggaagataacatttataatctgtatataaggtcaccatgttttctgaatgaaaagccaagcacctaatctaataaaggatttcatatttatgtaaagttttttgataatgtaaaccctaaaaaattaattatgtttaagtatgttttgttgcctttgtagaaaaaaaaaattattggccgagcgcggtggctcatgcctataatcccagcactttggaaggctgaggagggtggatcacatgaggttaggaattcaagacaagcttgggcaacatggtgaaaccccatctctacaaaaaaatacaaaagttagctgggcaaggtagcatgcatctgtagtcccagctgcttgggaggctgaggtgaggggatcccttgagcccaggaggtggaggttgcagtgagccgagatcatgccactgcactccatcctaggcaacagagtgagactctgtctcaaaaaataataattattggaatgcctttcaaatatttcagactgtaagactgctataaaattagagatatatcctcatattttaaaaaccttttcctgtgcgagttgattcttgcttgcctctgtaaatcaatatatactattcttctccttcctcttgtatttcagctacacagacctctctgtgttttcttgtcaggccaagctgtttctatccaagggccttagatgtatcttctccttttcccccagttaccatgcgggtggcttcttttcattcggaccctagttaaataataatgtatcttcagagaggcctttcttgattacccattctataatagccatctagccattttgttttgttaccctgttttaattctctgcatgtcccttgttactttccaatacttatttattgtctgttcctccaaaccagcacataaattccatgagagtaaagacctgatctgacttgtccacttgtgaattccccttgtgcctagtgcctggcacataataggtatttattgaataaataaatgaaagtagagcatatttagaaccaggcagagtatctgagtaatttcctttttttctgcttaaagaatttaaatgactcataaaatttgtatttcttaccaaaaattctagaaatgcattttttagaatggagaaatgttaatttaaaaattttgtcctttggtgaagctatttatacatgtatatcttagggttctgtttttaagtatatttttttctttgacttatctcacagcaaagaagtagaaggaaccagttaccatgaatcattgtacaatgctctacaatctctaagagacagagaattctctacattttatgaaagtctcaaatatgccaggtattatgaaaagacaaagttactgtattttaacatttaatgtcatggcttcttttctgaaaacttgagaaacaattttaatgtaaggatttgcattgatgaagagataaagacttggtggctgtgatcagatgtttccttgtaattctctgccctccttcaaaacaaattgtttctgggattccaggttcattctttaccctgacccttcaagaaagttttggtgattccctctttgttctcttcctatacaagtatcctgagaattatatcttgtctcttttggtaattgtatggcatttagtgttctaatttataaaattgtaactcacggttaatacttacaaacttgttttgaggcacaaatgtgatgaggcatgaggaaataattataatggggtaaacaaatgcagcatttttaaagccgtagtgacttaataaatcctatgtttatcacagaaataaaatttactatcatttaagtgcctatgatatgctagccactgttagactcttttcatatgtattctctaatcatgacaataactatggatgtgaaaaaaggcttagagaagtccagtaacatgcccaaagttacacagctataagtgacagaactgcaatttagatctaggtctgtgtgattccaaggtttacagttgatccttgaaccacttggaggttaggagtgctgagcccctcctcctcacacatttgaaaatgtgagtattactttgactcctcaaaagcttaactactaatagcttactgttaaccagaagccttaccaataacataagcagtagattaacacatattttgtataagtattataataccatattcttacaataaagtaagctagagaaaagaaaatgttattgaaaattataaggaagagaacatatatttactagtaagtggaagtgggtcatcataaaggtcttcatccttgccaccttcatgttgagtaggataaggaggaagggttggtcttgctatctcaggggtggcaaggtgggagaaactctgagtgtaagtggaccatgcatttaaatttgtgttgttcaagggtcagttgtattttgtttccactgctattttgtattcactgttgcttgttagtattattagatcagtagcaaagcctatgatgagaactctttaacaacaaatttaaacatttatttccctgaaaacctcttctttattttcagagtgtcttttcttttttgctactagagtaaaagaagtggaagagatgtgtaagcgcagccttgagtctgtgtattcgctctatcccacacttagcaggttgcaggccattggagagctggaaagcattggggagcttttctcaaggtatgtaattcgtatgactttgttatcctaaagtgcagcttttctgttaccaatagtgactttaaaaaataaaaactataggccgggcacggtggctcatgcctgtaatcctagcactttagaaggctgaagtgggtggatcacttgaggtcaggagttcaagaccagcctggccaacatggtgaaaccctatctctactaaaaatacaaaaattagccaggtatggtggtgggcgcctgtaatctcagctattcaggaggctgaggcaggaaaattgcttgaacccagcacaacaggcagaggttgtggtgagccgagattgcgccatggattccagcctgggcaacagagcgagactctgtctcaaaaaaaaaaaaaactatgtagagaccaaatgtgtgtgtttctttccttttatcaagatataagttgattagccctagtgaattgtgcttttattaaacattttccaaaatagtcattgtaaaaatttaagttttaaaaattcagcttaagtgtgcttttctctttataactttttccctggcctaccaagataaaattgtttcctcatgtttttgcatagcatgataacactccattcagttttagcactacattgtattactgtcattttatctctgccttgctaaactagaagctcccttaaaagtgggaaccattctattgtttattgttgtatacctagtgtttttgttttgttttcttttttttctttttatgtttttttgagaccaagtctcgctctgttgcccaggctggagtgtcatggtataatctcagctcactgcagtctccacctcccaggttcaagcgattctcctgcctcagcctcccgagtagctgggattataggtgccccgacaatgcctggctaatttttctacttttaatagagacggggtttcgccttgttggtcagcctggcctcgaactcctgacctcaggtgatccacccgcttcagcctcccaaagtgctgggattgcaggcgttagccaccatgcccggcccccaatgttttctcttctggtgactgataattatgtttagtaaacattcagtggatagtggatgtcagttaatttgtaaaaggtgttcagaaggaattgcttcttataatggtgagagggaaatgatccagggattttggaagatgaaatagtatagttactcaggatgctgtagatctaaattctttccttttatcaagatataagttgattagccctagagaattgtgcttttattaaacattttccaaaatagtcactgtaaaaattcaagtttaaaaaattcagcttaaaagtgcttttctctttataactttttccctggcccacccagataaaattgtttcctcatgtttttgcacagcatgttacactccattcggttttagcactgcattgcattactgtcattttatctctgccttgctactagataaaagaagtggaagagttgtgtaagggcagccttgagtctggcaggatgacaaagtaaagtgttttgggtcctcagtttcctcatttctaaagtcagggatttgtattcgatggtctctaaagccccttttagccctgctattttgaattactattattattatacgagggaagaaagaggatataaatgactaaggtcactctacctttatgcaaaaataaaatttggaatatgttttggaagtagaaaagagaaggaaattttagagtcagaagaaaataataatagttttttcaaaatgacatagcagaagacatacatattaatgtggcttaggaggaaaataaaggaacaaaagtcttttctgctttcattcataagtacattggcagtacttactgccagaaatcaagaaatttttcctctgaatgaaagattatcctgctgaaaagagtacagaattctttaagaaacagtgaatagaatggtagtaaccagaggcagggaagggtgttgtggagggagaggatgaagaggggctggttaatgagtgaaaaaacacaggtaaatagaagaaataagatctagtgtttgatagcacaatagggcaactgtagttaacagtaatttactgtatatttttaaatagctacaaaagaagatttggaatgtttccaacacaaatgataaatgtttgagatcatggatatctcaattacccaaatttgatcattacacattgtatgcttgtatcaaaatatcacacgtacctcataaatatgtacaactattatgtatccataaaaattaaaaataaattttaaaaagaaacacctaaagaataatctggctgtttctttggtagagaaataggaagaagagaagcagagggaaggttggatgaactggtgcacaaatgcttatgctctcagattacattccattcatatacatcaaccaaaacattaaataataacaaactaaatgcagaagcagagataagaattcatctcgttctgttaatccagacattaaagagatttgcaaaaatgcaaaacagtgccatgctcactaagttttgttttgttttgggaagtatacagttgaaattctttatctacaggtttccatctatggattcaaccaaccgcagatcaaaaatatttgaaaaaaaaattttaaagaatagggtataacacttatttacatagcatttacattatagtaggtataatatgtaattagagatttatgtataacctgtgcacattctcctattacacgtaatctagaggttatgtgtaatactttttggaaatgtttaataaaagcacaatctagaggttacgtgtaataggaaaatgccctgccattttaaataagggactttgaacatcagcattatcaaggtgtcttggaaccaattttctgcagatacagagaaactactgtagttatttttcctaaaaattgttatttatgatatatagtagatttattatttttgaataaattaatacattttagatttttctcagtctttctaatatgatatcatatctaatatcagtagatatggtccaacgatcgaaagttctttggggtcttcaataatttgtttgattgtaaaggagttccgcaaaaagtttgagacctgctgtggtagggtcatttagagaggaattgaagttttggttcctagcatttttgttactgttccttccctatcaagcaactaaaagagctttcatttcttagtcatcactttgtcatcttactctccctgcttcctctttcttatttctttcaataaatgtccctgaaggattgggtagtatttcatagttcagttatttgggaaggatactattcatataaactaattgtgcaatatgccttttctgttcctttaataatgttggtaaatgaaacctttgccagatgccagcttttccttcactggattgtgatttttttgacagctataattatgcatcaagtcatccccagtagggggtccctcatttccttgctgacatgtcctcattactacaggcagtattgaagcaggactaaagatggaggcattctttatgataggtctgatgaatatgttcttgtttcagaagagtatttagaagggctgctttttgtaatgtcagagtattaaaaattttttttgatgtttgtcatctgtgacctctctgctaataactcttaagagctctgaccgcatagcattttgtagttttctaaattttgatccatatgtaggattatttacaagttctagtcttgtcactacaaaagttcctttgtattattataatattatatcgtaagttccagaacttacatagtttttttttttttttttttcatttctcttgcttacatgaactctatgtcgtggcattcagatcagtcacacatagacaactctctgaagtatatattaagtggcagaaacactcccagcttctcaaggacagtgattttagttttcaggagcctatcatggctctacgcacagtcattttggagatcctgatggaaaaggaaatggacaactcacaaagagaatgtattaaggacattctcaccaaacaccttgtagaactctctatactggccagaactttcaagaacactcaggtaaatacaatttaaaactatgtcatcttacctcttgactttccttttattatttaaaaaacagaaagcctgagggaaaaagaaatgtcattaagagatagagatctctattaatatatagtaaaaataattgtttaagagttcccattttggaattagatctgacttttaagccttgggcaagggtacttaatcttttctcaacctcaatttcctggttataaaatgagaagatacgtaacttactatattgataacaattcagtgattttatatactgtgtgtatgtacacacagatacacatacatacatatagagagagacagacagacagacagataggcagacgtggggtggggagatgtcatgcagacagagaggtccttaagatagtccctgacaagtagttaagtcctcaatgaatggtagttgctgctttcattattattattattcatggtagtagtatcagtagtaaaagtatttattcccatatgtcattttcatttcagctccctgaaagggcaatatttcaaattaaacagtacaattcagttagctgtggagtctctgagtggcagctggaagaagcacaagtattctgggcaaaaaaggagcagagtcttgccctgagtattctcaagcaaatgatcaagaagttggatgccagctgtgcagcggtttgttttttttattggctggattagtgttttactgttatttaaaaaaacacaaatgtactttaaaatatttttaataacaattttattagagccttgaaattagtaatttattaacaagatattgtaaaactagtcttgaaaattaatttgtaaatgaagtttagaaactttttcctatatatcacaattctatcagtccatcatgtggtcgattcatttaatatatcccagtattaagcctttaacttcctatagaattcaagaaaggtatgtgggaaatgaatgaaatagctactctaaatttgaaatgacaagtgaaaaaagggaagaggaaatgaatgagagaactaaattagaaaataaaagcaagttgggacaattaggttgtcaatccaaatgctttgaaaatatcacatctaatattttatctaacattacctgttggtttttgcaaacttatgttgctacttcagctgtaaacccagcatacacactggataaagtagaggcattggtgtccccaaggtttgtctacagtggtgtcccacagacatgtacctgcttagtgaatatcagctcactgtgctttattatttatttatttatttattttttgagacggagtcttgctctgtcacccaggctggagtgcagtggtacgacatcggctcaccgcaacctccacctccctggttcaagcaattcccctgcctcagcctcccttgtagctgggattacaggcacatgccaccatgcccagctaatttttttgtatttttagtagagatggggtttcaccatgttggcaagactggtctcgaactcctgagctcaggcaatctacccgccttgtcctctgaaagtgctgggattacaggcgtgagccaccacgcccggcctttactgtactttttgatgttgggcactcattgtatagcatcttctgttattagagaaatcattataccaaagcactgagtgccaatatgatatgtgtaaatattgcttaatagtattggccctgaagtatgtgctgtctggagttacccaacttccttgtacctcagttttctaatctgcaaattggggtaataatagtacttatttaataggattcttgtgagaattaaatgagttaatatatataaagcctttacaaagtgtctgacatatataagtactcaataaatgtgacttgctccaataatggcaataataataataaacagaggatgatcatttcctacatgggattattaaaatagttgtatggcaaaagcagatgaggaaaaactttttttttcccacccaccaaggaaaaacatttttaacctgcttttttccccgtacatgaagggcagttgggtacagtcatggtaatgcattatattttaagattttgcctttcttatacagaacaatcccagcctaaaacttacatacacagaatgtctgagggtttgtggcaactggttagcagaaacgtgcttagaaaatcctgcggtcatcatgcagacctatctagaaaaggtaagatttttggagcaacccttaagatagttacttagcatgaatatgcttcatcttttcatcaagatcaatatatttccaaagcaaataaaagtatggttttatttttctatatattattactgttgtagctctgtatagtctctagggtggagtgaaacattgttacaaaacaaagcagccaattttgaaagtaagcccaagtatagtatctcttcttcctccttcctacctccactaccagctaccctttcagcaggttgcttctgatcatttcttcatttatgcatctacaaaaataactgattaagaataggcaagtcagcccttgctcttcattagcccagccacccacaagtaaaggcttcaatatactagcccctttgactttcctgtttctccctcttattcctttagattcactaattttggaaatagttacctcactaaataagtgtaacatgaaacacatgatgcgattgtctttcttttcttttcttttctttgagatgaagtctctctctgtcgcccaagctggagtgcagtggcgcaatctcggctcactgcaacctctgcctcctgggttcaagcgattctcctgcctcagcttcccaagtagctgggactacaggagtgtgccaccacacccggctaatattttttatttttagtagagacggtttcgccacattggccagtctggtctcgaactcctgacctcaagtgatccacctgcctcggcctcccaaagtgctggcattacaggcttgagccaccacacccagcctgattgtctttaaattttataaagttctctgtttttgcagagttctttacaagtattagctgtctgggttatttctacactgtcaaagttgttttgaaaagtcaagaaaataccatagttcagggctgtccaatcttttggcttccctgggccacattgcaagaagaattgccttgggccacacataaaatatactaacattaatgatagctaatgagcttaaaaaaaatcacaaaagaaatctcataatgttttaagaaaatgtacgaatttgtgttgggccacattcaaagccgtcctgggccacatgcggcccatgggccgtgggttggacaagtttgcaatagttcatataatttagctagcttttatatgtatataagttaaattttagtgtattaccttaatttgagtgattctttagatgtatttagtatttgtaaatataatttaaattggttgtgttttcttgaaggcagtagaagttgctggaaattatgatggagaaagtagtgatgagctaagaaatggaaaaatgaaggcatttctctcattagcccggttttcagatactcaataccaaagaattgaaaactacatgaaatcatcggaatttgaaaacaagcaagctctcctgaaaagagccaaagaggaagtaggtctccttagggaacataaaattcagacaaacaggtaactaggtttctacaagtgacaattttatgttcaccagttaactgagtgagtgtttttgcatagaaagagtgacttggtctttttatctgatatagttttgagctctaaaggtcggcttaactatatatagattatcttggtcttttgggttcttttcggtttttgttttttgtttttttttttgagacaaggtctcactctgtcacccaggctggagtacagtggcgtgatcactgtactccagctcactgcaacctcgacctcctggactcaattgattctccccctgagcccccgaaatagctggggctacaggtgcacgccatacctggctaatttttgtattttttgtagagatggggttttgccatgttgcccaggttggtctcaaactcatgggctcaaacgatctgcccaccttggccgcccaaagtgctgggattacaggtgtgaggcactgtgccctgtctgtcttggtcctactgtagttaatcacaaattagtatgtaagatattgacgtgttcttttgtgaataattcatgctctgcttctaagttcattgtggagaatatagatattagctttctgttttgcttttttggtttgtttgttggtatcatagtggaaaaggagatagatattgaaattaattacaaaagttacctattttgatgtaattaaatccctttatttaagcctgtcttgaatctgtatattttagtgtaagcagaggtgtaagttagctaaatagcttggggagagtcccctttgtcctttgatgcttaggaaggtgtgtgaattgcacagttaagacaaaagtaagtttattccctttataatccttagaagtttgcttttttccctgggataaaaacccaacttttttcattaaatgttgtatatcatgtgtgattttgtagttctgttaaagttcatggcttttgtgttttaccttaattattctatgcaagatacacagtaaaggttcagcgagagctggagttggatgaattagccctgcgtgcactgaaagaggatcgtaaacgcttcttatgtaaagcagttgaaaattatatcaactgcttattaagtggagaagaacatgatatgtgggtattccgactttgttccctctggcttgaaaattctggagtttctgaagtcaatggcatgatgaaggcaagtgttactcagcccaatattctaccctgtgcttgaaaaacttagacataagccccttgatgtcaggaatcgtgtatacctctttgtattcctagcacttggtccagtgctctacacataagtagcattttgtagttttctaaactttgatccatatttaggattatttacaagttctagtcttgtttctacaaaagttcctttgtattatataagctgacaagctgtaaatgatgcaagtttgtgtggaggtgatagaatttagcttggtcctatgtctttgcagttaccataggagagggtctagaatggggcattagattggaggatttagaaagcagttaaagatgatgtgatcacaggtgggttttccccctgctgcagaaatatgggatttttacaataaattacttttgtaagtagagaaaatatatttttcagaaaatgtcaagacagcagtattgtataagtttttctttgaaaaccttagattatagtgatgacacctaatattaaatttaagttgacaagctatatattgttagtcaatttgaaggttagagataaaatgtttctcctgcaggaaaataataagactcataatagatacagtcaatctctgctgtagtatacactaaatattacttttggcctatggggaaaagcaattacttcattttattgtacactgacttctcaggaatcaagatcacagtcacactcagatcacatttgtcttccttagattttttggaatataaacagtaccaagtattctagttctgaatccagtttaatttaggaccaaatattttgatttaccaatgcattaatctagagtacccattagaaagaccttcagataagaaaagaaatgaaggaaaacaatatagttagtgaagttttgttaaccacttgtgctaatagaggagcactgtcttaaaataacttacttgcttagatgtgagaatatttgaaataccttgtttcttaattttgtgtcttttttttaatggtagagagacggaatgaagattccaacatataaatttttgcctcttatgtaccaattggctgctagaatggggaccaagatgatgggaggcctaggatttcatgaagtcctcaataatgtaagtaaacctgaaaatcaaaccacaataattatttttattctattattactatatattatataaagtatatataccattccctctaagaaatggaaatacaaaattttgtattttttgtcttctcacatcacataagttactcattttctctctctaattcctcataggcctctgcctttttctcacacatgcaggcatacacgctctacccactgcagtatctagacagtaatacacattttaatgttaagcaaaatgaaaaatatggattatatttttttgtttatttgcataaatctaatagttcttttcttacagctaatctctagaatttcaatggatcacccccatcacactttgtttattatactggccttagcaaatgcaaacagagatgaatttctgactaaaccagaggtagccagaagaagcagaataactaaaaatgtgcctaaacaaagctctcagcttgatgaggtatttggattaaacatacgtaccttttagaagtgtgatattcagtctttcctagaatatttctttttaaaatcttgtgttattaagatgccatctaaaatcggttcaaggctggcacggtggctcacgcctgtaatcccagcactttgggaggctgaggcgggtggattacttgaggtcagaagttcgagaccatcctggctgaccgacacagcaaaaccctgtctctactaaaaatgcaaaaaacagctgggcatggtggtgggcacctgtagtcccagctactcgggaggctgaggcaggagaatcacttgaactcgggaggcggaggttgcagtgagccaaggttgcgccattgcactccagcctgggcaacaagagcgaaactctgtctcaaattaattaattaattaattaattaaaattggttcaaaattccttaatatttgtcaaagcataggagataccagtagtagtttacttttttcctcaaagcagttggcaaagtgaaacaatagattttgaaaggcacctaagtcattgacgagagtatgtatctttgatgtatttcatttatgactgttttgtttgtatctgaggaattataatcattccattgtctagatttgtgcataaattctgtttttctctttgtttttctaactctgagaagtttaaatgttgggtagttccttatgtaatgttttttgttttttattaataggatcgaacagaggctgcaaatagaataatatgtactatcagaagtaggagacctcagatggtcagaagtgttgaggcactttgtgatgcttatattatattagcaaacttagatgccactcagtggaagactcagagaagtatgttttttttaaagaagaaacgttactttcttgctgtgttactctctgtagagatatattagttatagagcctaataagtaaatctgcttaaaatcacaaacgtaatccaaaagcttaatttatatctgatggcttcagcattccctggttactttttcacttaatatctcttaatagaactggtaataggtgactacactaaattaattatttgatttcttctgataatcttctggcatacatacttattacagagaattgcataatagaggcaagtctattaaaataattgaataactgaacatttctagcctcaaaagtttttttaaacgatgtggttactaaaactgccctgggacttaaaaacaaaaaaaggctttaccatttcttccataggtgctaaaatgccattatttaattattattcttgctgtgtcagttcaaataattacaagctgctatataatctttggttttgtgactagtctctaagtatgcttctaagtatctccccatactttaataattgtatttttttctattcagaatcatatcttcaagtttaaattcttattacttgaaaacgaatgggacttcacatattgtttctctaagcaaacaaaaagtattgacatgtcttttagttgcatttaatggtaatgtgacaggagtatgttatctatgtactatgcaaactattacgtaattattttaagatgtttagtctggttcctcaggtggaatctggtctagttacccttgtcaggtaacctgcaaatttacttgaagctacattaaccactgttgagctttgactctgagctgcatagtggccaaagcccagagtcttcatttctcaatcagagcctgaaccacagattagcaacaagttggggccagtggtatctgctgactattcctgcttgaccttcaatgctgttcctcagtttgtcactaaaatctcttcatttttaaatacagaaggcataaatattccagcagaccagccaattactaaacttaagaatttagaagatgttgttgtccctactatggaaattaaggtaatttgcaattaactcttgattttttttaaactaaattttttttattagattgaaccatttgaaatagtatttttatgtaggtcaaaattggttaaatattggcaaatttcatatgtttcaacctataatttctcagtattatatttcctttgcccaagccctaaaatactcaaaagcttctcctgctttcttttccattgccttctgttctacacctcccatctttcttatgaaggtctatagactgttactttcattggccagaaggagagtttccgtgtgcttatgccaagattaatttttgacttggcaaggaaggttccaattgtcatatattgtttttaaaaattctatgtgcagtaaaatgtattggctgtgatatatcacagtattaagtaatatagtatgtattattataatattaagctgacttcatatgcatgatacacttagctctgttctaatattcttttattgcaagaaataatggaagtaatttcatgtgggcagggatatatgtaataagggttataagtttagaaaatgatcatcttaaatacattgtctttcttttcattttgcagtttagtgcttagtatctagttacttgatttgaaatgtagctgtatcatgtggattaactgctgtttttctagctatatcagctaggtgatttcgctgaatgtttccttaaaatgccagatttagcagttataacccagaaaactccttctactgttttccaaaatttactttatgttttcgtgaggagttatttctcagatgactttacatatattagtgaatctttgatgaaacagtagttaaagttacgagcgtgagccaccacacccggcctaaagttgtagttcttaaccactatcacatcgtcatttgtttctctgtttaatattaaaattgccatttataatgtatttttctttaagtgcaaatagtgtatctgacctattatcaatcatgtttatacttttattaggtggaccacacaggagaatatggaaatctggtgactatacagtcatttaaagcagaatttcgcttagcaggaggtgtaaatttaccaaaaataatagattgtgtaggttccgatggcaaggagaggagacagcttgttaaggtgagccttcccttctctggcttagcccttagagttttagtgatgaaaatttttagttcatattttctttctgctttatttgggattttgtctttattttgaatacttacaaatgaggaagatttgtagagtagaaatgcattattttctagaaccaggcttttctccattttttttgtgtctctgaaagacaatcattattatatggttgattcaagtaaaagaataccattaacatgtacagacatgtacagtgaggttgcttcttatgaaaaaaaatactttggtgtctgtctcttatttccttgaatagtgcaagttgacgtcctttgcatcagtataccgggtctcgtactgtgccaagtgctatttaatgtaccaaaaagggagagcattcttcccttaccatttgctgacgagctctttgggtcctactggggagtggtggaaagacacagtgctgttttactcaggtgtttgcagtatgccttcctaggggggacttccagttaatctaattacagaagtagcgaggggaaactttctaaatcagtgtaaatgttgtagcttattctaaatgaaagaatggcagtaggtatttaattatttgggagactgtcaagaggtgcacagatgctcagattggtttgagtgccctttgctattctcagatgactctgtgtttttataataaaataaactgtacttgtttattcatgcttaattattctgaagggccgtgatgacctgagacaagatgctgtcatgcaacaggtcttccagatgtgtaatacattactgcagagaaacacggaaactaggaagaggaaattaactatctgtacttataaggtaactatttgtacttctgttagttcaccaaaaacatataaaagatgccatttggttgggtgaagtggctcatgcccatattcataatgctttgggaggccaaggtgggaggattgcttgaggccaggagttcgagaccagcctcagcaacatagtgagaccccatcttgacaaaaagttaaaaaaaaaaaaaaagccagagatgatggcatgtgcttgtagtcccttagctacatgggaggctgaggtgggaggatcacttgagtccaggagtttgaggctgcagtgagctcaaactctgcagtgagccccagtccagcctgagcaacacagcaagatcccgtttaaaaaagaagaagaagaagaagatgccattatttggaccaggagtctacaaatgttttctgtgaaggaccaaataataaagatttattttctttgtaaaaagtatttattaatgttaattatagttaggtgtttcttatagtcaactgaagtattttttccttttttttctactcaacaatatgtcacagaaatctttctcattttttaacagctgcattgtgtgtatgtatgtagttttttatacaagtccttatcgatgggcatttgtgttgttttcagtcttttgctgctacaaacaacgctgtattgtagtgaataaccttgaacatacaaatttcatacatgcgcaggcaaatttgtagcatggatttccaaaagttggattgctgggttagaggatacatgcatctgtaatctggtacatattgccaaattactctcaatgggagtgtacccacttacatttcctctagctatttgcctgagaagacaatcctcagtcacattctatgagctgatcatctttgactcttatattaattattcatttaaccagtttagaaataacaataaatccttattttgaagggcctattttccataggtttgtcttttgtgatttcattcctgtacctcatttttaaactttctccttctataaatgttgtaacagggactatgggtgacatgtgcttttttatatatttctagttttccactatgaacgtgttttatttttaaaataatggctaaattaaaagccctaaataggggagtgaagaagaataaattagatctaccctccaaaatgctgcttgagttaggctattgtaataaaaagcagaacttggttttgagcttcttaactgctttcagagactaaatataaaacttattggttgggagaggggcatactgttcattaaggaaagcacaattttttccgtagccttcaagtttgtgagaaatttgtgacatggaaccttctgcaataataactaacataatagatgttttccattagcagtttaaaaagctaattaatcctcgatgaatgcaaaaagcaaaagttgctctataaaggctactctgtagagggatttctttgatgtggttaagatcattggtactcaagctttagcagacatcatagtcacttagagagtttgttaaaaacacagatttctgatccccattcttagaatttctaattcagcaagattagggtagaacctgtgaatgtgcgtttctagcaagataccagttatgttgatgctgcactggtccagggacaacactttgagacccaccagtctacttgttctaccatctattgacctgacttcattttagaacaaagttgatgatctattagctatctcctatctgacagataatgtagagattgctaagaagtttttagagactagatattctgtaatgtgaatgaaaggaaattgtttatgctctaaataccaaacttttagatgacaaagataataggtgaagaattgggttacaaaagtatgggctataggagcacctcctgaactctcagaaagtagctaagatttccaagcagatacacaattgaacctccaaagttcattgctgtaaagcacaaaaaagcaaatgcctgacctagaatatcttgaaagcagaaattactgaactttcatctctaccttatgactttttcaacagctagttttcacacaaaactattttaccatataagttattccattaagatttctagccgggcatggtggcccacgcctgtaatcccagtacttcaggaggccgaggtgggcggatcacttgaggccaggagtttgagaccagcctggccaacatggccaaaccccatctctactaaaaatacaaaaaaattagccaggcgtggtggcacatgcctctagtctcagctacttgggaggctgaggtgagagaatcacttaaacccggatggcagaggttgcagttgagccgagatcacaccactgcactccagcctgggtgacagaccgagacttcttctcaaaaaaggaaaaatgtctagaggccagatgcagtggctcatgcctgtaatctcagcactttgagaggccaaggcaggaggatcacttgaggccaggagtttgaaaccaacctgggcaacacagcaagacctcatctctacaaaaaattaaaaatttagccaggcatgatggcatgcacctatagtcccagctactcaagaagctaaagcgtgaggattgcttgaaatcaggagtttggggctgtgcatgagctgtgatcatgccactgcagtccagtctggacaacagagcaagaacttgtcttaaaaaaaaaaaagtggggttggggggtaacccagataattaattatttaatgttatacatctcaatattaaagtaaaacctgtaaacacaacagtttaggtttgactatttcttagaattacgacaataagccagtaatgttattttgagattactccaagaatgtgaaagttgtgtcatcattatgttaaactaagtgttcttgcctttagttaaggttccctagactacagcgaagtagtctacccagtccagtcatctgtagagtcattcccaatcctgagattcaggtcttctgtggtcattgtgtcaacaagagcatacattgactacctggaactagatcttggtatacaaaccttgtgtcattgtgcaacctcaaaaggagagacttgtatattgaggcatgccagatatctcttgtcagagagaatcagatggaaatgaagacagttcttattgtgtatgttgatagctcagacatagcccttaacattaaccagaattagggtggctggccccatttttctccaccaaaactatgcattgttacaaagtatactgaacaagtctaaaatcttaggtgtcagaggatttgttttctaaaaggcaagtctctaataaacaatatttaagtgctgaaaggagctttgcacttaacctgatcatcctgccttgtgccaataaataatttttattccttgtcatgcatatttcagagcatctatctcagtcatggttctggggagagaagccataatatcttaagacattcactgaatataatgaattaacttcatttctgtgtatctaggatgatatcagctgtgtactttcagagaactgagaaaatagtcatcagtccttttttgtggtattcacacaaaatacccagatacccagttgaaatcttccagagagtctttagtaccagagaaaacactgtcatttgctttttgaaattcaaattcagctctttctccaacaaccaacatcacagttgagactctaagctgaggtagaaaaaagccaacccattcctttctgtatcaatctctcaacaaaaaataagggtttgattccccctccccgccccagagctagatattgatagagagtaatcaatgtaaaagagactttagacagagtacactacactgcaagaatgttaatgtgatcaagcatcaggggtcacagctaactcaaagacagcaggggagagggcatgtagaatacttattaggcaggaagggaaatcagaaaggccatgagatcattcatttgtttattcaataaatgtgaatttatatacctacgttgggttagatactctactgagtgctaggtctatagaagtagtaaaacattgccctagtccttaaggtgttcacattctaatagggaaaataaacataataaacataattataatgcaaagtgtattgttagagatggtaccaccttcacttggttgctcagactgaaacctagaggctttattttctttttacttttattattatggaaaatttcaaacatacaaaaggagacaataacatcatgaacccccttgtacttgtcactcagtttcagcagttaccaactcatggacaattttgttccatttctctttccaccaacttccttccaatattattttaaagcaagatgtcatatcatttcatctgtaaacatttcagtgtgtagatctgtaagataatgtctgttttaaaaaaccattctcacaatactgtcatcactcctaaaacaattcacaaaaattcctaaatgtcaccaagtaatgggagtcattttaaactcttgtttctctcttctcaagtcttgtctattccatcagcaagtcctattggtcaacttccaggcaggtcactttaccacccctgctattaccaccctacttctgcagtcacatctctgtagatactagagtttaaaccaacagtttacttctgctcttggttttccaaagctagttttattaataactgttagagtgatccttttaaaattgtctaagacagagtactcttattcggtatctgtgggggattgtttccagagccccctgtggatactaaaatcaagtcccttatatacagtggtgtatgaagcatttgcctataacctatgaacctcctcccatgtactgtaaatcatctctgggttacttaaaataccttatatagtgtaaatgctgtgtaaatagttgtactgtattggtttttaaaatttttattttttattgtattgtttttattgaggtttttttggtgaatatttttgatccacagttggttgaatctgcagctgcagagggccagctgtattccattttcctgttcagaaccccacatgagttcacattatccctgaatgacaattctctaagttaagtgatctgcctctgctgttctccctccagccttatctaccactctcctcacactcctctcactttctgcttgtatagatgagtcatctccacctgacttacctggtcttttgcaattgcttagacacaccaatttgtttctgcctcagggcttttctgcttctgcctgcaatgcttttccctcagatcttcacaccagtcactcccttacttcattcaggcttctgctgcagtgttaccctcagaaaggcctccgaccatgttgccattacccactttctctcttttttaaacttaagttttgttctcttatacttattatctaatattatgaaatgtttattaggatatatgttcctcaccagaatgaaactttatgagggcatagtcttcatctgcctttttcccactctgttctcagtgccctagccctgtgtgtaacatgtaatacgcccccaacaaataaatgttaataaattaatcaaatgcttccttaagacacaaaacagttcaacatatgtgagaaacttaaaatttaaaaatgtatagaactaaagacaccataaggacgagtgaccagctgagaaaacgaatataataatgttaattagaacaaaaaggatcattttaatataaagaacaagggatttatatgaagaatacaatgatattcaacttttctagtaatctggaaaatacaaattaaaaccacagtgaaatactattaccctcagattagcaaaatataaaaagcctgacaatattaagtattgcgaaagttatggaataactctactggtgggtatataaatcggtacagtcactttgaatagttatttggcaatatctggttaaccgaggtgaagatgtatctctggctcagctgttaaattcctgggtatataccctagagcagacttgtccaacccacagcctgcaggccacatgcagcctacaggatggctttgagtgcagcccaacacaaatttgtaaactttcttaacattatgagattttttttgcagtttttttttcttttttagctcatcagcaatcattagtgttagtgtattttatgtgtggcccaaggcaattcttccagtgtggcccagggaatccaaaagattggacacccctgcctagagaaactgaaatatgttcacgagtagtttatttcattgcagcagtatttcatggaaatgtggaaacaatgtaaatgttaatatgcagattggataactgttgtatttatgtagtatatagctgttaaaatgaatgatgtagagttaaatatgctcacatagttaggataaaatagtattgaataaaaaaccaaattacagaaatatacatatagtatcctaatttttttacttaatacttacaactatttgtgtacatatagctttgaaataaaaatataccaaaaaatacaagaacatgataaaccagctaacagtcatcttgatggtgggagggacttagggtcagtgaagcacacaagggggagcttcatctcttccccagcaaatgtgagaaaatcctagatttgataaagctgtttaatggataaaagggtatctgttaatatcattttctatactttatgtatgtttataatataattttaaaaaactttcctagtaaagttgcttattttatatttaggagtacattttctctctgtgaagataataagactaaagcaagagtacatgtaatttcaataatgaagttacactaaaattgagaccacattcatgggtaataatttccaagtgaaactccccaaatttaattgatactaaaattttaaggaaagcagttaattcctctcctaactggacaaactaagtatggattaatgacagatgacggtgagtatagttaacaggagtgacctctcagagaatcgtggggattgagtgatgggcaggctctcaaacatctaggcagcaggctggaaaattatattctttgagcttaagtttatttccgattggtttcctccaaggagctttgtcttctatggacagagaaatattaatacaacttgaaaaaaaatgctttgcactgactctgatagctgaatgatcatcaaatgctctttaatggccttttaaaattaaaaggtatttaatctgtaactccaggtggttcccctctctcagcgaagtggtgttcttgaatggtgcacaggaactgtccccattggtgaatttcttgttaacaatgaagatggtgctcataaaagatacaggccaaatgatttcagtgcctttcagtgccaaaagaaaatgatggtgagtgacacccaaaattaaaggttattgtaagattatttaatggcttattaaagctgacagctgtcagatattatagaatacaaaaaaactttaatttcatcaggtaattgtcaaagatactaagtaaaagaaaaactcatcagaatgaaagtgtgtgagtgaaaaaggaaggattttaaactacataatatgtcaacccttgtcagataagaaatgtaaaggttattcaatgtgtgctgatttgttttcaatttgggataaactaattcttagcaaacaaaacactaaaatgccaggcacgatggcatgcacctgtaatcccagctacttgagaggctgagtctgggggatcccttgaacccaggattttgaggccagcctgggcaacagagcaagaccccatctctaaaaaacaaacacagtaaacaacaacaacaacaagattatgaagtaattttttatgaaactgatatagaaaaccttctgagacatttacaatgtcacattggccatctagtctgatattcattcgctgaatcagcaacatttattgtatgttttctgtctaccaggtactgtgctgacttaagacttcacaaatatcaaatattacgactaatcatcataatccttatcctcattttaaaatgagaagttcagagaacttgcccaaggccagtgagctaataaacagagcaaggatttgagccttgtctaaatccaaaatccatttattgttcattttattgtgctttctgtgacatgttttttaaaatgtgtgataagtgctataggtgttgtgatggaagtctgtacagggcacacagggtacagtgtaggtatggaggaggaagtgcttagttctgcctggggtggggagaatagacagaagtagatccaagaaatgcttcacagaggaaaaggtgtgtgagccgagttttgtaaatgagttgtttttccaggcagaaggagcatataagcaaaggagaggagacatgagcaggaaaagacaacataagcataggcttagtgtttgaggaagaaaagatgagattggagcagtaattgttggtcaaaagatggagtgttgctttatgaaatgcaaaggagtttgcaccttatgctataggcctcataagaccctaaaggatagtaatatcagacttgcattttagaaagaaattccgacggcactgtgggttctatttttgagaatgcaaactggaggcatgagatggtctgaactgagatgaacagcagtaggaagggagaatcgtgggtagagatgagaaatatgaaggaggcagaattcataggatttgattgctgattaaaaataaggttggggggcgggtgtggtagcgcatgcctgtaatcccagcacttaaggataccaaggcaggaggattgcttgagcccaggagtttaagaccagcctgggaaacatagtgagaccacatctctacaaaaaataaaaagtcagccaggtaatggtggcacatgcctgtaatcccagctactcaagaggctgaggtgagaggattgcttgagcccaggggccaaaattgcagtgagctgtgatcacacccctgcactccagtccaggtgacagagaccctgtcaccctgtctccaaaaaaaaaaaatgttggagaaaaggagtagccagtgcctcccagttttctgtttggggcagctgggtagatggtgaagctctttactgcattgaagaatagaagaggtgactaaagtttgccagagatgaagtatttgaatttggaagtgatccaagtgaagatgctgaatgggcagcttgagaagcacattaagctaaagcttaataaagatatctgggccaaacagatttagaaatcatcagcacatagatggaagggagttgaagtcggtaagctttgcttcaggtagtattttatggcaagaagatgttggaggatagagatctgagtcatatcagctgccatctatgagggattcttctgttctttctcttttcctgttttctattgcaacccaatgctgtgatgccacctgaggttatctggaactacttaggcatttctgtgtttatttctgcttaagagtacaggattattcaaattagaatttaatcaaaacaagtaacagtcactgtaggtgtgcttcctcccccaacaattaatatggaaatcctaaagggattatcacttgtaattaattgcttccctgtccagactgttagcttcttgtaggtaatgtatcctgttcatctttattgcccctatatctgtcatatttttatataaaaatgtgtatattagtttaattgaacacaatattgaaaaataattatatatattctctatttaaaggaggtgcaaaaaaagtcttttgaagagaaatatgaagtcttcatggatgtttgccaaaattttcaaccagttttccgttacttctgcatggaaaaattcttggatccagctatttggtttgagaagcgattggcttatacgcgcagtgtagctacttcttctattggtaatcttcttgtacatatagtagattgagcactttgttgtttggcaggttttatttttgtttgattcagcactttttctacattctgagttgcagggggatgatagtgatgatgtggttagtaaccaacccatcttcattattaaatcatatgtttcttgttcatcctgattcttagtgtctacctttttataacttatgcagaagagaattctcctacttcaataaataataaaaagacagggttttcttctttgttttatagtgaatatggcatattttctctcctctcaatatattattttctgagactttctttggaaaataatgaaacctgtgataacttatttcctttaattatttttgttcttttgcatataacctctaaatatcatcacctagtgattaatactttttaatagaattttgttttcagaatagaaaccatgagatatatttaaatattttgtgtacaatatatattttgactttttttccctaagaaattagaataggtagatagtatggttaacaaaatcctagagtatgagaactaatgtaaacattagagatcatctaatctatttgttgttttttttttttttaactaaagacaactccctccatcacttacatactataccccaggaaggcagggcatgtatgttttgaaagagttcccaggtaattgtgaaactctcttctacatagagaatcactaatctgatacaactagtttataaacaagaaagtaggcctagttaatgacagagcaagccagacacccagtcattctgattccctacccagtgtgtttttttgtaatgccatgtgatttctcccattagtgcatgtcatcatctgtcttaaatacagaaatgcagttttttggggggatacacacctggtgaaatgaattaatgattaatttgtgttaaatataattcatcaaggagaagaaagtttcactgaagagtgaagagtttatccatagacttctcattttataagtatgttcaataaaaatttgagtacatataatgcacagctttgacccaggtaaataatgggtctcaactttagccacaataattttttaagtactaatattttaaaatgtgtgcctattagtaaagagaaaatttttttagcaaatcatctaggatttgtaaaatgcaatatgcattaaaatagctggcaagatttgagttaaactcaacatggccggttatgcacatcatttaagtaggctaaaaatcctaaactacttaaagattataccaagtcagtggtcttaattgaaattatggctatatattagaaagagatggaatcagtgatttcagattgtttgtttcttttttctccagttggttacatacttggacttggtgatagacatgtacagaatatcttgataaatgagcagtcagcagaacttgtacatatagatctaggtaagtaataaaatctatgtatctattctttttagtaaatatttggtcatcatggaatgttgtttgcctaccaagatattacaaatataagagacagataaattgaagcagtaaatattgggtttttttgttttcagcataaacagttgtcctagaagaaacagttaactctgcctggggtactgagtgaaacttaatagatgaggtgtcttttgagcctggtcttcaagaaagaaagaaagcataattcagacagaagatagagcagattcaaaagaaggaatcagggctattccaccaaaacaaggagtaattttaagatgtagcatgttgtgggagtggtgagacattaaatgtgtctggagtgaagtaagcctgtagttgagtcgcttgagagagagattggtactagactgtaaaaagccaggctaaggagtttcaacttcattgcattaaactataggaaataaatgaaggacatgataatattttattttcagaaatataatttcaggagcactttggggagtggtattggcagcaggaagaaaaattaagggatattgtaatagtttagatgagaaatgatgaagatttatactaaagttgtagaaaccagaatattggatttgagggacatttttgtagtaaactgtaccagtgatattagatgaggaaatagtgggggagtggggcccccagataactgaagcttctaactaaggaatatatcaagttttgtaaatagtaagaaagtgatgaatttagttttgctcattattttgaagtattaatggaatttctaggtggaatagacagtttaatatataagaaagaaagaatatatagcttctatgtatatatatagacagtttaatataaaagaaagagaatatatatagctaaggaatatatcaagttttgtaaataataagaaagtgatgaatttagttttgctcattattttgaagtattaatgggatttctaggtggaatagacagtttaatatataagaaagaaagaatatgtagcttctatgtatatatatagacagtttaatatataagaaagaaagaatatatatagctaagaaatatatcaagttttgtaaataataagaaagtgatgaatttagttttgctcattattttgaagtattaatgggatttctaggtggaatagacagtttaatatataagaaagaagtgtgaatgtaatgtaaagaagtgtgaatgtaatgacaaacttctattaaacagtattaatcactaggtgataatttttagaggttatatgcaaaagaacaaaaataattaaaggaaataagttatcacaggtttcattattttccaaagaaattctcagaaaataatatattgagaggagagaaaatatgccatattcactataaaacaaagaagaaaaccctgtctttttattatttattgaagtaggagaattctcttctgcataagttataaaaaggtagatgctaagaatcaggatgaatatgaaacatatgatttaataatgaagctggtttggttactaaccacatcatcactattatccccctgcaactcagaatgtagaaaaagaagtgtgaatgtaatgacggagatccagaatcttcagcaaatagatttcagttgaagtcactgggctggaggaggttctgatctcacacatcatccgtgataaagagacctaaagatgaaatcataagggaagtgagccttggaaaggctgagccagaaaaaaactgagaagtactcaaaggaagtcaggatcttggaaggcaagaggggaaaatcttttatgaaagaagtagtgctcaatagtatctgatacagaaaggtcagagaggatgaatgctgaaaatagacctttgaatttaacaagtaatcaatcctagaggccttggaagtcccctttggatagaatggaggaaaccatactgtaaaaaggcaaggactgaatggaagttaaggatgtgtagattaagaatgtggaatctgccaggcgcggtggatcacacctgtaatcccaacactttgggaggccaaggcaggtggatcacgaggtcaggagattgagaccatcctggccaacatggtgaaaccccatctctactaaaatacaaaaaattagccgggcgaggtggtgggcacctgtagtcccagctacttgggaggctgaggcaggagaatcacttgaacccaggaagcagaggttgcagtgagctaagatcatgccactgcacttcagcctgggcggcagagcaagactgtctcaaaaaaaaagaatgtggaatcttcctacaagaagtttagaagggaagggaaggatggcagagaaatttgctgcaggaatgagagacacatttggtccttgcttttttaagataggagaggtttaaacctgttagatattgaagatacaggagaaaaacaaaagataattgaaatagcaagggaaatcataaagtacgtgagtctgatagcattggctttagattggaggcatgttagcttttctgctgagagagaaggaaaagtgatgccaataggaaagtcttaagctggagaggaaggagtatgagggaattatatttgctattgtgtttttgctgagaaatagaaagcatgctcatttgctaagaattggagggatggtaactggccttaaaagaacaaataaaattctaaaatttaccatggaaatgagaccaagacctgactagaaagggataaataaataagacatgccaagcagtttaaggggcactttcaatcctaaatttgtagtggagccaatagggttgttgtatgattttccagcagtcctcaacatccttggagcttaagttgtagtttaaaatgggagatgtggtggagggacaaggggacaaggagatttgaagcactgatgagagtaatcaaacttattgtctctacccctgggctgagttagggaaagaagagggctaataaactagaaatctcagtcaaatttgaagactgtttagtaagaataaggggtagaaggagaagaggttttgattagaatgtacaatttacaatgtctaagaagcagttttagcagactcatttctggagtacaacccatatgagtggttcattaagatagaatgaaattgaattccattagaacagagacagtcacggatattatatggttttccccagaatgaattctagagttgggacagaggggaagattgtgagctaggtccatgccaacattcagcgaatgtgagagaaaaccttacaggtttacagagtaaacgtgaagatggaagggatttgttagagctagaaggtggggatctcaacagaggagccagactttatctgagaatgaaaggagagtggtctggaagatgcaaattagaggtaggagtatgccaacctgagtccattcaggtcgtgctaaaagcatctataaatgagaagggtaaattggtacaacccctttggaatattgtttggcattatccactaaagctgactttatgtatatcctgtgacccatcaattccactccaacacaaatgcatacatatgtataaaaatgtttatagtagcattattcataatagcccctaactggaaacaatccagatatccatcataggtagaatggatgaacaaattgtcgtatatttatattctctttgtatataatgagattgaatgaataataacacacaatatagaagactctcacaaatataatgctaagtgaaagattccaacataaaagagtacacatgtataattccatttacataaaattcaaaagctgataaaattaatgtatagtgttagaaatcaggatagtggtgaccctttgaaagaggtgattagtgactggtaggagggactgaaagggggcctctggaatgctggtagagttctgttaacgtggatttgttcactttgcagaaatcccagtgagtcacacttgggtgatttgtatactattctgtgtatgtctgtttggttacctgttgctgcataacaaaccaccccaaaatttagtagcttaaaatcacaatttatttattattatctctcatagtctgttgactgggctcagctggacagttttcacttaggatctctcatgcagctgcagttagcatctggggctggagttatcttaagactcagctgggccagagttcatgattgcttcttcacttacatgtctgatgcttcagcactcccatgtggcctctctgtccacaatagtgtcctggacctactcagcatcttggggctccaaggggaaggaagtggaagttaagggctaggcctgcaacttgcacagtatcacttccatcacattatgtcatcacatagtcatgtcatagggtccatcctggttcttccctgtttctgggactccagtaaccctatgttaggcctttgcaatgtatcatttatactgttacctgctagtctatattttctaacctttttttccttttttctgactcactccttggtgtcagtggacatatccggggaacctggactttcagccctactcagctatagcaagccctttccctattgagtgtcagtggaggccaattggggaatctagtcttctgcccttacctagcagtaacaaggtggtgactcccaaaggcattaaaggcagaagtttaaggaagatcctgagtctcgtaataactaaaaggtgtaggtgtcaattgaaaatcattaggcatacctggaaccaggaaaatctcaactttaatgaaaaatggccacctgtaggtgccaacactgagatgacaatgatgttggaattatctaagattttaaagcagccatcataaaaacactgaaggaacaattacaaacatgcttgaaacaaattaaaatatagtaagtctcagcacagaaataagtagtctcagtatagaagtagatataaaggagaaccagatggaaattttagaacagaaaaatatagtaaataaaataaaaaatttcaactgcagaatgaggagacagaagaaattatcagtgaatagaagacagagccgtagaaattacccaagctgagcaacagaggaagaaaattaagaggaaaccttcagcatctagggctaaacagagttcctagacttgataccaaaagaacaatctttaagaactctcaaaacttaacaacaaaatctacttataaaatggccatgtactacaaatgtgtatagcagctttattcataatagccaagaaccggaaaaatccagatgttctacagtgggcaaatgcttaaacaaactgtgttacatccatgccctgaaatactactcagcaatgaaaagaaacagaactattgatatacataacaatttggatgaatctccagagaattaggctgagtgtaaaaagctattcccaaaaggttacatactgtatgattattccacttccatttatataacatacttgaaatgacaaaattataaaaatggagaacagattagtggctgctagaaaaatagggggtcagagggctgggtgataggctatgggagggaaataggtgcagccgtaaagggcagtatgaaggatccttatgataggaatattatatatcttgactgcatcgatgtcagtagtagtatagttttgcaggacattacagttggggtgaaatggggaaaaggcataagggatgatcttttctgtatgatttcttacaactcgaagtgaacatataattatctcataaaatgtcattaattttttttttttgatggagtttcactcttgtcgcccaggctggagtgcaatggcacgatctcagctccatgtatccttcacctcccaggttcaagtgattctcctgtctcagcctcccgagtaactgggattataggcacctgctaccacacccagctaatttttgtatttttagtggagacaaggtttcaccatgttggccaggctggtctcttaactcctgacctcaggtgtcaggcctcctcagcctcaaggtgctgggattacaggcgggagccaccacacccagcctaaaaattttttaaatataaatatatcatctccattttaaattataccagtagttacttcatttttaaaaatcaccctttaacctagatttctctagttgggttaagaagtagttaggttatttggatttgaggtggatctcacagacagtgacaaagatgaggaaggcagccagagcagaagtaaactactgtacatactagtgttcatagaacgtaggtaacatgtggtttcttgcctttgtaaagttcacattctaactggaaagaaagtaaattagctgtcaaacctcctaacttcactgtattctttactttaggtgttgcttttgaacagggcaaaatccttcctactcctgagacagttccttttagactcaccagagatattgtggatggcatgggcattacgggtgttgaaggtgtcttcagaaggtaagtgatatgaagtaaaggagggaaataatttttgatgtcaaaattacatgggctgggcatggttctttgcacctgtaatcccagctgctcaagaggctgaagtgggaggattgtttgagcccaggagtttgagtccagcctaggcaatacagcaagaccctgtatctaaaaaaatacacacacacaaacacacacacacacacacacacacacacacacacacgggttagagatttgtatagattatagaatttagtgctagaatcgtattccagtgccttatcaatactaaggaaaagaccctgggtaaaagcaataatagttcctcttccttccacccacctgggacctaagcccatgtaacatacatactgttattccaaacctcctctggaagcatcccacctttacttttaacacctctatcctggctgactccttcttaatgatccaaactactattgggtgctcatcactgtgcatatagaagagactacatttttatttataggagcttgtgttctagtataacattgtgctactaaaaaagctttgcagttccttgtagttttcccagcataggtctgtgtactcaacttggattggggcagattgcagtcagtgtaaactaataattgccacaataatcaaagactgagagctgagcccagtggtgcatgcctgtaatcaatagtgttgtgttattcttgtaaatgccaagcttgtgaaatagtcaaatacatatttgtattcatttcaaacgtctaatgaaagcccactctgccaagtattatgctattttgagatacagatatgtagattattaagcataggctcagcatactacacatgagagtatacagataaagatacgttgacaacattggtgtgtaacaaaatccgtatttataatgtgtttgactctagatgctgtgagaaaaccatggaagtgatgagaaactctcaggaaactctgttaaccattgtagaggtaaagtattttataaggaagactttattttttttcttaccaggtagactgtgtatctcatcaggaagtcactgatgtgaagagcactgcttcattttaacatagggggatgtggctgggcagcagaaaggaggagattgtgcacttagccttttcacacatccaaaaatactggtttagaaatgccttcagcccccttgagtttcttggaatgttagagcattgtaagtagtctctagttttcaattcataaatcaattctttgacatttagatattccatatggtattattattttcagaatggtttccattagggtttaagaaaaatcagaaatttatatctcctttttccctgctcaggttcagaactaattagtcagacaaatggagatcaaattgtcagcatcattactagaggaacatggcttaggaatgagggccagactagtttactgctggtgctacctcagtacctctctgctgtcttaactttgggacagctcacctgaatagggtttgggcctgcagagcaaacacatgtaatcaggatcactgccttgtcttgatccagggcagaaaaaaggaagtcaaacaaatttcagtgtctgtgctgttagtacctatgccagtcattcaccaatctggtaagggtatgtgagacaagaaatcaggagtgtggcctccccagggaagcatggcaggtagagtgcagtatgggcttgccacttttccactactcagcttttcttcctttaacctgatttatgttggactggctgcatgttagtattacttttactgcatttaaaaaacattgatgctgatcaaattcaaaccaggtttctagagatggggcaggaatatgtgcatttttaaaaatctctcctactgttcaactaggatatgagaactgtcttaattcattggcattaaccattaagcctgtggtcaataagggtggggctttatcccttggaagatgagtaacagtccatcagggtggtcctgtgtgcacctttatgaaccgaggcatctttatagatctcctttggactgcagatggtaatacagattttgctacaaggagtttgctgaaataggtcccaataatacgttggtaaaattaaatccaaggctgtgctattcccaaggttaaaaatacattcttttttcttttaccgatttcaaattctgttcatacatgttgtcatttgttacagtttgccattggttctgcagtaagaataaatgataagaaaataagcatgatgtgtaacattttaaaaaaataatacatggtaacatggatgcctcaataatgtcgaaattaaactctaaagttatattatcttgcactttttcatgtaagaaaaagagggctgggcgcggtggctcatgcctgtaatcccagcactttgagaggccgagacaggtggatcacctgaggtcaggagttcaagaccagtttggccaacatggtgaaaccccgtctctaataaaaatgcaaaaattagctgggcgtgatggcgggcacctgtaatcccagctactcaggaggctgaggcaggagaatcgcttgaacccaggaggtggaggttgtagtgagctgaaattgcaccattgccctccagcctgggcgacaagagcaagactctgtctgtcttaaaaaaaaaaaaaaaaaaaagcccaaacttttcaaattaaagagtcaaagcagcttaacatattctttagtattttactctacctagtttcagtcagaagggatttttatgctaaggtggatttgggagtttcttccagtacttgtatcctacctaacactcaccagaagaaggtagttcttttagggcctcagaaatcttactagtttaatgccaaactgcttatggacttcactttttagagtagtaggagatcaaatgagagaagtgacagtggccagatcctttgccattgtaaggactttggatttcctttgagtgagggttttgagtctgaaaagtgatttgcatctccacctacaataactgtcacctttaaacacaccctccgggaggaggagccaagatggccgaataggaacagctccggtatacagctcccagcgtgagcgatgcagaagacaggtgatttctgcatttccatctgaggtaccaggttcatctcactagggagcgccagacagtgggcgcaggtcagtgggtgcacgcactgtgcgcgaactgaagcagggcaaggcattgcctcacttgggaagcgcaagggtcagggagttccctttcctagtcaaagaaaggggtgacagacggcacctggaaaatcgggtcactcccacccgaatattgcgctttttggaccggcttaaaaaacggcgcaccacgagattatatcccgcagctggcttggagggtcctacgcccacggagtctcgctgattgctagcacagcagtctgagatcaaactgcaaggtggcagcgaggctgggggaggggcgcccgccattgcccaggcttgattaggtaaacaaagcagccgggaagctcgaactgggtggaacccaccacagctcaaggagacctgcctgcctctgtaggctccacctctgggggcagggcacagacaaacaaaaagacagcagtaacctctgcagacttaaatgtccctgtctgacagctttgaagagagtagtggttctcccagcacgcagctggagatcggacaacaggcagactgcctcctcaagtgggttcctgacccctgacccccgagcagcctaactgggaggcaccccccagcaggggcacactgacacctcacacggcagggtactccaacagacctgcagctgagggtcttgtctgttagaaggaaaactaacaaacagaaaggatatccacaccaaaaacccatctgtacatcaccatcatcaaagaccaaaagtagataaaaccacaaagatggggaaaaaacagaacagaaaaactggaaactctaaaacgcagagcacctctcctcctccaaaggaacgcagttcctcaccagcaacggaacaaagctggatggagaatgactttgacgagctgagagaagaaggcttcagacgatcaaattactctgagctacgggaggacattcaaaccaaaggcaaataagttgacaactttgaaaaaaatttagaagaatgtataactagaataaccaatacagagaagtgcttaaaggagctgatggagctgaaaatcaaggctcgagaactatgtgaagaatgcagaagcctcaggagccgatgcgatcaactggaagaaagggtatcagcgatggaagatgaaatgaatgaaatgaagcgagaagggaagttcagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaatgccacaaagatactctttgagaagagcaactccaagacacataattgtcagattcaccaaagttgaaatgaaggaaaaaatgttaagggcagccagagagaaaggtcgggttaccctcaaagggaagcccatcagactaacagcagatctctcggcagaaaccctacaagccagaagagagtgggggccaatattcaacattcttaaagaaaagaattttcaacccagaatttcatatccagccaaactaagcttcatcagtgaagtagaaataaaatactttacagacaagcaaatgctgagagattttgtcaccaccaggcctaccctaaaagagctcctgaaggaagcactaaacatggaaaggaacaaccggtaccagccactgcaaaatcatgccaaaatgtaaagaccatcgagactaggaagaaactgcatcaactaacgaacaaaatcaccagctaacatcataatgacaggatcaaactcccacataacaaaattaactttaaatgtatatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagaaacaaagaaggccattacataatggtaaagggatcaattcaacaagaagagctaactatcctaaatatatatgcacccaatacaggagcacccagattcataaagcaagtcctgagtgacctacaaagagacttagaatcccacacattaataatgggagactttaacaccccactgtcaacattagacagatcaacgagataaaaagtcaacaaggatacccaggaattgaactcagctctgcaccaagcggacctaatagacatctacagaactctccaccccaaatcaacagaatatacatttttttcagcaccacaccacacctattccaaaattgaccccatagttggaagtaaagctctcctcagcaaatgtaaaagaacagagattataacaaactatctctcagaccacagtgacatcaaactagaactcaggattaagaatctcactcaaaaccgctcaactacatggaaaccaaacaacctgctcctgaatgactactggatacataatgaaatgaaggcagaaataaagatgttctttgaaaccaacgagaacaaagacacaacgtaccagaatctctgggacacattcaaagcagtgtgtagagggaaatttatagcactaaatgcccacaagagaaagcaggaaagatccaaaactgacaccctaacatcacaattaaaagagctagaaaaggaagagcaaacacattcaaaagttagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaagagagaagaatcaaatagacacaataaaaaatgataaaggggatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccagtaacaggagctgaaattgtggcaataatcaatagtttaccaaacaaaaagagtccaggaccagatggattcacagctgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaacgaatccagcagcacatccaaaagcttatccaccatgatccagtgggcttcatccctgggattcaaggctggttcaatatatgcaaatcaataaatgtaatccagcatataaacagaaccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccagagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagatgacatgattgtatatctagaaaaccccactgtctcagcccaaaatctccttaagctgataagcaacttcagcaaagtctcaggatacaaaatcaatgtacaaaaatcacaagcattcttttacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatattgtgaaaatggccatactgcccaaggtaatttacagattcaatggcatccccatcaagctaccaatgactttctttacagaattggaaaaaactactttaaagttcatatggaaccaaaaaagagcccgcatcggcaagtcaatcctaagccaaaagaacaaagctggaggcatcacactacctgacttcaaactatactacaaggctacagtaaccaaaacaacatggtactggtaccaaaacagagatatagatcaatggaacagaacagagcccttagaaataacgccgcatgtctacaactatctgatctttgacaaacctgagaaaaacaagcaatggggaaaggattccctatttaataaatggtgctgggaaaactggctagccatatggagaaagctgaaactggatcccttccttacacctgatacaaaaattaactcaagatggattaaagacttaaacgttagacctaataccataaaaaccctagaagaaaacctaggcattaccattcaggacataggcatgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcagtcattaaaaagtcaggaaacaacaggtgctggagaggatgtggagaaataggaacccttttacactgttggtgggactgtaaactagttcaaccattgtggaagtcagtgtggcgattcctcagggatctagaattagaaataccatttgacccagccatcccattactgggtatataaccaaaggactataaatcatgctgctataaagacacatgcacacgtatgtttattgcggcattattcacaatagcaaagacttggaaccaacccaaatgtccaacaatgatagactggattaagaaaatgtagcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaatatcacactctggggactgtggtggggtggggggcggggggagggatagcattgggagatatacctaatgctagatgacgagttagtgggtgcagcgcaccagcatggcatatgtatacatatgtaactaacctgcacaatgtgcacatgtaccctaaaacataaaagtataatttaaaaaaaactaaaaaaacaaacaacaaaacaaacaaacaaaaaaaacacaccctccaatgctttgtgtattttacactcatctacctaatcttccctccgtaaatctgtccgaatttccccaaatcatttggtgtgattgttccaatcttcaagaataattttcccagtgatcttaccacagtaagaccctttctgccttcagctttaggagggtgcttctcaattagcatcctggttcccagtcctctgggacatcatttctttcctctcttggattcatttcttttcttctcttagatttcattgaggcacagtcactatttctgaactgatctccccgcttcctaagcccctccttcagagcactttaacctgggtgtatttcccttttcttttcagtgtatttgtctctcctggccttcaagattttattttcttcctaatggaccattctctcctctaagattttatgtgttatgctaaggaaatatatctctccctctaactcagtgatgcttagccaagagcagttttgtcccctagaggacagttggcaatgtctggaggcatttttattgtcacaattggggatgggagatgaggatagtattggcatctactgggtagaggccagggatgctgctgaacacctcagaatgtacaagttagcccccacagcaaagaaataccccatccaaaatgacaatagtgctgagactgagaaaccctgctctagcttaatcagtctgtattcctttactgtttccaaccacttctgtcttgtcagactgaaacataattttttacttattccagttcctccttaattctaatatttgcaagtatgattcctgacacaagcccttggttttgaagtaatttagatttttcttctacttcaacccaagaaaaccatctagtctgtattagaggccttcattccttttcattagttcattaataaaatatattaatatttcccttttgtgggtgaaactggtttggatctctgaaatctaaagccatgtcagtgcccaacttgaagtcacataggaaaccttgaacttaacggacaagctacatgtaatcaagctcagtttctccacagtatttaatggtcctggaggacactcaaaacagcattaaaaaatagagagattttggttctgctaatctagtacgtgtcctgaaactaaatctgctaaaggcattttatagtcccaacctgcagatttactgagaaactgtatacagatagcagcaaaaaagtgttccaaccttgtaatactggaatgccctgtagaatcattctttatattgtctccacttattactaagatttgtaagcatttgctaaagcctattttttttaaagttctgtgtttataaataccagagcagttagctgttctgaactgccaatatcagaaattcctcatgaactcactttctaaaatttacgacctaaagctacttgctctagccatgtcagttgttttggtatcctaattctacacctaatatatatctcaagattccaaacgcagcaccaaaccttgggttttgaggaggtttcaacaaattatacctttctggatccacccagatttagaactgagagaaaaagagccataggaatagggtggagatcagaatttcagatttgttactgataaaactattggagaagacggcttaggagtgaggtccaaataggcttgctggtgctctccagttcccacatcccaatctataccttgagacagcctgggctgaggaagaattgggccctacaaagcaaatacactaacccagggttaagagtagagagagaaggaaagaaagtgactaaccttttaatagattagtttcatccagtcaggaaacatgggtcaagggatgtcacccctaaccatggaggaagaatgaattcagaatgaaatgagaagcttggagcattatgctaggatagtttcctcaaggaaacatgaagtgtgcatgatgtttgttcccctcccccatcaactaccatgtgactggcttatttgtatgatactggttctactgtttctaagtatgtgattaaaatgtacattgttcttttaatacatatgttctctctgtttaggtccttctatatgatccactctttgactggaccatgaatcctttgaaagctttgtatttacagcagaggccggaagatgaaactgagcttcaccctactctgaatgcagatgaccaagaatgcaaacgaaatctcaggtgagcagtattttaagaaggtcctgttgtcagtttttcagattttcttattcccaaggcctttaaactgttcacctcactgaaacctttgtgtttttgtccttagtgatattgaccagagtttcaacaaagtagctgaacgtgtcttaatgagactacaagagaaactgaaaggagtggaagaaggcactgtgctcagtgttggtggacaagtgaatttgctcatacagcaggccatagaccccaaaaatctcagccgacttttcccaggatggaaagcttgggtgtgatcttcagtatatgaattaccctttcattcagcctttagaaattatattttagcctttatttttaacctgccaacatactttaagtagggattaatatttaagtgaactattgtgggtttttttgaatgttggttttaatacttgatttaatcaccactcaaaaatgttttgatggtcttaaggaacatctctgctttcactctttagaaataatggtcattcgggctgggcgcagcggctcacgcctgtaatcccagcactttgggaggccgaggtgagcggatcacaaggtcaggagttcgagaccagcctggccaagagaccagcctggccagtatggtgaaaccctgtctctactaaaaatacaaaaattagccgagcatggtggcgggcacctgtaatcccagctactcgagaggctgaggcaggagaatctcttgaacctgggaggtgaaggttgctgtgggccaaaatcatgccattgcactccagcctgggtgacaagagcgaaactccatctcaaaaaaaaaaaaaaaaaaacagaaacgtatttggatttttcctagtaagatcactcagtgttactaaataatgaagttgttatggagaacaaatttcaaagacacagttagtgtagttactatttttttaagtgtgtattaaaacttctcattctattctctttatcttttaagcccttctgtactgtccatgtatgttatctttctgtgataacttcatagattgccttctagttcatgaattctcttgtcagatgtatataatctcttttaccctatccattgggcttcttctttcagaaattgtttttcatttctaattatgcatcatttttcagatctctgtttcttgatgtcatttttaatgtttttttaatgttttttatgtcactaattattttaaatgtctgtacttgatagacactgtaatagttctattaaatttagttcctgctgtttatatctgttgatttttgtatttgataggctgttcatccagttttgtctttttgaaaagtgagtttattttcagcaaggctttatctatgggaatcttgagtgtctgtttatgtcatattcccagggctgttgctgcacacaagcccattcttattttaatttcttggctttagggtttccatacctgaagtgtagcataaatactgataggagatttcccaggccaaggcaaacacacttcctcctcatctccttgtgctagtgggcagaatatttgattgatgcctttttcactgagagtataagcttccatgtgtcccacctttatggcaggggtggaaggaggtacatttaattcccactgcctgcctttggcaagccctgggttctttgctccccatatagatgtctaagctaaaagccgtgggttaatgagactggcaaattgttccaggacagctacagcatcagctcacatattcacctctctggtttttcattcccctcatttttttctgagacagagtcttgctctgtcacccaggctggagtgcagtggcatgatctcagctcactgaaacctctgcctcctgggttcaagcaattctcctgcctcagcctcccgagtagctgggactacaggcgtgtgccaacacgcccggctaattttttgtatttttattagagacggagtttcaccgtgttagccaggatggtctcgatcgcttgacctcgtgatccaccctcctcggcctcccaaagtgctgggattacaggtgtgagccaccgcgcccggcctcattcccctcatttttgaccgtaaggatttcccctttcttgtaagttctgctatgtatttaaaagaatgttttctacattttatccagcatttctctgtgttctgttggaagggaagggcttaggtatctagtttgatacataggtagaagtggaacatttctctgtcccccagctgtcatcatataagataaacatcagataaaaagccacctgaaagtaaaactactgactcgtgtattagtgagtataatctcttctccatccttaggaaaatgttcatcccagctgcggagattaacaaatgggtgattgagctttctcctcgtatttggaccttgaaggttatataaatttttttcttatgaagagttggcatttctttttattgccaatggcaggcactcattcatatttgatctcctcaccttcccctcccctaaaaccaatctccagaactttttggactataaatttcttggtttgacttctggagaactgttcagaatattactttgcatttcaaattacaaacttaccttggtgtatctttttcttacaagctgcctaaatgaatatttggtatatattggtagttttattactatagtaaatcaaggaaatgcagtaaacttaaaatgtctttaagaaagccctgaaatcttcatgggtgaaattagaaattatcaactagataatagtatagataaatgaatttgtagctaattcttgctagttgttgcatccagagagctttgaataacatcattaatctactctttagccttgcatggtatgctatgaggctcctgttctgttcaagtattctaatcaatggctttgaaaagtttatcaaatttacatacagatcacaagcctaggagaaataactaattcacagatgacagaattaagattataaaagattttttttttgtaattttagtagagacagggttgccattgtattccagccttggcgacagagcaagactctgcctcaaaaaaaaaaaaaaaaaggttttggcaagctggaactctttctgcaaatgactaagatagaaaactgccaaggacaaatgaggagtagttagattttgaaaatattaatcatagaatagttgttgtatgctaagtcactgacccatattatgtacagcatttctgatctttactttgcaagattagtgatactatcccaatacactgctggagaaatcagaatttggagaaataagttgtccaaggcaagaagatagtaaattataagtacaagtgtaatatggacagtatctaacttgaaaagatttcaggcgaaaagaatctggggtttgccagtcagttgctcaaaaggtcaatgaaaaccaaatagtgaagctatcagagaagctaataaattatagactgcttgaacagttgtgtccagattaagggagataatagctttcccaccctactttgtgcaggtcatacctccccaaagtgtttacctaatcagtaggttcacaaactcttggtcattatagtatatgcctaaaatgtatgcacttaggaatgctaaaaatttaaatatggtctaaagcaaataaaagcaaagaggaaaaactttggacagcgtaaagactagaatagtcttttaaaaagaaagccagtatattggtttgaaatatagagatgtgtcccaatttcaagtattttaattgcaccttaatgaaattatctattttctatagattttagtactattgaatgtattactttactgttacctgaatttattataaagtgtttttgaataaataattctaaaagcata

SEQ ID NO: 177 - DNA, 1910 bp, Homo Sapiens
tagaagacaaaatgttttattttaaaacattgaaaaaacattaaaagacaaatgtccattatgtaaccaggaatgttaaatatatggaaacggtaaatctctaaaatgtggtaggtacttccagagctaaatgttgcaagttatcctacttttttctctaatatcaacaatacctgatacgatgaaaaataacaaaaagaccttactaattatccaatcaaagtcatcatctttgggtaaatttatatcaacacaacttaaagttttgtccaagatgttcctgacacatgaagcttccagttgaatttcagaaatgttaacaaaagtatcttccttttttgcctgtgaatgtttgagtattgctgtattgttggcttatatccactacagatactggttctaggccagcccaaggatcttcaagcattgaaggcttgaaataattttccaactcattagacattcttttttctctaacacgccctgatccaaatggtgtagatgtccttggagaaccctttagaaaaaaaatcagttaaaaaaacacttagtaaagataattggtacttcttcctttagctaaaggttagcgggaatcacattgctgcttaaaagttgtgacttgaacctaaataatgttcaattacaaagtccatgcttcctttaatcaagtgttcctattttttaaaaaaagtacttaaagcaattcgttattctcatttatttataattccatgaccactgtcatctcaaatacttttgtgtctaatgtagtaactttgcagtaattaaatacaagcagtgatgaaatcaagtaattatattcaattttccctcgaaattttcacttttttcaggagaaaacaatactatagttttaaagtttctagaacctttctagctcatgaacattttctttactccttagctccaggctcaaaaggggtagggggttggtgtagaatacagcaagttggaaaaccacgtagttgcaagttgtaaaccacagaaatcccagacatgctagagatactctctctgtcttttgtatttactctcactaaaggaatggaaaacttccactaccaccgattttcttttcagggaagttggagcagaagccagtgtagctcgaaagaaagataaaaaaaaaaaaaaaaaaaagaaaaagaactatttcttgaaacaaactggcaaggcctttggcaaacaggaggaaatggagaattaggaaaatctgtgtacgggtggcagtgtattggttaaaagcacgagggctcgaaaacagaacgtacggctctgccactctttcggataatcttccggaagtcactcaacttctctaagcctcagttcgctcatctgcaaaattgggctaacaatagtacctcagagaggattagacaaaataatccacgtaaagggaatattagtaccgtgcctgccataaagtaagagctcggcaaacgctggctattattattacctgggggtgggtctgctgctgccctggggagtagccgaattgctgctgggaccccgcgggggacctggagtaggagccagggtagccgccaggggacggagacccgaaccggccccccgggaagctgccgccgtgtcgcggagagtgactgctcccgtacggcctagaccggggcccgtacggcggcgtgtggtgcggactcccgtacccgtctcgaggggagggcggccgtggtccgcccccgcccggggttccccggaagctgcttccgctaccccaacctcctccacccggaccagggtaaggaggagttgggggccgaaaattctgtcgctgcatatcaggagccaaagccgaaaacctcgcagccgcgttctcccaccggaactgtatcaaccggccctccgcagagaactgctagtcc

SEQ ID NO: 178 - DNA, 19681 bp, Homo Sapiens
gcaaattttatattaattttatttaagtatacacgtcatataaaagtttcatctcataattttaaagacacataattacttatatatataatgcttcaaactactttattaattatcattaatccttttggtccctgaatctgcctttgcttcctcttctaaggcttgatgcagaatataactgcccatggagggcaggggacaagaaattaagggtcccagggagacccagtttcagttatccttgatgatgctgagaggcattcagcaccacgaacatgttgttcaaacataaatgagaaaataaagtatctgaacaatcttcatgaggtttttccacacaaagtgtatttcacatttctatagatttaactactaacaagctacatccaaggaacttaactactactgaatcctcggaggtatcatcaatatccagcttccaatttccactctctaaaatatttctccattgtgctcctagatttccaggtgcccacatttacagtaggtatgattttctggggcttcagccactggacaaagcgcttcatttctaggtagctgctgtgttcactgtaaggaattcctgtaacaaaaaataaacgaatttgtacactaaaatcaaactaatttaaactttcacaatcctaaaataaaatagaataaaacaaaagagaaaagcaatccacagtatttttgtcaaaaacccctcagtgctttagttctgaaaagaaaacttgttgatatcttttatgaataataaagattaagacattaaaatgataccaatacggtttggctctgtgtctccacccaaatctcatctcaaattgtaatccctatgtgctgggggaggggcctggtgggaggcgattggatcatgggggcagatctgccccttgttgttcttctgatagtgagttcttggtcaggcatggtggctcacgcctgtaatcccagcactttgggaggccgaagcgggcagattacctgaggtcaggagttcgaggccagcctggccaacatggtgaaaccccgtctccactaaaaatacaaaaattagccaggcgtggtggcacatgcctgtaatcccagctactcgagaggctgaggcagaagaattgcttgaacccagtagatggaggttgcagtgagccgagatcgtgccactgtactccagcctggcgacacagcaagactcttgtctcaaaaaattaaaaaaaaataataagatagtgagttttcaggagatctgatggtttgaaagtgcgtggcacttccccctttgtgctctctctcactctcctactccgctaggataagatgtaagatgtgcttgcttgccctttgccttctgtcatgattgtaagtttcctgagccctcccagtcatgcttcttgttaagcctgtggaactgagtctattaaacctctattattcataaattacccagttttagatagttctttaaagcagtgggagaatggactaatacagatatgaaacttagaacattcaaaaatcgattaccttattgcgtgtatacttaataacatgcatttccagagagtcctatttaattaggtttttcttattaaacaattcttcctttagacactttacttagctacaggtttcaggaaaatatggaagaaatatgagtcaaatgtgaagaataacaagcaggagactctcacttccagagcaggtaagcagatttgtccccaagctttgcacacataaaaaaataggaaaaaaagaaaaaataacacaccgtttatcttctttgttgaagatcaagtaccacagagaaaggtgaaaagggtcctattttcagtatactagggtcttcagaggctgagggtaaatcactggtctggtgacaccccaaacatgtttccatcagctgtcactgcaataagccaactcagaaggcagtagtaaacctccctcaaggatgaaaacaggcaagtctgtatctcctgctgtcaccacatctaacccatcatcttcccgctcccaatctcacattgtcatctatacttccagtatacaaccacagtagtcctttcaagttaattctgcgatttcctctcaatatcactgatcacaaagtgaaatgatctgtattcattaatgtctatctactagtcaagctcctttatatcagtttacaatggactagatacaggattagagttgtagagagatgaaaactcttgaattattaaattctttggtgcctgtttttgttggatttgaaccttattacattttttaaaatgtaattataaacattataaacactaaaagtgagaaaatttaataactataccatatattgaaatgtttcctttggtctggggaataacatctgctattctagtgaacttgttagagtgtgtccatcctgtaggtcgaaatgccaaaatctgattgtatttcccaccacacttcttcaaatgactctgtaagccctgttaaattaaaatagcatattgaggtcaatggagacgagttatatggaataaaacagactgattaaagatgttatactggcacaggcatggggagttttcatttttaagcattagcttcaacaacctagtgctatgcttctaaaaaataatcactgaaaaaaaaatatataaaatattttctcctttacttatctgaagttaaacaagtacagtctggaaaaaaaagtatagcgagacaactttaaacacaagtaattaggtataaacaaattacaattctgatagctaccaaaaacaaaaacaaaactactctccaaatcttactctacagagataataatatcaacaatggtaaacaccaatgcaaacatatctccatgcatatacatcaaaaggggatagctaggtggatagaaataattttatgtgaatggcattatactcaacacagagatacattttacagctgcttaatagcattcttttcaggtgtttatgccttttaccctttaaacatgaactagatttattttaaaacttttcataccactattgttggaagtaatatgctccccttataagtcttgagtaggatagaacttccccaaactaaagtaatcataaatgatgacatttgataaaactcttagaaaatcaatgactgaagttcagtcttcgaaagataacagaaatccagttacaaataataatggcacgagggatacaaaaaaatctaatacttttggtctgaggactaaaatccatagtttcaaagacttagaatgaataataaaattcattttattgatgaattggtaacaatcctttaatcttttgtatcaaataagagccttttattaattagaagtgaatataaaaatacctaccataagacaaccatatttcttaccaattactatgcacaccaaaaaaaagttaaagttattgatatgtaactaaatttccatttcaatattcttggctctgcaaatttgcaagtttttgccttgcttactctaggacctagttaatgtaatattatttgtttaatcactattccttctgcccttgtcctcacaaagaaagaaaataataagaaactgaggtttagagtaactatacatataatacataaactgagtccaactttcaatacacatcatcaaacctgtccattcctatttgtctctgcaaaaccatccagaagaattaaatgataactaatatttgctttttgtgggacaaattggagttaccacaaaaacatcattagcttgtaccataaacaaaaactttggatactatcatataagccaaatctacagaaaaaaagactaccagcagctacaaatagtccattaaccacaatctgagaactattctcatgaggaaatttattaagaatactttagtcaatatgaaatccctgatttatgacttgtctctctccgtttattggtaaccagtttgggagaaaaacacttttagcaatgttactagaattattttttcagcatgcaaataatcatctataacatcattgttataacattttaccacaatcaatcaatcaggtttaaatcaggtgatagtcaactacgtagcacatacgtgaacttgggatgttgaactagatagcatgaattgtatttatagcctttcaaaggctttcaggcatgccctgggcaccttgaaaactgtattaggattaccttttcacagaaagtaattatctctcatgaaacacaacttttggctggtaaaaaaaaaaaattggctctaattacaaacatcagcttctgctccatctgcgttttggaggtaagaaatcttccgaggccgggcgtggtggctcacgcatgtattcccagcactttgggaggccaaggcgggcagatcacgaggtcaggagattgagaccatcctggctaacacggtgaaaccccatctctactaaaaatagaaaaaattagctgggcatggtggcaggtgcctgtattcccagctactcgggaggctgaggcaggagaatagcatgaacccgggaggtggaggttgcagtgagccaagaccatgccactgcactccagcctggtggacagagcgagaccctgtctcaaaaaaaaaaaaaaaaaaaaaaaaaagaaatcttccgaaaatatttgggtaaatgagggacaggggaggaaaaaaaacttttcacaatatgccattttatagttttgttttttaacgttgtgaatgtatcatctattcaaaaacattttaaatacatatttccattatcattgctagaatgtttaataaacaaatattaaaagaaaaaaaagaagtcttcagaaaatgtgatcaatacccagtcactttaatggaggaagaggagggactactgaaggcaataccagtaaatatccattctggtattacatagttgcttgggtcagtgtggaggacaagaagatatagacttcactttctgcgagcttacagcctagtgggcaggaggtcagtaaacctcaccttctaatggaaaccacctgccctttctcagctttttctatctctcatcatctattacaccattagcagctaggagccttacagactgaccttttcacaaagaacttgtgttttattataaaatcctagacgtggaaacatacagacttgacgactatcaaaaatatagatttaatgactccaggtcactcctccaaggacactagcctcaaaaaatcattcaaaatcaacattcctgagttattaaaaaccaacttgaattcctgtattaaaaagttatgcttaggccaggcatggtggctcacacctgtaatatcagcacttggggaggctgaggcgggcagaccacttgagctcaggagtttgagatcagcctggtcaacatggtgaaaccccatctctactaaaaatacaaaaattaaccggacatggtggcacatgcctgtaattccagccactcaggaggctgaggcatgagaatcgtttgaacctgggaggcagaggttgcagtgagccaaggttgcaccactgcactccagcctgggcaacagggcgagactctgtctccaaaaaaaaaaaaaacaacaaaaaaaaaagtttgagtttgtagtagtgaaaatctaaatcttgtttaagttgggatttgtaaatatatgctgtctacaagaaggccatatgcatcagaacgcagtctgtagagtggtaggttgtgacggaactgtcagagaggaagaggtggccctcttcctgttcaaagtggatgcgcttcattacctatttttcagatcttgctcagaaatcttacttcatcaattattctcttatcttagattctccctgtccattaaaacataaaaatcctcatctctgatggctaacagacaagcaaccctcctccctttggccatgaaagtatccagctcctcttcacaccatgctctagtcttcctgtctccattgcctcacctctcattcattctttttatttcataaacacaatagcaaatgtgaaaatacattgtttcatgcattatgttctgaatttattttaatatacaggtttgatgtattcaattgccaggtgtcaaaatgttagtatatggaataaacgttagttagtatatgaataagtctgacaaataagcccccaaatcccagcaaggtcatatcatacgtcttaacttacaccttggaactaatgctcaaacttcctcttaggatacacttccactatttcatttaattgtcgcaacaagtaaattttcaatatttatcaatctagaaaggcttaatattaatacagaatagaatagacctgaagtaaactaagaacttcttagattcttcactcatttccccactcacccagaaagaactggaaaatgatcttaaaaattgaaggtttgaatgaccagatagctgcatacctttccatttttgttccttcctatatattagttctctagctcctaaacttctggtgggcatatgaattactctacagagttgcacatctagaaaaactatgaacatttaaaattcctcttaaaagattgtctagggcaaattttactatgggtgactctattataattgaattcctctaagttaaatgaagcttaaaataatcagattaccttttttgttcatcctaaaagacatatctcttgaatgcttaccttaaaattaatttgcatcattgggagaaggtgaaccaatgaactgcacatgtcggtagtgatgagtgaattaatttctggtatattgaggcactgtagagttttatatttttcctgggacatgcccacttttgaacctaaaacatcagcaatggctatgggcaaaagaaaagattaaaaatagtaaacttacagcttgtgaaaaaaagttacagcttaagcaaattttaaggtaagaatttaccaaataaaaggaaattcaaaacattcacacttttaccatgatatctcaaaaaggctgaatcattttgttagtttactgtgtggaatgaattgtgagaaaactaaataatttatttttaaaggcttattatttactatttaaaaactgcaaaagtgtatagaaagtgggtagaggaagggaaggaactaaatttgaagaaattaaaagccccagctttatcatctttaatgtttgatataatgtggccatacgtaagaagaaatggaaagtattttgcaaattagtacaatactacctggacaaactaagttatacatccagaaatcatttaggaacaaaaattaaaactgattgccaatgtaattattatcctcaaagaatgcagcaatacaactatgcattaatcatctttcaaagtttactaaataacaatgtagcatgggcagctgctctataaatttcttatatctagaaagcctaaattaaacacaattatcaaatgtttccctaaagtcaaacctttcaaagattaaatgtttcaaactgtcaaattttccttcaacttcaaaggtaatattgaatcattacaggaaataattatcaaatgcaagagtagaaactgaaagggcattatgcaaaaagaatctgatctttataatatattaatgtaaattagatacacctacaactcacctaggaagactttctcttttccaatagagtaagtgccacagacaacaagagcatgtgggtttagagttacagcctcaaaggcagtgttgatggcaaaccggataacctcttgctgagatggaaaggtgtattctgggctacaatatctgtggtatggaaacatggtacttactaaaagaacaataaaaaagccatcaccttaagctggatgctattttagaaaacaagcgttagcaacttacatacaacagcaatgtaatatattaataccacaagttatctcactgcctgtggttggaattatttgccagttactactaacttaagatcaaattgtaagttttcaatatatctttttcattatatttcttttatcactctcaaaaaattgtctttttgaagacttttttcctccaagaatatttctagcaagccagctattttagttataaattataaacctcactgtcttttatttaactccaaacactatcaaaaaatcatattgataaggattatatttggactaaagactgtcaataaaaaatgattaaagtaatgaaactaaatatgaatttagtgaaacagttttaaatcagttaatattgacatggttgatattaatatcatttcttacagatacaaaatatatatactatgtgtatatatatgtacatgtgtacacacacacacacacacacacacacacacacacacacacacacagatacatgcaaatacaacagatccagttgggtctatctccatgcaatataacccagtgaaaaattaagctactatctatctatctatatttgatatgaaaagtaagcactttttcactaaaaatgtaataaactgcaaaagccaaagaaacatatttttcccaattttcagaattgttttgctagtcaactactagagaagagtaagaataacctttctcctataacaacccatgaggaaattcagaatcgtatcagaatagaactaggtaacaaaaaagggtttttttaaaaacttattttcttaatttatccagtgcttaaaactcatatagaagaatggaaaaaccagttatagtgtgagaaaactggatgcggaaagaccatcttttactaaaatattgcatccaaacgtacttctccttgaaacaggttgaaatggttaagataatttctaacaagttgatgagatattttaatatataaaatcacatcatacaccagaaatatatacaatttttatttacttaataaagctagggagaaatacatacacagttaaaatgtaatggcttgtgccattatatttatagcactcaggaattcaaaactgtcacttataaattatctttttaagaaaagaacaacagcaagtttggatactcaaaaacagaatcacattttgacctctgtcttctcttcacaattaatagctacacagttactctgaaaggacaacttaaaagggtgtcttcctaaagtttgctcctaagtttttcttccttgttttagtaacaggattctcatgtaacatattttcaaaaataaatcacacaaaaaaatgagctgtagtcagttaacacatacaatctcaaatttgcccttaagcaagtatatacatatttttcaaacagcatccctctgataaagagccttaaaataataattggcaataagccatcattttgataaccataatacagagagcaaaggctgtcagtgggaaaaggaaacacacaaaaaaagcctctcttacgtggtatctaagtacagcatatggactttctggtccgcaagaagagaacgttccatgctgggatctgctctgaagtctcccgtgtgtaatatgacagtaccattaggaagataaaagaggatcatgacagcacctggacagctgaacacaaatgtcaaaggaatgttcataacacaggcaagcacctaaaggaacagtatctatttcaatatcaacaagttagcacgctttattagctgaccacaatgacatagcattgcactacaggaaatgcggcacttcaactcaaggaaatttacatcataaaaagaactggtgtgcaggaaaggcagacccaggttgctcaaactccaaacattcccaagaaaagcatgtcttcaggactggcccttggctggctcctaggaaatgaactctgaaccctaggaatattatgcctggtaagactgttttgtatgcctgagacattgaactatgtgatactagcttgacgctaactttgtgatctatggtgaaaaccccataaagttgactttaaaaatcagaactcggccaggcatggtggctcacgcctgtaatcccagcactttgggaggccgaagcgggtgtatcacctgaggtcaggagttcgaaaccagcctggccaacatagcaaaatcccgtctctgctaaaaatacaaaaattagccaggtgtggtggtgtgcgcctgtaatcccagctacttggaaggctgaggcaggagaatcacttgaacccgggaggcagaggctgcagtgagctgaggctgtgccattgcactccaacctgggcaaaaaaagcgaaactctgtctcaaaaaaaaaaaaaatcagaattcaaactggcaattaaaaaaaaaaaacagtagcaaagttagcagacaaaaacttaaaggcaacctaatgtaatagcttggcctggattttaggtaacctagatttagtcttctttctcttcatctatgacctctatgttacagtgggctaacattctatggaaagtagaaagaagcagagttgacagttgtgttttgacaacatgaatgctgatagtactttatattaaaagaaaaaaagagggaaaaatggaggccatttccaagaaaaaaaagtcttccaaacctttaatatctaaagcctgaatgatttcttagtttaaagaggggtagggggagataaaaccgacctctagtatctgaatggaatacaagctgttaatttatgtaaatgataaatgatactaaagaaaatggcaaaatgttatcttgcaaagaacagcaacaacatgttaaagtattttaaaaaataagatggaatctcagatgtcaagtgtagtaatttaaactggataaaaaatgggttagataacatttagaagatccctttacttttcatctctgattctataattgggcacattatttttcaaaaggagaaacatcttactcaagttttaagaaatatcaagcatattaattataatgaaaaaagttattaatcatgccaatgtgttgtccttttgaacatttaaaaaatgtgctattaagatgactttaatacttactgattggcatcaagcaaaacaactttgacaccattcacaatacattcagtgtccagtggcaatgggtgaatatattgttcttgcacatgaagcttgttcttcaacaaattgccagttatctgcaaaacaggacgtgcttattgctgatgcagtaaaacactaaatattttatttcatatctagtttagaaccatagcatcttaataacatccattttcctacttatatttaagtaaacactccacaatgccaggaagaatttcctataatggctgtgccactactctgcttgaaaatcgtcactgacttcgcctcatctgtgaagagtccatccttcccaccatgacatacaaaagcctgagtgatctggttccagcccattcctgtgggtttgtctcctgttattccctaccttgtgttctagccattttgaattatctcaagtgcctggaatgggcatatttctcaggtgcctgtgcctttacataaactttactctctacctagaatgctctttcctctgcctggtcctggaatcagacagatttgcatacaagttcagactctgccatttttagctctgtgacctggggcacgtcacttaacttctccaaaccccaggtgtttcattaataaaaagaattcctgaagcatgcttcaagaatgctgtgaagattaaatcaaattctagttcaagcccttagtaatgagcattaaaatgttcactttttaataattagttcgaggtatcttttaccacaaaactgtgtctaaccttagcccaggacaggataaagcactctcttctccctactcctagggagtactacttctattatgataccaatcccaatatggcattatttatgaatgtttcctctggaggttataagctccttgaagctcgatacagtcatgtccctcagtatctgcaggggactggttccaggaccccctgaggacaccaaaatctcaggatgctcaagtcctttatacaaaatggcatagtatttgcatataacctatgcatatcctctttaaatcatctttagattaattataacacctaatacaatgtaaattctatgtaaatagttgttatactatattttttaatttgcattatttttcattgtattattttttatttttgaatcttttcggttgcggttggttgaatccatggatagggcactcacagatacagcaggctgactgtattttgccttgagaatccatttaggctttcagtgaatgttaactaaatgaaatttcttgtttttagtacatcgtgaaatagtttatcttttgtttccatgtaataagacagatgttttctaaaaactgaaacttgacatcaactcgttttaagtttaggacttttatgtggaatatgttttctcattttttttctagtagaatgaaagatcttactggtttaattattattttttaaccaaattgcttagaaattcacagcattctacaaagtcaaaagttagaatactaaaacttacctcactacaataaactggaaatgtgaagtgtttagacaatccagcataatgatcagaatgaaaatgtgtgagaaaataggctgtgcaaccttcaaccacgccatactgaaaggcatcaactgtaaagccggttcctgcaataaaaataccgacacagtaggttgagcaagagctaagatacccaatttgattataaatactgaatgaaccctctatcctctttacctcttatttccaatttaactatatttaaaaacttatatcacataaatttaacaaaaggtaacactaaagatgagaatgtcttaaaagtttctaccaagtatctcagtatagagacttttatttgtgaataattgcaccaaaaaaaatttttttaaattctaggttacaaaccaattacttctttgttttaactaatactttcataatacttagcactttacttctgcaaaacagcaaaaggagaatgctaactttcttctaaaacatgaattctcaatgggggcagtattgatctaaggaagccaaaatggttgagggccaacataatctcacatatgagacaaacaacgtatctaccatctttgaattttgctgcacagtcgaactagaggagggggtgggaaacaagaaaaaaaaatgcctaaaaaggctccttagaggagcagtaatgaagaagaggttgagaaatactgttctaaaatgtgctcatgcaagaaataattaagtgtactgactggcgatgtgcaaataaataagcataacttcccaattctattgaggcttatcaacacatggttttaggatcatttaaagtatagaaaattggccgggctcggtggctcacgcccgtaatcccagcactttgggaggccgaggcgggcggatcacgaagtcaggagatcgagaccatcctggctagcacggtgaaaccccgtctctactaaaaatatgaaaaaaaaattagccgggcgttgtggcgggtgcctgtagtcccagctacttgggaggctgaggcaggagaatggcatgaactcgggaggtggagcttgcagtgagctgagatcgcgccactgcactccagcctaggcgacagagcgagactctgtctttaaataaataaatgaagtacagaaaattaatcaaaataattattaaaaacaccactgatgttatgaagtatataaatgctattctttacataaatacattgaacaaattatagatctagaacatcaataaagcactttaaaaatctttcagcaaccaagtatattttggcagcaaccaaagtatatgaaagggcagagaaactaagttctaatacggttttaaaatttttggcatttactatgatatgtaaaacctgtgacatttcccatctttgaaactatttagtactttgtatttctcacaagcacttagaggctgccttttattatagttatttacagagatgcctttcctcctttcatattaagctgaatccctattcctctcttactaatctttctatagcccgtaatatccacctaactagtatagtcacttacatagagggcatgtttaatagaaacttgatgaattgaatggagcaaaaaaaatcaaataggcaaaaaccatatctacgttagaggctcatgaagtatcacaaaagcaaaggaaacacatacaaaaaattgtctcatacacacacacacacacaatgggcaataaacacaaagttcaaaaacgttgtctttgttgatatatcgagtattgacatttcaacttaccaggtattttcttatagaatggacatgtcttttttcttgatcctcctacattagatgactctgggattttcttgttgcccctttgcagcccaccatgagctgattttgtgaagactttgactttacttaaattgactgcttcagattctgtattaataaggtgatctgatctcttctgacacgctccttcctgcagtgaatttgactttctacatctctttttttgacgctgtgacctctcactagaaagttccacagaaagctgactctcatgtaaagtacttgcatcaaattctaaatcacttaaagatttttctgctttcctcttgcactgcgaggacctcttttgattaggacttggaactggatttaagtttatcccttctaatgcactttcccctagcaatttctcttcctttcttttgggaggtagtccaaaatacacacctatatccatttgcttcattaccttggtagaaggatgtcttgcattatacttaagaccagaaggcaatattttcaaatacttcggagcaggtgtactagacaagttttctgtatttaaaattgtagctttaccaactggcacaccctctaatgcctttctgcagaaacatgctgagttagtattattcttagcattcaagttctcacttgataattttctaattgtattttgggttggttgggaagaaagatacccttctacctgactttcaaaaggtttcaacattaaactcttaactaacggaagagaaacttgattgtaaacagatgattcttcaattacctgtttctgtttatttgattgagctgagtgaaattctggctcatcaggttttgctttagttgcctgatgaacagaagcagcaagcttccctgccaatgcaggtggaaacaacacaaaatcaccaccagtacatgccagatcataaggcaaagtactctcattattttgagaaataggttgagacaaatcatttagactattgaatctatacaatccttcatcatacttatcccgagttaagaagctgttcactttggggcagctctcatcctggtccttcagtaagggaccatgtcgttttttaaaaaaaccacagctgtcatcatcttcttcgaggctgccatcttttgagctttcggtaaaaaacagttgttcttgtgaatcatccggtttttcatcgatatcatgagtgtcttcatcactttgaagtggagaataggagatttcacagtcactgaagtcattttctggcaatggcaaatttatgtgttctgagttgtttgcaagacgcaaagcaactcccactagtttgtcattctcaacaaaatctgtaaattgtagagcttgttgggatgtttggatatgagtagaaatcttttcactggcttcagtcagagacggagactttttaaaatactgtgtcatcaataagggatcatttgaaaccgagttatcagtttggttctgatacgaagaccatctttcctcaaggctacaaaggacgcctgacttagtctcactgaaactgccacctgacgcaggtgatgggctgctaaaaggatgatcaccagccctgctttgagctagcaggaagtgagtgtatctcttgtaatgaaaaggaatggttgaggtacacagaagaccatcaggacactctgaaattttaataaagaaaaaatattacacgatcaaagcatagactaagctttgacaacattagcagtataaattgggttccattatttaatatccacattgcatataataaaaagcaacaattttaataagattagttataattgttgatacactgaacaagttttagattctattctaagaatagaatttgagaaattggttaattataaggctttactaatttggaaactattccctatcatactaccatgattgagaaactttctataagccatcttggtatatccctgtgtatgttaatttccagatttatcaaaaaatgacacctccctcccctcaaaaaagatgttatatttgttatattaaattagaaaacttcatggcttacaacctaacttaaaaatgcctcttaaaagcatttgttatagaatggaatttaattcaagagccatctgagagtctactcaaaggagtttagtgaaaaaccaaaagaaaaattttttgaggtggcttcatctatatgacattttaccctaaggtcttcaaccatggactccaatttccattcttgattttcaagttacatgaaagaaaattactagcaaatttgtgaggttttcacttgctatccttttctgggaaaggctaatgccaaatttaaagaagagttgttttttttctgtatcttcatgcagtactttaaaataactacaggttaataataaaatgtattctgaatcatagctaacatgaaagccatattgagtatttttttattttactgaattttaactttttcagattaaaaaaatccatatatggaatataaatgatttcaaaatatataaatcatcacaacaacctgttctccatatgtattccaagtaggattttctacattaaatacttattacatattttaaaagataaaaaacatagcatacttttattatcatttgacacgttttttgttagaatcttaatcacctaggactccttcacagttcctcttcctgtatacatagcacgatgactaaaacataaccatatttagaaaccacattatatctatacttttttttttttttttcagacaaggtctccctctgtcgccccacccaggctggagtgccctggcatgatcacagggccctacagcctcgacctcttgggctcaggtgatcctcccacctcagccttccaagtagcccaccacacctggctaatttttggtaattttttttgtaaagatggggtttcaccatgttgcacaggctggtcttgaattcctaggctcaagtgatccgcctgcctccacctcccaaagtactgggattactggcatgagccactgtgcccagcctatttataattttctatggagttccataataaccaccaactggggccgggcgcggtggttcatgcctgtaataccagcactttgggaggccgaggcgggcagatcacgaggtcaggagatcgagaccatcctggctaacacggcgaaaccccgtctctactaaaaatacaaaaaattagccgggtgcggtggcgggcgcctgtagtcccggctactcgggaagctgaggcaggagaatggcatgaacctaggaagcggagcttgcagtgagccaagatagcgccactgcactccaatctgggcaacagagagagactccgtctcaaaaaaataaataaccaattggacaagttatctgacttttaagaactttcatctataaaatgtcaatactagctaccttatatggtgattgtgaaagttgggtaagtagacagtgtgaaagtacccagcatagtaaggattcagttaacatttatggaaaataatccagatacttaggaacttttatgaaataacacaatgtatttaaactgttttctagtctgccatttgctttacaattataccgttgactggtatggtgtttcccagtgtctcatctctcttttaggttactgcttgccttccttgtttcactgaattggtatgtctgacctaatgaagactttttagattatttagaaactactacgttttctgcagtcttacctgtttcagagcgtggtggagaatccaaacattcaaaaacatgccatcgaggtgtctgccctatcaatgaggaaaaaggcatctggcaatttggacagtatccatcataaactggacgtatctttggggacacgtgttggcttttttgagttctacagagttttcctggagtagtttccttgtcttgggtctgctgaataccatctccacaacttgaattctgactagaagcaacagaagtctgacaacctgcatttccaaggggcacttcatggtccttcacctctttagcttctgcggctctttttctgtttctactccgttttgactggtattttccatctgttgctttttcaacagattttagaatatttttagagccattatttggatcaactcgttttggttttcttttagatttgtattcccaaatgtcttcttcggaaatgtcttctaacatggcaaaatgattttatcattcaagaagtattaatcttaagtaaactgaaagtccatttcttgtcacaaacaaaaagttatagaattattttgctgagaaaaaaaacaaaggtaacaaaacccccaccaactcaatgggaatctgcagtgttggtaatgaacatattggcaagctacaaaccttgtacctgacaacacctgctattccatttataccacaatgaaactaagataaacctatcacaggagtagcaactgtgaagttctccattatgggtgctatttcattcaaatatcttgtccttttccagggcttgattcataaaaataatacttcaaaaattaagcgctaatggcaaatataggttcaacagcttaatcttagaacgagatttgtaacattgttatgaagctactgtcagttctttcaagtggacaaccgtccaaataattcataaatccaaccacagtccctggacaaagggcttaacaggtatcccaaacactaaatgactatctaacaaaactagtcacaacataatcaaagagatgtgtaattcgcaaaaaactgcgaagtcactgccctcatccacgactagtggatactcaaccacttcagtttcccgcgacagtccatgatcttcctccagcagcaatgaacaatccctgcacagtgaacaaaaaaagttgatatgtgaaaaaagttcaaatatgtgaaagagtgggcttgtattgaggtctgactccgtattgcacccatggttccgaaggtggccagccctctgtccacctgactcaaaacggggtcacacgccagcctctcccttatcttttggcattagaggctgggaggccaggaagcggggccttaatcatctccaggttaagcatagcgagctccaaaaagccctcagagtcctgcccttctgaagactctaaggcccgccctcaaggaccctcaccgccccccacctgccactcggcaccccaagggagccgctccagctgcatccgctcctcccggcacccccatctaaaaatgtgttcgcgcccgcactttcagcactcccagatgacaaaacgctgtgtttgtgtataagtgaaagccactcgcgccagtcacttccagtttacaaagccttctctctggaggttatccctacccgctttacctttagggtcttggcgggaacaagttcccgctgccagtgccgtgtcgaatc

SEQ ID NO: 179 - DNA, 9468 bp, Homo Sapiens
gatgacattccggtagcgcagcctatcagcttgaatgtgaggattgcacagagccttcttcagctccttcaccacgtcctcggagccaaggtacggcatcttcctaagagtcacagggcagctcccacagctcccacggtaactcgagggctccttctcgtcctgatgtgggagcctgagtaaaggaaatatgagtcagtgaaaatacaaaaggcgagatctcgcctcaggctcggcttccgtagggccggcacgctggccctgacacacttccacgccctccgcgacaccgcgagccccaccctaggctcttcaggccctaccgtcggccggcaggccgttcgccccgcccacagatcgctcccgctacttctaggtcctccgccggatttccagcgccgcgtccgactgaccgcagacccctccctctccagttccagccttaattccccctccacgccgttctcatcgcggataggcccaatcttgctttctgcggaagtcccgcccccttgtcaagagaccaaacagaagaccgctgccggtctccccgcgagcgagcgctaagcgtagtcccgactccgaccttaggatgcccttcccccaacctctcactctccaggcgcagctgcgcggctccctctggtggagctgcggcgggcaatcggaaatcggctactttggcctgtctcctccctgcagcgcgcgctttgagtgcccggctcggcctccgctcccgcgcggttgggagtgtccagcgccctccgcgatttgggctccagcgggcagggtgacttcctttttctgcccactctggtaacttattgctctgctgggctctttcccttagggtctctggccctgttcttgccccagcatgacttttatcgggacgccgttgtggaagcctcacgcaggagccctgcccccgtggagaagatcccactggtgactccaaccctaccaccatgaatggggtcctgatcccccatacgcccatcgcagtggacttctggagcctgcgccgggctggcaccgcacgtctcttcttcttgtctcacatgcactcggaccacaccgtgggcctgtctagcacctgggcccggcccctctactgctccccaattacagcccacctcttgcatcgtcacctacaggtatggggctggagtcggtctccgagagctggtccaggcatctgggttgggacttcaacctgtcattcttggagtcatagaatgggggccacgaaaactgatttggaagttgtttgaacccaaaaatgcatctttaacccagaataggaacgtgttttcgaagtgaccaacttgagatagttagccataagttgaggagatattttaatccagccaaggaaactattcctacctttataagtaagctaggccgatgtttcccaaacttgccttttttttttttttttttttttttttttgagacggagtctcgctctgttgcccaggctggagtgcagtggcgcaatctcggctcactgcagcctccgcctcccgggttcaagcgattctcctgtctcggcctcctgagtagctgagattacaggcgcacgccaccacgcccagctaattttttgtattttttgtggagacggggtttcaccatgttggccaggctgttctctaactcctgaccttaagtgatccgcccgcctcagcctccccaagtgctgggattacaagcgtgagccaccacgccccgcctaaacttgcctcatcttaagaatccacctaatgtgctgggtggttctccagctctctccccaccccacccttaagtctccaagagattaagatcaggagtaagtttgggaattgctgactagactgtttgctgaactctttttttttttttgagatggagtctcgctctgtcgcccaggctggagtgcagtggcgcaaactcggctcactgcaagctccgcctcccgggttcacgccattctcctgcctcagcctcccgagtagctgggactacaggcgcccgccaccacgcctggctaattttttttgtattttttagtagagacggggtttcaccgtgttagccaggatggtctcgatctcctgacctcgtgatccacccgcctcagcctcccaaagtgctgggattacaggcgtgagccaccacgcccggccagctgaactcttaaattgtacaaagggtgggatgggaagtggaaggaggaagggcagattgcttgggaatccccattacagcttctgctcccggtggctcaggatttggtcagctttcctgattcatgtaagggatagtccctgacccggggaggtaacggagaggagtcagtggtcactgggatgactaactgttttctcaggtatctaagcaatggatccaagccctggaggttggtgagagccatgtattacccctagatgaaattggacaagagaccatgaccgtaaccctcctcgatgccaatcactgtcctggttctgtcatgtttctctttgaaggatattttggaaccatcctctacacaggtgggcctctcaaggaatcccagtgacttctccagactagatgttttttttttttttttttttttttttttttaatgtatagactggggcctcgcagtgttgccgaggctggtctcaaactcctgacctcaagcaatcctcccgcttcagcctccacagtagctaggattattggcacaagccaccacacctggcagacttttcttgagcagccttaactcaatagaagtctggaggcgctggaggccttctaacttcatcacatatgagcatagtgaccccatctcaactgatttcccactgtttttttttccttcttctttttgagacggagtttcactcttgtcacccaggctggagtgcagtggcgtgattgtggctcactgcaacctccgccttctgggttcaagtgattctcttgcctcagcctcccaagtagctgggatgacaggcgcctgccaccacgcccagctaattttcgtatttactattagtagagacggggtttcaccatgttggccaggctggtctcgaactcctgacctcaggtgatccacctggctcggccccccaaagtgctgggattacaggtgtgagccactgcgcctggccgatttcccactctttaagggtccgaaccttgtgaagagtaattgaaaaataggagtaggatggagacattacaacaaagaaaccatgcagctatactgcctagttcagtgccaggctacataatagttttttcacagactagtaagcaaacgcctgtctattgttggaggtaggagaggcttgtcttctattcttttgtctctgaccttctgcccccatgtacatattcctccaggtgattttcgatacacaccatccatgctaaaggagccagccctgacactggggaaacagatccatactttatacctagacaacaccaattgcaatccagccctggttcttccttcccgacaagaagctgcccaccagattgtccagctcattcgaaaacacccacaacataacataaagattggtgagttgtttcctttcagtttcctgtcacctgtagatagtgaactagattctttaaggattctcacatctttcagatctttgtgcagttctcactttctcctacactgaccaccttatttaaaattgcaacctggctaggtgtggtggttcatgcctataatcccagcactttgggaggccaagatgggagggtcatttgagcccaggcgtttgagaccagcttgggcaacatggcaagaccctgtctctacaaaaaatttaaaaatcagttgggcacgatggtgcgtgcctgtggtcccagctacacaggggactgagacaggaggattgcctgggtccagtaggaggtcaaggttgcagtgagccatgtaagtgccattgcactccagcctggatgacagagcaagaccctgtctcaataaatgaatgaatgaatgaaataagtaaaactgcaacctgcccaccatccccattcccaactcctgatcatccataccaattcatttttttcatttttttatagcactcatatactatatatatttttaaatatgctattgcttacttgttgtctatcatgcacttcctctggcccatgcacatacgcgtgcacacacacacacacacaagcataaactccttaagagcatcactggaaatgggaagagactttgtgtgtttgtggaacagagaagcagcagtcagtatgacaggcacacagtgggcaaggaggctgaaaaggcaagaggggctgaagtgctgttaagccattttggacttgatcctaaacccaaccaagagctattgaaggattttaagtagaagagggacaatatgcactcatcaccttgcaatatattctataatttatgtatttattggactttttattgtctgattccccctgctagaatgtgaattccactatggcagtctctgttttattatgggtgtatcacaaatgcctacactaatgcctgacacagaagcattcaatatgaatgaatgaaatttatcagaacatagatatttaagtgagcgttgtgctttaaattaagtatactgaaaaaacaggtttgtgcttgttgtactgattataaatagtataaaacattgttgaggactctttcttggagttgccatttggaatagtttatgaaaatacatttttgttttataaaataaataaatgtaatagatttggttctaaattacttttttggttgtttccaaatttgtgagtctacaaaaggacaaagacttgccaccattataaatatttgaaaaggacatgtctcaactctgaaaggagtttcaaaatgagactaaacaaaggcattgaaaaaattatataacttccagggtgactaccaaatcgattgagaaatatcctctactctcaggattgcttagctacttataaagacctaaccattcttaatattttaatgcagaattttctcaaaaaagcaaagctggctaggaggatgctatagtaagccttaattaattttgcaaatatgtaataagcctctacccactaagtaccaagtatccaataggcagtggggatataaagatgaataaaatatagtctctgacttggagggctcacagtctggtagggaaggacctgtggggaggtggaagtgggaatatatatagagagaagaaaaatccgctccatttgtgcccaaggagtgagattttgaaccataatcaggaataaagtggatataaataatatatacttctttttatggcgttcacaatctggttgtggatttgaaacttcttcagaaaaagtctgagaacagctattaaacaacatctcccatatctgttaccataaccatttcccaaattaatgtctccatttctttctctgtaagtactatttgggcccttcaattgaaacttccactccagcttcttctcatcctggcagtcaaataatattattaccatatttttctttttaaagccctgctctgagcatattattcttatgattagaattagccattttcctgcttcacactcagtggctccccttcacttacacaatgaagtccaagcttcttagcggtacatataagacgctctattatatggcccttgcttgcctctctggtatcatttcttatcaattccttttttactttagtaacagcaaactgacccctcttaaaatgttttccactataccctttctaccctttccttgccaggttaaccttgcccatcctttaagatttagcctaacgttccctaactccatcacctgttagatacaatactgtatactttttttgtttttttttaagagacagggtctcactctgttgcccaggctggagggtagtggcatgatcacagctcactgcagcctggacctcccggactcaagtgatcctcccgcgtcagcttcctgtgtaccaggaactataggcgtgcaccaacatgcttatttgtttatttttgtagagacagggtcttgccaggttgcccaggttggtcttgaactcctgggctcaagcaatcctcctgcctcagcctcctaaaattgtaggcttacaggtgtgagccacagtgcccggcctgtacacatatctttaacgttgctcttaattgtggtttttctgggtctccttgtagatagtacttcttgaggactgacagttttctttattagttttcatggtgcctgaaacttgctagatgctctcttttgttgaactaaatgaatgagtggattctgtgtcattccctttcatatgtcttagctcaaatgccacctcttccttgatattctccctggatttctccatgaattgtatctatttttgttaaacattttgttgatttattaggattttccaatagcttaattttcttccttctcttactttccccaatacattgaacattatttaggactctacagcctgggaaaggaatcactgctggagcagctggccctggagtttcagacctgggtggtattgagtcctcggcgcctggagttggtacagctactgggcctggcagatgtgttcacagtggaggagaaggctggccgcatccatgcagtagaccatatggagatctgccattccaacatgctgcgttggaaccagacccaccctacgattgctatccttcccacaagccgaaaaatccacagctcccaccctgatatccacgtcatcccttactctgaccattcctcttactccgagcttcgtgcctttgtcgcagcactgaagccttgccaggtggtgcccattgtaagtcggcggccctgtggaggctttcaggacagtctgagccccaggatctccgtgcccctgattccggactctgtacagcaatacatgagttcttcctctagaaaaccaagccttctctggctgttagaaaggaggctaaagaggccgagaacccaaggtgttgtgtttgaatcccctgaggaaagtgctgatcaatctcaagctgacagagactcaaagaaggccaagaaagagaaactttctccctggcctgcggaccttgaaaagcagccttcccaccatcctttgcggatcaagaagcagttgttcccagatctctatagcaaagaatggaacaaggcagtgcctttctgtgagtctcaaaagagggtgactatgttgacggccccactgggattttcagtgcacttaaggtctacagatgaggagtttatttctcaaaaaaccagggaggaaattggtttagggtcccccttggtacccatgggagatgatgatggaggtccagaagccacagggaatcagagtgcctggatgggccatggttctcccctgtcccacagcagcaagggcacccctcttctagctactgaattcaggggtctagcactcaaatatcttctgactccagtgaactttttccaggcagggtattcttccaggagatttgaccagcaagtggaaaaataccataaaccctgctgaagacaggagagtacagaatgacaacattgagcccacactgcagttttgaagatagtaactgatggctggtgggaaagagtttgtttttggggcctacttttctatctttacaagactcttatgggcccaccgtggagcagcacttcccaaaacttgttcactggggtcctcgtgcctatggaatccttctttttataactaagtttaagaaatactttttttataaaatctttggagtatgcgtgagcaaattaaaagttctttgaagtcctacagtaacttaatctgtttaaccttgtttaacccagtatttctcaaacttttgtgaacatgcaatcatcttatgtgggtacagaaagaggtaaagagtctgaatcaaaaaggaccaggttattgctgttgctgttttgtggtgtcatgagccattctccatgtccccttctccctcttctcagatcaaaatccctagggagttctatttttaaaattatgaactatggcgctgcatgcttcaatcctgaacgtcactgacttgctgtgaccatccaaataattttcctgtctctgcctctgggagggaacaggaagcgatgaagaggtcttggaacagtagtgaaaattctacctctatgtccttcatgaggatgtgcagtatcccagtatcactgggatccatgtggaacagagccagctggggggttgggcagctctctccaaggcagtacctagagcccagctgaacaacaaggctttgggtgtgaagggactccccagcctggagaccctatttggctgaaacagttacaaaatatcaaatgtgttgtcagatattcctccaattgttcacatagctgggatatttgttgctcccctcaccccttggattatgtagggagccagtgcacacagcctgtttgttttagtatccaaggaagagaccaaggagccagctggcgggaaggggtgggggtgtgcagtctgccctgtccttctgctcataacctgacaaaatgccaaactagtaagcaggatagctgataccacggctatgagggagtaggctctgagagggcacagacttgtggagctgggcgtctggatcaaaactgctttgggatggaacctcgagccctagcagtgaagaagattccatttcttgtccaggggatttaaaagagttttctgctttgagagagaaatagagagtttagaaagcaattgctcttgggaaagctatacacagctctgttttgtcaatgacctttgttgtaagtctcccaacgtcctattaggagccacagcaggtgaggcatttggtgcagcaggaaacatggggactgcctaggctcgaatctgtggcaccctgagcaattacttaaattgtggagcctagttcctcatctgtaagatggacttgagattcctacctctcatgattactatggagattgaataattggtaaaattctcctagctcagtgactgccacaggatgggtctttcagattttggttctctttagcttctggttcttgaaagaaattaatctgtatataacataagaaactttgaaagtcaaaaaaacaaaaaattttaattcctcgtagattaattgatttgctatcttttagtttttttttctatgcatgtagatgtattaaatatgtaaatgtttttcaaagttgaggtaatattgtatagaattttatagcctacattttaatttcttgatatcttaagcatttcacttattagatattgttcaaaaatgccatttttaatatttgtataataccctatcatgtgagtataccttaactaagccattcccatattcaacattttgtgtactgtttttctaattacatatattacaatgaacaaccttatgcata

SEQ ID NO: 180 - DNA, 1560 bp, Homo Sapiens
ctagtaaaaatgcatttttatagagatgttgggaaaggcttgcttgaaattacacgtgggacttttaatagataggcgctttgaccagctaagcaacagggctcccctcgtgtgggacttttagaatgtagcaaccactgacacacagggaaggattatgcgatcaggtgagaaggtggccgaccctgactggctggaagcagatgcattctggtagttgattggtccacaggtagcgtgacgcttgtcacgtcctcagcctcccagcattcaatcgtagcctttcggacagctcgaagccttctgtggagagctcgaagccttctgtggagaactcaaagccgtccgtggagccccagacgagccaaagcccaccttctcctcagcctgagctgtcttgaagatgagtaagagtgggtttgggagctatggcagcatttctgctgctgatggagcgagtggaggcagtgaccaactgtgtgagagagatgcaactcctgctattaagacccaaagacctaaggtccgaattcaggacgttgtaccgtgtaatgtgaaccagcttctcagctctactgtgtttgaccctgtgttcaaggttaggggaattatagtttcccaggtctccatcgtgggggtaatcagaggggcagagaaggcttcaaatcacatttgttacaaaattgatgatatgaccgcgaaaccaatcgaggcccgacagtggtttggtagagagaaagtcaagcaggtgactccattgtcagtcggagtatatgtcaaagtgtttggtatcctcaaatgtcccacgggaacaaagagccttgaggtattgaaaattcatgtcctagaggacatgaacgagttcaccgtgcatattctggaaacggtcaatgcacacatgatgctggataaagcccgtcgtgataccactgtagaaagtgtgcctgtgtctccatcagaagtgaatgatgctggggataacgatgagagtcaccgcaatttcatccaggacgaagtgctgcgtttgattcatgagtgtcctcatcaggaagggaagagcatccatgagctccgggctcagctctgcgaccttagcgtcaaggccatcaaggaagcgattgattatctgaccgttgagggccacatctatcccactgtggatcgggagcattttaagtctgctgattgaggcagggaaaacatcctttcatttttcgaagacccttgcatccagctgtgagtaattttgacctgttgactttttaggaagtaggactaaaaaaaaaaatctcaagtggcattctttgtcaactcgctgcttttctaactgctttgaacttttcggattttctgtatttgaagctcagagagagacggtgatggataaattgacaactctgtaggatttactagcaagctaatggaaacatgattttcggggaagaaaaactacagaaaatgtagaaatttattatttaattgtgttggagcttctttttccaaaagaaaaactagttgcagtcagggagccagcgaaaagacaaaaaaaaaaaaaaaaaa

SEQ ID NO: 181 - DNA, 32760 bp, Homo Sapiens
taagtttgaaatcagttcaaagtttatttatagatatatctttccaatacaacactgaccgcttagataaaaatcttaagttatttatttctgtgttttaaacataaatatgtttacttgtgatttagctttggagcaaatttaggtaagttatctacttagccaaatgtactctagtagactagaaccattctttgtgaaatgtcaaaatatggctatggtttcaggaactttaaaatcggttgtattttactttaaatagagatgtagcaatatctcgtttgctaatatttatattgatgacttactccttttttgttgaattgtacttctggttttataacctgaaatcatctacaagcttgtccaactctagcccacgggtctaatgcagcccagaacagctttgaatgcagcccaacacaaatctgtaaactttcttaaaacatgagatttttcttgcaatttttttttttttaagctcatcagctatcgtcagtgttagcatattttatgtgcggcccaagacaattcttcttccaatgtggctcagggaagccaaaagattggacatccctgatctacatatttaacttaaagtatcactcagtgaacctctgtcagtataatattgctttcaaaaagatggttatgtcaaaagaaaaaatatagctaagtatataaaggcataaaaaacttaagacaattacatgaacttattctcaaatattttacattttttgtaaactttcttaaaacatgagatttttcttgcaattttttttttaagctcatcagctatcatcagtgttagcatattttatgtgcggcccaagacaattcttcttccaatgtggctcagggaagccaaaagattggacatccttgatctacatatttaacttaaagtatcactcagtgagcctctgtcagtataatattgctttcaaaaagatagttatgtcaaaagaaaaaatatagctaagtatataaaggcataaaaaacttaagacgattgtatgaacttattctcaaatattttacatttaaagggttttacataaaaatttttcccttgttttatactggaaaattatataattcatgatctctaattttcaaacattctcaaaagtttagatcttcagagataagctctgaaaatatagatccatacatataaaatatctatgaaattcttttaaaaactattgtctaactacaaaaataatggcatatacatgcataaaccatctttaattagaaaatttagtaacattcatatcaggcatcatcgatttttcttttcttagctcctgtattcttagaaccagattgctgaagcatgtttgcagccttcttctggaagttgcctgaatttttttcctccatctttttatcaccttgttcagaatgacaagtttgagacgattcagcctacaaaaaaaaaaaaaaaacaaagcaagcaccttggtaaaaatccagctattcagttttctcatgagattaaatatttcaaaatattctttctgtatcagttggctttttaagtatacaggggtctagttttttatctacaaatttctattcaaatatgagctctattttgaataaaaggggctacgttgtgagagaagttctaaagacctcaaatgtccttagacacaatggcacttgacttgacatgcttttgcagacttgatagtatttggtttaaaacagtggtttctaaccactggaacagcagaaacagacttctcaactattagtaatcacaaccaaataagagcagagtgcataacaaaattagatattcaaacggagtcctcccattccaagaaactggaaacccctagtttatgttaaaaggccagtctaaattctttcacttacatctttacagaaaactatattttctctcttccatacccagaaatctaatcagaaaactgacttttctcatgttcaactggacctaggggaatatgacagaaaagcatcccataggctttaatatactttttaaaatatataaaactgaaaattaatagccatttaccctgaaagagttctgcgtggactttgtcacttgcatagtaatagcatgtgcctcattgttcagaagattagctttaggtcctattttcaaatacgaaatggtagcataagctgtaaaactgtagtcttctctgcagaaaataaaggccaacaataagaaagcttttgaaggaatcacggaaaacaaatttataaaagaaataactatatgcgcagtaattcttaacacattgacttgaaataataaaatttacaagaatgcaaataaagcctttaaagaaaatattttcgttacttttttttatttatagtgattaaagtttgagtgttttaggtaaattactttctatagcatttaaaagttcacacaaaataactgcaaaaccgtttattctgttgcaatttttaaaaaaaaaccataaagacaacctgaaagaataatgaatgagtttgtacatacttaagatactgctgtattagaaagtgtgcaataatcttctccagatcttcacgaggaagtgtgggagccacaacacctgctactctcagttttgctgcaccctttcccatccaagaatcaatcagtttcaatggagtgagtttttcattcagttcctctgcctgcttcaggatcttgattagatctctgcagtactctgttatgttctttctttcaaatgctgtaataaaacaaatatggtagcaggtaattaggatttagaaatgagggcaaagataggctatcttaagtagttaaactggtttaaagctggttatcaatgtgagccaccctaaacattgatttttaaatgtattctgaattaagactaggctattcctcaagtctctgtcactagaccaagttatggtctctgtaagcattgtggggtttacagtgatatatataaaaaaaaattggttatcagaagccctgccatatactctagaaatcagaaagtgtctgccagacatgattactaagttactaagaggtgtgttttataggagaccctgtctgttctagtataggctcctgagtgaactctgatttagcaacaagaatgtcctcaactgataacccaattattaagagaccagtactctgatttatatataacactcttgttattttataagatagtctaataaactcataaatttctctgtctgcaaagttaaaaatacagtggcttccacctaacaaggcatcagaactcagtaaggtcttaccatgaggtactggctagtccagatcttgaaatacaacacacggatgaaaaaaagttaaaatatagtgccaaaatgctgcaggcaaatccgaaaattgggactcagcccaggagggttcccagtttcatgcaagaaacaatctgagagcaagccaacagagtaaagtgaaagcaaagcaagtttattagcaatagagtataggaaaatggcggctccatagacagagcagggctaccccaaaggcagagtggcactgtacattgctcactagcggtatttatagctgctccttagttatatgctaaataaggggaagattattcatgaatcttctagaaaaggttagggagttcctagaaccatgtaattttcgggcattgtcacggcatttgtaaactgtcatggtgctagtgggagtgtcttacatcatgcaaatacattatattttctagttctaacttgtttgggccagtttctttgctatatcttgttttgaccagatcctgttttgatcagcagggttgtgaccaatgctcagaaaacaaatcctgctgatctacatttaaaagaattttaagtaaatctccgatgactagccattaactggatcaaaagtgattctctatagtctctattttgcactaaattttcttttcaattagtgactataaagtattagagattatcacatggtttcccttttcttatagaatagcatttctattcagaaaaattcaaatattttccttcatttattaaaaatttcacatcctcagtatagcaatataaaatgtgtgcatacacataagacttttccttttattcacctttgtttcaaaacttcatgttgatagttttaattctggaaaatctgattcacactttaatcttttaaatccatttggaagtctaatacttctctcatgtcccagctgtatatacagttttgtgccacataatattttggtcggtgatggaccacgtatatgccagtggtcccaagagattatataataccatatatttttttttgagacggagtctcgctgtcacccaggttataataccatatttttactgtacttactctatgtttagatacacaaatacttaaccatgtgttacagctgcctgcagtatgcagtacagtaacacgctgtacagattggtagcctaggatcaataggctataacatatcacctaggagactataccatctaggtttatgtaagtacactttgatgtttgcacaatgacaaaatcacctagtgatgcatttctcagaacgtatctctgtcactaggcattatgactgtattagcctataaaggtttacaaaacaacaaactcaccactgtctttacagcagttatcgcacattttgttacatgcttctgagttccatacttcatcaaaatgttgagccatcaacacacgacgacatctgcaaacacatttaaagatacaaattattaaaggatataataaagttttaagaatctctatttcagcttacatagttatatactgtattagcttcctataactgccataatattaccataaacttagtggctttaaacacatttattcttacatttctgtggtttagatttagaagtgtactatgggtttcactggatcaaaatcagagtgtcaggttcttctcacatcacacaatctaaaataatctccctattttaaggtcagctaatgaacagtcttaattccatgtgcaatgctactttccttttgccatgtgaggtaacatacaggttaggaattaggacgtgaacatctttggggggccattgtgcccccgacataggacttttttccccacatattcttgataaacactgtttaaaaaattgtctgagttccatttttaaattcaatgttttgcaactattaggagaatattcttgacagtaaaatagtttcttatattttaataaagtagcaatatttgagttgaaaccttaaaatatgcttcatgagactctactggcctttggaagacattttcattttctcatttcttttaactagattattgtagtatctattggaaagaaagaacatttctatcactgtctggctgctatttaccacctcgacatttctgagcacttcttatgtgataggcaataaaagcacaaagataactatgacagaaagctttcaggaagctatctagtctaaagccaccctaagtagatttaaacttacttcttaaggagaaacttggtatttcattgacacatgagctggcaaggtggcacgttactgagcttgactctcaaaatgcctatcttaaccatagaccttttcaaaattattaaatcatgtaactgtacagcagtgccagagaaaaaaagccttcaagttgctatcaatgtgtctcaaaaaccttcaattaaaaaagtagttttggaggattatctcaaagatagggcatcttttcttgaactaaggcagatcatacaggttgatgtgctggttcctaccctccaacatctgcttttatggatctgcactttggtgttccaccaatgtatttagtaagaacttaaaaacgatgtcatatactttcatatttgctttaattgataaaagttataaaaaggtatgtggcttacttgcttatgttttgacagtatgataccatctcataaagcttctgctgtcccacattttccatcaccaccattgaacttattctgaatatatctccaaagccgtagtacaaaatacagtctgctttcatgtcatctcgacctgtggtgtgagaaaccttgagattgcagaattacatttacaaattcaaaatatgcaaaaatgacatatggtaaaattagcaggcaatgttttatactacatctagaaattttagagatgtggaagttaatttgtaatgggtaccctcaaattaaaaaaaactctaaagagacatcaataatcagctctactaagttaaaaaatgtgtctataatccagttaagttatagatttgaaatcactaattaaaaattcaggaggcaaagatgaacatcaaattatcttaacacacataaaaagaaacaattcagataacagaacataagtaaaaatttctccatatgcaagtaagtgtcaaactgctaaaaatacattgttctaaaaatactatccaataaagataaaacatacagacttattaagcatttatcatgtattttttggaaaagctttctaaaaatttacttctggatttgagtcctacatacctgcacgtccactctcttggtaataattttccatggatttactcattgaatgatggataacaaacctcacatctggcttatcaattcccataccaaatgcaacagttgccactactacctgaaatattttaacattttatcagttaattaaatcaagtttaaatattttaaaggtaaattaggcttctatggaagatatagacctaacctgaatttcattggctgaccattttctatgaactgtggtcttatcttctggctccaaattggcatggtaagcacctgcatgaattcccagattctgcaaactaaccgtaacttgttcagagtctttctgagaaaaacaatatatgattcctgcagtaaaatatgtgcatttgttagatagatatggcatattcctggaagatggttttcaacacacacattcaggacattgattaatacaatgcacagaaggaaaaaaagaattatgaaaaatttcaaggccttgtgcatatattgacattttggtataattccagatttgagcaccagcttcctttaaagcagaaatgagcctgagccatcagtttttgttcctgttatctcttttctctctttaactttatctcccactaaacagtatttctcaaactgatgtctgtaagatgctaacaaatgtgctatgaatgcagtgttctccagattaattttgggttaatttagattaatttgcatgcaaattaatttggagaacattgcattcaacaaagttaaatgggtgtctctctttattttcagggatggtcagagcttctagtttgctgatacaccctgtgaacatccaggcagaataaatacctgcaacctttctcaaattcatttgaccctagaactccttttacccaggactacctcctgaaaatctatagaacagtttaaaatgctactttcacacaaattctttgcttcagtaacatttgcttagtcattaaacccagaaaaccatgtatatatactcacaactcgatctgtgcttaatctattcagtatgtactactggatttatttattgctttaacgtgtcctttactgtaagggagtatattttctatccctttagaatatcagttgcttaatccactattttgtacacagtggatacatactaaatatgtgctgttgataattaacattaagtcatcaggtctattctaaagcaagtgtaaataagcaaaaataaatcaggcaatttgacgactcataatctatggcataagcaaatgtcacacccaatttctaagatcaagtgaattaattttatcacgtattttcaagtatcttctgctatacattaattttttttggtgttattcagttatcagtataattatcaatatgatatgaagtcactttttgaaagttatctctgtctccaaagttggtttgtttttacattacctgattgccctttgtatctcccattaatgagctttacaatatcctcaataaaatcttcagtgtttgagggcttctgccgaacctaaaaaaaacttaacttattaaaaagtaaatgaatgagtaccatccaagtggctgtctatgtacaactttcaggatgcagttctttcatgaccatagtgttttttttcctattactctttcacttactcacaggattcaacccatctgactcatctgttcctcctcccagactcttcttgatctttatttttttaatttaccagagaagagcaagcacatgagcagtgaataacttgcaaggatgcagacttttttattttgcgatgctacttttataaaaacaaaccgtaacataaataactctttaatgaaaactcagaaaaatattaaatctattcttaaaagggtttagaaagaaagaaaagacagctgttaggttatttgattttcaagtttatcaaataaaattcaaatagaattggcaaatctttaatggcatatgaatacttctatcacttagtaattaatttgaacagagatgttattagggtccttagtatcactccatcctttctctccatctttatacaaaaaagaacatacagaaatttaacaaagatatatgacttactcatatgttttataaaaagtatcacctagcaggtgtcttccatttaatctaacaaaggtttatgtagcaaaagatacatgaatgaagccctaatcacagaatctacttataattacctcctaatgttaaaaatttttgtaagtacttaactgctcatgtaaataaacataataaaaaggcagatcccctctgcgtaattcttcacaaaagtaaggaattgacataaaaattacatacctcataatatagatttggcctattaaaagaagctgtaaaagtaaaacacttttcaatgcacaaaattttctgagcatccgtcaaaacgtgatttgttgcagttgcagtcagcccaattagtgatgcgttagggaactgccgctttaagataccaagtgccttataatctgaaaaaacaaacaaagtggccctttttctatcctttaagagttagagtaaattatatcttttaacattatgcagataatcgatgactactatgattttgtttccacagccatctatagcagtaaatttgcagttctgtgttagcctctttgatgggcaggctttattacgtttatttcagacattactcttggtcacggtggactcaagagacagtgggtatagccacagtgttttaatttattacaactaacaaaagataaaacaggccatcagacaaacccctgctaccacctagtgtcatcagaccaaaaaaatcttggtaagggcggcactgctttgtatataacctatttctcggaaaccattctaggctcaaacttgttataagcatctacatcactagataaattgtcacttaaactatttggaggaaactgaaaaaaatgtggtagaaattgcttacatgctaagtagaggactactatgaaaacaaagaggacagagcagctgcttgggaagtgaagatttcaaggagataatacttgagttgtgtcttaagagaatgagcagaagttcactaggaagagacgaacatcacgcagaggaaacagcatatacactgcaaatacactgacatgaaattagtatgttcagataacagcaagcagttcactggggctaagtcacagagtcttgtggtggatggatttactgtccaatccattaagctgtgaattacatctcccagaatctctttcctgttccaagttagagctgacccaaaagagggacttgtgcaagatttggtggcagaagtgaaccagctaacatcactccttcaaggtctttacacgcagagaggatgatggacagatgcagaagtgctcagccagttctaggtcatcctagttcttttccattcctcattcagctgttcctcccaactgcaggtcctgccaatcaacagcagacccacagaggcgatagctactcacaggaagtagcttaccagagacctttccacgagcttccctttaggggtcccctttgccactgtacatgccagctgcagatttccctacaagctccgcctcgtcctcctgcaccagtgcttaggtatcaatccattacttttctctaatcctccaactcccctcttcagacctgcacttccccagttcctcccacaattgttcaagatctacttcctacagtaaaaccgttatcccataacattcatcgtgactctgcttctctgcctgaaccctgactgacactgttatgtacaaggcaggtttaagaaaagctatgaacaattcaaccagttgattctaagctgagactttatcctacaggaaatgaggaatcatcatgtaattttttttttttttttttttgagatggagtctcactctgtcacccaggttggagtgcagtgacacgatcttggctcactgcaagctccacctcccgggttcacgccattctcccgccttagcctttcgagtagctgggattacaggcatacaccgccacacctggctaatttttatatttttagtagagacggggtttcaccacgttggccaggctggtcttgaattcctgacctcaggtgatccgcccgcctcggcctcccaaagtgctgggattacaggcgtgagccaccgcaccgagcccatcatgtaatttttaaagacctatgcttcataaatcatcttttggtgacagtgcaaaatacagactggaatagacaaaacactgaaggaaaaccagttaaaagatggcagtaacagaccagaaaacaaataatacagaatataaaatgagacatgacattcaggataaatcaaaaagagtaaagagacatacatgaacctacaggtcctagtgactactgggatatggaggtggcagggaagagggagacagtgctggatttacccattcatcaatagataaatgttgaacacctttttaattgtgtgccaagcatttccctaggcactgaagataaagtgatgaacaagacaaaaatgctatgcaaatgtgtctataattcaagcaaagaaacaagacaatacaaagagtaaaccaataaatatgccattagagagtggtaagtgctcataatgataagcccagtatgctggggcttaagaagagaggaagagtaggaaatcaggtagacagatgggggcagatcacatattaccctatgggccccagttaagaacgctgggttttattctaagtacacagtagctactgggtagtttaggtagggaagtaacatgatttgatgtgtatttagaaaatatcactggttgctctgtggagaatgaacaaaaagtgtaagaacggaatcaaagactacttaggaagctgctgcagtagaccagtggaagggagctcaactgtatgtaagacgtaggtgcacagagagtagacaaacttgagattcattctagaggcagagctgacaacacttagtggtggactggatctgcaaagggagggtaaatcaaggacggtgtgtcatccattttttttttgtcatctctaaccccacccttctatactgtgctttgggatgctgcaccaaggactctgcacactacgcatcagctttgcctgctggccctggatggaagacaccatggctgcttcctccctaactgcttcctgtgggcttgcttgtgttcctgtgactgtcacccctgcaaggcttctcatccctgcagcagcacttctttccttaagagcaactaaatacagttggcacttttctcagcctttggagaaccagctttatcacagacgtaccccacctctgcctctaccaagagactccagcaccagggagctcagttccacaagccctcttcattaagtttctaagtcttatttgttccaatcttttcttcctgttctcccagccctacaggtggttgttgcttcttccagtttttaactccatgatatcttcgttttctttttactttttcagttatctatttagctactttttacctagttcacaattctttctaaaaaattctctctgttcaaataactgtctcctgactggaacctaaatgataaagataactgctaaaattttggcttcagcaaacatgtgagtgagtggatgattttttaagacagagaagactgaaggggaaattgcttgggagtagagaggagaacggagaaaggaaaggcgaagaaaacaaaaagtttttggttagaatgtcgagtagagttatggggaaaatattcccagttgagaagaaaaagagcagttcttttgggggaatttagttttggtcatgctaatttagatacacatttctgataaacaattaggagtataaatttaaagtttagcagttagctaattagatatgggaataatgttttacactttggcagcagatccacagagacaacataagtcatggtaatacttaagcaagggtgataatcataagggatcaaaccatttaggttgaaaatagggcaagagtcacaaatcaggtaacttcagtggccaccaggtaacaactatgtggcgctatctggttaagaaaagaggggcccttaatagaaaggcgtatacatcccgtttaaggcatttaaatctatttaaaatatataaataaataaaaacaatgcccataataattctgtaggtagagaatgcagtcttcgggctacaagctcactatccctggagaaacgtaagaaagggtaaagactgaggtcagaaccctagggaacactaatatttaaaaagaagacaggaagagcgaaggaggtgagaatggaagggaagacactgaacagcactgctgtacagtaaccaagggagtagaatgtggcaaggtgagaggtgaatatataaaatgttactgaagtgaagtgggaagaggaatgaagatgagaccacttgatgaagtggtctcatctgggggtgggtcaccgatgacctgtttcagtagtatggtggtggcagaagcatgattcaatgagttcagaatgggttaaaggtgaaaaatggagatggtaagctgagaagtctgatggtgacagaaagaacagaaagaggacagtaacattaaaaggtcagaagggtgttttagtttctgtttttagggagaggacaaaagagcctgaaggtgaaggagtgaggaatttggcagtgcaagatcttaagaaggcaggaaaggatgaaacgggagtggtcatggttagccttataaagcagtggtcttttctgccttaacaaaagaaaaaaaaaaaagattactaatgtttgaaagtagaaagaggagctgttcatacctgatggcatctattttctgtgaagcagaaagcatctgctaagtacaagttagggcctgaatagaaagttaatgataggagacatttgttggaagaaatgtataaaggagttgaaatagggacaagtataaggacggctgaggataatgaaaagctgaatggagttatgcaatttttgtttttttgacaatgtttagtagccaagcagcaggaatggggaaagccaaagtctagatgaatccagcatctcaggcacaacgcctgaagcagactggcagaatggccaggcagtccagggcaaatataacagaagtaaggggcaacagcacagtgtctggacgggaaacagagtgattgctatgtagggacaggagcctggataaataagcagggattaaaagagggatccagcaaatcctaatgtgtgaaaagcttcagaaggaaaacaggttgaagccagggagtcggatttttgaatttaagatttttttgcatataacaattctgagtaacttactttaggctatgactgtaggattaggtggtggggtgaagaaaaaggtcactaaaaatatctcatcaaagtttcatgctgaggagttgtatgtgggtgctgaaaagaccctcagaatgatgactaaagatgacaactttgaaacagatgcaaattcttcaacaaatgtgaaggaatacctagatgtcataaatgccacaaagatgtccactattggctagtaaacatatgtgtccatatttgtccataattgacaagggcaattaaactacagactacagtggggaatgaaactaaacattctgcctctcagtcctcctcataatgaggcaagataaaataagtaatacaggttgatcatcccaaatccaaaaaaatccaaaatttaaaacccttttggttccgaacattctggataacggatattcaatgtgtaactacttgaggatgattttaatagaagcagagatttccatcatgccaagctgagtaaggacacggtctatgacatcaaaaagttttctagataaaacatacataccaggtctgaaatcatgtccccactgactacagcagtgaacttcatccacagcaattcgagtaaatctccttgcttcataggctttctctagtcttgacataaacattttgctttttgcaattttctctggagtcacataaatcagctttaactcggagtttttatttaccatttcagcatgaacccatttaacatgctcctattaaaagaaaaaaatagacacaatgatagtaaaactaagctagcagactgaaatactaggtggtaaatgaaaacgttcatttctccaaagcaataatagcctttggctcttctaggagcagatgtttagttcattaaaactgaaaccatgtctcagtacgaaacatcatggcagctgtgtaaatagcattctagttatttactaacgtctacattgttgatgactaaaaaaaactcacttgacaaaaaagaacacaaacagatactccaatgaagagcatttattctatgaaggcataatcctaaattgttcataatatattctaaaatgtgagctagatgcaattgttatggttataaaggtgggttttattaattttaacattatatttataatccctttatgtatgtgaacaaaatttattatttattaacttctcaaatgataccatcaaatcttttaatctctttatttaaatataaagaccatggggtttcacaaagtatcactcattaaattaagataataataataaatcttaaaaggtaacagttattagattcttagtactcatacaattctatacaatacttagcatattagatgtcattttttttccttctaatctaaagaggaccaaaaaagtataaaaacatgccagtgaatgagatagaaagagacagtcaaactactttcatcatcccagcaaagaagcagtttgttaactcctagatatattctaggatacagatgttctttttttctctctccaactttcaagagtagggatatatcatgaacttgtaattatctgcaactttctaaattactttctattactattatgttctttttcaattttaagaaagtacattattagaaggcagttttctccacagattgattttgttggaggaaggagcagttataatagaatgacatggagtttaaataaaacaaaaatatatgggtaaactaaaggaaccagggcttcttagaggtatggctgactctaggtctgggcaggaaatgcataaaatgaacatggattatcttactgcaaaagaaagcaaggaacagaagcaatggggttaagagaaaggattcaggaaccaacttaaagaggctctcactgcccaaggacaggactatttcagcattacatatatacatattgatatatatatatatatgattccaaaggtgaatcatattatacgtcaaagcttgtaagtttatagtgatacttggggaaagaaaaccttaaaaatcttgttgaccacctttggagaatgctagaaaaccaactctttctgaaaactcataaagaaagggaaaaaaaaatcaagcattttcatcatgcagagttaatgaggaaaaagtttatttttgtagaaaaagtataactaatacatgaagaaagagtgacagaattagatatcaccattttgcacctccctaatgaaatcatggctctcacggtgccactcagtggctgctaaaaccattagatgaaaaactgataaccagagatcaggcagacatcacttgaacccactgacgcttagcatcacaaaaagataaccaggtactatgtaccacttgagtgataccacagtaagtatactcttgcaaaaaaaaaaaaaaaagttaaagaaaaattccaaatacaatcaggcttttagatctaactaaaaggatccagttacctatgtaacaaacctgcacatcctgcatatggaccccagaactgaaaaaaaaaaaaagaaaaagaaagaaaagaaaagaaagagagaaagaaagaacaccacaaggacgcaatcaggaaaatgtagaaagatacaggacagttaacccagtttcttcaacaaagaatttgcatgggaaatataaaagatataaagagaacctatgggtatatcaaccaaatacaatacaatgcatgaatattatctgggctatatttttttttaaaaaaaacataaaaatgagatagaaatctgaattttttttataattctaaagaattgattaaacttcttagatgtgatgatggcacagcacttttctttaaagttagagatacgtactgaagaatttacaattaaaatatgatgtctggaatttgttctgaataaataaactaagaggaaaggggtagggaaaactggaggtatacagattaaaaaaaaagattagccgtatgttgataactgttgaagggggaaatggctacatggcagtttttatgctattctctctccttttgaagatttcagtaatatgctttttaaaaaagaatagctgggaaatgctttattctacagatgagggtaagacagtccattcctaaatacaagaaattccacaggtatagggtaacttcttaataattcatatttcatatttaattacactgcataattagcaattctcccttactattttagaatggataatacaaaacaggtcagcaaatgtttcctgtaaagtatcagacaaaaatattaggttttatgggctataaggtctctatcacaactactccactgtgccattatactgtaaaagcagccatagacaacatgtcaacaaatgagcatggtggtgtttcaataaaactttatttatggatactgaaacttgaattgcaaataattttcccatttcacaaaatattctttttagattttttttagccatttaaaaatataaaaaccattcttaactcatgggacatacaaaaatagacagtgggccagaactggccaagagcagtagtttgtaactcctgatataaatagttaacagtttataattttataagcaactcaactgcaggtaaagctcctatttcagtgaatagtttacattaaaaaaaaaaaagccactgaaacataccttagaactagaagcatttaacatggttgctgaaattcctaattgttttaaaaccattaattggtcttccataagagagatcaatgggcaaatgacgagtgtaaaacctaaaagagaaaaaaaaaaaaatctaccttaaactttacaccaccctcagaatcagatgcaaaccattcacgttttttttttttttttttttttttttttttagagatggagtctcactctcttgcccaggctagagtgcagtggtgcgatgttggctcattgcaacctctgcctcccgggttcaagcaattctcctgcctcagcctcccgagtagctgggactacaggcacctgctgccatgcctggctaatttcttttgtattttagtagggacagggtttcactgtgttgcccaggctggtctcaaactcctgagctcaggcaatctgcccaccttggcctcccaaagtgctaggattacaggcatgagctaccacgcccggcccattcaccttcttaacttgtgggcactggccatcaattcagattaatttttaatgcagctttagtaaagcttacttcttactctcattaattagatatgaataaatgaccaaacaaggtaagtagaagccaaataaacatacaactaaacagaactctatccttataaaaataaagacagatttttatcatttcaaatgtttaatttgctatcgttttaaataatcactattggtaatttcagtaagacaacatatatcagttcaaacactaaacagtttcatcagggaaaaatcactataaagctttccaaaaaaaccagatttttaattatacagtagtgtgtataattaaacatgatagttgcataagcattcttttactttttgtacgagattcatttatgctgagtagaaatcagtgaacagtttactgtctgaatgaagttatagtaatatgcccccttccttataattgaaactgtttaaagtacaaaagctattctacagttaaaattatatatggctttacgtttctgtagtttgtttcttaaaacaacctttggcaaagagcagacatgtttaaaaaacataatcaaattaagaccttattagggatttttcccagtcaattattctctctcctattattttcacttttccttactagcacctactcattacatttaaacatggtcaagtccctctcatcttggaaaacacccactatggtctgaaagttggtatccccacagaagtgattaagtaatgagggctctgctttcataagtgggattaatgccattttacaaaaagttgaagggagtgccctttctttgccgccatgtgagggtgtagcaagaaggtgccatctatgagaaacaccccctctctagacaccgaaatctattagcatcttgatcttggacttcccagcctccagaactgcaagcagtaaacttctgttgtttgttaattaactgatataaagtattctgttacagcagctggaatagactaagataacatctcatttatggcccactctcttcttcccttcatagtcattcttttccaaagagaatcccatactcaccagttccacttcctcaattcctacctgcttcaaaccattgctatttggtctccacccaaccatttcaataaaattgctctagctaaggtcatagatgagtcctttgtcattaaactcattgaaacttacatccttacgtatttgacattttgctaacagacatcactattaactactccctcattcaaacacacccttccctagccttctaataacatcatacaatcctggttatcctatatgttgctactctttctcagccttgtctgcaagccctttttctctgtttatccctaaactcttggtgttctggtttctgttctaggccttcttttcttcttatgctgctctgaaattcattccaatggcttcagtggccatctccacactaacaacccccaactcagacctctaacaccaggctttagacacaaacatcctcctactcataggacaattccacctggatgtcttaaaggcatcgtaaattcaacatgtcccaaataaattcatcatctttcccctctccattcccaagagttctttcgccaatgtaccccatttcagtgaagaacctcaccacttgtccaagcctaaaatttgagtatcattcttgactcttctttctcctttccccccaagcaataaataccaagtcccattgaatctatcttccagatgtatctggaattcatctaactgctagaattatccttctaaaccatgaaataatgagtctcttacctgtgtaaaactcttcaatggcttcttgctaaaataaggaaaagttttaaaaataagactctttccacatgtcttaccactgactgccacatagaaattcctccaggttactgaatacatcataatgtgaatgttctctcttgcttttggatctcaagtattgcttttctgaatgaacactcttccttccctgtcccttctgcctactcaccctttaaactttagcttaaatgccacttcctcagaacagctttccctgacagcccctagaccagatctttgtacagacttaattccctattaaaacctttatcccaaaattcttattgcaattgcttgcaattacctgtattctctaaaccagggatcaacaaagtaagggctggttgcctatttttgtaagttattttaatggaacacagctacacccatgtgtttacacattatctgtggctgcttttgtgctacaatggcagggttgaagagctgccaaggagaccatatggaccacaagcctatattatttactatctaccctttcaagaaaaagcttgctgatcccttgctactacccaatcagtaatatcagtagcactagcgaacttgttagaaatgcaggatctttggtctcacataaaatcagaatctgcacataatcaaattctcaggtgattcttatgtacactaaagtctgagaaagtgctactctacactatgagttctgtgaaaactaagaccacgcccattttgctcactactgtgtctcccagtgcctagcaccatggcagacactcagtaaagatctgggactagaattcaggtctactgattcttcttccagagctgcttctcctacaacatttttgggtttttttgccccttgtatcttctgttcaagtgttctatagcactgtagggtgaatatggttaacaataatttagatagggtttcgaaaagctagaagagaggattttgaatgttcagtacaatatgtttttaaatttatgtttcaggaaccagataaaaggattaatctcagaagtttttaaaactcctcctttagggagagaggagggcaagggctgaaaaactacctagcaggtactatgtttactacttggacgatggatcattagaagtccaaatctcagcatcacacaatatacccatgtaacaaacctgcacatatacccctgaatctaaaataaaaaataaataaaattcctcctttaagtgaaactttaaatttctattaatatagaagaaatcaaacaaaaatgcacttgatttttatatatgtatgattataaattattttttaaaagaattaaaaaggtatgatgacaaagcacttcttcaactcaaaattaatttttttagtacataccatctgaacataatgctggtaactggtaacataagctctttccacctcctgtaggcataacaagaaatacctcctttccagccattgttacgttaatagtttcaagctgaagtggtctgaacttttccagtttaaagacattttgcagaatatctttaactttaccagaccatggaaaatctaggaaaagaaagttaagaatcagacaaacatgtaagactattatagaagtttgataagaatgagacaaacatatataagacttctaatacttatagaccattaaacttttatgataatagttttgagattaactcactagctaagcaaagcaaaaacaagttaaatgatgtattataagacatagtaggcatggtggctcatgcctataatctcaacagttttgggaggcctaagcaggaggattacttgagctcaggagttcgagaccagcctgagctcaagcgatggcaagactctatccctataaaaaaattttttttaaagtagccaggtgtggttctgtgcacctgtagtcccagctactaaggaggctgaggagggaggattgcttgaggctgggagtttgaggctgcagtgagttgtggttgtgccactgcactccagcctgggcaacaaagcaagaccctatctcaaaaacaaaaaaaaagtaacaaatgtaaacatttgccagttgagaattaacccacacaagaaaggaaggtgtttgatcaggtatttaaaaaattgtctgaatgttgatcagggaattcacagcatcataaagtactcaaatatcatgaacaaagttaacaattatctggaatttttggtgtaaatatcttgttcagacgtgaatcattgaaaagcaacatccacaaaaagcacaatcccttctagagttattctaattattctattattctatttataattgataaacttgatgtttgataaggtcttgaatcatgaaaggtttgttcactagggcaggaaaatgatctaacctttggcaaggagtttgaattttttttcttaactgtttgttaatgtaggtaaaggaagtatctcattttctaaacatgatcaatgttgctgtaacaataactggaaaaaaatgtctgaataataaaagtttaatttgaagactacagaacacagggaaagaatgatccacctgcaagtttcccattccactggagaaatggccagtttcacctctaagcctactggaaagcactgtcccatcaagaattcattctagttttttaaaatatgagaagaaataaaactagcaaaaaaaaaaaaaaaaaagttaaccttctttattccaagcggcaggtgaagaatcatattcattgcttgccccggcatcagaatcctctaaacactgctttattttctttgtcaggactttttttttctgaataagctcttgttgcctttccgtaagttcttgaatttgaatttctactgcatgtagctcactggttatagaatccagttcctcagttagagctatgggaggcagcgcggatacaatgattagacagagtaaattacaactttaggtttccagattgatttctgggtgttgcccgccatatcaattacagacaaacttgaagtagtatagcagaatggttatgagcatgtttttgagtcatatagacctaagttaaatctcaggtcctccttttacctgctgagtgacctcagacaagatactcacctgcatccccatttcccttcctgtaaaatggggacaatatctaactttcatagtatttttatgaagagctagtgagataatatattaggagttctagacgcagtacctggtacacaaatatttaatacatgataattatttttattatgttgtagagaagtggtctaacaatctcctaaatcatttaagtaaagtatcagactttgaagcaaaaggaagctaattccctaattactttgctattactttatgaaggtattcctatttgggctcacttggtggtaaaaggagttggtaattataaacaagaggatgtaacaagtaagagaaatcaagtgtactattggaattggcattttatctcctttgtaactaatctataaagaaaccccagtgtatgattctaatcaatctaagtattaaagtcaaaaagtgagatgctttttgataccacatcgatggaagctagaaaaatcttaaagatgttcttggtgcattctcatatacctgcctgcattaatcagtatacaggtttaatgtgcttcttcatgagatataatttatggctgtgatttaaaataggatgttggggtacctttttattgtaccaactgccatcatcccttgtatcaacccttccctacatgactttgggttaggtttggccacaagtgaactctgcatgagatttacaaggcagaaataaagcagcagccagttttacattgggatggttggcctatggccaggtgcttctggagctcactcatgatattaggaaactgctgcctcactttgtggacgtggggcagaagccagttcccccagctcctgctaaatcttggtggaacaacttggcccacagattctttggcttcttggtcatgttgctggccaaccttctgtgacaagtgcaccagcttttcagcagggcaccagcatcctaactttgtcctcatgaatttcaacttatccttgcagcttccagctcatccataccctcccatacttcacacccatcttcctttctcactgctggtactgctgacttcaggaccagaagctgactcagggatagctgcttaaccagctcccatgatcacataagttttaatccccataataaaacttacagcactcataatggttcagcttacctgactgaaccctaaccaatacagaattttgatccggaagaacagaaacttaacaggttctctgaattgtttctgggccacatagaactggctttctgatctgattagatttcaaggcattaataaccctgtttccactgataaagggaacataactattctatgtcatcatgcagtgaaaaaagttatttaaatcatcatccatagacaccagtagaaaaataactagagaaggcaaggctgtgggtgacaaagtgtttgctgttacaaatgttttggtgagaataatggggttgactggttgcttctaagtgtgcaaagaactcaggggaaaaatgtaggatctgcattaagggacctcaaagtttctatgattgtccttaaaaaaaaaccttatcctctataggtacagggccaatattttggaaaaatagctgtaagtctaaatcctgcagatggctgaatttcaatacaaactgaattcccaaccttgcagggacttttatgataaagtcagcacactgactgggaaggagactgaaatttggaggggaacataagggcagattccaacgaagcaggttaccttaaaccactaaattatgccaagtctcttctaccctgcctcccctttctgaaacaatgtcctcctaactgaagtccccacaatggtccttgttgccttgtatgggactgctaagcctcctaagaatcagcctctaccatctttcagtgctttaagatccagaagtcctagaggataaaacacaaagatgtaacctgtcaaaagacatgatatgcaccaaaagagctgcatgtgccaaaatatatcaatagaaactgtgttcatccattttgcattgatataaaggcgtatccgaggctgggtaatttataaaagaaaagaagtttattttgcttatggttctgtaggctatacaaggagcatagcgctggcatctgcttcttgtgaggaccccaggaagcttccaatcatgacagaaggcaaaggggggcaggtgtgtcacacagtgggagatagagtaagaaagagaagaggcagtgccaggctccttgaaacaaccagctctcatgtgaactaacagagcaagaactcagtcattaccatagggagggcaccaaaccattcatgagggatcctgctccatgacccaaacacctcccactaggcccacctccaacactggaggtcacatttcaacatgagattaggaggagacacatatccaaactacatcagaaacctagagaatgtatatgggaatagatcataaaggtactgaaacagggtttatggaatacaatgtcgaattaagctaagtttattgatacgggctcactaagaaattctggatttaatgtcctagatagtggccaggagtggctctagtaatttgcttggctcattgcctgaaacctggcctcaaagatgaatgtcagaaaattgggatggaataaaacaggtatagagtccagtgaggctggagctctggaatttcctgggtatgctctaaaggaaggtattcagaggcttagagagagagcagtgccagagtggaagatcaaatagattgataatccactcccttgctgtcccccaggagaatccagaggacacttctttcaccaagactgtgaaaaatacagtcatgagcagagcgccagcatcagcggagctcttcagggatgctggggctcccctggctgttctctgtaagctaggaatgacagtgggaaatatcatcttccaagtagaccacctgattcaacgacaatgatggattccaaggtatgggggctaaccattggcaattgaatttatgacgaaaaataaagtagatgtggttgccatgaagggcaacagagctgaggcagcaatcagaatggtctgaccgacaagatcttggattgactagttgactgtgaagtccctgaaacggaaatagattacttgatttgtaacacgcagaatagaaagctctgattctggtaaacagaaccagaaacacaacagagagaccatccttcgacgaatttccagaattgaaccaccttatagaaccagaggcccttgaataaggcagaggttggagcctgttggggaaggactcaaccacacagctaaaaatgtatgtaatgaatcttcctactactcttcaccaggaagtttattagggtaactgtgcattagaaaaaaagagaaatcggccaggcacggtggctcacgcctgtaatcccagcactttgggaggccgaggcgggtggatcacgagatcaggagatcgagaccatcctggctaacatggtgaaaccccgtctctactaaaaatacaaaaaattagccaggcgtggtggcgggcgcctgtagtcctagctacttgggaggctgaggcaggagaatggtgtgaacccgggagcggagcttggagtgagctgagatcacaccactgtactccagcctgggtgacagagtgagactccgtccaaaaaaaaaagaaagaaaaagagaaatcacttctcagaaactactggacattagctctgaactgatgctaattcttagaaaaccaaaatgccatggtgatccaccagtcagagtatagactcgacttaagtgaggtgatcaatgcagctttggtttccagagatttaaaaggtagaaatgaagcagtagacatattttctgtatttaagaaagtcagtgtaagggcagggttggtgatctcattggcatggggcagcagcaggttcaagtccagcggctgctagtgatatacagtgggccttctaatctgctgtgtggttatttcctcagtttcagaatgtatactgagaacagatatattcagcaagtggcagaatccacccattggtctcctggcaaagtaactaaggattattattataggaaagatcaaacggaagccagcaaaactgcctttaccaaccaatacagcaaactaaaaatattactgcattcctggagggattgcagagattactgcctacatcaacggcatgaaagatatgagggtaatgatgacttccatgtcgcattcaactcacctatgtggtgtatgcagaagacaatggattctggagattgagaatggattatgccaaaattaataaggctgtggctccaacagcagccatggttccagctgtaatttcattaataagacagaacacatgccctggcatctggcttcagctattgatctgctgaatgttttattctccatacccatgtacctgttattatagcataggggaatagtatagcacagtaaaagcagtttgctgagccagcaatgtatctttattctcccacctcagagctatatctactctctagccctaatctaggctgcagggatcctgattcccttttcattccaccagacattacactagctctctgcattgatgatatcatgcttgtctgacctgctgagcaagaagcagcagtagcagctactatagacaaactgctaagagagacacttgccagaggatagaagataaatcccataaaaattcagaggcctgacaccttggtgagagtcaaagggtatggggcatgttgagatacctcttctaaagtgaaggataagtttctatatctggcccctcctattactaagagagcagcacagagcctaatggactacttggatttgggaggcaacatacacctaatttaccaagtaaccccaaaacttgccggttttgagtaggacctcgaacaagaggtaacgccatgatacaatcttctcttaccattgagccatatgacccaacagatttgatggtgctgtaagtttgtgatgaatgcagatgttatatgacacctttggcctatagatgagtcacaacaaagatgataaggattttagagcaaagctctttgccattatctacagagaactattaccctttcagaaacaacttctgggttgctcctgggtcttacaagagactaagttactatgtgacctgtgctgcctatcatcaaccaggtgtcatccgacccatcaattcatcaggcaggcctccatcatcacaatggaagtggtatgtgccaaagtgagcaggttctaagtgaaggcgtgaacaagaagtctgaatgctcatgcaccatgctcccctttgcctcctcctcctcaacctgtagctataacctcatggtgggattcagtgttactaagggaaaaaaaaatgcagacctaatttacaaaagattctgcatgatatattgtcactacctgaaagtgaacaactaaagcactctagcatctctccagagtgatcctgaaaaacattggagatggaaaattctcccagtcagcagtaagcagtccacatagttattcattttgccagaggaatacatccacactattataagcaatggttaatgattggcaggatggttagcaacttggaaggtagcaaataggaaaactggtggcaatgaggtctgaggaagagatatatgtatagacctctctgaatggtcagagtgtgaaggtatttgtgtccaatgtgaatgctcattaaaaacaacttcgacaaagtataatcataattaatcaggtagacaagatgacctggacattgaccacacttgtccttgcacaacgaagtcaagaacaaagtgccttctgcaacatggactgccactcacgaagacccatctggctacatccagagctaagtgctcaacctgcaaacagctcataccaaccttgagttccaatggaggcaccattctctgtggggacagacagatgcttgatggcaaagtgaccgcattggaaccgtctataatgaaagaggcagcactttgttctcactgatacagatgcttactccggatatgaatttaccatacctgcctgcagtgctctatcatgtccaccatccaggaattcacggaattcctactgattgtcatcgtattccccaccaaattacttctgaccaaagaactcatttacagcaaacaaagcacaacagaaggctaatgttcaagatattaactggtctaactatgttcaccaacaacctgcagcagctagcctgagaaaataatggagtggcattttgcagactcaattatgctgccagctgggtatcagcactttaagggctggactagtagcctccaggatatggcatgctatacatcagtgaatagtgctgtttctcccattgccacgattcacgggaatcagcggtggaaatgggagtggctcttctattacccttagtgatccgctagtgaaatttttgcttcccatccttgaaacatcggactcttgctggcctagaggtcttggttaccaagaaagaaatgcttgtaccaggggaaaaagcaatagttccattaaactggaagttgactgccacttggccactttgggttcctcatgccaacaaatgaacaggcaaagaaggcgattactatacttgctggggtaagtgatcctgactattaaggggaaatcagatagctactacactatagggataaggaagagtatgtctggaaagcagaagatcctctagtgcacctctcagtattcccttaccttgtgattaaagttaattgaaaactataataaccaaatataggaaactactaaggcaagtagtccccaccaagcaaagacccattaccaactgagaaccaaggaatacagaatgggtagttgaagaaggcagttataaagtacaaactatgatcacatgaccaattgaaaaacaagaactgtaatagctataagtctttcttgctttttaaaatttgtatataaaccaagtttgggtttttccttttatttggtccctctccgatacattacagtattaccaaggaggacatgattcagcaagaagagaaatgagcatcacccaaagacgaataaagataatttgtacctgctcttttggggaaggggtcagtgtatactcagcagtaagagaaataggcaaaagcatgattccgctattgcctttatttggacacaaataaggtaaaaattagacacaaaaggacaaatgttatatgattccatttatatgaggtacctaaaatagtcaagaaacagaaagtagaatagtggctatcagggattaggagaagagaagtaatggaaagttacggattaatgagtatagaattttagtctggatagatgaaaaagctctggagatggatagtggtgacgactgcacaacagtctaaatgcatttaatgccaatgaattattcacttaataatggttagcatggcaaagtttgtaatgtgtattttacttcaataaaaaagctgaaaaaaatcatttctataatcagaatttttaaaacaaactttttcaaatatcatacaaacagaaatagaacagaaggaagaagaaaatgtaatcattgctactaacctgaaacggacgccattctttttctttccaaatttgtttctaaaataatccaaatttctttctaaaaataaaagcacaacagtgacaacaagtttttaaaaatagtactattaatgatgttcactcaacagtaatctgtcattcctaagcacggaaaatgttagaaagtaaattatatattgcagtgacctttcaaataagaaccacatggttcttttgacactaattttttatggaaaactctatatttcagcttaataacccacaacactcagaacgactaactctctagatttcagagaagtgtccaaagtcacataaacgtatacatgacaaatacagtagcaatgacactcagcaaacatccacaagatacaaagtgatgtaacaaaaaacagcaaacattcaacaggtctagcaccaattgctatgtgactaaattactatgttaggcaaagttgcatatgctgttcctccaagcctctttccctacctgtaaaactgggaggatggcaatcttataaataagttggatagattcaaatgtaccagattaagcaaaatacatcaacataaataataaaattaatcatctaacattttattgagcccttgcgttaaagaattacaatataagcccaatcttaaaagagaaactggtattctacagaaaagctagattttctaagttagaggtggggggaggggaaaatggtttgtaatgatttctaagtatctatgaatgactaaaacctaagcatgcatatggacaagtggaaaatggggctggagagtagaaactttaaattccccataatcctaaaaacacctcttctatctctctaatatggacattttctaaaactaagatgctctccaaaagtcacttctgcaacacctatccttagactgctgaccttacgccctttctacacagaattctgaagccaccactaggccggaaagataggctgactcttttttgccttgctaaagaatgtggaataaccacaccattaaaagaaggctaaataggagagtaaaccaaggatttctaattcttgatctatacaaacatctcttcacgtaatgaaaatgtaacattccttccatagactgtaaggtcctttagcagggctggggttcaatctcttcacctttgtatccgcacagcccaggaaaatgccttgatgtagtgagggctcaggtttgctaaggtagcaggggctgtttctacccttatgaaaagacacagtctatatccaattctcccccacgattttaaatgactcctttgattatgcggttaaaagactgctccttcccaaaatgatgtgatttaacagcaaaagatatctcaacataaaatgtatccagaaattgaactacagcaggtctgtcactcagcagtataagctaggcatccacaggaagaatgttacagggtgacagccagtcatcaatgttggaggaaacgccactgagataccataggctaaatcctctctctccccgccacctgcatttagaggcaatagtaatttaatattaataacgcccgcccttccgctactgtgaagcagggggtggaagaagcatccccagtagtatttaccaacaaatggcagctgctaataaacaggctttggtggccaatcctcctgcatggaaaagaatggggagatcagaagaccggtcagcaggcgaacgtgcccctaaaggcccgagttctcagagcagggcagtgattaactttccggtttctcctccgccaatgtgtgggcgaaaggaagtgatccgctacagaccggcctcgccctgcagcaggaaagggaaggatgaaacaaaaagcgcacacccttgacccttcaaagctgtaacagtagttatcccagagcctctccccaccgagaagcccggtctaactctccggtgtttgactgtccggtgtccgactgtcctgtgtccgactctccgatctccgactctcggatctccgacaccaaagcacccaggcctcgagcagatctttccgctactcgggagtaaaatcttcccgccagccagctgagagcatccacccttccgggtcggtccgttcagccaatcacagat

SEQ ID NO: 182 - DNA, 40358 bp, Homo Sapiens
gaaaagggctgtgtgcacgcctgcatgccccacaacaacacaactttattcctctcccaaacatctgtcaggcctggccttcctgagcaggagctgagcaggaacagggcctggctgcctctcctctgccacagctctgacctgggcaaggctggaagctggcatcgtaatggatgggggagtgggtggaggatctgagggtcccctgggtaggttccgataccttggacaggtgggcctcatcctgacttagaactcggggaggggccactcttccttccccttcttccagcagcagctccaccaccctccaccttctgtcctcgacatgtgtcccagaaaacccagccatgaggaccgctctgagaagggtctataggctttgcaagcagaaagaaaggtgggctgacctctgacctggattcagggggtgtctggggtcatccccaaagccaagtatggttggaaaggagaaggactgagaaaagacgatggccctggcatcagcaggtgaggcccaggatgacccatgctagaatctgggggaggacgcgggccctgcccagccagcagttggtcatctctgggggccacacaggccatgccagtcagcttcgctctcgcaccgggcccggccatggaagaagtgcctgatgaggttctgggcctcttctttcactacagattcagggtgggggcatgaggaggtgagcgttagcctcctccctgtagaccaccctcccaagtgcctcctggccctggcaatgccagcgctcaccgctccttccaggagaggtcttctgagtcagcaagtgtgagaggtggcgggcaaagcctttaaacaactcctggaagggagagggagaagagaagcagagagcaggacccttggtggccgggcgcagtggctcacgcctgtaatcccagcactttgggaggccgaggcgggcggatcatgaggtcaggagatcgagaccatcctggctaacacggtgaaaccctgactctactaaaaataccaaaaattagccaggcgtggtggcgggtgcctgtagtcccagctactcgggaggctgaggcaggagaatggcgtgaacccgggaggcggaggttgcagtgagctgaaatcgcaccactgcactccagcctgggcgacagagataaaaaaaaaaaaaaaagagagcaggaccctgccctgacccccagagcaacccacggccatgacccaacggcaaggcaggccccagggaggacgggcgtggggctggccctaggcccactgtgttctggggctcaaactccctgcctcccacccccactacacccacataccccaggcatgggagaaggcagagcccactcactccccctaccttggaagcaaacttgccctccttgtagaaaggggtgaggcacttgaccacaacatttgcagcctccttcaaggagacgccaggagcggagagctggaaggggtcttgagccgtgggattcaaggtgccctgttcgctggccgagacgctgcccttgacctcagctacgacggagggcttggctgaggggcgtggcctcttctgaggctggctctctgggttctcctgagaagggccacagcagagggtcactcctgagctcccttccactggcctgctcccctcctccagaagactgggtccccgcaccagctgcctctctccagcccagcccatctgctgccaggtgtggaaagaaagctgattttccctgaccccttgagcagggcacaacagctcctggcctcgcccacagcccttctctcctccccaacagactcatccctgccggcacctgctgggatcgaggccgcttgcccttccatgtgtcctttgcaggggtgggctggacttcaggggtgccctggtctctgggcgggcaggtgctggtagagggaagagcaggcatcacagcactgggtcctggtggctccctcatcccaggaggcctaggagagcccatctcaggggtgagctctgagcttcagacgcccagtgagcaaaggggatgctgccgtgtaggttccagaagattctatgactacctgtacccttaccttggcctctccctgaggcactcctcagtctggggaggggcaggcgaatgtcccccggctccatcttcctcccctgtgtacttctctggggccatcgggggtccctgaaccccctcacaggaggggcaggcaccttctgcctctggggctgatgccagcagagctgggctttccacccttcggcagaagaagcgggcgatgctctgagaatccttgtgggccgctgtggctaggagctgctgtttcttgctagcccggcccttggcaagggagctgcccccagaggaactttttgccttcttctcaggggagggccccccatagtgagcgctgcctccagggacctcccctctgggcccagggaggggctcactcccatcctcatccaggaggccacagggccggctcgggggctcgtgctcgcctccccgctcgggctggggggcttgctccctgatccgagttgtctccatcagttccgtggccgtctggaacgggcaggagcctttggggaaaccagctcccacccgcttgggtttgagctgtaaatgtgagcaggaggagaggaggttcagcccactaggcccccttgagggcaccgctggctggagcagtaactcacattgggacggggctctcaggagtgtgggagggaagaggcaggcaggaccctggtggggagccaggccttggcaagaggtgcacccctgagggcagaggggaagtgaagcctttcctggtcacaggtctggaggccactgggccacagctcaccgagtacacatgggaggctggtggaatgtcatactcattgggctccgggggctcagcttgggcactgcagctcttggcactgcctcccatgtcatagggctgcccatccttggaggctctgtggatatcggccacctgggcagggataggcagggaggctgtggcacccgccagctcctcctgacatgccccacctagccctccttttctactaggcactacaagtgggtttctgtggccagtggccacaggcaactgaccactgggcaagttttaggcctcccatcctcacagggttggctagaaacatgtccagccagtggagaatggagctctacccccataaactgtctctggggtgggctggggagggtgagttctgggctgcctgagcccagagagctggcagacagcttctgcgtcagagtatggaggggcccctgcaacgaccctgggtccgcctgcaccaggcccaccttcttcagcacgctggccttgtagaggttggccaccttggcgttccggaatgtctcatgttccagctccacggccttggcccggaggtcagctctgtgggtgcaaggtaacaggcacaaggtatcaggtgggcctgggcttctccctgctgagctcttgcgggactccaggcctggtggggtaggccttgggcacagggattctgattagggctctctgagcaccctgtggcttactgtccctcagcagctgctggtagcacctaagttgtagccatgcctggccctggtggggttgtaggggcagtcccctggagtaggagaggtacaatctggggagaggtggcccaaacaggccagggttgacagggtcctgcagtctccaagggaacgagagcttggagtgctcctcagcccagtgatcgtggaactcactcatcagcggtacgtgttgactggcggttgctgctcagcgcctcctccagaagccgcaggcagtgctcccgtgcctggcacaggacagtgagactggtcgcatggcctcgcggctgggggagggccccggcgggtggctgaggagctgcccgtctcttaccttcacagtcagcctggggatcctcctgctagaagcctctttcaggggacagttctcatctgtggggggggggggtggtccttggtcctttcgctccaccttctgcgctctgaggtcccccacagcccggatgagaatcctccctccatgccccgggaagagcccacaagcctccaggaacatttctgtactgacctgggggtacaaattcttctatcttggggtctttgccctggaggacaacatgaaggacccatgaggcgtcctgccctgccgcaggacagtcccatccagcaccagagaaggggctgagaggtgcgagcagggggccaccaggggccccacacaggccactgagtgcctcccctcaccttgcgcagctgcatctgcttctgatagaagaggttccactcccgcttgtgggcctcatctctgccttcatccccgctgcctccagaaccttcgtcatacctagggacaggccaggcgtgagtggccctggcctgggctctgccctccccatgtgtgctgctgctagaacggcaatgtccctgatgtcctaccagctcaaggggggattgcggcatcgtgccacctctggtctggccctggcgccaagggaatgccaggcaattccagcgggttggagccctggcttctcggccccttacctgctgaagtccccgtagcccttgcggcctccctcatacagctcggggtcaaagccgttcccctgggagggcccgatgcaggtcttgctccagctgctgctgcgctccaaggcctccagccgcctccgcacggccgtggggttctggcagtggtcgcagcctttggcgcaggcaggcagcgcatccccgaagtacttggcaatggcggcatggcggcacctggagcaggcagcaccgcagaggtgaggggcggagagcccagtcggccagcgtctgttcacccgagcctgaatcgctagctgagcgagcactgccgcgtccggcaccatgccgggagccccacacccctcatctcatccaagctgcaccaggcatcgtttggctctccccactacacagatgaggacgataaggtgaaccaactttcccaaggtcacgtaacacatgggggtctcccgggaagcaggatgtgaaccccactctgtccagttactcctctgctcctcccctctgtcctctggcaatgggatgtagatgctggctctgccatgaagggtgtcttttgggtgacacacttcacctcctaaagcccatgcattcccgtcagtaagatggtgcagaaaggcacagccctcacggactgagcgaagatggctgaggtgatgtctgaagtgcattacagtacagtcatgccccatggaatgactgcacagccaatggtggtcccctacgattctaacactgtatttctactgtactttttctatgcttatgtgtgcttagatatgtgaataccactgtgttacaactgcatacggtactcaggacagtaacgtgatgtacaggtttgtggtctaggagcaacaagctgtagcgcatggcctgggtgtgtaggaggctgtgccgcttgatatttttttccttctcttccctggaattgctgtttgatttccctaagtatactctgtgaccgcacaatgacaagttaaatttctcaaaacgtatttgcattgctaaggcaggcacggctgtgtagtaatatgtcccatcatcaacccgtgagggtgtcacaggtggggcctttagccagggagacgcagcctcgcctggagtcctcctctcgtcttcctctgtctcaaccctgctgcagccctcctggggtgagcggcctctgcccatgctgggagcagggagcagcctctggctggcccacgaggctctgtcgcatctctgttccctctgcatgggggtggctgtcgacccttggggcagctgcagaggccgcaagaggggccatagctctctcaggctccttataaacagccattcctgccaccaggaacgtggcacagggtagggaagcccaagaggagatgctggaacacaggcagggctgtctggggtgccacatcccagggacaagaatagctggcattaactgctctaactagaactcctcccagtgtgagcactgctgcggctgcaagaagccctttgaggggctgcgaccccaaggcgcaggctcaaggatgcaaggctgattgcaacaccccggtaaggaagcagggcctggctgactttcttttagctgagtgaatgcagctctgaagcctgacctgggctgggacagccgaggcggccaccagagggcgctcctgcccccactctgctccaatgagtaaatgcaacaaatggttcatccccaggagtccgtgcgcccgcacagcggccgcctgtccagcctctgggaggctctggcatccgagtggtgtgaccacatggctggcttcctccccctgccctcctcaggccctgactcactggggttttgtgctcggactcaaagagctccattgacagcggggctggggtcggtttctctccacacagcctagcctgctgggaggcacaaccaggcaaatgtcacagggcccggcccctggactctggagccctgccctgacagctgggccaggagtgcggtcacagccccagcagaaggccctcacctcacaaggaacatgaggcgccttgccgggcgcgcaggccactcccaggtcactcaggattccaagttctcccccaagacgccttcagatgctgagcggcacaagggcctccccagggactggttgcaaagcctcctgctcagcttgagagggccaccagctccccactgtttactgttgttcctgagagaggccagagggagggaccagccagggagtggccagagggacagaaggggtggccttcctgagggcagggtgggtgccccagacctgagagcgctgcaggactcccctccacaggctcaggtggagcctccccagggtcctcctggccaggaaggcagagagccgacttctttcttcagctcccaacccaggcccagcccacggcgtgggagtcggggagagggagaggaggaggaaggaggaggagagagggagcttgtcttgtccctgagcagcgctctcagggcagaggtgaggcaccgggacatgaagttggaggacaagttcccaagcagggcttcctcgggctccccctcgcgacggtaatttgacacttggatctccaggacgaccaacaacaaaaaagccaggcagagacagcagctggctgtcagcagaggagctgggctgaggcgcccaggggagcagcggcgcccacgaaggaagtacgaggacagcacgtggaggctccgcgctggggcactgctgctcagcccccaacacctgagctcccaggtgagtggcaatggccacagaagaaggggggacagggagggagcagcaagggtcccctgcccccagggtgaagggccacagtctaccataaacacggagaggtcttcggggacatgctgggtcgcttccctgcagggaagtcagccagcctcctgcacacacctgcactctccctgctgctgggaccctgcactaggggagggctgggggctctgctcagagcgcctcctgctccgcctgctgtgcagcagaggggccccgagggcctgcttattctgcaagttcatttcagctcttttattcagggggcttaaaagagggatttggctgtccagcttgggagagaatggctgccggcctgctgagcctccctttttcccaggattagggcagagccctgtcgaggtcagcgcagggtctgcccagccagcatgcggcgcccccaggatgcagcaggactctgcccatctgtgtcctttcaggggcttggcccactcactgctggtgttctcagctcacggctcagcctgggtcctcctccctgggcccatctagaaccccataaactcctagatctccctctggtgatgagccttgaacaccaaaccaggaacctggaggactgactttcaactcaggctcaggtgggcagaaggtcacagaagtgaggctgggagggaccacgctggcaaccgggacctctgctgtgccaccgtgatgcacaggctgacatgacaccacccctaaggaagcaggacccggctgtttggttctttggggaacactgagagcagccctcctgggcagggcccgtgagccgaggctgcctactcctcctgccgccctgtcctcaagccagcgttaaagccaccaccccccatatgttttcctcaaagcaaacaagctggcatctagtgagaaacaaaaacaatgacccagggaaatgtggaaaccaaggactagcccaagtgttctcagctcagcagaggctgggggcttcggctggggctggtgtctggggagacaagctcctgcggtgttgggaggcgcacagtagggaagagtcaggccaggtcggggtcggggcacagcggtgagcctggagaccccagtggctgtcactcacaagacgccccaggcaggcaggtggggatccctgtcctgcatccacaggacacgagtggacagggtctctccaacacagtccctgaaccaggacggagggtgaatgaacagccagcttctgtagctgcagaaagagcgcctactgtttctaacaccagcagcagaaagcgcttcctcccgccctgggtggctacaggagcagggcctgccaggggttcaagcaccactttctacttccagttggagccagggcaaaaaggggagtcacccaaaggctcagtgccacaaataggggcatcccccccggctgctcaggcacaggaccctgcaaatctcccacaagtgtcagttatgcctccttctaggtggacctcaaacgagataatgcccaacagggcaagggtgactaaaacccaccatgacgaaacaacagggcagagcaagcagccctctggggccccgcgctgccaacacacctcgcttatcagtctcaaacacgccgcctgctgccagcccttcctcgtgaggcgcctggggttggagtatcagctctgcgaggaggaaacagggaagcttcgggaccaagtggcagctgtctggcctgcgggatgcctgcctgttgcaaggctccgtgtgccaggagatgccacataaaggaatgcttcccatccctccggctctgccagccttctctgccctgagtgtttcccctgtgctgaccgctactgcagccagggcacaccctctgaaggctccaagcagggctggctgggcagcctgggcagcaggagggcctggtggcagctgggctacactccctcttaaggccagagggagccaccacttgctctggcagccactcaggaacccctgaggaccctgagaagcctccaaccaaggcactactgagcgtggggttgggagggactctggttgccctggttcgcaggtgggcactaccaagcgtggggttgggagggactggttgccctggttcgcaggtgggaagtgtggttttggaaggagttgggtgaacctgagatagaaagacgggaaaaatatgggatcatcagtagccctcctgggcttccctgccttcctcctgccaaacctaggaagggaaaggggaggagaggtggccagcctcagagctcccatgttcccctcgccacagctgggaacactaaggttcccttaggagcagcggctggggcacatgccacacagtcacctgacggctgctggttatattgggcaccaagtgtcaggcactccttggcctggctttaaatagcccgctgggaagaccacctggggaccggctggaatgcgcctcctcctctttagagaacaggacccctcagctcccccacctgcgccatgaaggttcagtcgcgggtttacgctccaaatgacaagatatcaactgcaaaacaaagggggtcccggggttcctctccagctctctgggggcagaacagccacgtccaacggtcctacttctgctcactgtgtgacaggataccgtgagtacccctgggtcagaccctggggctgggtgaggctggccatgcctggctggcaaattcagcttccagtcagccccctagggaagccctgggcgcaaagctatgacactgtccacagccgcagcctgctgctgctgggaactgacacttttccccgctggaggccggggtccacccggcatgagtctgcagctctcccactttgcagcccctggaggaggctggccagagcttctcagcaacaaaccccacttttcctgcaccagtaaattcagcctcagtccaaccttcctcctccctgttctggtgagcacagccccaggtctctcgctcacaaggaaaagtgccccctgcaatctctccctgggtctctgggtgtggcacaagcgaaaaagctctccctgcccgctccctctttgaaggagtgtctctgctgggctacattaggccgtgtgggcacagtgccagtcaggctgaaaacgccagaccaagtgtagacagagagggaggggagaaaggcagcccagctcctgaaccacgcgcaaactgtcccgtaagggacactgtcggcattgtcgtccctctaagaatgagggaacctggaaagctggggcgtgaggatggcacggaggtcccggaaccaagaggggaccactgtccttgtgcaagcctgctccacctggccagagagaatgtcccattcagtctgaccagagggttcagtcctacactcaggctggctagactcacaagacctgtacctgtggtgacaaggactccaggtagtctcaaagagcctggtgtggccccggcctggtggtgatatgctgataaaagcagcttcagatccacaaatgtgggctggggctggccgagcacagccagctggcttccagggggctctcgggccctggctcctgtactgagcccactgcacgggcagtaccctcagcggggctgctcctggctatcttgctggtctaagctggagacaggcctccatggagagacagcgtggggcaccagtgggggtgctggctggggccctgtcctgctgtgtaacctcagagaagttgcttgctctctcgggtctcagcttccccacgtatagaaggaaggaggcgggagcggatgatctatagcattctaggaccctatgcctctcagtacatttgaaaactgagatcctcacctccacagaaacgcactcactccaggtgaggtgtgagaagctgggtggatctaactcagggaacccacggcttttgacaagaactcatctaattttccacggagccatcttctgcctgctaccctcatcatcacttaaaaaaacagctccccaggccgggcgcagtggctcacacctgtaatcccaacactttgggaggccgagggcggatcacctgatgtcaggagttcgagaccagtctggctaacatggtgaaatcctgtttctactaaaaatacaaaaattagccgggcatggtggcgcacactcgtgatcccagctactcgggaggctgaggcaggagaatcacttgaatctgggaggcagaggttgcagtgagctgagatcatgccattgcactctagcttgggcaacaagagagaaactccatctcaaagaaaaccaaaaccaacaacaaaaacatagctccccacctccagcttgcctaccttccttcagggcacacaccgcagacaccctaggacagacacccaaaaggtgttgggggtgctagtgacggtgcacgggggtgacagcccccaaagccagtgagacccgtcccgggggggcattctcgtgtgccgggcacccccctatggctgtctacaatgtgctgctagatggtcagtcctcccaatagcctcaaaacacgggcatctcattccatatcagagacatgaagcaacctgttcatgtcacaaaaggaagaagtggaggtggcattcaaggaggagcagctgaaaacactagagcaggcccctggcagagaaggaaatccagaaggtacatgccggctgccatcttgctcctgaagggctacgaggcagaagagggggcaaggtctaagtgaccacaagtgggactaactgggggccagcagggagtccgaccttctgcagtgggtgggctgcctcagcaggcggaggttcctcaccatcctgggtgctcatgcaaagaccacatggcctcaaggatggccgcaggccaattgcagggtggagggccccgttcgatgaccttcacggtggttctaaaccagctctgccaaggcagcggcaccgggagtgactggcctcactgacgtagccatctcagcgagaaccggctgagacctgggacaaggcaacgataattacagccaaaggtctggcaccagcccctggccacctgtccccaccaccacccctggattagagcaactgccttggtgaactggatcaggctgggttgggacaaggttgtctctggctcctctctaaagaggcaccagctccctcatgcccacaggagaggcagaaggggaaagccttctggagtggcaccttgggcctcttgggcaccctgagacaggaagaggctctcctggggcaggggtgggagtggagaggactttcctggtcaggctagagaaacagatgacgccagcaggggaggggctggcttgagcaacctgggcctcctgaccccctcccaacagacaggacagaaaccctggcaaaacctggagggacacggtgcggcctccccctctggcagaacaggcatgagtgtagaaactgggctggtgggagaggttggggggcctgggggacaggggggcagttttcacctctgactgaccctggccagaagccccatgaacctgctctcgggagaacctgctccttctgtccccacattgatggaaggcaagagtaccagcttggcatcctatcccagtctccccaccccgagggagctgtgccagtcccaagcacccaggcaaaacccagtagtggtacctcaagacaagggaatggaacagcgaagccagaaaccaccaccagccgccgccttggccggcagcccccgaagcaagcccttggtctcactgtcctcaccggcttcctccaccctgagctgtgtcagctgggtggggactgagggccaccactaggtggaagtcaccaggggtgcaatgtgtgagacctgacaaacttgttctgcgggctgcggatgggtgcgagggtggaatctcggtgctgcgacgagtgtggggccagccgtggaggctccaggtgttctctctgccccagcagagcccggcaggagccccaacaggaagccagcgcggcatggctgccaccgacttcgtgcaggagatgcgcgccgtgggcgagaggctgctgctcaagctgcagagactgccccaggctgagcccgtggagatcgtggccttctcagtcatcatccttttcacaggttagttggggcactcagcaccccatggctctccctggcatctgggagagaccacaccatggtgccagccagagggctggcagaggtggcgggtgtctgccggatcaaggaggaaaaccagttgtcccttgggggaagccaagggacttccctcatcctctgatatgctgcttgggtgatgggcggtgctggggactgggcccagcagtaccccgggatcccaaacgcggggatgacgggagccaggcttgggcagtgaaagagaagacacaacatggaggaggttggccctggcggctggcatggggaccgtccgcacctctcaccagcctctcggatctttctgacctccaccaaacctgtgggggaaagaccctggcaggcagtgggtttctctgggaggagggtgggcatcctttctctcccccaacctgagtcccgtgctctctcccggccctccagctactgttctgctgttgctgctgatagcctgcagctgctgctgcactcactgctgctgccctgagcggagaggcaggaaggtccaggtgcagccgacaccaccatgacggacgggcgatggctgaggagaagctggagaggagatggccaatgccatgacacaggccatcagcctggccctgcagcccttacccctcaagaccaggctcccctggccccagctctggcccagcccaggtacctggacactgacaacttgagccctaccaaggaaacaagggctggtataggtgcaaacctctcatctgccagtggacactgggtgctggggagtcagctgtttcaaagactgggtcaactgcctgggcttcttcgcctacctgcactttttaacaaaacaaggaagtaggggtccccataccttgatggagaacagtccccacctgtgggcaattggcccttggggctctgctgatacatgccaaagaggagcaaggcaatcagaggggctttgtgcaatagcttctgcatccgagctcccgccagagcgtgagcatgtcagtattctagtccagtatttgccagtttccaagtaaaagcttttgtgttacgtgtttctgcggtgccggactccctgaggttgggctgggctctgtacattgggagggggtatggctggtgcccgtccttcccaggcctctgctctccctgtgcccacgaaagctggaaaaccacgcagagaagcatgccacacaggcggttaacaccacgggaccagtggacggtgccatgaaattcctgtcatgcattagctgctaatgagctctgccaggctgaggcactactctgcagagtggcagagactgtgtttgcccaaaggcaggagctaagctcaggaacagcactttactctgtcaactgcctgcacctttggcctgcacatcccacactagcagactcagaccagtgggtcttcacaaactgccagaggaaggccctaatgtcacctgtaacctgcctcctgaccctgtggccctcccccatttgtgtgctgtctgggctcacaccctcaccctgtcagctgcgtgactcaacttccctaagccgaactcccccttggtgaaatggagcaaatcctggtactgcttcctggggtttgctgtgaggataaactaagatgacctatgtctagcactcagctcggtgctgggcatatctttagagccccatcaccatgacccgttattatttgcccctctaaacatgggaccaaccagggcaacagggacccattttaaagactggtcttgctgagaagcagcacctttccttccttaccccctcctttcagctgagtttttcttccagagaactttccaggtagagctacgaacccaggagtgaggggaggggaggcacatggctccagaaatgccaatgggtccagacagagcatcccgaggtgcctccccggggcttccccagagcctcaagaagtctgtgtttttcacatgcttccatcatcttggcctgcgtgacccgtgctctggccacctgggagcagagccctgtctacctgggaaacatgtcatggagaggggatcccagcccctgccacacccccgccatttccagctggcagtccaggccacactggcaatagcaggcagggaggggaagctctcaccctctggtttcactttctagtgtccacggacttgtctgacaggtttaggttaaagacccagagagtaagtgttttcatacaaaagaaaagaaattcaaaaatttgtccattctcagccccctccaaagaataggattcagaatgatgacgatgatcatgaggaggaggatgaagatgatgatgaagatggctaaaatttactgaggagttacacatactcagcattgtcttcagcattttggtgcagataaactcaattactcatcacagtacctccatgttgaagataccactattacccccattttagagatgaggaagctgggcctcagcgatgttaggtaacttgtctacattcaaccagctgaaaaggagcagggcctgcttgagtccagcctatctggctccagagcctctgcttaccacacccagggctctgagacccagaacttggcctcctggttgcagtacagataaggctctaatccattatcctccatcgaccaaccctacacccaaaacacccacaccccaaactctgtctcaaaataaccttcgcaggactgggtgggacccaacaggtaagagctggggtggtgcccaatgaggcacccctcccggaagaaaaacacagggtagtggacggacaggaaaccctgcatttttcattcccagcaccaatggctggagggtccctggaagccttctgtttgggagatggccaacagggaagcagcccaattcctgggtgacttttccataagccagttttcatcagcataagaatagccctgctccagggcggctgaggctgaggccctttgttagaaaatattctgcttccccagcccagctgcggagaggtgggaaccacagacagccctgggcacagacaggccgaatggccgctctagggcaggcggtgaacaactgctgagtccgcacaggattcggtccctgccctcacaggactcactcctccctgctccttggccaactggcacacaccaggcccggctgtcgggccaactccttcacaggcttcaaacccactgagattaacaaaccagacctgctctccgacagcagcctggcccgctcctttaagaggcagcttcttgtgccggtcttccctggggaagatgggcatggaaaggtggcagcagttgccccactgtgggaaagaataaacagaaagatgctgcagacctgggcggcctgaagacaggtgggggccatggaaggggcagccatcaggctggtttcaggtttagaggacgtctgacttggtcaccacctctctgttcccgccactgtgccatcctggaccatgccaccatcaatgcttacctgtggtcactgcagcagcatcctaagtggtccccacaatcatgtcgccagcctcttcatgcccaccccaagctgtgccctctgcttccgccacagggcaggctgctctcggctcctcaaaagggctgcactctactctgaagacctgcgtgccacactgtctgtacatcatgcctgattaaaagctacaatagggatgggcgtggtgactcctgcctgtaatcccagcactttgggaggctgaggcaggcagatcatttgaagtcaggagttcaagaccagcctgaccaacatggtgaaacctgtctctactaaaaatacaaaaaaattagccgggtgtggtggcgcacgcctgtagtcccagctactcgggaggctgaagcaggagaattgcttgaacccaggaggcagaggttgcagtgagctgagatcacgccaccgcactccagcctgagcgacagagtgagattccgtctcaagcaaacaaacaaaaaacaacaacagaccagcatagtatatcacatgcatgtaatcccagcactttggaaggccaaggatccttgagctcgggagtttgagaccagcctgggcaacatggggagaccctgtccctacaaatataaaaaaaaattagccaggtgtggtagcatacacctgtggtcccagctactcctgtggaggttgaggcaggaggactgcctggggcatgacagtggcactgcactccagcctgagtgacagagcaagaccctgtctcaaaaaaaataaaataaaaataaaaaatgacaataaagccacggatacaagaatctcattagaaaaacttggcagagagtatataaaagtttcctcccaaccgggcatggtggcacacgcctgtgatcccagctactcaggaggctgaggcaggagaatcgcctgaacccgggagacagaggttgcagtgagccaagatcacaccactgcactccagcctgggctacagagtgagactctgcctcaaaaaaaaaaaaaaaaattatccaattggggccggcagttaattgaaagagctggtcaaagcaacttttgttaaagaacacctaagttctctacacatctattacttttttacatatctcacattaaatggaaacatacaccttttccttggccggccttcctggccttttctctgagtgtgggcttgccaaccagagctcctggattgctatcttctagttttggttgagtgtgggcttgccaaccacagctcctggattgttattttctagttttggtttctttaaagcagaacaaaaacttaaagtcattggaacttaaaggcaaaggaagctgggtgtgaaaaccttctgggtttttacaaaatgtccctgatgtttagttatcatgtctgcatctttttcaacaggaacattatctgagtgattccaaagtcatcccaaagtagtcaataggtatttctagaaagaatttctttctccactcgctctgaggtgcagcacaggtgcttcagcgctcagactgtgtgctgctggattcaaactccaactcagttacttactagctgatgacctcggctaagttatttaacctctctgtgcccgttccccacatgtaaaattggggtttcagctattattgttgcttcattggttcccgggatgttaaattcaattatgtaattacaagtacaactgccatgaacaggtttgggaaccaacacttgactcttgataagcatctgacttaactgacggagctgcacgcaaagggtgagctagagactggcccactgctgtgagcgttcagcatgccaagggccttagtcagtaagtttcacacaaggaaacagaaaacatcaggtaacccgggtcagtgacgcccatgatagttaagaacgactgttctaaatctgcctccatctgtcatccaaccctggccacacctggggagaatcacctggggatgtgtaaacaatacgacatcctggcaaccccagagactgatataagtggtaccaggtggggcctgggcatttctcaaagctcctagatctttaccagctgggataagcacccgagggctagaagggaagcccttggagggcagggcccgcctctctgatctcacaactggacacacagtgcctggcatggttcctggccatagcgggccctcacatcctagcttttaaaggagtatatggtggccactaggtttcaagcaccagggcacaggcttgatcccctcttcccagcttccctattgtgccagtgggcagaaaccaaccacacaatgttgctgaggccgtgcccagggagcagacaaaggcaccaatgggaagcctcagggggggagcaacacttcccccagaaacagttccaggaggcaccaggcgccagccagggctgcagttaatcattcaccccacaacacaggaagtgagccctacgccagtcccagccccagggcttcctgagctcggggcaggtccgcagtccacacgtcacccagacagaggacagcccagcccagccacaggtgaggcggcctgatggcctggggcaaaggccctcggtccagtctcttccccgtccaccccaagtctgacttctctcaggagggactcatgaacacgtgccctgagcacccccaaaatgacatcacacaagggcagaaaggagctgaagggggaacgtgaaaggcagaaagggagccgtggttgccaggcaaccagccctagcccacctttgtttgtttggtgacagcaactaaggtctggtcagggccgcttggccacgctcatgccttttcctctcaacagttgcttctttgagtcagggtgcagctctggtcacctggcggcctcttcagctcagccctccacaaagtgtgagcctgaaggaccaccctgaattgcccttgtaggacccagaacagctaccagcagaatcaggtaatggctccctccttctccacctgggctgccctcacctggctatgggcttgcagtctgcgataaggagctccgcttctagaggactcctaagttctattctcagctgctccaaggaggctaccgaggcctcagctggagttggcccctcctcggctcctatacgctctctcaaatgcctcccaaatgtttggcagttggggcaggaaaaacagggagactctatcatgatgctttttagattctagccaagtaggtctcagggatgagagagagtccttgctcacacttgctactcaggaaagaaggactggagaatccaggggcatcccctaggaagaatccagggccccacttcttgcgccagtcctggctcctgtatctagagcgggggaaatgccatttgctgctggctgcaggcatccagcacaaagactctagccctttcatgtcccctggctgccaggcgggccggctgctcacagaggctgctacagaggctggagtcggcgggcagagcatagcacctgggacagggcctgggagggctgcctgcactcaggtcctctgtccctcttttccagattctcatggaccaactggtattcaaagagacaatctggaatgatgcgttctggcagaacccctgggaccaggggggcctggcagtgattatcttattcatcaccgctgtcctgcttctcatcttatttgccatcgtgtttggtttactcacttccacagaaaacactcagtgtgaagcgggtgaagaggagtgacctgacttgctggggactgagatggcagcaggggaggcgagctgacctgcccccattccagtggtgggccccttcgcggttccctctggctcaggggccaagccctggtgtcttcctttcccatcaggaaaaagtctagtaaaatactgtatctggcttagggttggtcagactagtaagatggggaggctggtctgagaccaattctggctccttgaccctattgtttttagggttccccgaccagaaccctaaaagcacatggagaggatggctccactgcctcaggtggaaggagctatggctaacaaggttctctaacaggctcacaggcccagccagcaatttcacaaatccttgacagagaaagacacaaccaaatgaaataaaaattccttttcaaatctgctaacttgtgagagctcatttttaatccagatagagccaccagagcaagcttcccgaacaaagccgcaccggggcctgcacgctctagcctgcctgtctccagccatcttgcccaccccatcctgccctgcccctgggttctcagcgtgtctttcagttcttgaatatgctgtgttctctcccaccacagggcctttgcacatgctattctcattgaccgggatgctctccctcacaccacactttactctatggcctagttagtccttcctcatcctttgtatctccgtttgaacctgactccctcaggtaaatcttccctaaccctcaaggattagggtaaggccacttgttttatactctcgaaacaccatttacaggacttatatgtctttgttgttgttgtttctttgtttttgagacagagtcttgctctgtcacccaggctagagtgcggtggcgctatctgggctcactgcaaactccacctcccgggtcacgccattctcctgcctcagcctcccgagtagctgggactacaggctcccaccaccgtgaccggctaatttttttgtatttttagtagagatggggtttcaccgtgttagccaggatggtctcgatctcctcaccttgtgatccacccgcctcagcctccaaagtgctaggattacacgcatgagccacggcgcccggcctttttttttttttttttttgagatggggtctcactcccatcacccaggctgcactgtagtggcaccatctcggctcactgcagattcgacttctgagtttacatgatcctcccatctcagcctcctgagcagctgggactacaggcatgtgccaccatgcctggctaattgtgttttttggttttttttttttgtatttttagtagagacagggtcttgccatgttgcccaggctggtcttgaactcccaggctcaagcgatcctcccacttcagcctcccaaagtgctggtataacaggtatgagccaccatggccggctctgggacggggctatttctgcccactagtgtatcccccatgtccaatgtgcctggcacagagctggcatcagtcaatatttatcagctgaataaatgaatgaatgagtaaacacacagagaaacaagaagatgccaggctgttgggcacccccagccccaagatcccaggaaacaacagggcccaattcaatccaggtctaaacacaaggctgctcttccatctcaagatgccgaggcctcaagctggaggttgcttcaaacctaataactgttccctgtgacactaaaagacactcattgttatgaataatcaaacactgctttttcaaggctgcagcccagagaaagtagctacagatagagaagagaggaaaaccgctggctgccacagccccgcctcattagttaactgacctgagtatcttttctgctggtcccactcccatgtgcctcagaccccacaacaaactgacaagaaacctacagcttcctttgcagaaatgcacccacttctgctgagcccaccccactagctctgtccctcactgccaggtgcccgccccaagggatcgctggtgggaggctgcttcgacctcagcctccaatgagaactattcttaggaagcaaatatctggtggagaaggggctttttctttgtgctacacgccagttatgcaataaagaaacattcacttattcaaagaacagtagccaatacagacataccagcagcgtttattccagcctgctgcctggatttcagaatcatcacatgtagcaaaggagacaggcacgaggctgctcaagaggcagcgcaacaccgtcacctggactccttgagtccacagatgcctggaccccagcccctggcaaccaggccactgatgcactaagaagtcccagctccccggaaggtgacaggagaaatgaaggcagaggcccttgggaggacctgttcccttgcctggcaggcggagcagaccctggggacaggcagagttaaccctccagagagcattccagagcctcagacagccccagagcttttttcagcaaacaggactcacaatgaacaggaacacttggccctttcattcctcaccagaaataagagctctgctcaagaagcctaagaaggccaaatttagcaactcccatattaattgtgcttgaaaagggctctggtcgcaaaggctgcaggcaagggtggtcctggcactgcagccgaccacttttgctgggcgtggtcttgccacagaggccaaattagagacagcagtttggagaagaaaatagcttcagtccagaagccaccgactcactggtcaacaggaggaggtggaaataaaaacacacagcccaaagagtttctctgatttcctcgcttttttcttgcaaaaaccaagatggcccaggtgtatgcaaatgaggacgccactgaaaatcaggagacgggtgtttagtggcctcagtctaccatgagcttcgtgactgtgacctctctggacctcaatttattcacctctaagtctgaagcaatcacgtcagcgtcatccgacaggatcattccatgagatgagatgaatccaagagctttttagaccaaaatgtaaaaactcctcctgggtgtctctcctgcaggcactcacagctccgcatgcctggacacaacctgactacaccaagcagccctcagactctttccgtggcccctgccccatcgcctgcagatgcaggtaaaacagatgcgtgagttcaaagcacatgactccccgaggtaagtggggccacaggcttctgtgtgggtcctggataagggtgaggactactcaagtgatgccagaagtcccagctcggtggcacatgatgaccacaaagccgatggctcagagctggtcacatcccttggaactgagtggcttgtggggccagccatcccagaagagggtggagtggagggaaggacaccactcagaatactgagcaaatccccacactgcgagagatcccggggcctccaatagagaagagcaaggtcctgacttccacactgcccgacacaacagcctttgcaggcaggtgtcccttggtagcctacgggctgtcttatgtcagctgcttaactagggcgtgccggggaagtaaatgatctcactgacactttgctccacatataaaataagtcacttaccccagttcttcacagaaggtcaccagggcatcaaaggccatgatagtggctttatcagatgctttgtttcctctcttttcctggggacaaaaaatgaccacttagcaagtcttatagaattggactaccttagagccacaaaaagtaatgaggaggccgagtgcggtggctcacggctgtaatcccagcactttgggaggctgagccaggaggatcatttgaggtcaggagttcgagaccagcctgacctacatggtgaaaccctgtctctactaaaaatacaaaaaaattagccaggtgtggcagcgcatgcctgtagtcccagctacttgggagactgaggcagaagaatcacttgaacccaggaggtggaggtttcagcaagctgagatcatgccactgcactccgtctcaaaaacaaaaaaaagtaacaagggagaaaaatattaaatgacagtaataaagccatttacaaaagtgtccccaaacctgactatgtatcataacccccagactactgaactgaattttctgggatgagcttttgagagtttccgaaaagcttctcaggaggttctcatgcaaagggcccacagactggcatttaggaagcgctatataatatcacctattttaataatagtaaatacacgcacaaatgttgtgaacttaacaaatatgaacacatatacttctgtgtatattggagggagatatattaaaaggttaagtgactcttcttgataagcttaaaacatgaatttaaaatacaatttaaaacctgtaatcccagcactttgggagactgaggtgggcggatcacctggggtcaagagttcgagaccggccttgccaacatgttgaaactccatctctactaaaaatacaaaaattagccaggcatggtggtgcatgtctgtgatcccaggtactcaggaggctgaggcaggagaatcacttgaacccgggaggcagaggctgcagtgagctgagatcgtggcactgcactccagcctgggcaacagagcaagactccatctcaaataaaataataaaataaaataaaataatgcttgacctgccgactcagaaacccatgtggggtgggggtgggcagctgccagctacaccaggagagcaagattcccaagcccttcagttggcacccaaggggccagtgtgcaccacttggatcacacaaccagaaaacaggaggaccccaaaggtttcctgagtctctacttaccagggaggctgtgtgcggccctgccagctcatgcctgagcacagcatcccagatggggcagagcagggtacggctgggcaggggaggtgggctctggaaggtgctaatggtagcagacagggtgttgcctcctgcctgcaggtagggagcaccctgaatgagcgggctgagctgggctggtcaccaggcctggacccacagctcctttggctatggactaatatcagaggagtggcttatgggaagtggatagcaggaagcgctgaggcctggctcctgagcgcagggtaaagctgggggaaggagatggtactgtgaaggcagataaaggggcaagagcctcaggtttctgtcccccaccccacttccctggggctttccaaaccaaagcctgcaactaacttaaaaggaagaaaaagcacttaagttaccaacaactaccaaactcccccaaagcccctctcacaaaatccaaactgttttctcatctccactcctgcctcccccacacaatatagtttcctgttttctttttaaaatgttgcctgccacctctccacctgggaaacccaaggcatgactgccggttgctggtgacaggcacacagcaggcagagccccatctttggtggtggggcggagggaggtgggggcaccagtccctgccacatcctcaatccgcagacactcatcagccagccttccctttggctcccactagaggggagtagggcaatagcaggtggtccccacagctgagcaacaacagctccaggccttcccaccaggaagacctctgcacccttatccaattcaaagtacaggctcaccttgggccaggaaccactattaggtaaggaatgggcactatacatttcaaatgtggacacctggtcagggcagtggaactctaaagatggcagccaacttccttccttgcccattcctggaggtaattcccctcttagtgaccgaagctctggtgcagctctgctcagagaccgttcctggcttcactctgttataagcctgtctatggacttgtggctgaatcaactagcagaatactgagcatttgtgagtgatgtgattattcatcagcggccttttttgtgtacatgtctatttgccaacatatccttttaaaatactgtgaattatttaatacagaaaaggaaaaaaagagcccgggcatggtggcttatgcctgtaatcccagaactttgggaggctgaggtaggtggatcacttgaggtcaggagttcgagaccagcctggccaatgtggtgaaacctgtctctactaaaaatacaaaaattagccaggcgtggtggtgggcgcctgtaatcccagttacttggggggctgaggcatgaaaattgcttgaacctgggagatggagaatgcagtgagctgagattgcaccactgcactccagcctgcacgacaaagactgtctgaaaaacaaaacaaaacaaaacaaaacaaaaaaaaaaccccaaaaaaacaaaaaccagacactgatatctgagacatcatctattgagtttctgctttgggcaggtaactcatccccaccaatacacacaaatacacacagattctgtacccccaacttcccaatatgtttacaacacaatttcttattaaatccatattttccttattatgactatgtcaacagagttcacagctaaaccgaagtgattgcatttttatatttcctgtgatcacatttcctttcttgtgtaactgtgtttcccctgaaatagctttgtttttctccatttacttagatttcagtatgttattaattcacccctaactgtcctaacataatgaacaattcatttcgataggagccagagatgccagcttccactttgatgtttagaaccttccttcctggagtcttctgccccctagtgcaatctggaccagttttccctaggcctgggacacagctgtctttccggactactctccaatattgtcctgtgccaagacttactcctgggtaagtttccatctttgctttctaggtttactgcctctctacaatggagaacatcctttaatagcttctgagacatgacataccaggggaaagtttttgaaacctttgttatctgaagatgtcttttttttccttcaagtttccacatacagcattgcatttttatttgtttatttatttatttttttggagacagagtcttgctctgtcacccagtctggagtgcagtggcatgatcataactcactgcagccttgaattcctaggctcaagcaatcctcccagctcagcatcctgagtagctagaactacaggcgcacatcaccatgctcagctaattttttttattattattagtttttgaaacagggtctcactctgttacccaggttggagtgcaatggtatgatctcagctcactgcagccttgacctcctggactcaagtgatcctcccacctcagcctcttgcgtagctggaactacaggtgcataccactacacccagctaatttttaaatattttgtagagataaagtcttgttacattgcccaaactactcaaactcctggcctcaagagatcctcccatgtcattctcccgaagtgttgggattacaagcatgagccacctcacccagcctaacatttttaaacatgtcatttgataaatttttctgggaactttcttttcatattatttgcttttcatatcctttgttcaagcgattttcctacttcagcctcccgagtaactgggattacaggagcccgccaccacgcgcggctaatttttgtatttttagtagagacggggtttcaccatgttggccggctggtctcgaactactggcctcaagtgatccgctcgccttggcctcccaaagtgctgggattacaagcatgagcccctgcgcctggcctttttttttttgagacagagtctcgctctatcacccaggctggagtgcagtggtgcaatctgggctcactgcaagctccgccttccgggttcatgccattctcctgcctcagcctcccgagtagctgggactacaggcgcccgccacgacgcccagctaatatttttgtatttttaatagagatggggtttcaccatgttagccaggatggtcttgatctcctgacctcgtgatctgcccacctcgtcctcccaaagtgctgggattacaggcgtgagccaccgcacctggcctttttaatttttatttttattttgagacagggtctcactttgtcgcccaggctggagtgcgtcctccactccatggtatgatctcagcttaccgcaacctcaacctcctaggttcaagtgattctcccacctcagccttcccagtagctgggactacaggtgtgtgccaccatgcttggctaatttttgtattttttttgttagagacgggcttcactatgttgggccggatggtcctgaactcctaacctcaggtgatctgcctgccttggcctcccaaagtgctgggattacaggcaagagccactgctcctggccccagagcttgttttctcttggtgagattttagttttcttcatctaaatcagtggttgtcaaccctggccatatattcaaagcaactggggagctttttttggtttattttgagaccgactttcactcttgttgcccaggctggaatgcaatggcgcgatctcggctcaccacaacctccacctcgtgggttcaagtcattctcctgcttcagcctcttccaagtagctgggattacaggcatgcgccaccacacctggctaattttgcatttttttagtagagacggggtttctccatgttggtcaggctggtctcaaactcccgacctcaggtgatctgcccgcctcagcctcccaaagtgctgggattacaggcgtgagccaccgcacccagcctactggggagctttttgaaaaaaactcgtgttaacagcttgtaacacttattcctaagtattttataagttttattgttgtaaattaagttttttttttgtttctatttctaggtatttatggtaatgtggagaaaagctactgattttttttttccttggctctcatctgactagagaaaagctactgatctttaaactatttctcttatattcaaccagtttgccagattttcttatgattgagtagatttctagtagggtttttgtgtttctaggcacaatgtgttgtcatttctacctgctgttgtcttctctcctactttcattatccttgcgaatttatgtatatttatccttctattgtcttttttttttttttttttgagacagagtctcactctgtcccccaggctggagtgcagaggcgtgatctcggctcactgcaagctctgcctcctgggttcacgcccttctcctgccccaacctcccaagtagctgggactacaggcgcccgccaccacgcccggctaattttttgtatttttagtagagacggggtttcaccgtgttagtcaggatcgtcttgatctcctgacctcgtgatccacccgcctcggcctcccaaagtgctgggattacaggcgtaagccatcgcgcccggcccctttattgtcattttggcagagattagaaataagtacttataggctggacacggtggctcacgcctgtaatcccagcactctgggagcctaaggtgggaggctcacttgagctcaggagtttgagaccagcctgggtaacataacaagagctcgtctctacaaaacaaacaaacaaaaaacaagggaagattaagccaggtgcagtggcacatgcctctggtcccagcgacttgagaggcagaggcaggaggatcactcgagcccaggagttcgagggtatactgtgctatgattacgcctgtgaatcaccactgcacttgagcctgagcaacacagagagaccccatctctttaacaaaagaaacaaggcagtactgatcttgaccacataaaataacatgtacacaaaagacaatattaaggccgggagcagtagctcacacctgtaatctcagtagtttgggagtttgaggcaggaggattacttgagcccaggagtcatgagaccagtctgggcaccatagtgaaaccccatctctgccaaaaactgaaaaaaaaattagctgggcgtggtggcacacacctgtggtcccagctactcaaggtgggaagattatttatggccaggagttagaggctgctgtgaaccatgactatgctactgcactttagcctgggtgacagtgagagaccttgtctcttaaaaaaaaaaaaaaaaaaaaaggtgggcacagtggctcatgcttgtaaccccaacactttgggaggccgaggcaggcggatcacgaggtcatgagatcgagaccatcctggccaacatggtgaaaccctgtttctactaaaaatacaagaattagctgggcatggtggcatgcacctgtaatcccagttactcaggaggctgaggcagaagaatcgcttgaacccgggaggcggaggttgcagtgagccgagttcatgccattgcactccagcctgagcgacggagtgagactctgtctcaaaaaaaagaaaaaagaaaaaaagctagtattaagataatttaaatatttaaatatttagaaagaaaaagtctaacctagcttgttgtaagctgcctacctaaccaatacgccatttccctttgctatacttacaggttgggagcagcctcctctagcttacacaagcatcatcagagttcagaaatcagcttcacaaaactggagagtggtgggtcagactgaaagaccttctactgcccaagccttacctggagttttgctacttccttcctgatcaggaagctgacttggtcccggtcattcctggagtaatagagacggcaccaggaaggcttcccatccctgccagcccggccagactcctggtagtacccagccatagacttggcaatattccaatgggcgacaaacctgtaggatccaaagggacaagcagcatgagatggtggagaagctgagtgtcctttggaggagtaatcatgactaggagagcagggaggccagcagatagggagggagagggatagtcccagagttagaatagttaagacacctgtagcccatcagcacgtctcccttctagaagcagcccagcttagaggccacagcaggagttaagggggggcaaatccagcacatatgaggggccaaaaaactcagccagggcccagtggaaaaaatactggacctaaagaaacaaaatgaggctctgccacttatgagctatgcaaatttgaataagttatttataacttctttggagagggaaaggaataatatttattaaatacctcctatgtgccagtttatatatgtctcatttaattgttagtcaccatcatgtgaggtagcccattctccagaatatgagattcagaaaggtaaatttgtacaaggttacacagtaaagggtcagcagagctagaatttgggcctaggggtgtctgccttcaaaactggctcttaacaagataccacagacccaggattcattttatttattttgcttgttttttattttattttatttttagatggagtcttgctctgtcaccaggctggagtgcagtggagtgatctcagctcactgcaacctccacctcccgggttcaagcgattctcctgcctcagcctcctgagtagctgggactacaggtgggcgccaccatgcccagctaatttttgtatttttagtagagacggggtttcaccatgttagccaggatggtctcaatctgttgacctcatgatccgcctgcctcggcctcccaaagtgctaggattacaggcataagccactgtgcccggccttgttttttatttttcaagacagggtcttgctctgttgcacacgctagagtacagtggcacaatcacagctcattgcagcctcaacccccggcctcaagcaatccttccacctcggcttcccaagtatccaggactacaggcacatgccactatacctggctaatttttaattttatagagatggagtcttgctatgttgcccaggctggtctcgaactcctgggctcaagcaatcctcccatctggtcctcccaaagtgctggaattataggtgtgaaccactacacctggcagcatacccagggttcgaactctgattctgaagtcggtgttctttcaaatgtaacgcactataaaatttcgtccctaactcagggtcactgtgaggttcacgaagaccatgtatgcaaacatgctccgtaaatcatacaaggtattattatttgtcgttaatcagaccaaagggcttcaggctgtagcccaaaacgcctcttgaaggtcatggccagatataaaagacttcctattagttgccagtgtggggctaggaggctgggatgcaccccgactcttctagactattagtaagcaataaaaaggaatgatggttctaagagccttgcctttgaccttccacagggagtagcttaaaatacagtcacacattacttaatgatgggaatacatattgtgttttggtttttggtgtttttgtttgttttttaagacagggtcctggtctgttgcccagcctgaagtgcagtggcatgatctcagctcactgcaacctccgcctcccgggctcaagcaatcctcccacctcagccccccaagtagctgggactacaggcacgcaccaccacacctggctaatttttatgtattttttgtagagatggaggtttggccacgttgcccaagctggtctcaaactcgtgaactcaagcgatccacctgccttggcttcccaaagtgctgggattacaggtgtggaccactgtgcccggccagggatacgttctgagaaatgacttgttaggcaatttcatcattgtgcaaacattacggtggatagtctttacataaatctagatggtactgcagcctgcacagctaggctgtaaacatgtatcgagtgttaactgcactgaatattgtaggcaactgtaatgcaaatcactaggccataagaatttttcaactccattacaatcttacaggatctcagtctatgcagtctgtcattgaccgaaacatcaacatgaggtgcatgactatagttcctttattcccacctcctcataggatccacctactgagatgtgagtgaacaggactatgttaaaggacaagcctgacagactgcatgctgccccatcctggggggtgccagaaccatgccgtgcagtcacctgggagcaggccgcacaggagctgtcagcattcaggctgtattctaaggactctctcctggagcttccttcccctctagccctcgaaggagcacatgcacctggtcctttgggcacagcactaggcaatccaccctgagccaggcccagaccaggagggcagggcaagaaccaaagctcacctgacattggctttatccactcccatcccaaaactaatggttgcaacaattacagggaccttctcctccatccagtcgttctgcaccagcgttctttcagaggccttcagccctgtaaaggaggggaagatggagaagggaactcacatttcccttgggtttaccgggggcctattttgggtttgacactgtgtgctaggcacttcacaaaccctgaatctttcacttcccagctgtctgaccttaacatcaggcgcttaactttactgagcctcagctgacaggcacaaagaccctagcccatgtgtggcacagagcatttggcaaaggttagggccatgattcaagcccaagtccgttggcctccaaagcctgtgctcttcctacaacaccattaccttggcttgtaaaaacgtatcacctgctgctgggtaggcatacagtgggaagaactcaggagtcacaattctcattttagacctcattcatgtctagactccttttaggggatttaagtgtatcactttagctctgcctgagtatctgcaataagatggtgggtcacctgataaccaggatctgtaaagaacaagagaccagctaagaagcctctgagggtgaagagactcaagtggcctgggtgccccttacctgcatggtaagccttggcgttcacacccctgcagctgagctctatggccagctgttcacaagcctctctagtcctgcagtacacaatgccgcagccagataactgaatggggagatgcaggaagaaaataagcatagcaagaacagaacaataggcccagtgtaatgcaccctgctctaaaagaagctctgtgttccttctctcgtcggcttcagtctcttctgaggcaggacacccagtgaggctctgtcactttataaaaagcaggaccaggctggatgcaatggttcatgcctgcaatcccagcactttgggaggccaaggtggggggaatcacttgaggccaggagttagagaccagcctgggcaacacggagaaaccccgtctctgctaaaaatacaaaattaaccgggagtggtggcgcatgcctgtaatcccagctacttgggaggctgaggcaggagaatcgcttgaacccaggaggcggaggttgcggtgagccaagattgcgccattgcactccagcctgggcaacaagagcaaaactccatctcaaaaaaaaaacaggccaaaagctgctcaaaactcaacctgtttaacttctctgcctcctcttcatgagctttgcatgggtctgcagaggcatcacacagactggctggctgcttgccttccacaggatccagaacaaggaaaccctggtaaggaggacaatgccaggaaaccaaagagacaactctttttgtgcacaagttttaggaagcctggctgagaaagctagaaaaaccaaaggtcttagactaatctccatctccatcacatcgcaccccactgctctaacagctgcttggcctccacctcaatgcctcacccctttatcagcctcctgtccaagagccttaaggcagaagtccttcaggttcccatagggatcagaaatcagttccttgaattgcacatcatagaagaggttggcccggaagcagggagtcttgaagatggcaactggtttcttcaggtgcagggcagcaaacacgtcctcttggacctgtggggtggctgtggcggtcagagccacacaaggggcatgtcccaggcgggagcgcagggcacccagacgcaagtagtcaggacgaaagtcatgcccccattgggaaacacaatgagcttcatccaccaccaagtaagacagcaggtggcgggacaccagggagttcagggtgggctggaaggaggatgaagctgccatctctggggtgatgtacagaatcttggtctggggcttttctcgctccaggtcagcaagcagctccttcctttcctgtgcagagagcttcgagttcagggaacttactcgtacctttagggttagcaagtggtccacttggtcctaagagaagagaaagaggctgtaactggccctcaggactcaggtaaacatcactgcaagtccctggaggatttcccagtcataaactgtcctcctcccaccctccaatatatattctctttgcatagaagtagtagaggttgaatatcctttatcaaatgcttgggaccaaaagtgttctagatttcagatattcctggatttaggaatatttgcagattgcatatacataatgagatctcttaaagatgagacccaagtctgaacatgaaattcattttttctttcacgtataccttatacatatagcctagatgtaattttatatatttttaataattttgacatgacgttgtgcacatgtacctagaacttaaagtataataaaaaatatatattaaaaataataataataattttgtgcatgaaaaaacagttttggctgagttttgaccgcaacccatcacatgaggtcagaaaggtgtggaactttccacttgtggaatcacgtcagcactaaaattttttggattttggagcatttcagatttcagatttttgctttagggatgctcaatctctatggaaggtgaagtggtttagagcacaggctctgaagtcagacagacttcagatttagatttcatcctggctcacttaatcgccacatgctcgctggctgtttcttaccctctgaacgatttatacaattctatctaatagcattgttgtataacttaaaatttacatctgagaggtgaaattaacgtatgtaagccgggcgcggtggctcacacctgtaattccagcgctttgagaggctgaggcgggcagatcacctgaggtcaggagttcgagatcagactgaccaatatggtgaaaccctgtctctactaaaaatacaaaattagccaggcatggtggcgcatgcctgtaatcccagctactcgggggactgaggcaggagaactgcttgaacccgggaggcggaggttgcggtgagccgagaacacgccattgcactcaagcccgggcaacaagagcgaaactccatctcaaaaaaaaaaaaaaaaaaagaaagaaagaaattaatgtatgtaaagcacttagcacgaagcctgggacctggtgaacattcaccaagttattactgtagttccctctctaccttccttcatggtggatggctcttacccacacagccacacttcctcaattctgattctatcagcccatctgcaggccttaaatagtcagaacacctgtagagcagatgttaataaggtcccagacagtttctcatctttttttctgtttcacatactgtgcccttaccaaaataagcaggacaccagggattccccatatcaacttagctatctatccatctgcaacttctgtctcaacatcacgagtgcacgtgtgtgtatacatgagactgagtgtatatgtgtgtacaaatacagtttcatactcctctgaacaaaaaaataacaaaggagggtgagggacctcagaggagtcattcataacctcccagagtgatatgcaccagtggagaacactacattggggaaatacagaaacccaatatagcgaatgagataggcaaatcatagaaaataagaggcaggggcgggtgtggtggctcacacctgtaatcccagcactttgggaggccgaggtgggcggatcatttgaggtcaggagtttgagaccagcctggccaacatggtgaaacctcatctctactaaaaatacaaaaattagccgggtatggtggcatacacctgtaatcccagctatatggggggctgaggcacaagaattgctggaagccgggaggtggaggctgcagtgagccaagatcgcaccaccgcacttcagcctaggcgacagagtaagactctgtctcaaaaaaaaaaaaaaaaaaggaaaaagaaaaagaaaagaaaataagaggcaaaagaccaatagagaagtgaaatttccagcctcaaaaaaccttccccgaatctttttgggctaccatcttcattgccctaagcctcacctgaatcaaagcaatgagaggagagactacaatggtgatgcctttggccaacagagcagggagctgatagcatagggattttcctgcccctgtgggcatgcacacaaagacgtccttgttacctgaaaaaatacaagacaacaatatctcagtgcttcctgccttttcattgaagttgttgaaaattaaatgagaatgtaggaaaagcacctagcagagtgtctggcacatgggagggtctcgatgtaatcctaattcccctcctgtcctttctatgaaaaaggcaaggatcctgggaaacttggatacatgcccaaaccatttctagtaatggttaaaaacaagatttaaaaagtctgggtcaagcgcagtggctcacgcctgtaatcccagcactttgggaggctaaggcaggcagatcacgagggcaagagtttgagaccagcctggccaacatggtgaaactctgtctctactaagaatacaaaaattacccaggcatggtggcacgtgcctgtaatcccagctactcaggaggctgaagcaggagaattgcttgaacccaggaggcggaggttgcagtgagccgagatcgcgccactgcactccagtgtgggcgacagagcaagactctgtttcaaaaaaaaaaaaaaaaaaaaagaagtctgagtctgctgtgatatggatgattgaactaaacagccatgaaagcagagtactgctagatgagtgggtacatctgtgtagacatgagaggacattacttagagggcttttgtttagacatgtatcattaatattacattgctgctcgcctcttggcaacttccatttgtcaccgtatctcaggtttataacattattactctttccttctctatctgggaccaaggccactcaacctgcaacaagggaattacctaggaggccagtgaccgagttaagttattcctaccaccctcactgttgctgttcgtttgtgtgtacaaacgaacaataatgagaatctgaagtgttttcaaagaccatgtgtaaatctagctatgaaatatagaccagctgggtggttctgccactaaaactacaagctttgggccgggcgtggtggctcatgcttgtaatcccagcaccttgggaggccgaggtgggaggattgcctgagcccaggatttggagaccagcctgagcaacatgccaagaccccatctctaattaaaacaaataaacgaaactacaagctttgacaactctaaagatttccaaatccagttatggaccaaaggtgaggcagtacgaagggtgaggaggagggtgttctgccgcagcgttatggtatagccagcataaatttaaaggaaggtagcttggtaatgttaccttttactacagccatggtcgcactctcctgtaaaggcgtcttaaaagagtcaaacccaaagaccttcttcagcgtactccggactcgccgctcagggtcaaaaggaaaggtggtatggtggctgctcatcttagccaagaacagtggccaaaggttaaggcaaaggtagtaaaaggttgccacgagaaccctctgttttgcattaaaaatacagattatttttctgtaacaatttgctatattacacttaaataatgtattatttttaagtaataaagctgaaggtgaactgcctcaagcaatacattcctcagtaattaacatctccacttttacgctcaatgaaaatgaaaacattgaactattccaggccacggtatagcacagagctagaaatcagatcaagagaagaaacataaatgtcttcagaacagcttggagaacggggaaccgttttcctaagatccaccacctgctcctacttctataagcgcaaccacgacgaccgttcttccaccccgggaccccgaaccccttctcccgtcttcctgagcccaagatccgcaattttctctcttggctggccgacacctccctctcttcaccctaagatatcagaaccggccgtggtccgcccaagaattaaaggctgctggctggttccggaactgttcgaagacccctatacacaaccccaactcagagaagccaaagcgctgggaattcagctttaggcagaacccacgcaatcttatatccgtcgcgcagtgatga

SEQ ID NO: 183 - DNA, 48541 bp, Homo Sapiens
ttcttaatgtataactgaaatgtattttttcatttataaagtataagttatctttaataacacacatgtacaataaataattcatatatgaaaattctcatcagatagcttcatgctttgtcagtggaagaagccacagcaccagggaaatcagaaggcaatcttagtaactcttctacctcttcttgcagggcttctgctttttcatgcaacagcatctacattaaaaaattaagacgtgaggccaaaatatgcattgctagagaattgccaacaattttaccactgtccattgaacacctgaatccttacacatcagaaatctagacattaaaactataatgagattgaaaaatggccacttaagaataaacgattatagtcaatgaagatgaggcatttagttaaaaccattttagctgatcactgccttttagtataccaaaaataaaggagctttaattctcccaaagatttgttttattgaagactcagccacttaaaaattaacttttaatctataaaatctaagacaattttgcaaaaatttaattagctcctgaaaaatgttatcctttatatatatgcattttattattcctcaaaatttagtatgctttaaaaagctaccagtatttcaaataaaagttttattcaagttcctaaacttaaaactgttaatttcaaaagcaacataatgagcaaaaaaagtatttccaaacatggcatatgaaagatgtcaatgaatttttaccaaataataagctatatagatcaataagaataataagtaaactacacaaaacccttgtgttagtattactataatacagagaatatcaagaacctcaaattacttgtttaaaaaagcccaccaatttgtggaagaataaattccgctcccccccacccgcctttttttcttttttagacggagtcttgttctgtcgcctggctggagcacggtggcgtgatctcagctcactgcaacctccgcctcccaggttcaagtgattcagaaggcctcagccttctgagtagctgggactacaggcatgcaccaccacacccagctaatttttgtatttttagtagagatggggtttcaccatgttggccaggatggtctccactgcttgacctcatcatctgcctgcctcagcctcccaaagtgctgggattacaggtgtgagccaccatgcccagcctctttttttttttttaattagaaaaaatttaaaaagctttttttgtagagactggatctccctatgttgtccaggctgttctcaaactcttgggctcaaacgatcctcctgccttggcctcccaaagtgctgggattatagtgtgagccactacactcagccaaaaccagtttcttgagctcccacccaagtgtttgcagagatccagatggggttgagaaaaaaaaaacacatgaacaagataagagggaaatagagggtctaaaatgaaataagatcacctccagagagaaaaagcctacccaaatataaaaatactgaaaaaagaatgttggttgattaaagcattgtttataggaagatatttaaaatgcatgtgggactctaggaggcagtcttcgaaaggcaatgcttttaggggagagaatgggtgaaaagggaggtgccttttggaagctcagccatgagaggaagaggaaaaaaggacaaaatttacaatcttgtagggcaaaaggaaattaaacaaacaaacaaacaaacttgcattcctctcccaccccaagtcatccattaaagaaaaatactttgctactctgacagaagagaacactcttgaactgggatctcataaatcattccaaatgactgtgttgtccaagatatgcagaggcacaagcagttctcatctatacaaaactactatataaaaagaaaacaaggctgggcatggtagctcatgcctgtaatcccagcactttgagaggccaaggtgggcagaccatgaggtcaggagatcgagaccatcctggctaacacagtgaaaccccatctctactaaaaatacaaaaaaaaatttagccaggcaaggtggccggcgcctgtagtccgagctacttaggaggctgaggcaggagaatggcgtgaacctgggaggcggagcttgcagtgagccaagattgcaccactgcactccagcctgggcaagagagcgatactctgtctcaaaaaaaaaaagagaaaagaaaaccaataagaacccaaactcttcatctcataaaaatttcccttcctgaaagcaaaccatgaagcagaaaaactgtaacacaacactccaaacaaaattaaatattctcaaataaaaatctggagatatgaggaggagtagaaatgctctctaaataagaagttaaaaaactaagaaccgacatggacaaaaactggaagaaatgatacaaaagttgactgagctcaggaatgaaataaaagaaaaaggcaaaatcatattagaaataaaaactaataactataactaaataactgggtgtccatagaaaaacagatttaaataaaaaacctaattagggccactgaaaaaatttaaaaagcaggaaaacaataaagagaataaaaacgagataggccgggcatggtggctcagacctataatcccagcactttgggaggttgaggcaggaggattgcttgaggccagaagttagagaccagcctgggcaatgcagtgagaccaagcctctacaacaacaacaaaaaattagccaggaatggtggcccatacctatagtcccagccactcaggaggctaaggtgggatcacctgagcctgggagttcaaggctgcagtgagctatgatggtgctactgcactctagcctgggtgacagagacctagttcctccccactccccctaaaaaaatatctgtgagggaaggagaggaaataaaatggaataccagtagaatttgtgtttcaaatgtataacagccacactgaagcagatttttttaaaccccaaaccaagtaacattttaacacattattttaattatatactctcagactgaagacaaaaagtgctgtaaataaatactgaatgtttgttttttttggagtggtataatttaacaattctgcagttactttcagtgcattctaagattgaggaaaacagaaatatattaataaacacagggatgaggtttctcattattggagaaaggaagtacaaatatgaaaaagaggaagactatatagcaagtcctgtatgggattagtgtggcaaattaaagatgattggaaattctttgacaccttcattgagagacgggatctaattctcctcttgaatctgtgctagcctttgtgattcacttataactaatagaatgcagaagaaatgatgccacatgacaggtctcagtttaagaaaggccttggggtcttgaaatgagatcattccaaggtcatgtgaatcctccccctcagatcctagcatccacactgtaagaaagccaagctaggataggcaaggtggctcacacttgtaaccccagcactttgggaggccaaggtgggcagattgcttgagcccaggagttcgagaccaaaccgggcaacatggagaaaccccatctctaaaaaaaaaaaaaaaattacataaattagctgggtgtggtggtgcatgcctgtggtcccagctacttgggaggctgaagtgggaggatcacctgagcttgggaggctaaggttgcagtgaggcatgattgtgccactgcattccagttggagtgagagggagaccttgtctcaaaaaaaaaaaaaaaaaaaagaaagtcaagcaacatagagattataaatagacaaataagaaactgcagtgttttaaaagatattatactagattgaataaaaagagacagacaatacaaaacatcaagtgcctttgaacttttttttttttaaatttagagatagggtctcccccaggcatggtggctcactcgtaatcccagcattttgggaggctgaggagggtggatcacttgagctcaggagttggagaccagcctgggcagcatggtgaaaaataaatttaaaaaggtaatttagttaggcatagtggtgcccgcctgtggtcgcagttacttgggaggctgaagtaggaggattgcttgagcctgggaggttaaggctgcagcaagccaagatcatgctactgcactccagcctgggtgacagagtcagaccctgtctcaaaataaataaataaataaataaaattaattaatttaattaaattaaaaataaaatagagataaggtctcgctttgttgcccaggttggagtgcagtggcatgatcatagctgattgcagccttcatctcccaggctcaaatgatcctcccattgcagcctcatgagtaccacaggcacacatcaccatgcctggctaattaaaaaaaaaaatttcttttgtaggaacagggtcttgctatgttgcccaggctgacctcaaactcctggccttaagtgattctcccactctggtctctcaaagtgctgggattacaggtgtgagccactacacctgagcctgaactcttgaacttcaatattcttgaactacatataggaagcacattgagaaagctacctagcagcaaacatgggtttattgcttatggaaaagggagaatgactcaaatgagagaacccaaagccaagaaaaaccattcccagagagaagaactgggacataattaaggaactggccacatatgactggctggatttcagaactgctgctgtgcactacccattttccttctttatgaatgagagtatactatggttatcctatttctagtttcactgttttatgtagtgtctctttagttcactggtcttcagattaagaagaactgtaacttgtgaaactgtactgaaggtgtatcactcacactcggacttgatttagaatactggatctgagtctgatgctgtgatattatgatagacatatattggtcttcatccacggttcctggctcataactcccacagcccttcttacaatgatggggcactttagacctcagaaaacagaatttctctctctgaccttcttctgccctccttttgcctgcctaaggcagaactctaatctgatcattgggtcttaaaaccctcattccaggctgggtgcagtggctcatgttgtaatcccaacactttgggaagccaagatggaaggattgcttgaggcccggagttcaagaccagcctgggcaacatagcaaaaccttgtctctattaaaaattaaaaacattagccaggcgtggcacctgtctctattcctagctactcatgaggctgagatgggagaactgcttgagcctgggaggggaaggctgcagtgatctatgattgtgccattgcactccagcctgggcaacagagcaagaccctgtctccaaaaacaagtaaaaagaccctcatcccagagtgtcctgccccatactctgaagaaaggaatgctgcacagagaggccagaagaatctgaacagacgggtcttgctgggtttccccactcaatctgttagtattattaataaatcataccctttctgtccagtcacatttctacatgattgtcaatcatgccaacccaataaagtttccataagaggtctaagagtacaggattcacagagcttccagacagctgaacacatggagggtgctgtgcccagggagggcatgaaagctctgtgccacttcccccataccttgacctatgaatctcttcatctgtatctttgtgatatcctttattatacgcatgttttcctgagtttcgtgagctgactgaacccagagaagaggttgagggaaccccaacttgaattggtaagaagttttagaagcccagactccagctagatagtgtcaggacacccagctgatgtctgctacagaaatgattgcttgtttttttggggagaaatccctcacatttggtcacagaaatcttctgtctgtgttgtgtttgttgagtgttgagtgggggaacaacaacaacaaaaaagactttgagtttttcctaatagaaactataatggaaaagccttttgggggttaatatattttgcatgtgggaggaacagaaacaatttgtgaccagagggcagattttaaagatgaccacaaattatttgacactcttctcatgaagaggtggtctgatcccctttcctttcaatctaggtcttaacggttttctagtaaccaacagtatgcagcggaaatgacactgtataacttctgaggttggctcagaagacttcttgcattttctgcctggatatcttaaaatgctcattttctggacattccctctcaaaacctagtttctatgccataaagactgaagccacatggaaaggccatatgtagttgctccagtcaaaagctgaaaagccccagttgcctccaattatcagctgttggtcatgtgagtgagtcacctgggtcatccagctctgctgggccttatgactatagctccagtcaacttctgactacagttgcctgagacccaagtgagaagcacccagctgcacccctccagaattcctaatctacaaaaacatgagcaaaataagatggctgttttaagccactaaattttggagttagactctgttatgtagcgtatgtacgtggaaaaatcagaattagggttatcagtatgagctcatggccttcagtaatttacacataagtatagaaaaatacatagacatacatcagctagggtggtcctagctagtgccctagttccatgggccctagagctgacttctgggcaagttcaacagtacattgtaggcagcttccttgcagttttgtcagcactccgtgggcagtttctgcttattagccttggctgtagcaccacaacaaacttcccagcatccagtggcaatgaagtccggatcccatccacaggggtgctgtggggtgggggtggaccgtctctcaaatgtattccttcctgaattctttaaagttctgttgaccccttagacgcctgttcaaattactgtgtggtttctgcctcctaatgattagatgctgacagacacagccagaaagtaagaaaatacttcaagaatgatgatgacaggtcaaaaagccacacaaaccagttttcaggggcttccactggccaaatctgaggccatttgagcaccaaaataagtaatgttattaatgggttataacccattgaatatgtttgaacctatgagcacatactgataaatgaataaataaaggaaaagcttttcctcacagtaaaacatcagtaaataaatccagaagggataatgaagttagaaaatcacctcttgataagcatcatggaaataatggagttaggcaaacatcactagtaaatgctgaaacaagtgtgtgaaagtttaatgaaccttttttttttaggtgctatagcaaaggaaatgactataacttcatccctaccaaccccaagaactcctaatttaacgggacaaggtcaatcttagtggtttcatctataaattgggggtaacactgactttgtccacctcataggtttgttgtaaagaacaattaaggtaatgtaagcaatgtgagcaccattaaaaaatgatggaaagctaattctgatttatatatgaaaatagtaaaacaatgaagcttcaaagaagccaagcaatttcagacttagaaccacagttgagatcaagaaggaaacaatctcaaattgctgtggaatggctttacccacagggagcagaaggcaatggcaaactgggttgcatctagcaaagggtaactaggacagtgaatggcctaaaacttgattatttaatacagataaaagcaacagaaaagagaaacccttgggggcaataagagctgtttttgaatatgtgaaaaacagcatacaaacaaaaaaagagtccagttccagaggtagtactctgatgcaatggtagaaattttaagaaggcaaaatttagcctcagtatatcaggataatttttgtaacactaagagtgtacaaaaatagacaacctaatttttgatgatgcaggctccttgtcagtgctggtgctcaaaggtggagagaccagatgctgggatgctgaggaaaggattcctgtgaagagaactttgggagacagagctcagtgacttccagggttctttatacttcaatgaacccttgaaattgtcttttttttttttttaagacagactctcactctgtcacccaggttggagtgcagtggcataatcttggctcactacaacctccacctcctgggttcaagtgattctcatgcctcagcttcctgagtagctgggattacaggtgtgggcctacaggtgtgggccaccacgcctggctaatttttatacttttagtagagacagggttttaccatgttggccaggctggtctcaaattcctggcttcaagtgatccacctgccttggcctcccaaagtgctgggattataggtgtgagccaccgaacccagccatttttttttttttttttgagacagaatctcgctctgtcagccaggctggagtgcagtggtatgatctcggctcactgccatctccgtctcctgggctcaagcaattctcctgcctcagcctcccgagtagctgggattataggcgtgtgccaccaagtctggctaaatttttgtatttttagtggagatggggtttcaccatgttggccaggctggtctcgaactcctgacctcaggtaatccacctgcctcggcctcccaaagtgctgggattacaggcatgaggcaccatgcctggcattttttttggggcggggggacagggtctcaatctgtcatcctagctcagtgcagccttgaactcctgggctcaagcgatcctcttgcctcagtctccggagtagctagaactacagcacaaaccaccacacccagttagtttttaaatttttttgcagaaacagagtctcattatgttgcccaggctggtctcaaactcctgatttcaagccatcctccccatcttgaccttccaaagagctgggattacaggcatgagccaccactgaaattttctttattttttagcaggtcctttttttgttttgcaaggcttgtgtcacaacagatgcattatttttactcacaaataagagtatgtacttttgtatctatagaaataaacagttatgcaatgtgaaatgtttttgttctgatgtctataatacaaggaaataacactacgcaagattattaaggttaaaaaatggtttgtttgcttacctttgctgatgaaacaatttgcttggcttggcgtcttgataaatgatcaattgtccttacgagcacttcaggatttgcattagctaagtgcattagacttttgtaacctgcactgtataactgttttgctcgaccctgaaaagtgttacaaaaatcagtaggataatagtttgggattagaaaaaagaaaattaagcactttactgaaaagaacaaaaactgcatgtaagagactgggataaaataaagtaaatatgaagagacaagacatgagaatactgaggaatttttaaaaatgcatttgggtggttccaaactgactacaaggtaactatagttctatgcagcttgagtcaactgatgtgtgctgcaatcaagaaaagaaacccacttaggttggtggcatcatctcatatcctcaagtaaaatgttctagtccagtatctttctttctttcttctttttcttttcttttcttttttttttttttgagaaagagtcttgctctgttgcccaggctggagtgcaatggtgcgatcttggcttatggcaacctgcaccactcacgttcacaaaattttcttgcctcagcctcccaagtagctgggattacaggcgcacgacaccatacttggctaatttttgtatttttagtaaagatggggtttcaccatgtgggccaggttggttttgaactcctgacctcaattgatccacccaccttggcctcccaaagtgctgtgattgcagcatgagccacatcatcaggccaagtccaatatctttcagtgttctcaccatctactcaggggaccactggtgtctctctctgtgtgtgtgcgtgtgtcctaagcagaactcctctgactcaagaactgaataacagagaataaactgaagttgagggttggctgaaaatagaaagctggaaaaccagttgcgaaccctttcttcttactctcttagaaaaaatacaaatgaccctttctgccactgaatcaccattatcttaaacaagcactgagtccaaactgacagaaggtaattcttcaaaggagtggaggaaggaagaagtgttaaggacaaccggtagcacaacatacttggagacagtcactcccacccttcctgttatgttttttttttcacaactgagatttttcatcaggtatgccatctagtaacagcggatttctggaaggccataacagctatttgttttaaataaaagattcccatgacaaatgagcaattaaggctcttgctatcacttcctctgtattaagacttcagaaaataataaaacctggcttctgtattaattcaacataatttcaattgggaaaccaacaagctactgacctctaaaactccagtaacttccatgagagggattaattctgcctttacacagtaagtcagcttcttggtaagttctaccaaaagggctctgtaaacccaaaactcctcaagctcctgtagaacacaaagaaatatataaaatttaaattttgtaagttatttcaaagtttggtttgtgtgatagggggctcagagagaatgttccttacataagttctggaacttgagttaagccagagatgaaagatgattctaagcaaaacagatgtgaagaaacatggggaggaccctgaggaatttgaggaactggttttaggatgaggaaaagattgaaaattgaaaaataagtcaataaaaagagttctggtcattttaatcaaaatacctggaagaaaatgcatagtttttctttcccaagtgactaaaaacaattcctacatctggaatttatctggaagatgaatattaaatatggaaatattcaaatgtaacatgatgttcaatgcaacaatacaataataaaaatactggaagccatgagtcaataactgttaaagctagaagggtaaatgggaattcaatataatattttgtcatagatatttgcaatattctattatagtagtttattttattttaaagttccctttctagcctttggatatcactgtgaatgtacatgatgaatggaacagcattagctagccatcttgtgactactaagaaagaaatcaacgtaatgaagatggcagagtaaaaagaagaaaaccttgaacagaactattgaatcaatcaatcctgaagctgccttagttctggcatgcctgttatataaaataattattttttcttattgtttaaaccttgatgggtttttctgtaacttgtagttaaaagcatcttaactaacacaattaatgtaccatttcataccatttataactttttaaaataaaaaataccttaaaacaagcttgtccaacctgtggcccacaggccacatgcggcccaggatggctttgaatgtcacccaaaacaaattggtaaactttcttacaacaccatgagatttttttttttttttttttctagctcataagctattgttagtgtattttatgtgtggctcaagacgattcttcttccaatgtggcccagggaagccaaaagattgaacacccctgccttgaaatattgaaagtagaccaggtgtggtggctcatgcctgtaatcccagcactctgggaggccaaggtgggaggactgcttgagtccaggagtttgaggccagcctgggcaacacagcaagatccctgcctctattgataataatttgaaaaattatatacatgtaatatatatcatataattatatatttatattatatgtaattatataattatgatatatataaatgaagtaaattaattagagtacaaattgtcagctagatttttcttaggattagtcatcaaattattgctgtttttcttgatgcttcatagagttttttacttaaacaattctataaggctcaagtcctcatagtcgcaatgaaaacaaagggaaaaaatattagggaaagcatctttaaatatacaaaacaacaaatatagaagacttaagaaaatacattttaaaggctagcttcttcttattacccataatttttgtcttctgtttaactagcatgtgctcagggggtataaaccaacatttaaaaatcagcacaagtaaaagatatttagaaagctaaatttgttaaaataattatcattcaattgaaagccaagtatttttgaattatttactcctttcattagcacatatgatagaattaattgccatatacatatacagaatatgaaggtttaagaaagggaaaatgaagtaaattttaaatttagaaaacaattcatgggaaaaaagttttagaaaattgacttggaaacaaatatggaaaggattattatgccacccaataagaagaaatctaaatgcagcaaaaatggcttatattataaacacataaaaaaagtatctggatgtaaaagcctggtaagctttattgtgctatttaaaggaattctgaaagcttattttaataaagtcttaaatccatcacaaatgcatatgaccagtataaggtttccttcttaaattgttctataaaatacacatttgatgtaaaagctttaaatagctgcctgacactggaagcaaatatactaaattacagtggcaatcaagagaatatgggccaggcgtggcggctcatgcctgtaatcccagcactttggaagggcaacctggaggatcgcttcagcctgaagttcaagaccaggctgggcatcatagtgagaccccccacccccgcccaccctttgcacaaaaaaaatttaaaaaattggttgggcgctgtggctcatgcctgtaatcccaacactttgcgaagcccaggcaggtggatcacttgaggtccggagttcgagatcagcctggccaatatggtgaaaccctatctctactaaaaatacataagttaactgggagtggtgttgtgtgactataatcccagctactctagaggttgaggcaggagaattgcatgaactcgggaggcgggggttgcagttagctaagattgcgccactgtactccagcctgagactccatctcaaaaaaacaaaaaaaattagccaggtgtggtggcacatgtctgtgatcccagctactcaggaggctgaggcagaaggactgcctgagctctggaggtcaaagctgcagtgagcctggattacaccactacactccagcctgggcgtcagagtgagacccaagtagctgggaccacaggcgtgtgccaccacgcctggctaatttttcttattttttgtagagatggagttttcccacattgctcaagcagctgatctcgaactcctgggctcaagtgatccacctgcctcagcctcccaaagtgctaggattacaggcgggagccatggcatccagtcaaaattaaatttttttaaaaagagaatatggtactaaatagtcacatggtagctgttggatataggtaactttctaaccaaacacctgacatttttattactcaggtgaaagacattcacatggaatctacatcaataggttgtttttaacagttaattctgaatacctgaaactattaatggtggctttaagagttgggtcaaaaagacacttttcattatgtgttttagttgactcaggaatttttgtattgttaccataagtacataatagtagtttcataaacagataaaaacaaacgtacattttaaatagttttttagtgctctgtaataacagaatatgtcaacaaggagaaaatgctgacatactgactaactggcttattagtttagtaacagttaaaaccagaagatgcacaaagtacatatcatatattcaatgaaattacctcacagaaatgtaacacacaagatgagaatgaggcagttccagtgagaagattttgtatatatcctcgaggcatattaaatttttcagatacagtccaaatgttggtctctttgagcaaggtataaagaacaaaagacagatatagcctgttgacaacgttcttgtccaccttctagaaagacacaatcaaataaattcgtttactagacctgctaaaaatgtatgttattaaaattggacaaaaggaaaactgaagttgtattacagaatagcaaggatagaataattccatagaaacaaaactaatttctaacagatgtacttcagattaattaaaatttattatcatttttccaactacaataaaaagataaggccaggcagagtggctcatgcctgtaatcccagcactttgggaggctgtggcagatggatcacaagagcccaggagtttgagatcagcctggacaacgtggcaaaactccgtctccacaaaaaaacaaacaaaaaacgtggccgggtgtggtggcgcgcacctgtagtcctggctacttgggaggctgagggatcacttgagcccaggagacagaggttgcagggagccgagatagcaccactgcactcagcctgggagacagagtgagaccctgtctcaaaaaaataaaaataaaaataaataaaagttaaaagataaaccaaattatttccaatctaaattaaacttccttctacagggaaggaattgtaccccctctccatcactccacaaaaagaaatgtacaaatcctaacccctggtacctgtgaatgtgatcttacttggaaacaagatatttgcagatacaatcagttaaggatctctaggtgaaatcaccctggatttacagtaggctctaaattcaatgattagtgtccttataagaggagaagacacagagagacacagagaaggcagcaatgtgaagatggaggctgagattggagggatgcatctataagccaaggaacaccaaggactgccagtaaccatcagaagctaggaaagaggcacggatggctttttcctcagaggctcctgaaggaatcaacattgctaataccttgattttggacttttggtctcctgaactgtgggagaataaatttctgttgttttaagccacccatttgtggtaatttgttatggcggttgtagaaaatgaatacaggaaaggaaggaattggtgagagagacttttacagttagttggtatttgtaaattgtgtacgtatgtgattattattataaattagacaaatgtactttagataaatatgttaataagcttgtctatattataaactaagagtaaatattagatcctatgatttccacatggtccaagctaaaacacctgaaagagattgaaaaatgcttcctgtagttgatgatttcgattctgtatacctgctttggcctgtggtgcctgatgaccacatttgtgcataaaggatttcatagctagcttagaaactaatcaattcttaaaattgagggcaaaaagatgaacttaaaaaagaaaaagtaggtataaaaaataaaatagaggttgggagtggtagctcacacctgtaatcccagcactttggaaggctgaggcaggaggatctcttaagttcaggagttcaagaccagcttgggcaacatggtgaaaacctgtctctattttaaaaaaaactgtaaaataataaaaaataaaataaaatataaaattatatcctccaccatagtaaaagaatgaaatgagaacttacggtgacaaattgaaggatgtatgagttacatattctgcatgttgatactggatcacttttttaaaagcattaagctgaaaaagtatgacagctgaacatcaagtaggaaaagagagctatttaatttcccaattttagtgcatcttcagtactaactataaattgagtcaatgtaggttttttcttagaatgtatttcctaagccaagaaaaatgatataattattatatggcaaaatacaatgctttatgccaatgtcaagatcttttgtggcagggcacggtggctcacgcttgtaatcccagcacttttggaggttgaggtaggcgtatcacctgaggtcaggagtttaagatcagcctggccaacatggtgaaactccatctctactaaaaatacaaaaattagctgtatatgatggcgggcacctgcaatcccagctacttgggaggctaaggcaggaaaatcacttgaacttgggaggcggaggttgcagtgagctgagatcgtgccattgcactgcagcctggagcctgggcgacaagagcgagactctgtatcaaaaaaaaaaaaaatcttttgcaagaaatcaagaatgttcaaaaaaggtcaggtggggggcctctttttcaatgtggagaaatcaattagattttaagtatttaaatatgttctccagagttttaaaaaattatacctccaaaacattaaactagtaattaatccatttgtaattaagataagttcatgtccatactattttaaatatgtatcaatttggcaaatatttgttgactatattacattaaatgtaacaaaaataaattctggattcaagcttaaaaagatatattattctaataagatttttgcatgtttattattatttgataattagttccaaattaatgatattgtttttattttacatttcagagtttgatataaaaggtttgttttaagaaatatttttattcagcattttgaaggtctaaacagcatagccatttccaaagtaaaagacccaatctaaaaattgtgataacatgaatgcttaagtactacagatacttttatttttatttttgagacagggtctcactatgttgcccatgctatcctgaaactcctgagtacaagcaaatcctttgcctcagcttcctgagaagctaggagtacaggtgtgtgccactgtgctgggctcatggaatttttttttgagacagagtcttgctctgtcacccaagctggagtgcagtggtgtgatctcagcttactgcaacctctgcctcccagatcacgtgagtctcctgcctcagcctcctgagtagctgggattacaggtgcccaccaccacacatagctaatttttgtatttttagtggagatagggtttcaccatgttggtcaggctggtcttgaactcctgacctcatggtcgcccacctcggcctcccaaagtgctgggattacaggcatgagccactgtgccgggcccaatatttttgattttatgacacagtgatgcatgggacactgcaccatcaatttaagtgtatgtaaacatcatcttccattttacaaaatgaaatctgtactgtctatgtaaatttaaaaggtatagaggaggttgggtgtggtggctcccaacctgagagccacctgtaatcccaatgctttgggagaacgaggcgggtggatcacctgaggtcaggagtttgagaccagcctggccaacatggtgaaaccctgtctctcctaaaaatacaaaaattagctaggcgtggtggcaggcgcctgtaatcccagtgactcaggaggctgaggcaggagaattgcttgaacctggaaggtggaggtgtcagtgacccaagatcatgccactgcattccagcctgggcgacagagtgagactgcacctcaaaaaaaaaaaaaaaaaaggtgtgggggaaaatggaaggtaactaggtttcaatgtaaattggattgccaaataaaatttaaaatgaaaaaaaaaagtgtattacaagggggaaaataacattctcttaaggaaatcgaaggtatggttatgaaagaattacttcaatttctcttaaagttagtgtatgcatttgataacttgcttcatgcctgcagactgaattttaaaacaccaaaatatatcacaccaacgagtattagcttatcccctttaaccttctaaaatgctttatgtaatataagtactagactaggagttctttgaggatgacaaaagcagtaacaaaaaacccagacctgtcctatcttagaatccttgataccaaatagaaagcctaatatagtttctagaaaatgtatttcctcgtttgaattgaacttatatcaggattgtgtaatattatgaaaacatttcatgctacccaaaaaaaggtcatcacactacccagaaataaatgttgtttaaaaatattcatacattttgggtgctcaggtatgttttaagtagtaaaatgaacgttatactaatttaaaggaaaaaatgtaaaccaaaaaagatcaatataatggtactaattttgttgagtgaacttagtgagtgaactaagtgttgagtgaacttattatttaggaagaaaaaaagaatgtggtacctttccgatggcttggcctgatgctttcttcccaataaagctttcagagactccaagaatggcagctacattttgttctgctggactgagttggctaaactacatggaaaaagagcaaatagatggaaacatcaaaaaatctgtcatgtgaaccaaatccagtatttcttttgatatcacattctcatgattcaggatacaaaaaacaagataaatatatttgtaaatgttgcaggttttaaagttacatcattaggatataacaaggatataacacactttagaattacttaaaggcatagccacaagtactggtttccatggactatatgactatatttaataccagatggctgaggggaaggagaaggaaaggtttgagagtaattgcattatatagtgctacttaaaaaaaacttacttcctgagtaatgtaaactcaggaagttgagaagagatggagaaaagaaaaaaaaacagtaatgatttaaaaatatgacattaaaaagaaagctaatttcctgtgattaaaagatgtatactacctctgtctaatatacgtttttgtttctgtttttgtttttttttttgagacagtctcattctgtcacccaggctggagtgcagtggcatgatctcagcttactgcaacctccgcctcctgggttcaagcgattctactgcctcagcctcctgagtagctgggactactggtgtgcgccaccatgaccaactaatttctgtattcttttagaagagacggggtttcaccgtgttgcccaggctggtctcaaactccagacctcaagtgatcctcccaccttggcctcccaaagtgctgggattacaggcatgagccaccacatgcagccctaatatacatttatacagctagcctgttcacagtaaaatcataatatactgtatgttaccacttggctttataataagtatggacagttctactttgtgatgggttgtaaaataaatattccttttcagttattaacgtcattgggtttaatgtattatcatacttggctctgaccgagctttcatgtaattaaactctaaatcatcagagatggttttcactgttttctttgcattctaggcattatcaaatgcagtgatcataacagtaactttctgtggggaaataggaccacggataatctttttttcttttttttaacctttacttttttcaataacaaatatgtttatatttaagagaaaagtaacattaaagttaaacgaaccataaatgctgttgccagattataatttttaaaaactgaaagaaaaaaatatccaattccaaatatattttaatagagaaaaaaagtgaataatcacttcataaaaagcatataataggccgggtacagtggcttacacttgtaatcctagcactttgggaggacaatgtgggaagactgcttgagcctaggagtttgagaccagcctgggcaacatggcaaagcctcatctctaaaaaacaaaacaaaacagcatgtaataattcataaacgaagtagcctaagttgaaaaacgttatattctcacctgcctgaagtatatcatccaatcagggttacactgtgaaaccagatcatagggggttgttaggtagattagatgaagaaggctttcaagcacaagtccttcaagacctttcttcaagtctctgtacagaatgtcacaataagctaaatctatagttcctaaaagaaagatacaaatattcaatctttcacaattaccagaggggcaaagagatggctttaaatattgtgtagaaattgcttaaatatagcaaaaagtcttcaaaatctcttataacatcttactatataactattttggaggtcattttgatagtactcatcaacactttataagtacataccttctgaaccaactattttggggaatctaatccagagaaacatttccatatgtaccccaaaatacatagagatgtccatgcgccttgtttataacagagaaaaataaaaaagaatgcaagtgtccatcaacatcgaatggttaaataaattatggtacatccatactatagatgactgtagtattaaaagaaaaatgagatagatttaaagagactcatctgttaagatgttcatgatatcttatgagaaatgtaatttggaaaaaaatatttaaatgatcattccatttgaaaaataaatacacacataaaaatatttggaagaatacatatcaaactggtagtagtagctcctgaaatgggacaggaatatggcactttccttaacataattctgagttcttaggttttttttttttaacaacagacatgtattatttttcattaaaaaaaagcctcagcctgggcaccatcgtgaaaccccatctccactaaaaatacaaaaattagtcaggcatggtgacatgcccctgtagtcccagctacttgcggggctgaggtgggagaatcatttgagcccaggagacgaaggttgcagcgagctgagattgcgccactgcattttggcctcggcagcagagcaagaccctgtcaaaaacaagcaaacaaacaaaccaaccaaaacaacccccacaacactttattcactgtcatgaaacaatctctaagacattatattcaggaaaaaaagcaagttgcaggccaaatgtgttgtctcatgcctgtaatctcagcactttgggaggcaggaggattactttaggtgagaagtttgagaccaccctggcaaacatagcgagattttgcctccatatttaaaaaaagaaaaaaaatttttttaatttataaaaagtttcagaataatataaatgattatttgtttaaagacaaaaacttaaaactgtacatatgtacatattatgcactgaaatgaaatgtacagtaaaggtctggaaagatatacaccaaattgttattcttggtagaatattaagatttgtatggttgctaggagggaagcatgaaggagggatgcctaccttattctctatatacttctgcagtacttataattcaaaacatttttcaacttttgaaagttgaaggagttatcagcttataaaataagattaatgtaattaatataaaattataaatacaacttaaagaaagtataattttttatttttttatttttgagatggagtctcggctctgttgcccagcctggagtgcagtggtgtgatctcgactcactgcaacctctgcctcccaggttcaaacaattcctgtgcctcagcctcccgagtagctgggactacaggcatgtatcaccatgcctggctaattttttttgtattttagtagagacagggttttactatattggccaggctggtctcaaactcccaacctcaagtgatccgctccccttggcctcccagagtgttgggattacaggcgtgagccactgtgcccagcttaaagaaagtataatttaattttcattttttccaatgtgtttcctatgatcaataagatttaggtaaactcttacccttaaatgaagcacgtcccaactttgtaatatgaaaattatattggacctcttcttcagacttataaatagtgtctttttgtaggagtcctttttctgtcaggtatctaagtgattcaacagttatttcccagagacttttttctttcaataaaaccttttgctgaacaccaaaaaatgtaccattcatgaaatgatagatgtcatcaagattcgttgcaatctgaaacaattcaggatatcattggagcattttccttaattcaaggcatcaccttgaatgcatattaatcaagataactcatttccatacctcaaagctatttaaataaaaaattagtattaaatctacacagttgcatatataaatttataatggcaattaaaaattaacaaaaaatttagggggatgatagttattatattcatgctttttatgaaaacatgtactcatttttcattccaaaactcctttggatagatctttaaataatttttcacaatatctccagaactgtgctatttactccccaaccaattttcactaattctcactcagcctcctttagggatcttccctgcactgcattccacccaactgtaaaaacatcctttagctctaaaagttgcattaaaaaaaaaaaaaggaaaatacaacagtttctgggtgcagcacaccaacatggcacatgtatacatatgtaacaaacctgcacattgtgcacatgtaccctagaacttaaagtataataaaaaaaaaacaaaaaacaaaataaattaaaaaaagaactgaaaaaaaaaatacaagtttccactaaaacagcgtcagacaatattttgcctaaaatgttacctaaaaatagttgatctctacctatttttgtctctctcattcctatctccatttcttgttctttcactgttattcactatttataacttacaatggcaatcataaggaatacttaaccctccatttagtattcagatgtagagctgactctgaattagaataatttttattagccaatttcaatgaaatcagcatgttatactaaaatatagtcaatcaataagtatatttctctctcttacaattctgatgctatttcaactggaaaatttaagtcgtaatttcatattaaaccaatataaggggtaagaaaaatataatggagcacagacattttctattgcttcttcccactttaataaaaatcattattaatatagtattcaattaagctaaaattatacttttaagatatttaagaactgatacttggtttttggattattaatgtactttgtttttgtactgtttcctacctaaatgattagagttaacactgggggtggaagagtgcaggggggcaggggaacctttacttgatccctctatctaccatcatgttatctttctattcctccctgaaaaagtttttgacatagtaattgaaacccactgggccagcctctgcttctggcttctcaaatccagattctccactgatgccccaacttggaagttcacccacgctcagttccaaagttaatttcatcaccatgtcccagattaaagaaaaaacaaacaaacaaacaaacaaaacaggccaggcgcagtggctcatgcctataatcctagcactttgggaggctaaggtgggaggactgttgaggacaagagttcaagaccaatctaaccaacatagcaagaccccatctctaagaaaaaaaaaagccaatttcattaattcaagtatttattaagtgccaaccacttgccaagcattaggattcagtgatctttttttttttgagatggggtcttgctatgttgcccaggctggtcttgaactcctgggctcaaacgatcctcctgtctcagcctccctaagaggtgggatcacaggtgtgagctactgcacctaaccattccatgatcttttaaaaattatttacattaatcactgaaggggatgagaaaacaaaattaaaaagaaaaaaattaaaagaaaaaattattaaataaaaaattagtataaaatctacacagttgcatatataaagttattgcataactttttaacctctattgtctcagataacagtaataagataaaaaatttaagaaaaataccttcaaaccaatcaaagagagaaataatgtttggattcccttggtgaattcctgaacaagatggctgtaacagttttccaatggtttagttattaactccaatacctataaaggttaaagcaaaaccatgccttgtgttattattaaaaataaatggtatttaatataaatattttatactttacataaatcttgtggagccagaaggagaccaaaaaagtaaagacaaaagaatttaacatttatcttcattaaaaatggaagaaaaacaaataggaaaaatattttttcattgtctgaaatacatacattttcaaaccactctaattcttaatcatataggaaagaaagcatcatttaaagaaaattaataattaatttttaaaagatgatttcataaaagggctagaccaacaaccaagaaaaagacaaaaacaaccaaccaaccaaattgagtattacctgttgtttgtctttttcttgcaatatgaggatactctccccaatagtatctattccagcacgaccagctctgccaatcatctgtttatattgattcctctttaaaaattccttagcaacatagggagctcttaaaataactctgtggaattaatgaaaaatgatactctacagcaaacagcaccaatttaaaaaattcttaatttcattatatatttgtgatattaaatttaatgacatactaacacaaaataataggtaactagtgtttaccaagaatctatgatttcttaggtttttacacatattatctataattcttacaaaactcttagttataatatacttttttatttcatttttataaaggaattaattacaactcagttaactgacttatcctaaactaaaaaattagtaattaccagagctatcatttgaactcaagtctgcccagctgcaatgcctatgatcaatctgtagcagtagtctccaaagcgtttggactttatactccataaataaaaaatatgaccatacaccactaacatatacatatctatttatgaatttttattattttgaactgtataaaattgcagatgtcaactgtttttgacctacaaaaatggtgatttcagccaggctcagtggctcatgcctgtaatcccagcactttggagggctgatgtgggaggtttgcttgagtccaggagtttgagaccagcttgggcaatatagtgagatgcagtctctacaaaaacaacaacaacaacaacaaaaaactggctgggcatggtagtgtgcccctgtagtcccagatacttgggaggctaaggtgggaggatcacttgagcctaggaggttgaggctgcagtaaatcgtgattacatcactgcactccagcctgggcaacagagtgaaaccccatctcttaaaaaaaaaaagcaatttcaattatgttcatatatacagaagtctatagtcagttagtcagctttcttatccaaagggaagaaaaaacctattgtttacctatactagtcaacttcctctttatttataaatctcatatgcagaaaagattaccaaatacttgaagaaaactaataacataaaagaaacataacatgaatatacagaataagtgaccacaaaaccagataatatagggatcagaagagaacttttaaaaatcctaattagcattaacagaaaattccaaagagtattatatccacaatataagagtagactattggcggggcgtggtggctcacgcctgtaatcccagcactttgagaggctgaggggggcggatcacgaggtcaggagatggagaccatcctggctaacacagtgaaaccccgtctctactaaaaataaaaaaattagctggtcgtggtggcaggcgcctgtagtcccagctactcaggaggctgaggcaggagactggtgtgaacccaggaggcggagcttgcagtgagcggagattgcgccactgcactccagcctgggtgacagagcgagactccgtctcaaaaaaaaaaaaaaaaaaaaaaggagtagactattggccgtgtgtggtagctcatgcctgtaaatcccagcactttggaaggcgaaggcaggaggatcacgaggtcaatagattaagaccaccctggccaacatggtgaaaccccgtctctactaaaaacacaaaaactaaaaaacattgtgttgtgtgcctgtaatcccagctacttgggaggctgaggcaggagaatcacttgaacccgggaggcagaggttgcagtgagcagatatcatgccactgcactccaacctggagacaaagcgagactctgtctcaaaaaaaaaaaaaaaaggagtagactattataaggaaagaacaacaaaagagagttcttagaaataaaaaaaaattaactttatttaaaaattcataaaaaatttgaagggccaggtgtggtggctcacacctgtcaatctagcacttcgggaggccacggtgggcagatcacctgaggtcaggagtttgagaccagcctggccaacatggcgaaaccccgactctactaaaaatataaaaattagccaggtgtggtggtgggcgcctgtaatcccagctacttgggaggctgaggcaggagaatcgcttgaacccaggagacagaggttgcagtgagccgagaccgcaccactgcactccagcctggccactgggcaacagagtaagactctgtctcacaaaaaagaaaattcaattgaagaactgaataatgaatgaaaatagttaatggatacagttaatgtagttaatggatatcagttaaaaactcatttttttttttgagacagggtctcactgttgcccaggctggagtgcagtggtacaatcatagctaactgcagcctcgatgtcctgggctcaagcaatcttcccacctcagcctctcgagcagctgggatcacaagtgtatgccaccatgcccagctaagtttttaattttttagtagagatgaggtcttgctatgttgtccagactggtctcaaactcctgggctcaagcaatcctcctacctttgcctcccaaagtgctgggattacaaaaaaactgattttttgatatggaaggtaaagttgaaaaaaattacatggcacaaacgtgtgcttacattcttccacattctgaaaaatgtgtaagaaaagagatacgaaagctgaatctaagaggcctcaaccctgcctaagtgaaattataaaagcaaggaacagagataatgggaagaaaaagaaataacagaaaaaaaattactcaaagaagaaaggcataaagcttagattaaaagcatccacccaagtgctaagccctatgaatgaaaagtagtactgttgggattgtaaaatcaaacttcctgggttcaaacactggctttaaaactcatttgttggaaaatgagttgggaaaaagttatgtaactttttaaagttgggaaaattatttaattatttagtgcctcagtttccccttctataataggtgtgtaataaaatatgaccttcctcacagagttattgtgaagctgtatcaagtcaatgcatgtaaagttgttactacatgaaagggaggggaatgtagtaattacaactattattatacaccatgacaaaattgggaggttaaagagaaaagtctaaaagtttctggaaaagaaaaacagaaaatccatgcagagacaaaaatgagcaacattggcctctagaaaatatggaacaatatttacaaaatccctaaaggaaaaaaattgaatctagaattcttttgctagtgaagtgtaaaagtgtgaggccaaaatacagatatcttcaactatgcaaagagtcaaaatgttttaccccctaaagcggtattctaaaaaggattactcaaggaaggcaaaattaaaaaaaaaaaaatcagagaagaaagatgtgggatataagaggcagtggtaagcaaaaaagaagtatgatttacaggtaagtttaaatactacataagatgaaagaaaatgtttaaatctggcactaaaattctaagtaattgcaacattcatggggcagagtagaatatactaaggacatgctaagcctctttttatgttcaggagaggacagttattgattaattctaaagtaataaaaaatgtttggttacaacttaaaattttaagagtaaccactggaataatagaaacaggatatataactttcatttttttcttcaattgtctgaaaaatggaaaacttaatgagagacagaaattgaaaataaaagaatggaaaaaggtacatacgtggcaaaaaaaaaaaatgagtcctggtattcaaagcaaaattattaaatgagaaaaacaagtatttattgtattgataaaaggtataattcggcaataagatatttgaagtaaacctttgtatatctaaatagttttgaaatataaaaagtaataacttctagagatgcaaaaaggagaaactgataactacataattaaagtgggagactaacacacttctctgaaattgatagaccaaggaatcaaatatagtaagaaaatagagaagccgataacacaatgaacctctgtgatctcgctgagatgtacaaaactgcatattcaactgaaaatacatatttttttaaacactcatggaaagtttataaaaattgatcatttattagcaaaataccccatgatcataaattataaaggggagaagtcaattacacaggcctacacctttggtaataactggaaaggtaatcaagggcctgctttaaaatacatatattagacacaaattgcctatggatcagctctccaagatttcaaggaaatctctatgttaaataaactctttcatatcataaaaaaggtaaaacacttgccaactatttctacaaaaccagattaatagaccctaacatcaaaaccagatataaagagcagaaaggatggaattctaatatcaagaaatctattaacgttatttttcattacatatttcattacatattcattaaaatattaaagaaaataaaccaaccaatcaactcagcatatgctaaaagaacatttgataaattctcatccactactgagaaagcataaaacaacaaaactcctcgcaagctagaaatggaaaagttctgagcctggtcaacacttacttatctcttaccttcgagctggtaggttgacacctgccgctagggtagatgtgcaggtaaaaagacagagcactcctgtggagtaggcctcctccaagagtttcctttcatcacttgttaagccactgtggtgataggcaactccaaatgggatagtgcgctttaaaacaggacacaggttgccattgccaatattcttcaagttcttaatcacctcacatttttctttctccttatgtttcagatattccctatgaaaaagatctgttagaaatatgagcccttgatcttttagtgacaaaatttctaccattttcattttagtagatgctaatgtaaacattctttaatgtactatttccattgagttaagtacattaaatgttcttagaattttgattctgacttcattaactattaggcagtctctcaatctttttgtggattacagaaccctgtgaaaatcttatcaaaactaaggaaaggcgaaatgcgatggctcatgcctgtaatctcagcactttgggaggtagaggcagaaggattgcttgagcccaagagttcaagatcagcttgggcagtgaagcaagaccacctctacaaaaaataacaaaaattagccgggcatggtggtgcatgcacctgcagttccaggctatgggggaggatgaggtgggatgattgcttgaacccgggagtttgaggttgcaatgagctatgaacctaccagcctgggtgaaagagcaaagccttgtctaaaaaaaaaaaaaaaaaaaaggaaaaatataactatttacataaatacaacactttacatataatttcagagggttcgtggatttcctaaaattcattcctgtacttcctttgaatccatggacaccaggtttagacctttgctctggatgttataactgtttttttctttataacatatatctttataggggatagtttttttaaagacataaattttcttttctgaagatggaaacatacatattattaaatcatacttccatggtaaaacactgcctaaacacttgcactttagaaacttcacatcctacaatgtttccatcacttagccagtgtctccatcttattaccttgaattactctaagaaaatgaatgatttactgagaatttttttaatgataatttaatttccttaagcttttataatcaaaatcattgtaaaagcagactgttaccaaaatgagcaactccttcatcttattccaaacatttttatattttgctattcaataaatttaagtctatcttagaccaatccatgatagtaggattgaaagaggaggtagaggttgactagattagcattcaggttaatagactatgaatagtgatacagcattagctaaggggctgaaagaaatctcagaaaatgataaaaccacacatgggacaaacaggtgtataaaaaactgaactgttagtagttaaagtaacttcatacttatctctatgaatacgacagagccaatattaagatactacaaaattataagacaacacatttcttactcaggaaattatatccaaatgtccatacaactaagtgtgaagtttactaagaaaacaaaggcaggccaggcgcagtggctcacgcctgtaattccagcactttgggaggctatggggggcggattgcttgagctcaggagttcgaaaccagcctgggcaacatggtgaaatactatctccatgaaaattacaaaaaattagttgggagtggtggtgtgtgcctgtagtcccagctacttgggaggctgaggtaggaggatcacttgagcccaggagacagaggctgcagtgagctagctgaatttgtgctactgcattccagcataggtgacagagtgagaccctgtctcaggaaaaaaaaaaaaaaaaaaggaaaagagaaaaaaaggcaatggaagatacaattcatttccacagtggtaacagtgattagtcctttgactgactaagccagttgttcctgtccttggctatatgttggacttgcctggggagctttacaaaatgatatctgggtgtcactcccagagattctgatttgtctaagatgtagcctggactttggaatttttaaaagcctccaagatgattcactatgcacccaaggttttgaatcactgacctaatattacttaacattctcatacatatagtcttagggttttgtcttttttttttccttttctttttgagactgagtctccctctgtcacccaggctggagtgcaatggtgtggtctcagctcactgcaacctctgcctcccaggttcaagtgattctcccgccttagcctcccgagtagctaggactacaggtgcacgccaccacacccagctaatttggtattttcagtagagacaggatttcactatgttggccaggctggtcttgaactcctgacctcatgatccgcacaccttggcttcccaaagtgctgggattacaggcatgagccaccgtgcctggtcttcttttttttttttgatggagtctcgctgtgtcacgcaggctggagtgcagtagtgcgatctcagctaactgcaacctccgcctcccgggtccaacagattctcatgtctcagcctccccagtagctgggattataggtgcaaggcaccacacccagctaattttttgtatttttagtagagatggggtttcaccgtgttggccaggctcgtctcaaactcctgacctcaagtgatccacccacctcggcctcccaaagtgctgggattacaggcatgagccatggtgcccagccaccttagaatgtttctctggctatttcacatgtgatttttcacagttaaaatttctttcttcaaggtcaaggccttcagtatactaaaacaacttaatatgatgttttgcaaggcataattagtgtttgcccaataaaattaatacatagtctgtaattcctaataaaaataaaacaggctatttaaaaaatattaacatacttgcttaaaaatttgcatatcatttctgctacattttcacagttcttcttactaggacaaaaaactaagcaggaataattgggaataacttctgtcaccaatgctaccaagtgatcaggatccatcttttttagggtatcagaatactgcaaaacaacaagatgtaggaacaaagtggttagtaaacatgaaaccctgtcaattttttaccagtgtgatttgaaaggtaaataaaccatctataattctaaacttctaatttaataaatctgatcatttaaaagaaaagatgaaatctatattaaacatcaaaatgttcaatctcacttttcttttaggttattatgattttcttaggtctagttagtctaaaaaaaaacctagaattaaacaagtgaattaaagaaaattaaagaagtgaaaatagttaatgttattaatagcctcactacatgcccatctccaccacagcagaacaaaaaagtccacagagagaaacacagattgatcctaataatagttaacggactgtgtaaataagacatgccctttacaaccattaagttttcaaaaacacagattcaatcatactactgaattatgacaatttttgtagtcacatgaggaacacaaagaacatgaagaaaaaatgtgaagttatttaaaatctatttcttcaactttactaaagacatagctgtagaataacacatcttcacagaattctaaaactactgtataatcccttcttcccctttttaatatccttcatacaagtcataaaacactaaaatttacatagtagacattaacattttatacaccaatatctgaactacatggtccataaattattcttttgttgttgttgttgtatgaataaacatttacaggagagttttccaaattttctttgttcacagccccagggcccaaagaaatactttacagttttgttaattaaatagtgaggtccaaacaacttaataaatacgtacttcctcacaatttagtagctgttagaataaataatacacatcagttgagtgaaaaaatatttttatttcattcttaaataaccacaacagctcactaatgggatgtgtgcacaacttggtactgtctttcaaaatctgaaataagactggacacagctattctcttctgttccagattgattttcacacggtacttgcttacagcaactgtaaaaaccccaacttcacaaagatatgatgtcatagaaaagaatatggtgtgatctaatgttgaaactggaaacgagctatcttgaactggcagtctgcatggtgtccaacaaatgtcaagcatcagctgtttctctgaaaaatctagactattctacggaatccattggaaactcttgttgtgccccagacacaaagtctggtaacctggaatttaaatgttatcaatgttaccttataattaagaagacgtgaaaaagtcatgccattctcagctttgctgtcaacttcatatattgtatcatttattttcagatattcttttaactcaaccttgaattaaaaggacatttgcaattaatacgacatataaattcatctttccagtgttttaaatattgtaaaataggttaagaaaggacagctataaaagagtttagcttttctaagatacataaaacatgcttcaacttaaaagttcttgctttaccatttcttcttcttctgttttggtctctttttcccttaaaatcaaaatagagatcaatatccttgaagaaatatgtttgaattcagtaaacatcatatccaaaaaagaaaccacacacttctgtatttgtcacaaaaagtgtgagtcttggtgttcttaacttttactaaggtatcatctgttttatgtctcaagatctaaaactttgtcttttttttttttttttttttgagacagggtctcactctatcacccaggcttggagtgcagtagcatgatcacagcccactgcagcctcaacctccagggctcatgctatcctcctacctcagcctcctgagtagctgggatgacaggcatgcgctaccacgccaggctaatttttatagagatggggttcctctatgttgctgaggctggtcttgaactcctgggctcaagcgatcctcttgccacagcctctcaaagtgctaggattacatgcatgagccaccgtgtccagccaaaactttctgtcttattattcatcagttttaattctaaataccaccacactatttttctttatttgtcgacaaaaacagtttgtaaacacagctcattgcattttataataacaataacaatgtctactgtggcaattaagttaaaaaatatctcttgaaaatgttcctatctggttcaaatgtaaaaacatcaatttttttttttttttttttttttttgagacagggtctcactctgtagtccaggctggggtgtagcggcacaaacacagcttactgtatcctcaaccttctgggcttaagtgatcctcccatctcaccctctcaagtagctgggactatatgtgagtgctaatatgctctaattttttttttctctctcttgcaaggctggagtgcagtggcgcaatctcggcttgctgcaaccttcgccccactgggttcaagcgattctcctgcctcagcctccagagtagctgggactacaggcgtgcgtcaccatgccctgctaatttttgtattttttagtagagtcggggtttcaccatgttggccaggatggtctcgatctcttgacctcgtgatctgcccacctcggcctcccaaagtgctgggattacaggtgtgagccaccgcgcctggctgccctaattttttaattttttgtagagacaggggtctcgccatgttgcccaggctggtcttgaactcctggactcaagcaattctcatgccccggcctcttaaagtgttggcattgcaggtgtgagccactgcacccagctaaaacatcaaatttcaaattaaaatttggcaattaaaaaaatattttctgaaaacctatttagacactgaaaaactattgaggcacaaaacatacacactagtagtgcacacaaaaatatatatacattacaagctattttcaaataaccacaaattacatttgtttactttcttcaagcattttgggaatgctgctgttgaggagtttatatgtaaatccatgtgaagccttaacttattaaaaaagtattataactactaacatataaatatttaaaaatattttaaattttaagatatattttttaatgtgccaataactcaaaacatgtctcactaaaattttgccaaataaaaaaatttagtttacagaataagaagtgaaaaaataaaatgggggtttgggaaaactcattcaatgaacgttcattgacagcctgtgggccaggctatagatacattagtgacccaacccaagatccctgacctatacacaaactcttaaattctctatacacaacctcttattagcatatagtcatggtgagtaaaatatgccccttcactactctacagaattctttaaatcctatgtttactactttcatttctaagttagatgaatacgaaacaaatcaatacagtgcaaaccttaggtacatactggtctaaattgactggtataatattctgcttgaagaaacttttgtaggtcttcaacattgtttaatgttgcactcataccaataatttgagtcgtttctaaaacacaaacaaacaaaagccaaagtgttaaggaaaatatgttatttaatatatcataaagtaattttagcaagtcttttgtgctctgaattcttcctgagtgatttgggaaaggggtgggagaggtaagtaagaaaaatacaaatagctgggtgcctggctcacatctgtaatctcaacactttcggaggctgaggtgggaagatcgcttgagggcaggacttcaacactagcctgggcaacatagtaagacctcatctctacaaaaaaattaaaaattacctgggcatggtagtgcacgcctgtagtcccagctacttaggaggctgaggtgggaggatcgcttgagcccaggaagtcaaggctgcagtgagccatgattgtgtcactgcactgcagcttgggcaacagtgagacctgacctcttaaaaaaagaaaactacaaatatattaccagagtattaatctggcatttgaagaatgaaatttttcaggtatcctgaaagttactacttagaagtttacagagtttcaaacttggcaagaactaggatattaaggcttctaaacaataataaatgagtataaatctgcttataactgtctatctggatcccctttacgaagagctatgatatgttccacaggtatggctatagacagatgtagaggtagtaggatagagggctaaatgcgtctcgaactcttggcccatgaaaagtcctctatgagatcttgctatcaagctaacttttaattttatttatttatttatttttttgagacagagtcttgctctgttgcccaggctggagtgcagtggcatgatctcggctcactgcaacctccacctcctgggttcaagcagttctccttgccccaacctcccgagtagttgggactatagtttttgttgatgttgttttaaataaaggtggagtgaagcttatgaagccatatgacatcctgggcaatacaaaatggctgctttctatagacttaactattgaatgaaaacccaaataggccttctttgcaaatgtttcttcattgctcctatgtcttgaaatgatcattcaagaaactcactgaaagaggaataagtgggagtatccttctcattccataaggatagactacaaagctgaagaggtgggcatggggtcaaatcaagaaaggctgtgctaagaaattagggatttatgcagaaagcaaaggggagctattaaagaatggtaaacagtaaaataaactaattggatttgcatttgggaaagatcattcttcttgcgctaaagaaagatggatttggtggatgaagggcagtgggtacacagaagaacttggtgatttctgtggcaatccaggtagaaaggatgaggtactgaactaaagacttagtggtaatgagggataggagagacagaagtaacaatatatttatgaggtaaaccagataggatttggttgctgatagaatatgtaggaccctggcttggctggctggagagtggtggctgagaattcaggctgaagaacggctttgaaggaaatgagtttggctcagactaagccttagttaggcttagctgttcagagaatattcaaatagggatgccctaaaatacaggcttgatgaaagcagggactattttattcactgctgtatccctagcacttaaaatagtgcctagcacacagtaggtgatcaatatttttttgaatgaacaattataaaatgctataacctgcttaaatattattgctgttgaaattttttaaatactttttaagatttgacctttatagttaatttttccatatataaggtaaatattgcaatagcatatcaatagtaggttatgacatttagaataaatttttcataaactttaaagactacctgatgctgcaaaatagctccttaaactgacctatttaaatgtatcgctttacaatattattattataatatttatgttatatgtattattatggtgatgatgatgatggccacagtagcagcagcaaacccttactgaatgcagtgtgctaagcactgctgaatgcaatacatgtgttaactcacactatccttacaacaatcccatcaggctggtaccattattatccttgttttacagataaagaaacatagaggttgagggatgtgcctgggcacacatagctagtaagtggcggataataatagaggacttcttcaaataccaatttcatttaccttcaaaattctattcattagaaattttaaaacaaaggcaaaaagcttaagtatcttgctttaggttacatactgtagctagtgatagaattaagtattttataagtctcttgattataaatcaattcatgacctcatttgaaaaaatacttactgctagtgtagaggatttttgctagggtcatttccagtgtagctccacggcttccttcaccaatcatgtgcaacttcgagattttttttaaaaaggacagagaagtaaatcttcatatagtgctcatataaaacatgcatatattcatatgaaatttgtttgtaaagagttgcttataacttttaagtattttgaatataacaactataatacatgtatattatttcactggtatttaggttaatgagcttttggtacaaaatccttataaatctgggattcataagtactactaaaaaaattttttttttaaacggagtttggctcttgacccccaggctggagtgcaatggcgtgatcctagctcactgcaacctccacctcctgggttacagcgattctcctgcctcagcctcccgagtggctgggattacaggcgcccaccaccacgcccggctaatttttgtatttttagtagagacagggtttcacctgttggccaggctggtcttgaactcctaacatcaagtgattcacctgcctcggcctcccaaagtgctaggattacaggcatgagccaccacgcccagccaataaaattgtatactacacacatacgtgttcacacttcaagaaacacttgacacaaaaccaaatttaagattatcaagcatagaatgtcttcacctatattgtctatattttcaaataaatttatttttatagaggtactaaggtactaagtagatccacacaataaccagaataataaatatttagtataataaaaatattgacaaattacaaaagtattaaccaacctcgtctacaacaaccagacccagactgtcaattcttccagtttcaatcaaggagttcaccaagctatgtcctttttcaatagtggcaatatagagtgatttcttttcccttcttttagttggaggaaatcttcctttgcttccagcatattcttcaacaaagaaaccgagttctataccaaaacttgacaaacctgaaatctagaatattagttaaaataaagaaaaattggccaggcattgtggccaatgcctgtaatcccagtaccttgggaggctgaggcgggaagatcacttgagcccaggaaggtgagaccagcctgggcaacacagtgagacctcatctctataaaaaataaaaaattcgctggctgtggtggcacaggcctgtagtctcagctacttgggaagctgaggtgggaggactgcctgagtccagagaattgaggctgcagtaagccttggtcatgccactgcactccagcctgggcgacagagcaagaccctgactcaaaaataaataaataaacaaaaccaaaaaacacaagtaaaaaaccccccattaggtgctcatggggttcaaaaaagctaaagtagtgtttaatacccatcaacaggaacaaggtcacaggcaagacatacgtaagaaatgctgtaatgtctcgatctttgcaaaataaatgcaacttctaaaatacatgtgaaaataaatttcaactggcgcctttgataccaaaaagcatcaggggtgtgttggctcatgcctgtaatctcagcattttaggaggctgaggcaggtggatcacttgaggacaggcgtttgagatcagcctggccaacatggcgagacatcatctctaccaaaaataaaaaaattagccgggcgtggtggcgtgtgcttgcgattctggctgctgggtggggtcgtggggcatgagaattacttgagtctgggaggtgggggttgcagtgagctgagatcatgccactgcactccagcctgggtgatagagcaagactgtctcaaaaaaaaaaaaaaaagcatcagaataactcattttagtaatagtttctgcttgaaaaagcaaggtaaggccgggcacagtggctcacacctgtaatcccagcactttggggggccgaggtgggaggatcactttaggtcagaagttcgagaccagcctgtccaacatgatgaaaacccatctctactaaaaatacaaaaattagccaggcatggtggcacacacctgcaatcctagctacttgggaagctgaggcaggagaatcacttgaacccaagaggcggaggttgcagtgagcagagattgtgccactgcactccagcctgggcgacagagggagactacatctcaaaaaagaaaaagcagggtaaatagtaatagaacatttaagatgatgtttaatccaccagtttagaaaaagtaaaactttcaacaactggtaattagtatttgaagatattttaggtagtgtatactgcttttatacattctaaaaatattaattctccatcattaagaggtacttctcaccaggcgcagtggctcatgcctgtaataccagcactttgggaggctgaggcgggtggatcactggagatcaggagtttgagaccagcctggccaatatggtgaaaccccgcctctactaaaaacacaaaaattggctgggtatggtggcatgggcctgtaatcccagctactcaggaggctgaggcaggagaatcgcttgaacctgggaggcggaggttgcagtgagccaagatggtgccactgcactccaacctgggtgacagagcaagactccatctcaaaaaaaaaaaaaaagaggtacttctcaacaatacaaagttatcacatttacagatcttaacgtcaaagtactagcaaataacatttgttttaaaacatacacacacacacaccttttcttggacaattgccacatatggaagaatcattaaaacatctttccgacagcaaagcagttcttgcagcattaaaatctcagccacgagggtttttccaccacttgttggcaaggaatatattaaattttttctttcttgcacagaattcaatgttaaacaagtatgttgccattctgtggaattaaaaaaaaaaaggcattattttccccttccaaactttgaaactcaaaagttttctaagaaaaaaaatcaaatcccttcctgtggagcaatcctctcataaggataaatttaattataaccaatgttacatgtcaaaaatcccaaatgtgcaagtagtacagccagtgagagcctagttcaggcctaggcagcaaggtgggcaaccagcccatttattcaccagctgcagacttgggtccaatattacagcagggcaggtagcagcctcgtggacaaggagtgccatctgagatatcagaggaacaaagggacagtacaaggacctgtgtgaattcgaatgtcttcctcttatgttctgcaaggagattatataagcttcccttcctcattcagccaaaagccatctcagagagaagcaggggaaggagggaaacaaatctattaggttttacacaaactaataaaaactttaactagctctcatggagacctgaacttcgaatgggtccaaaaccattttaaactgttaaaactctttaaaccacaaaagactaggattattaactgacacgcctaggattcccacaatttggcaaggcgggattcatgaaaatagatcagatccaagataccgtgtgaaaactagtattaattactctgtaggataatctgacaataaaaatcatcagaagtctttaaaaatgtgcttcagtgttttatcactagaaaaatgggcaaaaaatttaagacatttcacagcagacggcaaatggccaataaatacatggccaataagcagcagaaatgcaaatggccaataaatacatgagaagatgctcagctgttctctactgggttggcaaaataaatttttaaaataaaaaacaaataactatcaaaaaaaaaaaaagccccacacatgcaaaatccagagctgactaatgtggggaaaaacagccattttcatgtacggttgtgagaacataaactgctagaatccttgtggaaagtaacctagtataaaatagaactgcacattgcctttgatctggtagtattacttttgggattctacatctatagaacggaagccaaagcatataaaacacagcattgtttgtaggtaacaaagtgccatggtggtgggggtaaaggccgaatgaattattgtacaatcaaccaatgagattctttgcagtttaaaaatgaagaatagatggatctatgtatgttcaatatacagttaagtttaaaaaaaaaaaaaaaaaaaaaaaaaaaaaaaagcagatcattgccccggagtggtggatcatgtctgtaatcccagcactttgggagcctaaggcaagaggatcacttgagaccaggatttcaagatgagcccatctctattaaaaaaaaaaaagaaagttatatctgaatgacagttacaagtaactttaacttattgtgcttttgggtgattcccaaatactacaagtgactgtgaatattttctttaaaaatatttcaaaaatacttaaatttaatattcaataaatattgaaaaatacttcagattggtatcacccgagttatcaaattagatgtttatgccaaagtataacttaaccatagccacattttatccaattcagatttttaagcataacatgacaaaataactaatatttatgaatacaatcttcacatcaaaaaaaaaaaaaaaaactagccgggtacaatggctcatatctgtaattccaaccctttgggaggctgagacagcaggactgcttaagcccaggagttcaggaccagcctaggcaacaaaatgagaccctatctctacaaaatataaaaaaattagctgggtatggtggcgcatgcctatagtccccacgacttgggaggctgaagtgggaggattgcttgagcctgggaggttgacgctgtagtgagccacgatcacagattgccaggtcgtattcctagaggttctgacgcagtaggtctagggaagtgtctgagaacatgcacttcaacaaatttccaggtgatgttgatgctgcagtccaggaaccacacttgagaaccaccgctttagcttaataaaaagtagcacatgcatttatgctttaatctggtcatgttattaagccagatttagaggtaaaaagatttaaaaagttgttatttactgaagttcttacttagaagctaccaatgtaattactgacaatcattaccaacatctaatttggcatgtccttaacacagactctaacttgcaaaaaaaaattatccctttttatagatgaggaactaggcccaaagtgctaaggttgcatttttaagtgacaatccccagcagttgagaacctaccagagtataccaggcacagtgctagttaagaaaaagatgagttaggccgggctcggtggctcacgcctgtaatcccagcactttgggaggctgaggcaggcggatcacaaggtcaggagatcgagaccatcctggctaacacggtgaaaccttgtctctactaaaaatacaaaaaaaaaattagccgggcgtggtggcgggcgcctgtagtcccagctactggggagtctgatgcaggaaaatggcgcgaacccaggaggcggagcttgcagtgagctgagatgcgccactgcactccagcctgggcaacacgcgagactccgtctcaaaaaaaaacaaaaaaacaaaaacaaaaacaaaaagatgagttagatagagccttgtcctcaggatattcattctggcagactaaacaaaaagcaaggtgctagcagaaaaacagagggaagaacagagggaagaaagttaacgtctacttccagggcaacacacaccattagctcttaagtcatgaacctcacaatttggattcttgtagagtcttttattagactttgtttcctgtagttctgcttctccaacctgattgtcttctctgcaagaacccaagttttcatatcattcataagatcctaacaggagttccagaaaacttacgaagtggaaggttgatggggctgaccctccagtatggcagcaactgtcccttcttggtctaaaatgacacatatctgaaatatatgcaaggaccctggatttttgaaaaacattacaagataccttcttaatattattgcttctttgcacttaaaacaagtttgtccaacccacggccctcatgaggcccagaatggctttgaatgtggcccaacacaaatttgtaaactttcttaaaacattatgagatttttttttttgcaattttttttcttggctcatcagctatcgtgttactgtattttattgtggctcaagacaatactttttccaaagtggcccaaggaagccaaaagattggacatccctgacttaaaacttaattgcagctgtctttaaagatgtctagctttgggaaaggcagcacaaggcagagcatctgggtggtggcagggatgcacccgtggggagaggtagctgcggctgctggtgtggggggaaagatgtttggtttaatcaacagtattactaataactgacttctttcactcaagacatgtgagtgtcaaagacataccacaacagctaggttttggtagagaagacagagccagccaaggaaatacaactaagaaagctgaggatctctactagacaatcggggtcaaaaaacaggagtggttgtaaggacatccagaaacaagaatttcaagaagggtgtagtcaatagcatcaggtaagttattgagaagtcaggtaaggtaaacattaaaagtaacactgtgtttagacgtctcagtcatcagatcttaagtgagagaatgagagcacagaacccagaattagagtggggtaatttactaaagttcttacttagaagctaccaatataattattgaaaatcattaccaacattgaatttggcatgtctttgaaccagaatctgacttgctaacaacttattatccctttcttatagatgaggaattagaggaattatgtcaggtaaggaaacagacagaaaggataactggtttgataagtgtgactgtgagggaaggaaagaggttcagtggtagcaggacaggtaggaatggaaggggctgagagatcactgatcttttgttttcaaaatgagaaacagtatggaccatgaaagcatttgcttctatttacttgcactaatattatggtaatgataggaaaaaaatttttttattccagcaaaaagcattaccatataatttttcaattcccttgaattgggcataaaggtctctcactttgctgggtaatgaataaaaaggaccaaggtcatttgatgatgactcaactgttttcttagcaacattaatttcctcagataggagagtgtctttgagctgtttacttctagaaaatattggtgtctgggccttcgcatttccagtcatggcattttttagatgatctttaatactttttctcctgttcatatctgaactagttctgactttggaagaggactcatcattttgctggggttgctctatgcaattatggggcagttcctcattcacagtgttgtgagaggatgacttccaatccctttctttcatagaatgatcacccaaatcatttgaagagttctgcaaattttcaaagtatatagcctgtgaggaaggtacatcatacaaaagatcagctccaggttcaatagtgacaccttcatatccactctggttctctgtgtgcttatcagtttgtaattcagtaaggttgcctatggtagtaatgctgagtttgtttttgatactttccgagcaaagattttcagtggcaaagtctgtagcatgtttcttatgttcagggagttgcatatatttttgttccaggtcgtcaacttgagctataaaggagttttcagtaaagctatcatagtcaccaaacatgtccacttcactgtcattaggctgcaaagagaacaaaaacgcttatggtcaattccagtttcattaagaataaaagcttcaccagcctggccaacatggtcaaaccccgtgtctacagaaaatacaaaaattagccgggcatagtggcatgctcctgtaatcccagctactcggaggctcaggcaggagaattgcttgaacctgggaagcgcaggttgcggtaagcccagatcgcgccattgcactccaacctgggcaacagagtgggactctgtctcaaaaaaaccaaaacaaacaaacaaacaaaacccccaaaaaacacttcagcctagggctgtaccaagtatataattatatggtcacatatggatcacagacctatatgtaaatagatatcttacagctgaagaaatggaggcccaaagaggttaaattacttgcctaaacagcaggttcaggagtgttacgatgatactgagattctaatttttgagacagggtctggctctgtcacccaggctggagcacagtggctccagccactgcacgatcacagctcactgcagtcttgacatcctgggctcaagcgatcctcctgcctcagcctcccaagtagctaggactacaggtgcaggccaccacacccggctaattaagaaaaaaaaatttttttttttttttgtagagactgggtctctgttgcctaggctggttttgaacgcgaacttctgggcttaagtgatcctcccatctctgcctcctaaagcactgggattataggcatgagccactgcacacggccagattgtaattcttaaagctgtactaaaacagcaggaagactggtagacgtctactgaaatgtcagcgcattcgaagtttctgataactgcagcgcttccctcccagactacaatctacagtgactggcctctaacagaaacatggttgtaccactagacactccaaggagttcctaggaatttggaattgagactgagaaactgaatactgacttggagtggtctgctacacagaagacacacaaacctggaggcagcaatatagtaaagtgattaagacaacaggatttggagcaagaactgtactatctcaacttttcagggcctgattactgtcgtaaaatctagataatataactagcttaacataacgggtcttcaataaacagcagattttatttgtacagtaggagctgcagttatctggaagcctagatttgtgtctcagtcatgccacttaactgctgcgtgcacaacttttatgtctcggggtttacatttcatatttatatagaaatgtaaataacaaggcaatcaatacctcctaagtgccgattaacagtggtaacgaagacgagagaagtaaacgaaggcgataaaactggtcaactctttgcatctgggaaggatgccaaaagtttgcagtttcaagttccaagtcctccgtacctggtctcccacccctctgtcagtgggcatgtgacgtaggaggtccgggtttgtatcaccacctccaaggacgagacattccggggaatctgagagtagaaggggctgtacctcaaccggcagtacgcccgcggttttccgcctcctgttctcagccaccatttcctcctcctctttcccctcatctccgggcacgagctcggccgcggtgggagcgccaaaaatacaccccaagcttggacggttccttttggggagagacacccgccggcggatgcgggaaccacattcatccatggcaaggacccagggccctattcagacgtcgttctcagtgacccagacgctaagcccatatggaagggagagtgggacgccggagcccgcttctacatccaccttgggaaaagaccccaagttagctctcagggctcgcggaccggaagcacgcataaacttctaccctgtccaatcataagcctcacgt

SEQ ID NO: 184 - DNA, 13742 bp, Homo Sapiens
tttatctaggcaacctttattaagttccgttcgagatccgctcctcgtcaccagggcgatcttatcccacaatcctacccaagcctcccttcccactccaccagaacaccccttccctccccttcgccaggaaagatttgggcggccgacccaggtggttccaggactccagcagcctatagtggtggggcggcgtggggtaggggcacgacagagcttcccaaggaagttacatgacctcgccttgggatattcagaaatgctagtcaagttctggcagcctgaactcttcctcctccaagctgaaatccgagagatacccttcctcctcttggccatactgcttccagggagagcaagggacctgcaaaatgtgcgctagttagggtggcaggcagaacgcacattacggtcattcattccaaaatgttgccgtttttgctaaactttccatatcctttgttgcatgtttgataattcaccactctattaggtaggggctgccagggaataagtgaagactccaaattttctgtaggaggggttttgggaggtgggcaattcagtctgggagagaagtttgaactgtcatcctgccttgacttaacacagccattaccctagaaattacagcgccactcttcagaggtctaccctgtgtgcacacatggagaagaggcttaggttgttaaagtcagctgttaaataatttcctgaaatgcgactataactggaacccagctgacttcctccacagccattgttacctattttattactcattgtctggcacaatcaccagcatgtgaactctaagaacgtgcttcatcttatgccagtgcctagcataggtatatggtgcagattaatggttttacaatggaagggattccaagacttgcctcatttagggatggatctattgttataatcagatttctgaaatcagtgctgactttctctcacatttcacaggaagctagacttcttaaagcttgaagtttccttgatgggttttatttaaattgaattaaaataactattttacagggaaaaacttcaaaacaaaacgctttgcaactttggggtgaaagttaaataaaacactctagccccaaattaagttcctactgaaaaaaaacacttttgctactttttttaaagaattccatatgtagtaaataatgactgttttctttcagagattaatttagaaacttaatccctatttaagagctttcatatacagtcatgcgttgcttgccatgtgaggagaagcttgagaaatatgtcattaggtgatttcacccttgtgctaacatcatagcatatacttccacaaacctaggtggtatagcctacagcacacctaggctatatggtatggcctatggctcctaagctataaacctgtactgtatgttactatactgaatactgaaggcaattgtaacataacggaaggtatttatgtatgtaaaatggaaaatgtacagtaaaaatactgtttaaaagataaaaaatggtatagctgtatagggatagctccattatactcttatggaaccaccatcatatatgtggtctattgttgaccgaaacatcattttgtagcacatgattgtaactgatttacagaaagatctcagcaaaatattctacccaagatatacgtgagatattgagatccaggtaataaactgtatttgaaaggcattatagttttcgaaagctgtagcacgatcattcttaaggccagttactttctccccatatctctgggattctgtttgaagaaagttctaaaaaggcctgtgttcaagcagcctggaatccctaactcctgggggaagactaatccctctcctgtgtccacaactgtagtaatactctgatagtcctcagttctcctctccaaacttcaaataagcggtcagagccaaaggtcaagacttcaggaaaagccccagaaatactctgcactcaaaagtagtatcagtttcacattttcctaagaatgaaacaaattatcctccaaattatgctgcttttttttgaattatggttacactggctatgttacccctgagtttttatcttcacatacttgaattaaaccgtgtagttcttcttcgcatctgacacctacgatgtcttcactgggtctgtactccacagctattttaccactttctgaaataaagttagcgaggatcaattcagaatctttttcattctaaaacttcctgcatataatggtagcaccccatgatgaaacattgttttggtttctaaaagcagaaaataagagcattttcctggaagtttccttatctcctcatctcacacttcagttttttctttctttctttctttctttttttttttttttttagaagacagggtctctcactctgtcacccagactggagtacaatggcactgtcacagctcactgcagcctggaattcctgggatcaagtgatccccctggctcaccctccagagtagcaaggactacaggtacacaccactgtgcctgcctaatttttttttttagagacgtggtcttgctttgttgcccaggctggtcttgaacccctggctttaagtggtcttcctgccttggcctcccaaaatgctgagattacaggtgtgagtcaccatgtctggcctcacacctcagtttttaacatatgtatgaaatatcaaccatattcggtacaaaggactttatgatcttacagataggaactaaggaataacataagaaataaaaaatgtggaaaccaaaatgctcaatcataatatgactaaatggtaaggcatcagatgggggtcaaagcaagttcaaatttggaatagagaccactgggctagtagacacttcacattagaagcaagggccttcttttgtctactcaggtgtctactccttttgaaccaaaattcattccaccagatacaatgaacaaagcttctgagagagagaacatttgaacattttattggcagacacaggctcacatacccttatagacaatagaactaccttcaaggcaaactagagccatcaggcttttggtctaagaagttttcagtgtgtgcaagatacctttgtatattagggagaggtaaacaacacacacacttcgtttggttcttaaatgttgttactcagacttgacagttgatgaccaaggaagtaagactttcactagaagggctgttgcccaggttggaaagctgagagcagtcagggccacctcctacaagcaaataaaggtctgtggtaacttaattaggatctctcagtctctaagcctttagggctgtgaagcagaagagcaactctgttcagggactctttgctaatcattaggcttcctttgggcacagcctataagattcgtgccactgtagaactcaatagggaatacaagcaatagggaatatattcaatagcatgaccaattccaaggctcacggcaaagcagctgatttttgtataagaatcatacttgcccaatgtgtcagtgccagaaatgaaagctgaaactgaattcttgattcaggaaacataatctaataaactcttcagcagagagcttatttattcagagataaatcaacaatgacaataatagttaatatgtctgcttatcttgtaagtgtagctccgagtttttacatttgtcatctcatttactcttacaatgtcctccataaggctgactgaattactaaccccagtttatagatgaagagactgcagcttagagatattaagtattttcaaatctctctggctataagacctaaaattgcattaaaaaatcttttttttttttttttttttgagatggagtctcactctgtcacccaggctggagagcagtggcacgatcttggctcactgtaagctccacctcccaggttcacgccattctcctgcctcagcctcccaagtagctgggactacaggagcccgccactacgcccagctaatttttttgtatttttagtagagacggggtttcatcgtgttagccaggatggtctccatctcctgacctcgtgatccgcccatctcggcctcccaaagtgctgggattacaggcgtgagccaccgcgcccggcctaattgcattaaaaatctaagagacagagttaggactcaaatccatgcgtccaaaacttataatcactattctgtatgataggtaagcaattaaagaagacctggcttaaacattttctgtgggaactgaggcaagtcttttcacatctgtaaactggggacaatatttgctgtcattttttttcacaaatgtcacacagaacaaatttgagcctgttggtgtgaaataatttagcaaatgaaagcatactatagagtgctttagatatcaatatttttattcaattaacttttcaaaatgagtttatttgcttactgaaactgaagtacttcaaggatgatcaagacagtcttacctagaacaacaatcaacagtttctggaatgcatctgacaaagccttctgaatagcaagcttctgggctgtcttccttttcataaggaatgataatggtcctaaatccaaccaaaacaaatggatttaaggtgcctatttgaatgataattgctatatgtttaaaaaataaaaaagcatccacgattcttagctcaaaaccttcatgactaagggcagatggcacaagcgtatggttgaatggctctgttataggtacatcctggcagggcccatttttactacctccatctagtagggaagttcctgaggtactagaagggagataagagccaagaacctggcacatgtctcacatcacccagagatttcaaattgatcagttaaggctacactcctacagaccctaccctcctatgcatcaagggctggaatcactcatcgaaaaaggtttggttggctggacctggtggcccatgcctgtaatcccagcacctggggaggctgaggcaggtggaggccaggggctcaagaacagcctggtcaatgtggtgaaacttgaggccaggagttcaaaaacagcctggcggacatggtgaaaccctgtctctactaaaagtgcaaaaattagccgggtgtggtggcacacatgtgtaatcccagctacctgggagtctgaggcacaagaatagcttgaactgggaggcggaggttgcagtgagccgagatcatgccactgcactccagcctgggcgacagagtgagattctgtctcaaaaaaaaaaaaaaaaaaaaaagaggctaggcacagtggctcatgcctgtaatcccagcactttgggaggccaaggtgggcagatcacttgaggtcaggagtttgagagtagcctgggcaacatggtgaaaccctgtctctaataaaaatacaaccacaagaaaatagccaggtgtggtggtaggcacctgtaaccccagctacttgggaggctgaggcaggagaatcacttgaacctgggagatggaggttgctgtgagccgagatcacgccagtgcacttcagcctgggcgactgagtgaggctccatctcaaaaaagaaaaaactttggtacagataatctggctcctccctgggcatcacccccgggagcctactccactccattagcctacagccctgcctctgacttcaaaccctaagcatgatggccatgaatactaaaaaaatactcaacatcagtatcaactgagtaccctttctaggtatctatattagacactttttctgctgaaacccttttatgagtaaaaaaaggaactgaatgtttatacaaaagtttatgtaaatctttagatgatgacctggcatggtggctcatgcctataaccccagcaacttgggatcctgaggcaagaggatcacttgaggccaggagttggagaccaggtgggacaacacagaaagaccccatctctaaaaataataataataataataattaggcaggtgtggtggtgcacgcctgtagtcctcgctactcaagaggctgaggcaggaggatcccttgagcccagaagttggaggttacagtgagctatgatcatgctactgcattctagcctgggcaacagagcaagatcctatctctaaaaaataataaatagataaaaaaaaatctttagatggttttgctgggataaccgagagctacaagagacacatatttgaaggactattttagttcgaagcaagttcttaaccaaaaactgtaaaaacattacttccttcttcctcctaagcttctcggcaggaagtcagctgtacgattttaaatttaaaggttcaatcaggtattgcctacagtaaaaccctatgttgtaagacagaaaaactctgcccaggacttcagtagctcagagagggaggggcttgatatgtatctgaaaagatgagttttggaaagtaagaaaaaaagaaagatcctttccactccaaatccctaccctcctccactcccagtgaaaacagaccttcctccaccttatccataggctcctccaccaagccaatgccaggactcctgcaatcacaggatggcaacaccacttctaaagcacagaagaacttcaggctttgcttcggaagtggcaccatgctatcttcattttccctttcttcaaggtcagaaagctcctgaagctgtaaggatatttaatgtaaggtccttcctggggtcttaatgtaggcttcaaaatgttttgttattaaaagtaaaaacttggctgggcgtggtggttcacgcctgtaatcccagtactttgggaggccgaggtgggcggatcacgaggtcaagagattgagaccatcctggccaacatggtgaaactccgtctctactaaaaatacaaaaattagctgggcgtggtggtgggcgcctgtagtcccagctacttgggaggctgaggcaggagaattgcttgtacccaggaggcagattttgcagtgagctgagatagcgccactgcactccagcctgatgacacagcgagcctctgtctcaaaaacaaaacaaaacaaaacaaaaacccaataaaaaaaagaaaacccaaaaaacaactacactccagtcattcaagctaacagttgaggtgtcctatggcttcaaaatcaagttagatttgcaaatgaattgctagatagagacaaccattttttattatatgccacaaaaacagtggagaaaattacggataccaccatccaattgactgagattattaattctaggtagcaggccaattcagacatgtcaatttatcctcaatggtagaggcctctcacatctcctccctacaatccagttcaatacttctgtctaaaatctaggatttcaatgttgaaaggagagtgtggtaagtgaaaaaaaatctacaaggtttaccttgatgatccttttggaacacccattgaaaccaaagtagtaattcgccagttcttggcatttggaactgttcagggcaagggcttgatgttgaactgccttatgtctggtgccaagacgaacctaaaatcataggagatagacccataaatatcacaaccgctagagattttattttggatagatctgagatttgtcaataccaagtgtgcaatgaaaaattgttactgtcttcccattcagtagttcctgcttgagaatatgacctgaatatagataagatgaacccaccacccatccccctccccaagttactaacccgttaaaagatgaaataacaccaggtgcagtggctcacccttgtaatcccagcactttgggaggctgaggcaggtggatcacaaagtcaggatatcgagaccatcctggctaacatagtgaaaccccgtctctacgaaaaatactaaaaattagccaggcatggtggcacgtgcctgcagtcccagctactcgggaggctgaggcaggggaatcgcttgaacctgggaggcagaggttgcagtgagccgagatggtgccatgcactccaccctaggtgacagagtgagactgtctcaaaaaaaaaaaaaaaggaaatacaaatacttctataaattttacatgcaactgaaaggagaggtatatctgcatttacgtgcttctttgagaacgcaaatatctactgagtgttaattcttaaaacattttatccatttttgtggatttcttacatcacaagttttcctatatatttcattttttaaatgtagtatattatattcatgaaattcaaatgatacaaataaagtcaaatttatttgtattagaaattaataagaattaacagtaaagttctttttttttttctgagacggagtctcgctctgtcacccaggctggagtgcagtggcgcgatcttggctcactgcaagctccgcctgccaggttcacgccattctcctgcctcagcctcccgagtagttgggactacaggcacctgccaccacgcccggctaattttttgtattttttagtagagatggggtttcaccgtgttagccaggatggtctcgatctcctgaccttgtgatctgcccgcctcggcctcccaaagtgctgggatacaggtgtgagccactgcgcctggccgtaaagttaattctttattgatttgtttatgcaccttcctctatcactggtttataagctccttaagtcccagatgaaaccatagcttattcttttttcatttccagaactaagcatagttcttggcatataatagagcacagatgatctatcgattgaatgaataaaacaatgagcaagtaaaaaatgaaattactttctccaactgaaaagaaggagaaatgcctgttgggaaagaaataaagaccagtttttaaacgttgagtgccactggcgagaccggcctgtatcgtgagtcacagtggagcctttccagacaaccaggaagcttcagaaaaactctgagcctctgggtggcacagacagctgtcagcttggataactttgcagcaaccattttccttcatttcaccaaaaaaaaaaaaaaaaaaaaaaaaagaaccaaaaaaccctcttggccgggcacggtggctcacacctgtaatcccggcactttgggaggccgaggcggcagatcacttgaggtcaggagttcaagaccagcctggccaacatggagaaatcttgtttctaccaaaaatacaaaaattagctgggcgtggtggtgcacgcctgtaatcccagctgctctggaggctgaggcaggagaatcaattaaacccgggaggcagaggctgcagtgagctgagatcatgccattgcactccagcctgggtgacagagcaagactccatctcaaaaaaacaaaacgaaaaaaccaaacaaaaaaacaaaaacccaaaaagcaaaaacaaaaccctctcaggtgccttaggcctttccttgattttattttaaaacattattctcttttctgtatttagaaaggcaaaaaagacaggaactaagtgtacgtgctaaagtagaaaagaacacttaaactagattacagtggggggtgagtagtaactgaaagctttgagtttagtaataaatctagtatgaatgccctctcatctcacctatctattgagttgtagaacatttccttcattactgtctcagtgataggctttatgctgtgaaattctcaaaacctaaagcttatgaaatggtctcaatgtccaaagagcactaaaaactcattatttgcaaaatgataccaagtaaatgtttcataatcttagttgtacctttataatatttgagtggctatgtgaaatggtcacaggttagaaacagaccatagttcaaaagttaaataatatctcacaggtaatcatttcagtcacagaaagtggaaccaggattgaagagggtgttgaacaggctaagagggcattgaacaggctactgaagtgggagtagtatacctggagtcattactaagcagagttctcagatttgatcaaggttaattcaatgaggaatggaatatagagaagaataggcagcaagattagtaggaagcagtcagatcaagtagccaatcaggaattgaaatggtccttgaaaagggaaagatgactgaattgaggcatacaatgagatatcattctgtggctctgggaaagtaaaattggttggcatgttaatatggaatagggtttctacaataccgcttaaagaatgttcccatcctctcagaactgaagggagtttcaaacaggcagtttgtgagccatggtgagtatgatgatgatgatgtgatgatgatgatacagtctcctttatgtaacagctggcagaagacctggtcacacccacacattttaaattcacataaaactaaatatataggctgggcgcggtggctcacgcttgtaatcccagcactttgggaggctgaggcgggtagatcacctgagttcaggagttcgagaccagcctgaccaacatggagaaacaccatctctaccaaaaatacaaaatcagccaggcgtggtggtgcatgcctgtaatccctgctacttgggaggctgaggcaggggaatcgcttgaacccgggaggcggaggttgtggtgagctgagatcacaccattgcactccagcctgggcaacaagagcgaaactctgtctttaaaaaaaaaaaaagtaaatatataatatatggctgggcacagtggctcacacctgtagtcccagcactttgggaggctgaggtgggtggatcacttgaggtcaggaattcgagaccagactggccaacatggtgaaaccccatctctactaaaatacaaaaattagccaggtgtggtggcaggcgcctgtagtcccagctactcaggaggttgaggcaggagaatcacttgaacccggaaggcagaggttgcagtgagccaagatcatgccactgctctccagcctgggtgacaaaatgagactccatctcaaaaaataaaaataaaaagtaaatatagctgggcatggtggcctgtacctagctacttaagaggctgaggcaggaggactgcttgaggccaggatttagagaccagcctgggcaacacagggatactctgtctctaaaaaaattaaaaagtaaatataagcagaagtcttctggcaaagatttcattcattcagtcattttttagagatagggtttcactctgtggcccaggcaggagtgcagtgatgcaattattgctcactgcatcctcaaactcctgggctcaagcgatcctcccacctcagtctcccaagtagctgggactacaggtgcatgccacatctggctgatatttaattttttatttttctttctttctttttttgagatggagtctcactctgtcacccaggctagagtgcagtggcacaatctcgggtcactgcagcctccacctcctgggttcaagtaattcccatgcttcagcctcccgagtagctgggactacaggcgcatgccaccatgcccggctagtttttgtatttatagtacagatggagttttgctatgttgcccaggctggtctcaaactgctggcctcaagtgatcagcccgcctcgatctcccaaagtgctgggattacaggcatgagccacggtgcccagccttatctttacaattttttttatagagatggggtctcattttgttgcccaagctgagatttcttaaaaagggacagcataaaatgacatgaggtttagcatcagtaggttttagttcaatctcgagtttccataattcttgtcaggaaccttaaacaagtcgctcaaccaccttgagtttgagtttcttcatgtaaaaaacccagagaactggaagattagtgtggcaatgcatctgaaaatattctgtaaaccagcgtgctggacaaatgctaacctattattgaattcagcacttcatttcagcggagctaggaattccatatttggacccaccttgactggagatttctgaaaaagctgcttccggtcgcatgccttttgggctctgtgggcagcccttgcagaataaaacttaatgacggcatagaaaccaggatgggccactgcagcatttgggaagacccggactgaatacagaaggccaaactgagaaaatgctgtgaacagagaatgctgtgggggtgggacaagtaaatgcatgaaatctcacgcccagaaaacaaaaccgcacatgccctcatattccccaaacctctcttcgcgaaggatgcgattcaaaacacttcccacttaatcaacaggttttcctcttaaaatcctaaactttaagaagcactggaaggtaaaacgttctgaaggtggagagatacctctccgggactctaaaaatctgttgggggtcgtcagttgtcagttgggatcccctttataattaagagtccttcagcggaggctcaggcaggtgagggtctgaggcaggactccggaactcccagtcagcgggtgggcagctttctccatccctccctccatcctggccccggctcacatgcaaagcctcggccgtgggtccggagctcagctcccacactagcaaggttttgtcactctcgatgggaaccgcaaaaggtaccaactccgccatcctcccttcaccgcacctgcgcggctaaccctcgccccagcattgcgcctgcgcaaggcacgcccgcgcttttttaaaaagaggcgcatgcgaggggcggggacggggctcggatcgctcccttgcccctcctacctagggccagcctctgagtctgttcccctcctccagtcacagccacaagatccctgagtttagagcttccgttcaatgcatgtttagggtaaagtcccaaaataggctgacaggatggaagggtagggacgtgtttatagaagccagcttcatcttcactcctgaaggagattagggtactaagtattagcacttgtgggaaataaccacgaaagatgcaatcttttgacttaagaggtttttttaagagtttaaaattgcaaataaaagtataactcactaaaccattaacagtctcgcatgaaatccttaaaaagaattccctgattgtcctacgtcattctggtgaatcgtgtatgtgtacttgtgggggtcagatgatgtgagaggttggaggtacgagtgagaaggagagattaattttgaaaaaagaaaaacaaacaaacaaacaaacaaacccacaaagaataagtccaaataaggcaccaacattggagctgatggtgtctgagaagggtaggtgtcataatcagctacgtggtggaggagtgtaatcaactggtgggttcatcatacccactgcccagaaaagctgatttactgagacagtgttattgaaataggcaaagagtttcataagcacagaaccagctaaatagaagactggagttttactattactcaacttagcctccctgaaaatttggaagctggtgttttttaaagggtaatttggcagtcagggggccagggaataggaaatgctgactggttgggtcaaggatgaaatcatagagagtcagagcttgtgttcttgtgctgagtgaattcctggttgggggccgcaagaccagatgagccagtttgcccatgtgagtggtgccagctggtccatcagaatgaagggtctgaaaaatacctagaaccccaatattaggttttacaatagtaatgttgaa

SEQ ID NO: 185 - DNA, 7820 bp, Homo Sapiens
gacgaaggctggccaggcctccactctagacaggaagtctagtctagagtctatatggtcccagccaggactatgtagccatttaggagggagaactctatgttcttcccggcaaaaacgtgtgggcctggccggccacgcttcgctttggaggggtgcaggtgacttgtgtcttagagctgacgcagattgttgcgagatcattgcggagaggcaggcctgcagcgtgacctgctgcgggtccggcccctctcccttttccagagccctggtcagcatcccagagcttcgtaaccccttgactcctgtcatgggaatggatattgcagttaacaaggcggccgcggggtggggagtgagggagtctgaccgcaaagcttagatctggggtgctcaacgggttgtctgcctctctcccaggcgctctcctgccgtatccacgatggctccccgaacacttgtggagttccctgaaacacctaagaggaaggaagggagaaaaaatttccctcttcctgagttggggtttgatttccttagcttacaacaccgtggtgttggggatgtgggcggtagagaacgtgggatccaagggaagtcaatgtggagcctaaagagctccgtgagcagataagggattaattaagcaaaccaaggcattacaatcacatgacttcctagactaatctggtattaaatagtatggtatttattgtggacattggctaagcaaatgctaatgcacattaatacacacatacacacatatctttatgtaatttgtttatacacaacaatacagagctagctaccttttgtggacaatttgacaggtcccaaaaggaactaaagtttcaggcctcctttctgctgtcttctagcgggactctgagataagtaagataagagtagtatggccgggcgcggtggttcatgcctttaatcccaacactttgggagaccgaggctggtggatcacgaggtcaggagtttgagcccaggctggccaacgtggtgaaaccccgtctctactaaaaatacaaaaaaagtagccgggcgtggtggcgggcgcctgtaatcccagctactcgggaggctgagacaggagaatcgcttgaacccgggaggcagaggttgcattgcagtgagccgagatcgcgccactgcactccaacctgggcgacagagcaagactcctttgccggggtggagcggtggggcggggcggggaagagtagtatggccaggtgcagcggctcacgcctgtaatcctagcactttgggaggacgaggtgggcggatcccttgaggtcatgagtccgagaccagcctgggaaacatggcgaaactgtctctacaaaaaaaatacagaaattagccgagggtggtagtgcgaacctgtagtaccagctactacggaggctgtggtgggaggttgcagtaagccaagattgcaccactacactccagcctgggttacacagcgagaccctgtttcaaaaaaaaaaaaaaaagggactaacaatgtttctctctttgtcgcaggttccatttcttccaagaagggtgagcctgccttttgtctctggtgtaaatgccacttttcccagagaccttgaccaagctgggtagtgcattaaagatgagaaccccaaatcaggaacaaagataacggttagagcaataaaaagggaggaaaccgtgtgtgcctactgtgtgcaaggcacttttttaaatataacttccgttttctcgtaagatggaattacatattttttgtctttttttccctttttgtggagaatggggtctcgttatattgcccaggcaggtctggaactcctggactcatgctatcctccagcctatgcctccctacgtgctgggattacaggcgtgagccaccgcgccttgcggaattggaattacatatgtttaaatagtcgagaaatgaagtgaagcattgagccaggattcaaacttttgtccgccagattccgaagcccttgctccttttcccattgtgtcactctttggaaagaaacgtcttagaacctaagtgcattctccctagccaagttaaggaaaactgggggccctgtgcgccttctagtggtggatttttccccctacagagccaactatctccaaggttcctttaatacctgaaattcgcccccttcgcggcgcacgagtctctgatcccgattggctgggcagggcaggcggcgggacgcagggcgcgcccgggcggtgctgattggccggaggaggccagccgggggaaacttccgggaatgtccgcactcccgcgttccacggggcagcatccggcggcagcggagcctgtggctccccctgcgggctgctcagcggcgtgcacagtcctgccggctggcttgggtgggtggtgggctgcgggtaggggaggggatggaccgagtcccggcttgtcgggatgagggttccggaagatctggccagtaagattctactccctggctgtgcaccgggttccctacccctgtctacgtcggctccgccacttcgcggcttgagactaaaagagcatcccggcagggggccttccagccccaaagcagcctgtccagagacccccaaattctgatcctgaagttggaggcctccggggatgttcttttttaatcttttagaagggttagaggggttgaggctgcctgaccccagcctaatggggtaggtaggccttgggaagtggagcatgggggcaaaggatccaagcattgagccttcatcctctattccccatccagtggggtgccgaggctcaggcagcatgacgacggagacctttgtgaaggatatcaagcctgggctcaagaatctgaaccttatcttcattgtgctggagacaggtgtctatactggggtggcgggttcgcgggatgggggtcgggggcaggaggggaagaacgctgtctgcgttcttaacttgctatggggatggcaaggcaagctgcaagacactcctcactcccaatctcttcgaccctgggacagaaagttgcagtcaggtatagggtagatagaactcttgccagatctagacctcctgtgcgacgcgggcctctttccactcagggccctctccatggtgctggcccctgaactcccacctccaccctccaccaccccttccacaatcccaaccctttatgccccagggatttgggctttcccctgtttgtacaccttttccctcattccaccaatatccacatctcatccttctgagagataccactccatttatttgaccatcctcccacctcgatttatctgttccgttcaggccgagtgaccaagacaaaggacgggcatgaggttcggacctgcaaagtggcggacaaaacaggcagcatcaatatctctgtctgggacgatgttggcaatctgatccagcctggggacattatccggctcaccaaagggtaagtcagctggtgacttctggccttccaaaggcaacaacaatcaagagtggggttaacagtccctataacacttctgagtactgaattttgctttttttgcctcccataggtacgcttcagttttcaaaggttgtctgacactatatactggccgtgggggtgatctgcagaagattggagagtaagtgctgtcttggggattgggatgaagaagcaccagggcaaaggggtttgcaaggaggcagcatagggtgtgcagtccaagcctcatttctggactttttctgtttgtttgtttgtttgttttgagaaacagtctctgtcgctcaggctggagtacagtggcatgatctgggctcactgtagccttgacctcccggggtcaggtgatcctcccacatcagcctcccaagtagctgagactacaggcgtgcttcaccacacccagctaatttttttgtattttttatagggatggggtttcgccatgttgcccaggctggtcccaaactcctgggctgaagtgatcctcccgcttctgcctcccaaagtgctaggattacaggtgtgagtgaccacaccgaacctatctggacttttctgaggcctccagcagtggcccagaggatgaattcaaggctttagctactttcttcccttgcagattctgtatggtttattctgaggttcctaacttcagtgagccaaacccagagtacagcacccagcaggcacccaacaaggcggtgagtcctgtggccacaatggtgggaaaggagggcagatcaagacaagaagcatgggagggagcaggatctgaatatgtaatctgtgccttcaggtgcagaacgacagcaacccttcagcttcccagcctaccactggaccctctgctgcctctccaggtaaatctgttcccttctatccactggtcctcctagctctcccactctcctcagcctagaaagatgcatttccctcattccttttccaaatctctcttttctcagtgtatcctccttcacccaattctcccagacccctttttttttttttttttttttttttgagacgaagtctcgctcttgtcaaccaggctggagtgcaatggcgtgatctcggctcactgcaacctccgcctcccaggttcaagtgattctcctgcctcagcctcccaagtaactaggattacaggcacctgccaccatgcccggctaatttttttttttttgagatggagtctctgtcacccaggctggagtgcaatggtgtgacctcggctcacttcaacctctgcctcctgggttcaagtgattctcctgtctcggcctcctgagtagctgggatcacaggtgcacgccaccatgccctgctaattttttgtattttagtagagacggggtttcaccatgttgcccaggctggtctcgaactcctgagctcaggcgatctacccacctcagcctcccaaagtgctgggattacaggcgtgagccaccgcgcccagccatgggctgcagatatcttagtccagtggagcagcagggttcagtagagatatggtttaagaactagactggctgggcgcagtggctcatgcctataatctcagcactttgggaggccaaggctggcagatcacctgaggtcaggagttcaagaccagccatggccaacgtggcgaaaccccatctctattaaaaatacaaaaattagccagatgtggtggcaggagcctgtaatcccagctacttgggaggccgaggcaggcgaatggcttgaacctgggaagtggaggttgcagtgagctgagatcatgccactgcactccagcttgcgcgacagtgagactctttctcaaaaaaaaaaaaaaaagaaccactaggctataacttccatgccatttagggttcatagtccctactgtatgcaagaagcaaacctctgccttcatataacaaatgtttctagagcacctactatttgccgtggaataaaacacactacctgcctttaggggcttgtggtttatacaggagagagataatgattataatacgccatggttaagttcaatgacagtggtatgtccagagttgtgagagctcaaacaaatcatcccacacacctggcttcaaacattgaaaatataagccagacgcagcggtgcacacccatcatcctagctacttgggaggctgaggcaggagcattgcttgagcaaggagtttgaggctgcagtgagctatgatcacaccactacactccagcctgagtgacaaagtgagacctcatctctaaaacagtaaaaattaaaaaataaatatttatatacacaaaaatgtgacttgttattagctttggtgggtaagattacgtgtaataatcttttcactagctgggcgcagtggctcgcgcctgtaatcccagcactttgggaggccgaggtgggtggatcacctgaggctgggagttcaagaccagcctgaccaacatggagaaaccccatctctactaaaaatacaaaattagccaggcgtggtggctcatgcctataatcccagctactcaggaggctgaggcagaagaattgcttgaacctgggaggcggaggttgtagtgagctgggatcgctccattgcactccagcctgggcaacaagagcgaaactccaactcaaaaaaataaataaataaaaaataataataatcttttcactgatggttatctatattttctaaaatgaacattatcattatcgtacactcatacacaccttttttttaagtgcctcatattttaacgcagagacttcaggcccttccccttgccatgcttctccagttttataatcacttttggtgaaggggccttttttttttttttaattgagaaggagtctcacactgtcacccgggctggagtgcaatggtgcaatctcggctcactgcaacctctgcctcccaggtttaggcgaccctcctgcctcagcctcctgagtatctgggattacaggcgcctgccaccacacctagctaattttttgtatttttagtagagacggggtttcactatgttggccaggctggtctcgaatgcctgacctcgtgatccacccgcgtcagcctcccaccgtactgagattacaggtgtgagccaccacgcctggcccagtaaaggggcatttttgtcagaggtccctgagcctagaactaaacagctaattctaggtctgattcccaataatagtgagataactacaagagaaaaataccgtaccgaggttcatgtagcaacttcctaaatgatcgtgtaagtcttctctggagctccattcatactcgcagcccacagtcttttgcatttggtccagttggcattaagatgcagttgtgcatggtgaagactgtgccactctttggggcatggagacaggccttgggatggacccctctcctatgttaactaattcctttgtttcttctcctcccacaattagcctctgagaaccagaatgggaatggactgagtgccccaccaggtcccggtggtggcccacatccccctcatactccctcccacccacccagcacccgaatcactcgaagccagcccaaccacacacctgcaggcccgcctggcccttccagcaaccctgttagtaacggcaaagaaacccggaggagcagcaagagatagcatgacattctttcttcctgccaccaaccacatcccaagtgtcccctggagagcaagatagccttccactgattggctggtgtagcagtattttagccactgaacttcagtggagggtggtgagcagtgtccttatccaccctaatctcatactccctcattgtccagctgaactacctgtcccctgggagtcaggaccctctgcctgctctctttcctctttagaaatggcagttactggctgggcgcagtggctcacgcttgtaatcccagcactttgggaagccgaggtgggcggatcacctgaggtcgggagttcaagaccagcctgaccaacatggagaaaccccgtgtctactaaaaatacagaattagccaggcatggtggcgtatgcctgtaatcccagctacttaggaggctgaggcaggagaatctcttgaaaccgggaggcggaggttgaggtgagccgaaattgcaccattgcactccagcctgggcaataagagcgaaactccatctcaaaaaaaaaagaaagaaagaaagaaagaaagaaagaaatggcagttaccatctgtttcttctgtgtgagacatgggagtctaactgaagtctctccttcctaataaatgttaccactctactct

SEQ ID NO: 186 - DNA, 129592 bp, Homo Sapiens
tgtattaagaaagcagtttatttcttaataactgaatgtatattattttacatataattaatgatcagagagaaataacagttgctgagaacgtaaatttatgttgtactttagaattgaacagatacaaccacagattcataccaaatgcattacttttagattattaacatattcttttacataatttcatttcacatatatggagtccaaccaagatacatctggcatagtaagttttcatcagtagcttcctgtataaggtaatgcacatgtccttcaatagataacggcagtcctgtcactctatttcgagtcttgattacaccttgtagtcgctgctcaatgtcaagaacatgggtcttggcctaaaaagaagaaacataaaaccaaaaacagatgttaataatttggaattactacctttctttatattttgacatttaataaatgttaataccattttactgaccaataccccttttgtaagagcaaatacaggaaaagaagaaattaaacaaatacagttagcttgtgatactgatttggaggctcgcaagattgattcaacatcaactgcttggacatgtttctggactacgtgaaataccagggaattatttacacattacaattctagaaaaataattttttaaatctgctttggaagtgtttaggacttaaacatttcaatgaatattcaaataacaatgctgtactgcctaatatttacattatgttagtacatgcaaatgggtgttctaagtgagctacttggaactgtacaatttcttaagcatatctgaatgcaaaaggaagaataacgttattagaagaataattctcagaggtggtgctgggtgggctggtgggctgcgctgcagcccacgagcacaaagaggagggccacggggtggagactgttgctgtgccatctgccatcgacttttccgccaagagcctggactccaaatatgacttatgttccagcagaactccaggtattaaaataacccctacaacagccaactttcccttttgcagttgcaaaccagctgccgcttatttctttggtgaagcacttgagccatgtgcgtgaaccaaacccagttcattcaagacagtgtttaagttactttgccagacctttatcaaaatggggctgctgtcttctttcacttgtgacaagtttagctcattgagactacatcaccacagagctattactcacttaatgaggtccactaaagagagagttcatcaggatccttgtgaggctatttctcatatccagaaaatcagatcaagggaagtaccctttgaagcacaaacttcacgttacttaaatgaatttgaagaacttgccatcttaggaaaaggtggatatggaagagtatacaaggtcaggaataaattagatggtcagtattatgcaatttaaaaaatcctgattaagggtgcaacaaaaacacattacatgaaagaactacggggaatgaaggtgctggcaggtcttcagcaccctaatatcattcgttatcacactgcgtggacagaacatgttcaagtggtccaaccacaagcagacagagcttccgttcagttgccatttctggaagtgttctccgaccaagcagacagataccaatacggtgttaaaaatggtgaaaatagcagctcacccattatcttcgcggagctcacctcagaaaagaaaaaccctttgcagaatctgacactcaaaatcagaacaacaagctgtgaactacaccatcaattccgtcttaagagacaccagtgaatatgaatcatccctggagctccaggaaaatggcctggctggtttgtctacctggtcaattgtgaaacagcccctgctgctcaggtgtaattccctcctagaggagaatttcacatccactgaggaatcttccaaagaaaacttcaacttgttggggatcgaggtgcagtaccacctgatgctgcacatccagatgcaggtgtgcaagctccagctgtgggactggctagctgagagaaacaaacagggccaagagtgtgtgggcaagtttgcctgtccttatggccagtgttgcaacaaaaaattttcaagatttagtggaaggtgtgttttacatacataacatgggtattgtaaacagagatctgaagcctagaaatatttttcttcatggccctgatcagcaagtaaaaataggagactttggtctggcttgcccagacatcttacaaaagaacacagactggacccatagaaacagaaagagaacaccaacacctatatccagagtgggcacttgtctgtatgcttcatcccagcagttggaaggatctgagtatgatgccaagggtctcactctgttgcccaggctggagtgcagtggtgtcatcatagctcacagcagcctccaactcctggggtcaagtgatcctcccacctcagcctcccaagtagctgggactacaggagtgtgccactgagcccagctaattaaaaaaaaacaaaaactatttgtagagaccagggctggctttgtccagttagatatgtatatagcttgagtgtgatcctgctagagctctttcagctgtttagaacagaaatggagcgagcagaagttttaacaggttcaagaactggtcagatattggaatccctcagtaaaaggtatccagtacaagccaagtatatctatcacttaacgaaaaggaacatgtcccagagaccatctgctcttcaactgctacagagtgaatttttccacaattctggaaatattaatctcaccctacagatgaagataatagagcaagaaaaagaaatttttcttttagttcttttagaagaactaaagaagcagctaaaccttctttctcaagacaaagggttaaggatgacatgaaggatgggggcgtacaggtctagccttcctcgagctatatcagtaggatgaaagtggacttaaactctttaggtagttaactggaatgtaaatttttaatctttattagcatatagttggtataattcattgtatttagtaagcctgtacaagacttattaaagatgtaagagtgccccccaccaaaaaaaacgaatcctcaatctattctaacttattaaaaacaactatctgagctaggcacagtggcttatgcctataatccctgcattttgggatgctgaggtgggtggatcacttgaagccaggggttcaagaccagcctggccaacatggtgaaacccatctctactaaaaatataataattagccagctgtggtggtgcacgcttataatcccagctacttgggaggctaaggcaggagaactgcttgaacccaggaggcagaggttgccgtgagccaagatcgtgccactgtactccagcctggatgacagagcgagactctgtctcaaaaacaacaaccaccaccaccaccacaacaacaacaacaaaactatctgcaaactttgcagcttcaactaagtaagaagtgaattgctgcatttgttaacatagcttgtgacatactggtatcatgatattaaagctcagacctgttgttctgtaagttcaggcaatttgtactatagtttttcctactgtatctcataactgtgaattgtctatggttaaacaagtgtgccatgaacttttattatacaaatgcgaatactgttaacattactgacaataaagaaaacttatggcattgtgatactagagaactagatttcagagtaatcaatagtcactaacagtatttccaagcagttctcatgcatagagatgagaactatagctgcatatcaagttcatttgtagagatgaggactacagcccatatcaagctataccttctactaaccttttcattgacaacttctccagtttcattcagtggcgctttggaatgccctttcactggtttactccattccacaagaggatcatgtagaaaagtctttaagacactaaaattgaaacaaatattatggtatgatgttatctttgcaagaagaaatcttgctgacatcaatatttaagtgaaggatgagaagctaatggtaatactcttataatacacattactacgtcttcattaagttatgtgaaatttctgttttggtgtgaggggagggtaagagaagggaaggcaggaaaaaaggcaagatagaggggagtcagaggtgttttggagaatagagtaagatgggttctatgtgccatctctaagtgtatactgtgaactggtaaatgactatattttgaatgaaggaattttatcccttaccatgtcttcaataacgatataacatctatagctaccatatagacctagcccagaccttttttctgcaccctaaacatcaaatccaattacctatgggaaatacccagttggatatgttccaaacacctcaaactcagtatctccaaaataaaattaattaccttttcccaactatttctcctgtattccccaaatcatcatccacccatttgccctagacaaaaatctaggaatcatcctcaccccgtcttcctctaacatgcaattacaactcctaaatctctttggaatctcttcagttatctccgtctctacggccgtgacactatccagtacaccatcatcctttcctgggttactgcaataaacctctaactagttttctggctgttggcccaaactaggaccctattttttctacagtacaaatcagattatctctttccaccccttgccccctttttattccttcttaaaatcctcaatgacttctggttgctctgcaggcaaagttataatgtagtaacaggccccatgtgagaccttcataatctagcccctgcttacctgtcctgcgtcatctcttagcaccacctcctggaagtataccctctggaatacatactgtatttctcaggcaggccatgacttcacttgccttgatatttttatcactcagaacactctcttctcccttgcatggtcaactttattaacttttaaggtctcaactacttcctccagaaattatttcttgactgacccagactaacacaggggctcttggtaactgttccacatgatgatatacttcctatttcagagaatttgcttttgcatatgtccaactaaccagtattctaccataatgtctgatagacagctttttttttttttttttttttttgagacggagtctcgctgtcgcccaggctggagtgcagtggcgcaatctcggctcactgcaggctccgccccctggggttcacgccattctcctgcctcagcctcccgagtagctgggactacaggcgcccgccacctcgcccggctaattttttgtatttttagtagagacagggtttcaccgtgttagccaggatggtcttgatctcctgacctcgtgatccgcccgcctcggcctcccaaagtgctgggattacaggcgtgagccaccgcgcccggcccgatagacagcttttaaataatgaaggtgaataaataagctttaaaagtcctttcaaacaatctgtttcccacagctaacatcatacttaaaagtcaaagactgactgctctacccctaagatcaggaacaagacaaggatgtccacttttagcatgtctattcgacactgatttagttagggcaagtaggcaagaaaaagaaataaaaggcattgatattaaaaaggaagaagaaaaactgtatctgcaggtgacatgttattgtggagagaaaatcttaaggaaggcacaaaaataattattagaactaatacatgaattcagcagattgtaagatacaatatcaatatataaatatcaattatatatctatgcactagcaatgaacaatccaaaaatgaaattaagaaaaattccatttagaataaaatcaaaaggaataaaatacttaggaatacaatttttaaaagttaaatataaaacttgaccctaaaaaccacaaaacattgatgaaaaaaataaaattcaaataaatggaaaaacattctatgttcatcgatcagaagacttaacatggttaagacagcaatactcccaaattgttaagacagcaatactccctaattgatttacaaattcaatgtccttcctatcaaaatccaagctgattttaaaattaatatggaaatacaagggacccataatagctaaatgatcttgggggaaaaaaagcaaagttggaacactcacactttatgatttcaaaatttactacaaaggtacaacaatcaaaacactgtgttgttagcataaggttaggcatatagatcaacagaatattgctgaaaatcaattgaccatttcaacaaaaaagccaagataattaaacgaggggcaaaatattcttttcaaaaaatggtgctgtgactaatggatatgcacatgcaaaaaaatgaatatggacccctaccttacaccatatctacaaaataactgaagacagataaaagatttaaatagcagagctaaaagtcaaaaatgcttagaagaacacataggtgtaaatcttcatgactttggattagggaatagtttcttagatatgacaacagaaacaccaaaaataaccagaagaaaaaaacaaattagactgcatcaaaatttaaaacttttatgtttcaaaggccatcatcaaagaaagtgaagagacaacccacagatggaagaaaatatttgaaaatcatatcttaaaaggtcttgtatccaaaatgtgtaaagaactcttgcaacttggctgggcggggtggctcatgcctgtaatcccagcactttgggaggctgaggaaggtggatggcttgagcttacgagttcaagaccagtctgggcaacatggcaaaaccccttctctgctggggaggctgaggcagggaaatcacttgaacccacgaagcggaggttgcagtgagtggagatcacgttactgcactccagcctgggcgactctgtctcaaacaaagaaacaaactcttgcaactcaagaataggccaggcatggtggctcatgcctataatcccagcactttgggaggccaaggtgggaggatcacttgaggtcaggagttcaagaccagcctggccaacgtggtaaaacccaatctctactaaaaatgcaagaatcagccagacatagtggctcatgcacacatgctgtcccagctacttaggaagctgaggcacgagaatcgtttgaacccaggaggcagatgttgcagtgagccaagatcacgccactgcactccagactgggtgacagagcgaaaccctgtctcaaaggaaaaaaaaaaagaataaaaaaacccaatttaaaagtgggcaaaggatttcaatagacatttgtccaaagatgatctacaaatggccaacaaagacatgaaaagatgctcaccatcactggtcattagggaagtgcaaattaaaaccacaatgagatacaacttcacatccctagaatggctaaaataaaaaaggcagacaataaccaggatagataaagatgttatctaaagatagaaaagatgcagagaagttgaaacccacatacattactagtgggattataaagtgttacaactgctttggaaaatgatttgagagttcttcaaaatgttaagtacagcatttaacatatgacccagcaattccactcccaggtatacacaagagaactgaaaacatatgtccacataaaacttgtgcacaatgttcacagccacactatttataatacacaaaaggtggaaacaatccaaatgtctcttaactgatgaacagaaaaagaaaatgtagtatatccatataacaggataccatttggcaataaaaaacaatgaagtactgatacatgatgaacactgaaaatattacattaagtgaaagaagacaaacacaaaaggccacatattagatgattccatttatatgaaatgtcctgaataggtaaatccatagagacagaaaatattataaatgagtggttacaagtagatagcaggggtgggagggggaagggatcaggagtgactgctaatgcctacggaatttctttttgggctgatgaaaatgttttaaaattagatagtggtaatggatgcacaatcttgtgaatatactaaaaaccactgaattatgtacttttaaaggggtgaatttatggtatataaattatatctgcataaagctattatttaaaaaaactatttcagtcagtacaaagtggtttctacataaaaacaaacatatgtaggggccaataattatattcgaggttactgttaaattatttacaaagtataggtgattacctcattaaaggctctcgctgatcacgcatcagcctcattgtaacttcacatgctcttcgaaaaagaccctctgttcccataggacccattccattaaccatattatgagtcaggcgaaatggcacaatttctggaacttcaaaggtttctcccttagaaacaatacattttattacaaactaacaatgttagaatttaaaaatctttactcaaagaacttcatgtccagattcttttagcaaaaagcaaaaataccctcaaaatatttatgttgtaattactttagaagtttgtaacatgaaggagccatgtagctctgcctttgcttttacagaactgaaaccatacttgatcttggataagatctaggagataagtggacttacctttcactgagtttagtacagtgaataagcagtattacagagaaattttatgcattcaatatttagtctcatattaacttctttaatgtctttcttgaataatatgaaatacaaatattctcatatatttctacttttctttaacactttcatcttaaaacaacagaagcagccaagggtcagatgctcacatcccctcataaaggaaataaaacatgtcatataatgaagtccagttgttcattttctgctgtcctctaatctgccttttctagggacctttcatcccttgtccaatcagttaccctaaattcctctcttgtatggtttaacccatgccagtattttatctctgatttgttctcagttggatctatgatctttcttggtttcttgtgacagcacaaggcaacctgtagatgatggaggtgaagaaaatagtgcgctaacctaccagtctgccctgcaggattataatattggaaaattgtagggggccttaaagatgggtccaattgcctcaatttattcccaggtcccactctggacctacagaatctgaatctcctgggtatctataaatttttttttaattcttggataattctgatatgttgctagaattggaaactatcgtattaaactactctgtctctctaaaactgagtctcagtaaaatgaactgatctgcccttattcacataactaataactaattgagtcagaacctaaacctatgctcttggacttcaaattcagtactagctttacagtatcactcttctaagttctctccatcctaatacgcattactacatgatccactgatgaaaactagtcaacaaattctcagtataactcaactgtgagtataactgctactaacaggtatgtcaaggaagatacagttgttgagaaaaggaaattgagagaaaacacaattagtaagagtaactcatatcacataccttattgaaaagacaattgaaatctacatgtacgcattcaccagtcaaagaatcaaagagaatattttcaccatgacggtctccaagccccagaatataaccaaccattgacattactgcagtggaacggcagtaagctgatctactactgtacctaaaagaaacacaatgcctatgaaatatccatatacatatgaggccaatataaatctaaaatattaaaaataaacattcaaccataacaacgtattatattcttggtaacttaccatgatgtaggatcagggaatgttctcagaaaccactcatgaaaaataggaggatgcctgggcaggagaaattctcggaatactttgagtttttcagataaagctgctgactttggtagcatacactggcgaagttcttttcctgtcatatacactcctgcaaggaagagtgatatccattaatcacatcagccaaatgaaaaaaggggcaaagttttttttgttaaaattggacaagaaacatctacttttattcaaattgttattgaaaaacaagaataaaggaacatttttcaattaagcatacataaagttactgattgtataataaaataataaaccacattatcttcccttaatacagatgacccttgaacaacatgagtttgaactgtgtgggtccacttacatgtgatttttttcaaccaaacatggatcaaaaacatgggatgtaaaatcagtatatactgaaggctgacttttcatacatgcaggttctgcagggctgactgagacttgagtatgtgtggattttggtatgtgagggtattctggaagcaatcctccagataaggagggaccaccgtacttacccaagtgaagcctcttattgatgaaaattaatgtcagttaaaaccagtgttgtgaaatcaaatagttccagaatacaagactcaaaattaagtcccatatgaatgaacttattttgcatatatgtgtacatatcaatatatatgtatatatacatatattttttacactgacacaaattatcaagaaaaaatatattttcaaatccaaactcagacatatacaatatgtcatgctcataaataaaatagtcaacagcaagttctttgaactctgactcaagtgtctctgagtttcagttttgcaactgtgaacttagacaagttacgtaagttctctggcactgtccataaaatagggatggataatcaggcgtgttaacaataataaataaaataatgtacataacatacttggcacaatacccattatatagtgatttatcagtattacttaatgttataaattgaactttatctctcaaaaaaatatgctgaaatcctaattcttggtacctgggaatgtgagcttattcagtaacaggatctttgcagatgtaatgttgttaagataaagtcattaaggtgggcccttaattcaataatccagtgactggtgttcttatgagaaaatagagacacagagacatagagagaatgctatgtaacaataaaggcaatgtggtacaatacatccagaagccacagaacaccagaaggttaagagaaaggcaaggaacattagccttcagagagatcatggtcctaatgacaacttgatattgtatctttagcctccagaaccgtgagatgataaatttctattgtttaaactcgcttagtttgcagtaatttgttatggcaaataccatacaaattatgtatgaaaacatatacttattttctacttcactttgacaacttgatctattcatttttaatgtattacaccatatgaactttaaaaacgtcttattttaaaacaagtttagatgttacaaaaagttgcatcaatgatacggagttcccacatattcttcacccagctttccttaatgttcatatcttgcgtaacaatagtacaattattcaaatcaggaaattcttattattacagtattattaaccaaacctctgaccttattcaaatttcaccagctgtcccactagcacactttgtttaggggtcaggatccaatccaggattacacattacatttagttgtcatcaaatgtcaactccttaatgtcatcaaatctgggaattcattactttgacatttgtaaggagttcggaccagttatatttatatttctctactgtaaagttactatacttttccctttataattgttaagtatctgatagggagatacttcaagattcttcaaataacctgtttctcatcttttgcctattaattttagcatccattaataatcactgcctgcaataataattactatagtgtttgctaattgctgatttcccatttccatcatcctttctacatttattcattgaaattctattagtacataaggaagaactattcccacttccctatttatttatttactcaaatatctgtttatatcagtatggactcatgtttatttgtttattccatgggttataatagtttacaatcattatttattttgctactcaaattatcccaggtttggacagttggagcctcttattccaatctaaaacgtcagacttcattctagccttctctccttcctttctccaatagtgagaaaactggctctcattatacaacatatttacttacttgctgaagactagtactgtatatacatagtttcagaattgttaaccaatatctgtgaaaaacaaatattcatatatagttttgtaagctacctcaaatcctgttgggatgaagacagggaaggaatcaaaatggaaggaaggaaggaaggaagaaaggaaggaagggatggaaacacttaagtgtttctgtatataaaatctagaaatttcactatagcttatatcaaaaaacatatgctagcatatattaataccaattatacccatattatataacttagtacccacactgtatatgtataagaattaattttagtacccttttctttatatagtttggtcagaataggtctcaaaccagcagtgttgttcacccattcaataatcccacattcatcatttagtggaataactgcatatgttcgaatatgaagttctcttctacgagactctgcatcttttcttaagcactgttaaaaaatacacataaatttaaaaacaagatagaactcaaaatttctaaatgttatatcaaatatatttaaagattgttcatttcataaccaaagaatgtcattgaaggcttactatgtggtatacatgaataattcttctgaatggtaggaaggaagctactgggacagtatctctaatctatttacagattattaaaaatgtcctgggtaggtccttctttttaattattcactattaatgtgacaagaatattgtatttaaaatatttaagttgtatatttaacaatgacaaaatgctgctgttttattttctattgctttataggtattactgaaacattaagtctttaggcacagagactgctatttaatttttcttttttttttttgagatggagtcttgctctgtcgcccaagctggagtgcagtggctcaatctcggctcactgcaaactctgcctctcgggttcttgccattctcctgcctcagcctcccgagtaggtgggactataggtgcctgccaccacgcccagctaattttttgtatttttagtagagacagggtttcaccgtgttagccaggatggtctcgatctcctgacctagtgatccgcctgcctcggcctcccaaagtgctgggattacaggcatgagccactgtgcccggccaattttaattatttctaaaatacataaacaaaagagcatgagttctatgacatcctcaaaatgtattgctcctcttgcggtttatcacaaccttatttctaaagctatcccttagcagaagaaagccttacatatttcatctgattgatcctgatatatcaggtggaaataaacagtattatgtttaattctagacctgtatgaagtaagcacacatctgtaattgtaacctgctcaattcaaaagcacaatcactgatcaaaaatacattttactttaggaaataggttccataactaccaggaaaacaatatggccatagaatctcatataaagatcagtgtgtggcctccaaaactaacatagttttttacaaaactatgttagtaaatatgttactaactaagttagtatgtcaggctattttattttaccatgtttatgagggaaaatgtaacaaaatactttaattaaagtaacaaagctgattaatgtaaatttataaactaaagccaggccacttgatactcaagtaaatctgatactcagaaaaactcagggagctttggagagaacatactaatggttcagtagttagtgaattaaggtaccattttaacaaacaatacttttttgttgttgttgttgagacagaatctcactctgtcacccaggctggagtgcagtggcacgatctgggctcactgcaacctccgcctcccaggctcaaccaattctcatgcctcagcctcccaagtagctgggaatactggcgtacaccaccatgcctggctaatttttgtatttttagtagagaaaggtttttgccatgttggccaggctggtctcgaactactggcctcaagtgatctgcccgcctcagctgggattacaggcatgagccaccacacccagcccaaataatatgttaaaataaaaaataatcctccttttcatattgcttttgaaatagctttttaatgtggtattaatttttaaattacttttggttaaaccaagcagactataactttttttaaaaaacaaactcatctactgctatatcttttctatgctaaagatctatgactttaaaatgtgggaaggcaatgagaagaagggaaaaaaagcttgtagaaaaataataaagtttcatctttccacagtatagatcaatttttaccaatggaaaaagacatacactatgcatctacaaatacctggttacagaataattcaaaatacataaaaccatacatttataataaccctttaataagattcctcatatcatctttgagatagaaatcaaataccaacagaactgaaaaaatgctaatgattaccttttatttatctatttatttatttataagagtcagggtcttggctctgtcatctgggctagagtgcagtggcatgatcatagctcactgtagcctcaaactcctgggctcaaacaatcctcctgcctcagcctccttagtagctgggactacaggcatgtgccaccatgcctggctaattttttttattttttgtagagacagggtttcactatataggccaggctggtctcaaactcttggcctcaagtggtcctctttcctgggcctcccaaagtgttaggcttacaggtatgagccactgcacccagcctatttatcttttgataaatatattaacacaatagccaaaaggtagaagcatccaaatgtccatcactggataaatagataaataaaatgtggatggaaaacaatagactattattcagcttaaagagggagaaaattctaacacatgctgtaaaatgaatgaactttgaataatgccaagtgatttaagccagtcataaaaggagaaatactgcacttatatgaggtacctcaaatggttaaattaatggagacaaagtaaatggtggctgctggaggctgaggagaagggaaataggaagttaattgtttcatagacacagagttccaatttgggaagatgaaaaaagttttggagagggatggtggtgatggttgtacaacaatgtgaatgtacttaatgccactgaacaatatacttcaaaaactgtcaaatgttaagttttatgtatgtacattttatctcaataaaaaaattaagtgaaaatgaaaaagactttatatttcattcctgctttttaagagtgatctgtttgtatactaaaatgcctatatcagattgatagtaattatagcaactctgaaataaaagcaatctggttttataatagtcaaaaatttttttaaaataaaaaataaataaataaaataaaagcaaactatctcccaaccttattaatcaaggaattgaattccattagtctacaatcctttctcaggtcatcttttggcttacacatcatgatgtagaactttccatctgagccttttaaagaaatcttctttggtttctgaagagaagcaagaatttccacctaaaagatgatgagttatatatgaattagggccaaaaatttctgtgtaaatgtctatatattataaaccttgagttatgtaaaaaaaaaaaaagaatattaccagctatattatgtagtgaatttgtattttaaaaatcttttattttaattatctatgacctatgaaaagaatgactgtctatgaacagaaacattttcacccattaaaaatagctatgacataaaaagattacttcatcgccaatacaagtacttacatattcaaatttagacaccccccttcaaagcagtcaaaatgtttaaaagatttttgaaacatcttttcaggatctttctgcggagcctgagactctgtttttcaagctttatcaattaaaagtagtttgatttttgaaaaaacaaactccttcaaaattaagtgtacctaatgaagtgagtaaataagatgaataatactgcttaaattaaaaacaaagcatagactgggtacagtggctcatgtttgttacactaacacttgggaaggctgagcaggagaatggcttgagcctaggagttcaagactagcctgggcaacatgacgaaaccccgtatctacaaaaaatttaaaaaattagctgggcatggtgacatgcacctgtagtcccagctactcaggaggctgaggtgagcaaattgcttgagcctaagaggcagaggttgcagtgagctgagatcgcaccactgtattccacccaacccgggcaacagaatgagaccctgtttccaaaaaaaaaaaaaaagaaaagaaaagaaaaatcaaattgtgaaaaaataaagattatagtcatactaaaacaacaggagcatttgaaaaatcaaaacgttacggtgaatgtgaatcatgaatcagaactttttttaatcactgaatttttttgccatcagtacaaatgagtttagttttactcttctgtatttccaattatttttcttcacaaataagattcacgtagattttgtgaaatacactttttatcttaatttgaagtttttaacaactaaattttaaaatcatagtcatataaaactgaagtttaccatatcatcaaaccctgcaatataggcccaatgtccaggaaatggttcatggctagcatggttagcatgggtacccagaattgatggaagtgtaggtatcatgactgattgtagaggaatgaggatttcactaaatgttgcttcttctaccagctttttaagcattttaaaatgagtgctcatgcttaatgtggaactacttccatcaacctgaaaaaataaatagtgcattttaatttgtttttaccttaaattccactataacaaaaatttcacttttacaatattttgattacaaaggttcagcagtctgtggttttctaagtatttcctaatcatcccattttaacctctgtcatttacctcattaataatagtacctacatcataggattgtttaatgattaaaggagagagtagaggcctataatctattatcaaatattagaaaatccaaagagctctgtaaattaaactctcactgaagaaacagttatgtgtttgattatgggatactccaacaggttaccctcagtggaaatatcaaatattaaatatgcactaaaatcttaaaaatcctaaatttctaagtgtagcttgccacaaaggtttcagataaagaactggaaacctgtacatgtaaagcacttacaacagtgttagtgttttaataaatgttggccaccataacactgtttttgataatgtcaagtgcatcagaggtcaaatgggattaatggagataataaatgcagattacccttttgagatgtttattgataaaggaaaggtgagaaatagtctgtatcttttcatctataaacactgatgcactctgaatatttgtcaagtgaagtctagctatgtaccttattaaagaacttctctctccctccttataaccacccccacctcccacttttatctttcctatacatccttgggggtttttctctaatacttaggtagaattatggggttactcctgtaaccatgttcctactttagtcacaaatctaccgaaaaaagtacttattactctagataaccatctgcttagttccctaaaagactgtaagcacctcaggcatgagaatagattttattcatcttgtttcccttagcatagtgcttgtcccctcataggcactgaaatgtgtactaaaagaatgaaaagcaaaaccccaaccctcttccctatcgtaagtgtagtttaataatgtatatgaattttgaaagtttaaagatatgatataatcatagactaccataagtaacttagaatattttacatacttatatttttatggcttatttcatattctctactaaaaattgctgagaaacatggatatctactctcggaaaattcttaattcacactaagaagaacttttagaaatattagagggtatttggaagtaagatgtattagaaatattaaaaactgctttattaagacaaatcatacataattaaaatatacattttgatatatgtgtacacctatagttagaattttaatttaattaatcaaatgaaaaaatctgctcaaattatatacataattacccaacatcagtttataagcactaagattatgatagtaccggtttattgcacaattctagaagcttatctgttaggcgagttgcatctccaacaaacttctctaaggattttttcatatgaatagctttattgaggatttccttgcatctgttcacacgcatgggataagatgactgtcataaaaaagagttaaatgtcataaaaaagagtttatacaggatttttaaaagataaattttttgcttgacaaaaaacttaaaaagtattcatgatgagagtttatatgatacaaattttctgaaaatttatttggcaatgctatcaagagccatacaaatattgccaccctataactttgtgaattataaagttatagggatctgccctggagaaataattacaagtgagaataaacatagacatatctagatgtgttacaattgcaagaaaaatagaaataaccttaatgattaactaaacagttaaataagttattgaaggctattttttagaattttatatattaaaattatatcttcaaattatatttaataacatggaaacaataaagtgaaaaatatgaaattgtacggcaacataattaaatttagtgttaaaatatgctagaaaatatacaaataaaattacatcaaaacattaatgaatggcccaaggtgtgaattttaatttttgttttatgtctctgtattgtctaaattctctaaacatttacttattacatatattgaccaacatatgaattcccattaatgatgcaataacggttttttagtattaataattcaggtactggcggggcacgatagctcatgcctgtaattccagcactttgggaggccaaagcagaaagatcacttgagcccaagagtttgagcccagcctgagcaacacagcaagatcccatctctacaaaaagaatttaaaaattaactgtacatggtgacacaccgctatcatcctagctactgggaagctgaggcaagaggatcacttgaacccaggactttgaggctgcactgagctatgatcccaccactgcattccagcctgggcaacagagaaagatcctgtttcttaagggaaaaaaaataaaaattcaggtagtttggattaaaatatttgtgaaaacataggtaaccattttgcatcaagcattaactgtttactagacttcataaagaaaacacatgctgaattatttgatcttaaacatactagttacttcatttcatatggtaaatatatccaaatattaagatataatgctataaatttctctctttaaaaaaatatttaaaattactaatctaatacaggagagacgccctggaacttgtatctacatattagtattacataatcaagttcatataaaatggtaaaagatcttttcatataaaaaggtaaaagacccttttacctttgacacagctgtcatcatccacattgcttgttgaggataggctagaaatactttggctattatttccatcaagacaacaaaaacttcatcgtgagaatgacaaattcgagagatcaattgtgaaaaagcagtcaaaaattgatatggagctaaatagtttgtatgctctgtgataaccttgtttattttacccaaatcattcctcatttgtacacgatcggagcggccagctgggggaagaaataagtttaaaaaacaataaaggaaagagaaaaatcagtatatcagttcatttcacagaagaaaaattttgctttaaaaatagctttaaagtatgttattcccatgcccaaggttaggtcacttgccaatttgtgaaaagatagttgtctctgtccaaccagaaaaaatatttagagccattcaaaaacccaagggacattaattttcactatccattttaatttttagggtaaattatttggctaaaactaacacattttaatatgtgttagattcattaagaaataatcagatttgtatttgtggccctgaattaaaactactttaaaagtctatgatttgtctttcctttttaacatttagtatcttactcacacttacataatatcttaattatcaaattcattccaagcttctaggaaattagactgtccagccaaatctgactttataccaaagttataattcctagtcctttaaaacttttacgtgaagagttatacctttttcccattcatatgcctttgtaccataatcaagccatagagttaacattcgtggcattgactgatatatgaactgatttccatattgtagagatctgcaattatatagacaagaaacactattagcatagctgtcatttttatattatacgaattaaaatttaaagattcaaactaccacataccgttttcacaaaaattatggtatcaatatttcttcctagaagttatttttgactcctctgtctcctttttagctcacttagttctacattccctgtaccaaaaacatgtacatactgtatgtttccacttacagtatacagaatttgtacattatacaaattctgctctaatcaaagtctatcaatacttctttcaatttttccttaggatctctgtgccttcatttgcattctttggccataagcctaggttaggtccaatcattctatttctgggaaattataataacttggtcaccctaaatccatatttctacccttcagtaaattccagactaacattcctgaaattctggctttatcatgctctccccttattaaaaaacaggaatcaatacctacatattaaaactatataaatgattctgcctgggattcaaacattcagaatcttttatctccataattttccaatcttagcatcttgccactcaccagtatacatcttccatcaggtctagtttctgcaccatcctacaaaccaaccactcaacgctgtttctggtaaaatttgtgaaaagttaaagttctctccttcttgaattttttaggggcctggacatcagtttattttcaaaagaaattttattgtggtaaaacatacataacataaaatttgccatcacaaccatttttaagtgtacagttcagtgttatattaatatggttgtacattcacattgttgcgtaatcatcaccaccattccccctccagaacttttttcatcttcccaaattggaacctcgtacctattaaacagtaacttcccgtctccttccccacccagtctctggcaaccaccattgtactttctgtcttcatgaatttgaccattgaaggtacctcatataagtggaaacatacagtatttgtcctttttgtgactggcttatttcacttagcataatgtcctcgaggttcatctatgttgtaccatatgtcagaatttccttcctttttaaagcagaataatattccattgtgtctacatcacattttgctgatcaattaatctcccaatgaactcttgcactgctttcatgttttagctattatgaataatgttgctatgaacacgaatgtacagatatctttttgagacccatagagacagtttaatgacatagaattgcatttaccattctacaactatagaagaagtggggactttcttttccccttcttattttgtcaagattaatttaaccagaaattaggagagctagcaggtttttttaaaggtgcacaacataatgtttttgtttttaaacatttcatttatttatttaaatcaacaaataaaaattgtgtatatttattgtgcacatgttttgaaacatgtatacattgtggaagagctaaaccaagctaactcacgcatgctaattatttcacatatttattttgttgtggaataaaatctattctcagcaattttcaatacaaaacatttgttaactatagtgaccatgttgtagagtagatctctttaacttattccttctatttaactgaagttttatgtcctttgaccaacatctccccaactcctcactactccaacccctggtaatcaccattctactctctagttctatgagttcaacatttttagattctacatataagtaagataattcagtattaatctttctgtgccaggcttacttcacttagaataatctccaggttcatccatcttcgcacaaataacaggattccttcttttttaagcctgaatagtattccattgtgtgtgtgtgtgtgtgtgtgtgtgtgtgtgtgtgtgtataagtatacatacatatgccacattttctttattcattcccatgttgatggacacttagtttgattccatagcttggctgttgtgaagatgctgcaatgaacatgggagtgcagatatctcttcaacatattgatttaatttcctttagatatataccccataatgggattgctagatcatatgatatttctatttttaatttttaaggaatctccatactgttttccataatggctctactaatttaccttcccaccaacagtgtataagggttcccttttccccatatcctctccaatgcttgttatcttttgtcttttatatgatagccattcaaacaagtgtgaggtgacatctcattgtggttttaatttgcatttatctgatgattaacgatgccgaactttttttatatacctctgttggtcatttttatgtcttcttttgaaatatgtctgctcagacccttttcccattttttttaattgggtaatttgtttccttttttctatttttatttttattttttcagacaggatctggctctgttgcctgggctggagtgcagtgatatgatcctggctcactgcaacctccacctcctaggctaaagtgatgcccctgcctcagcctcctgagcagctgggactgcaggtgcataccaccacgcccgaataatttttgtatttttttgtagagatgggggtttcaccatgttgcccaggctggtcttgaactcctgggctcaaacgatccatctgcctgagcctctcaaagtgctgggattacatgcatgagccaccatgcctggccaggtgatttgctttcttactattaagttgtttgagttccttacctattttggctattaaccccctatcagatgtgtggtttgcaaatacattctcccattctataggttgtcttttcactctgttgattgtttccttggctatgcagaagtcttttggtttgtataatatcatttgtctatatttgcttttgttggctgtgctttttggttcatatccaaaaaaattattgcccaaaccaatgccatgaaccttttcctctatgttttcttctagtagttttacagcttcaggtcttacatttaagtttttaagccattttgagttgatttttgtatatggtgtaaggtaagagtgtaattccattctattgcatgtggacatccagttgtcccaacaccatttattgaagagactgtcctttctgcattgtgggttcttggcacctttgtcaaagatcaattgactgtaaatgcgtggattcatttctagggtctctgttccactggtctatgtagccattttaatactaatgtcatactgttttgattattatagctttgtggtataattttgaagtcaggtagtgtgatgccttcagctttattctttttttttttttttagagacatagtctcagtctgtcacccaggctggagtgcaatggcacaatctcggctcactgtaacctccacctcccgggttccagcaactctcctgcctcaacctcctgagtagctaggattacaggtgcatgccaccatgcccagctaattttctgtattttagtagagatggggtttcaccgtgttgccctggctgatcttgaactcctgagctcaggcaatccacccacctcagcctcgctatgattacaggtgtgagccaccacgcccggccagctttgttcttgctcaagatttctttggttatctgaggtcttttctaggtccatacaaattttaggatttttttttctacttctgtgaaaaaagttattggatttttttttttttttttttgagactcccagtctggagtgcagaggcacgatcttggttcactgtaacctccgcctcctgggttcaagcaattttcctgcctcagcctccctagtagctgggattacagatgtgtgccaccatgcctggctaatttttgtattttcagtagagactaggtttcactatgttggccaggctggtctcaaactcctgacctcaagtgatccacctgcctcagtttcccaaagtgctgggattatgggtgtgagccactgtgcccagccagaatttttaaacaaaacaaaacaaaaaaaaaaggaaagaaagaataagctattggaattctgatagaaactacattgaatctgtagatcactttgggcactatgaacattttaataatattaattcttccaatacataaacaggatatctttccatttgttcatgtcttcttcaatttcttttcatcaatgttttatagttttcattgtataggtcttttgccttgtatttattcccaagtattatattttatttttgtagctactgtaaatgagattgtcttcttaatttatctgcaagtactctgttattagtgtatagaaatgctacttacttttgtatgttgcctttatatcctgcaactttattgaattcatttatttgttctaatagtcttttattggagtcttagggtttcagtatataaaatcatgtcgtctgcaaatagaaaaaaattgatgacttcttttccaatttggatgccttttatttatctctcttctcgaattgctatggctaggattcctggtactatattgaatataagtggcaagagtgggcatctttgtcttaatcttagaggaaaagctttgaacttttcaccactgagtatgatgttatctttggggttatcatacatggtctttactgtgttgaggtacattccttctatacatattttttttttaaaaaaagtttgtttttttttaaaaagcctcttttattttaaaaaacaaaggaatgaaaaacacaaaattgggaatagtggttgcctccagggatagaggggtgacataaaggttagactagattaatggatgttcattctattattatgctttacaacttatatacatgttatgttttatatatatatgtttttaattatactttaagttatagagtacatgtgcacaacgtgcaggtttttagatatgtatacatgtgccatgttggtgtgctgcacccattaactcgtcatttaacattaggtatatctcctaatgctatccctcccccagcccctcaccccacaacaggccccagtgtgtgatgttccccttcctgtgtccaagtgttctcattgttcaattcccagctatgaatgagaacatgcggtgtttggttttttgtccttcgatagtttgctgagaatgatggtttccagcttcatccatgtccctacaaaggacatgaactcatccttttttatggctgcatagtattccatggggtatatgtgccacattttcttaatccagtctatcattgttggacatttgggttggttccaagtctttgctattgtgaatagtgccgcaataaacatacatgtgcatgtgtctttatagcagcatgatttatattcctttgggtatatacccagtaatgggatggctaggtcaaatggtatttctagttctagatccccgaggaaccgccacaatgacttccacaatggttgaactagtttacagtcccaacaacagtgtaaacgtgttcctatttctccacatcctctccagcacctgttgtttcctgactttttaatgatcgccattctaactggtgtgagatggtatctcattgtggttttgatttgcatttctctgatggccagtgatgatgagcatttttttcatgtgtctgttggctgcataaatgtcttcttttgagaagtgtctgttatatccttcgcccactttttgatggggttgtttttttcttgtaaatttgtttgagttctttgtagattctggatattagcccttcgtcagatgagtagattgcaaaaattttctcccattctgtaagttgcctgttcactctgatggtagtttcttttgctgtgcagaagctctttagtttaattagaccccatttgtcaattttggcttttgttgccattgcttttggtgttttagacatgaagtccttgcccatgcctatgtcccaaatggtattgcctaggttttcttctagggtttttacggttttaggtctgacatttaagtctttaatccatcttgaattaattttcgtataaggtgtaaggaaggatccagtttcagctttctacatacagctagccagttttcccagcatcatttgttaaatagggaatcctttccccatttcttgtttttgtcagggtggtcgaagatcagatagttgtagatgtgtggcattatttctgagggctctgttctgttccattggtctatatctctgttttggtaccagtaccatgctgttttggttactgtagccttgtagtatagcttgaagtcaggtagcgtgatgcctccagctttgttcttttggcttaggattgacttggcaatgcaggctcttttttggtttcatatgaactttaaagtagttttttccaattctgtgaagaaagtcattggtagcttgatggggatggcattgaatctataaattaccttgggcagtatggccattttcacgatattgattcttcctatccatgagcatggaatgttcttccatttgtttgtgtcctcttttatttccttgagcaatggtttgtagttctccttgaagaggtccttcacatcccttgtaagttggattcctgggtattttattctctttgaagcaattgtgaataggagttcactcatgatttgggtctctgtttgtctgttattggtgtataagtatgcttgtgatttttgcacattgattttgtatcctgagactttggtgaagttgcttatcagcttaaagaaatttggggctgagatgatggggttttctagatatacaatcatgtcgtctgcaaacagggacaatttgacttcctcttttcctagttgaatgccctttatttctttctcctgcctgattgccctggccagaacttccaacactatgttgaataggagtggtgagagagggcatccctgtcttatgccagttttcaaaaggaatgcttccagtttttgcccattcagtatattggctgtgagtctgtcataaatagctcttattatttttagatatgtcccatcaatacctaatttattgagagtttttagcatgaagggctgttgaattttgtcaaaggccttttctgcatctattgacataatcatgtggtttttgtctttgcttctgtttataggatggattacatttgttgatttgtgtatgttgaaccagccttacatcccagggatgaagcccacttcatcatggtggataagctttttgatgtgctgctggattcggtttgccagtattttattgaggatttttgcatcaatgttcatcagggatattggtttaaaattctctttttttgttgtgtctctgccaggctttggtatcaggatgatgctggcctcataaaatgagttagggaggactccctctttctctattgattgaaatagtttcagaatgaatggtaccagttcctccttgtacctctggtagaattcggctgtgaatccatctggtcctggactttttttggttggtaagctattaattattgcctcaatttcagagcctgttattggtccattaagagattcaacttcttcctggtttagtcttgggagggtgtatgtgtccaggaatttatccatttcttctagattttctagcttatttgcatagaggtgtttatagtattctctgatggtagtttgtatttctgtgggatcggtgatatcccctttaacattttttattgcatctatttgattcttctctcttttcttctttattagtctagctagcagtctatcaattttgttgatcttttccaaaaaccagctcctggattcattgattttgtgaagggttttttgtgtctccatctccttcagctctgctctgacctaagttatttcttgccttctgccagcttttgaatgtgtttgctcttgcttttctagttcttttaattgtgatgttagggtgtcaattttaaatctttcctgctttctcttgtgggcatttagtgctataaatttccctctacacactgctttaaatgtgtcccagagattctggtatgttgcgtctttgttctcgttggtttcaaagaatatctttatttctgccttcatttcgttatgtacccagtagtcattcaggagcaggttgttcagttcccatgcagttgagcagttttgattgagtttcttaatcctgggttctagtttgattgcactgtggtctgagagacagtttgttataatttctgttcttttacatttgctgaggagtgctttacttccaactatgtggtcagttttggaataggtgtggtgtggtgctgagaagaatgtatattctgttgatttggggtggagagttctgtagatgtctattaggtctgcttggggcagagctgaattcaattcctggatattcttgttaaccttctgtctcgttgatctgtctaatgttgacagtggggtgttaaagtctcccattattattgtgtgcgagtctaagtctctttgtgggtctcttggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggatttcaacccctgcctttttttgttttccatttgcttggtagatcttcctccatccttttattttgagcctatgtgtgtctctgcacgtgagatgggtctcctgaatacagcacactgatgggtcttgactctatccaatttgccagtctgtgtcttttaactggagcatttagcccatttacatttaaggttaatattgttatgtgtgaatttgatcctctcagtatgatgttagctggttattttgctcgttagttgatgcagtttcttcctagcatcgatggtctttacaatttggcatgtttctgcagtggctggtaccgattgttcctttccatgtttagtgcttccttcaggagctcttttaggacaggcctggtggtgacaaaatctctcagcatttgcttgtctgtaaaggattttatttctccttcacttttgaagcttagtttggctggatatgaaattctgggttgaaaattcttttccttaagaattttgaatattggcccccactctcttctggcttgtagaatttctgccgagagatcagctgttagtctgatggggttccctttgtgggtaacccgacctttctctctggctgcccttaacgttcgttccttcatttcaactttggtgaatctgacaattatgtgtcttggagttgctcttctcgaggagtatctttgtggcgttctctgtatttcctgaatttgaatgttggcctgccttgctaggttggggaagttctcctggattatatcctgcagagtgttttccaacttgtttccatttccccatcactttcaggtacaccaatcagacatagatttggtcttttcacatagtcccatatttcttggaggctttgttcgtttctttttattcttttttctctaaacttctcttctcgcttcatttcattcatttgatcttcaatcactgataccctttcttccagttgatcgaatcggctactgaagcttgtgcattcgtcacgtagttcctgtgccgtggatttcagctccatcaggtcctttaaggatttctctgcattggttattctagtcagccattcgtctaatcttttttcaaggtttttaacttctttgccatgggttccaacttcctcctttagctcggagaagtttgatcatctgaagccttcttctctcaactcgtcaaagtcattctctgtccagctttgttccgttgctggtgaggagctgcgttcctttggaggaggagaggccctctgatttttagaattttcagtttttctgttctgttttttccccatctttgtggttttatctacctttggtctttgatgatagtgacgtacagatgcggttttggtgtggatgccctttctgtttgttagttttccttttaacagtcaggaccctcagctacaggtctgttggagtttgctggagatccactccagactctgtttgcctgggtatcagcagcggaggctgcagaacagcaaatattgctgaacagcaaatgttgctgtctgattgttcctctggaggtttcgtctcaaaggggtacccggccgtgtgaggtgtcagtctgcccctactgggggatgcctcccagttaggctactcaggtgtcagggtcccacttgaggaggcagtctgtcagtgctcagatctcaaactccgtgctgggagaagcactactctcttcaaagctgtcagacagggacatttaagtctgcagaggtttctgctgccttttgttcagctatgccctgcccccagaggtggagtctacagaggcaggcaggcctccttgagctgcagtgggctccacccagttccagctttccagccactttgtttacctactcaagcctcagcaatggcgggcactcctcccccagccttgctgccgccttgcagttcgatctcagactgctatgctagcaatgagagaggctccgtgggcatgggaccttcagagccatgcacgggatataatctcctggtgtgctgtttgctaagaccattggaaaagcgcagtattagggtgggagtgacctgattttccaggtgccatctgtcacagctttgcttggctatgaaaaggaattccctgaccccttgcacttcccaggtgaggcaatgccttgccctgcttcggctcatgctcggtgcgctgcacccactgtcctgcacccactgtctgacaagccccagtgagatgaacccggtacctcagttggaaatgcagaaatcacccatcttctgcgctgctcatgctgggagctgtagactggagctgttcctattcggccatcttggaaccgcccctctgaaactttttagtcataaaaggatgttgaattttgtcaagtgctttctctgcatctattgagatgagatgatcatatggtttttgtccttcattctattaatgtggtatatcaaatatatgtatttggatatgttgaaccatccttgcattctggagtaaattccacttggtcatggtgaatgatccttttaatgtgctgttgaatttggattactagtataccttcttcatgaggtttaccagacttttgtagcaattcaatgcaaagaagtacacttttgaaatcataaagccagtggcttgtggcttgacttttgacctccatgacttctggacttgtttggttcacttttggtatctggctaatatagcctcccacatagctgggaccatggttgtacaccctatgcctggctgatttatttattttttgtagagatgaggtcttgccatgttccctaggcttttcttgaactcctgggctcaagcaatccttccatttcagcatcccaaaattctgggattacaggcattaatcaccgtgcccagccatatctgatatttactacatttattttgatttatttatttattttttttttgagatagagtctttctctgtcacccaggcaggagtgcagtggcatgatcatagctctccgcaatctccacctcctgggctcaagcaatcctcttggcttagcttcccttgtagctgggaccacaggtgtgcaccaccatgcctggataatttttgtattttttttggtagagatgggttcttaccatgttgctctggctggttttgaactcatgggctcaagcaatctgcctgcctcagcctcccaaaattctgaggttacagacatgagccactgagcccagcctattttgatatctaatcacacattctattatgtaccattatttaaatgttttatgtacttaaggtttctaaccctaattggatcctagattcttaagggcaaacattgatatttaatcagtaataacacaattattcagtcaggggataaatatgtctcaatagctaagtttactcccttaagcatacaaatattttattttaactactatggatagaaacaggttttaaaatgtacttacattcctgaagggtactttaaaaatactcactatacataacagttttatgcatatagaggactttatatagccacttgttttaaaagaaatgtgttaagtaaattctatatcccaaggcacatgatatatactaagactaaagagcaaacaaaagaagctattactcatttttcaaaagaactgggccaagagtgatggctcacacctgtaatctcagagcgttgggaggctgaggtgggaagattgcttgaggccaggagctcaagatcagcctgagcaacatagtgagaccctgtctctacaaaaaattatttaaaaacatagttgggcatggtggcatgtgcctatagtcctaactactaaggaggctgaggcaggaggatcacttgagcccagagttcaaggtcatagttagctatgattgtactgcactcctgcctcagtgacagagtgatactttgtcaattaaaaaaaaaaaaaaagaagaactgcctttagtacctttactcattttgctaccctaataccattgatgatgaacaaatattgctttttttttccattttttttctcgtgtgacacagccctcaggagatcctgagaacatatgccccctttctttcttttttttttttctttctttctttttttttttttgagacagggtcttgctctgttatccaggctgctgtgcagtggtgcaatcacagctcaccactgccttgacgtcccaggttcaggtaatcctcccacctcaacctccaaagtagctaggactacaggcacacaccaccacccgtggcttacagatattgctttaatttctgaaaatatttaactgagaagtcatagtacctcataataggcaattttaacagatatattgatctgaagatatccttccatgtaaagcaatggtacatgagtatgataaggagaatgtatggaatgatattgtttcttagcaattaataatttataaaaacataaacagtaggcctgagattatacttgactataatacaccgatatatgaaattaaaagttatatttcacctattaactagtttaagaataagtactttctacaagtctaatgtcaaaatcattttcatgtatatatattataccacttcttattggaatgggctagaaggaagtactccattgcaataaaatataaccacaaaggctgagtggagtggctcacatctataatcccagcactttgggaggccgtggtgggtggatcacgaggtcaggagttcgagaccagcctgaccaacatggtgaaaccccgtctatactaaaaatacaaaaattaactgggtgtggtggcacacgcctgtaataccagctactcagaagggtgagccagagtcgcttgaacctggaagcagaggttgcagtgagctgagatcgtgccattgcactccagcctgggcgacagagcaagactctgtcttaaaataaataaaataaaataaaatgaaataaaataaaataaaatatatatatatataaccacgaaatatgacattaagggtcttctggaattctatggttggggactcaggggatgagggtctggaatgagaaggatacttaatttggtgctgttgaatttttttaaaaatccaggctgtggaattataatacatatattggttttagttcacagttactggctcctaactcctcgttttaatgtcagggcactttaggcctcaggaaacagaatctctctctatgagcttctcctgtccttcactcatctgcctaagggaggattctaatctgactgtgagtcaaaagatcctcatcccagagaggatcctgccccatatcctagaggaaggaatgctacatagaaaaggccaagaaaagtctgaacagacagaccttgctgggtttacattatgagctatttgtccactcacatttctacatggttgtcaatcatgcccatgtaataaagactccattaaaaaccccacaggacagagtttggagagcttccagagaggtgaacacgtggaggctgacaggagggtgaagaagacctcatccacgtgccaggaggatggcacagcccatctccatggagacagaagctcctgtgccggacccctccagacctcaccctacctatctcttcatcagactgtttatttgcatcctttaaaatatctttcttaataaactagtaaaaatgtttccctgagttctgtgagccactctagcaaatttattgaacccaagaggaggttgtgagaaccccaacttgaagccagttggtcagaagttccagaggcccagacttgcaactaagggaaggaggagatggtcttgtgtcaccaagccctcaacctctgaggtatgacaccgtctccaggtagagagtgtcagaacagaattggaggacaccaagctggtgtccactgcttggtgtatggggaaaaaaacccacatctttggtcatgtaagtcttctactgtgttgatgattgctgtgttggtgtgagagcagaggaataacatagttagagagagtttccaaaacacatgtctatatcacttttttcatttaaaaagtttttaaagtgaagaaaaaagttgcataaaggaaaaatttacatcttatctaaggtgatacactgaatcagtcataagccagaaaatacctagaatatgctaagacatgtgataacagtttcaatattaatagtcatccttacatatttaatctgcaaacatgcagttctcatactcacctgccaaaatgaagaactatataccggatgagatcaccttgcttttccattttgttgtctgtgaccatgggcatcaatttgtcatagtacttggcaaggtaaaaatgcccatcctcccattctggcaggcacgcggtcacatcctataaaaaagaacataggatacctacctaaggaaatcccacgctatgctgggaagtaaaatatgaatagatgattagggatcaaaagtatgtgacctttatctaggcagagcaaagtcaaaagcagactcaatctttgatgtggaaaaggaatagctaacttcttgtaaaggttttctcaggagggctgatttgttctggtgggttgcccactgcccaacatgaaatagtgctggaagaattcgcaacttaggagaaaactccatttatgtcaccactttaaaagatacatcaaagtagtgtctggatgggttaaatttttttatacatatatatgatatgtgtgtgtgtgtatatacacatatatcatgaaaggcatttttaaaaatcttcaaagcagaagtaatatcaagtctctaaagagtgtaggactttaaaaagcataaaaattttggtaaaataaaaatcacatattttgtttttctccaagatctctcacaagttattgccctttctctcaattccttcagaagcaggcttctaaaaaggattctctacctcacattgattcctaaaactatgtcttttcagcttcagtcttcaccactccactaaggagctccttaaatccaagagatattttacaactctgatctcatttgaactctcttcaatatgtttctgttgtccaagtcacttatttcaaatgctttcatcccttgacttctgtgaggccaccatcttccaagttttctcctctctttctggccactctcacttagtctcctttgtcatttctttttgctgttcctgccttaaatatttgtgtggtttattaatttttaatattacatgaaatgtgatgggaaatacacaggatcactgacaattttttttttaattgaagttccacttttcatctaaagaagtttgagaacagtttagaccagaaaccttaagtgagatcttgagtttctactgactctaatcttgagactctacagacacaaacctgcctgggaatagaggacagaatgatatgattagacgtgtggcacatgctaggttcatgtacctaatcagccacacagggtaagggctgccagaaaaacatattagtcaatctagtctttccttcctttcttctttcctgcctgtcttcctgccttcctttcttcctccttccctaacttccttcctcctccctctctcatttcagcttagattttaaatatttattttgaaaagtaaaattcacatactgaaaaatacactaatattacatttacagcttgatcaattatcacaaagtaattacctttatataaaatctccttcctccctctcttctctctcgctccctttttagttaagatttttaagttttattttgaaaaataaagtttatatacagaaacatatatgaatcttatgtatacaacttgatcaattattacaaatttatcatcctcatacaagaactccaggagttttttgtctgtttttgaacttttatataaatagaatcatactataataattattattattggctgggcaagatggcttatgcttgtaatcccagcactttgggaggcccaggtgggcggatcacgaggtcaggagattgagaccatcctggctaacacggtgaaacctggtctctactaaaaatacaaaaaaaaaaaaaaaaaaaaaacaattagccgggcggtggcaggcgcctgtagtcccagctactcgggaggcggaggcaggagactggcctgaacctgggaggcggagcttgcaatgagccaagatcgcgcaactgcactccagcctgagcgacagagcgagacaccatctccaaaaaaatacatattattattagagacaaggttttgccctgttgtcctggctggtgtgcagtggcatgctcatgactccctgcagccacaactcctaggctcaaggcaatcctccctcctcagcctacggagcagctgggactagaggcatgtaccaccacacccagctaatttttgtattttttgtagagacggagatttgctatgtttcctaggctggccttgaactcctcagctcaagcaatccgcctgcctcagcctcccaaagtgctgggattataggcatgagccaccatgcccagccctacgtgtattatattttttatctggcttatttcattcaacattacatttgtgatatcaatccaagttattgcatataaatttggtttactatatagtattccattataagaatatgctacaacatatttatccattctataactgattgccatttggattacttccaatataaaatctacaaataataatgttataaacattcttgtgtttatcctctggggacatgctgggtcatattccagatatgagcctctaatgtattgcaaatatcttctaatctgtaggttgcctctaactcacaatggtatcttctgataaacagaagttattgtttattttagggttagtgtttttgttatgtttaagaagtcctgacctagattaacaatctacctcaagtttacttttgtttatggtgggaagaagggatcaagtttgattttttgttttcctataagatacccaagtgatacaacaacatttattgaaaagactattttggttattcacagtttgcccctccagatagatacacttgccaactttagccttttccactctgctcagtgccccagcaaactgaaattgatgatttatatcaatgggcctgtttgccctctggcttcctgtgaagttcaatcaatggaaggtagcaatagattagagggtgagggggagagtgaggttaaggtctttatacctgctcgtttccttcctgctgggctgcagttgacagtggtggtgtttctttccctaaggttaagttctggtccaatggtcctttcctacaaatttagctccctgtacaggttccagtaaatgccctatccttttgctccttcaggtctagagttagcaacgactctctgttgttgctagccatggggtactttcaccatcctttgttaatttcccttaatctagtttttcattaaactctccccaattacctcttttgattgggccaactattttctccctgcacctgacctcacacgatacagtaaagagcatctcagatagattggaggtcactaaggagatatgacaactaatgctatatggaatccttaattctagacagaagaagaacactattgggaaaactggtgaaatgtggtctacagatagttaacagtattgtttatcaatattaatttcccacttctgatactctggtagtgtaagatattaaaattagtggaaacacggtaaagggtagatatggaaattccctatactactactaactttttagaagtcaaagattatttcaaattaaaactgaaaaaatgaaaggtgacagagaagcttcttggttattcttggcctttatgtttccacataagttttaaattctaattgtcaattacctgttagcatttgatgagtaatgcattaaacctctaggtcagtttgtagagaaataattatattattgagtcttcccattcatacatgtattctagctaccaatttatttagttcttttttacttcactcaattttaatgttttaatttttattttgtggagaggtcttgtgtgcaatttaatcctaggcatttcatcatttttattgctatcctaaatgatatctttaaaaattttaggctgggcatacatggtggctcacaactataatcccagcactttgggaggcagaggtgggaggatcagtagaggccagggagtttgagaccagccttggcagaacagcaagaccctatctccacaaaataaaaaattagctgggtgtggtggcatgtgcctgtagtcccagctacttgagaggctgaggtgggaggatcacttgagcccaggaggttgaggctgcagtgagctgtaatcatgccactatactccagcctgggttgacagaccaagaccctgtctcaaaaataaaataaagtaaaattttaaatcaactttcttaagacatatacacccatggaaccatcattccagtcaagaagatgaacattcctaactctcgaaagttcttatgggcgcccacccttgccgtcactctcctgccaactacccaggcaaatactgatataatttctatgcatatacattaattatacctgttctaaaatgtcacataaatgaaatcatataagcatatagtcttttatgtccctcttctttcattcagcatatctatgacattaatctaccttgttgcgtgtatcagtagttcatttcttcttactgtagggtagtattccattatacaactgtaccagtttgtttacccattcttctctggatggccagctggcctatttccagtttttgtgactaaacctactataaacatttgtgtacaagtctttttattgacatatgtaattgtttctgttggataaacacctaagaatggaatggaatatggtagatttaactttttatagtccccaccaggtgcatttattgcattaataggtattgctagtctttcagactttagccattttagtgtgtaatgtgttatttcattgtggttttaatttgcatcttcctaatgactaatgatgttaagcatcttttcatttgctttttggccatttgcgtgtattctttatgaagtgtctatccaagacttttgcagatctgtattttttttcttttaatagacaaagtttcactctgtaactcaggctggaatgcagtggtgcaatcatagctaactgtaaccttgaactcctaggctcaagtgatcctcctgctttagcctcccgaatagctaaaactataggcattcgtcaccatacctggctaatttttatttttgcagagacaggttctcactatattgcccaggctggttttgaactcctagcttcaagtgatcctcaggcctcggcctcccaaagcaccgggattacaggcctgagccactgtgcctagcctcacagatctttaaattgtcttactaagttgtagggttctctataatttagctacaaatcctctgtcatatatgtattacaagtattttctccaagtctatggcttaccttttcattttcttaactgtctttcttagaaaaggttttaactttgatgaacatctaatttatcaggattttttaaatgcttaatgctttgtgtgacctaagaaaacctttgcctaccctaaggttgtaaagattttcttctattttttcatctaaaaattcataattttagcttttcagtttagatctataatctacttttttgaagcaattttgtctatcatatgaggcagaggttgaagatcatttttttcctcatacagatatccaactgttcaagtactttctgcttgtaaatggtatgttttaaattcctttcttgttgtcatatagaaataaaatcatcaggcaatcttgtttaattcactcaatattttgaatagtttataatcttttgaattttctacatatgtattcatatcatctgcaattaataactttcctatatttttttcctagtccttgtatcttttacttctttttttatttaaagattgccatttgggtaatattttaaaatgacagctctattgggatataattaatatattataaagttcacacttttaaagttgttgttagtatatttacagagttgtgtaaccatcaccactatttaattccagaacattttcatcactccaaaaaaaaaattgtaccaattagcagtcacttcccagccccaacctcagtctctagtacccattaatctaccttctgtctctatggatttgcttattctggccatttcatgtaagtggaatcatgcaatatgtggccccttggatctgcatgtcattctacagtagtcagcctctattcttttctctactcatttctgtctacatcatgtataggcaaccagaacaagagaagcagctactgaggcctttatgacaggaaattaggggtgtatgcagaagaaacagaacctgaaaagttggtagtctgacaacatctctcttccctaaccctggctttagtacccaggcagagatgggagaactggaatatttgctatcaaattctgctgttaagtactggtgagtttttgtgtgcctcataagttgttgtgtcttacatactagaataaattcagaagatctctctaactgggaaggtgaaacttacaagtatggtttcagaacttgcctcattatcactgccctttaggataatatagtttttaatgcaaatcaaggttagtttcttaggtggcatgacatcttcttgtaaccaaggaacaggagctggactcctatttatcttcatcagaatgcaacacttcctggatctaaagattagcactgtctgtgccatttgctttggctgttggtcccatttaggtctttcttgtatctttgatttctctctcttctcatcatgctcttatttttgtttatgttcttaaacttatggagcctatatacaatagctgtttttaaatcctgtcatttctagaactatttctactgatttattttttttcctatctgtggctcaaatattcctgcttcttcattcacagagtaattttttaatggatgctggatatatttttacattgtcaagttttagattttgttgtcttgctttaaagagtgttaggctttgatctggcaggcagtaaggttacttgaagatcagtgtaatcatcttaaagcttgttttactgcccttctagtatggatatagagtagtttttagcctaggactaatttagtcctacttctaaggtgtggcccttttaaggtctttactgaatgctccatattatgcaatgaggcctcttaatctggctggtggactgaataactctcaatcctgtaatctgaatgaatctcaatcccgtgtgagctctggaaattgttcttatagcctctgcatgtttattctttccccagcagttattcctagcttggcctcatagaattctgaattattcatgtgcaggctggtattcagcgaacacaattcctatgcagataggaactactctgtttaacttttttctctcagttaatctgtcccacaaattctagccacctgctctttgctttattatttcctttcttctacttttttatttctctccctacttttttagttccttttctaactctttgggatagatacttaactcgttaattttgaacctttattttcttcgaatatatgcaaataaaaatttaaatcccttttaagaatggctttagctgcacaggatatgatatgccatttttattatcattcagttcaaagtacttttcaatttccattgaaagttttcattgacccatggattattgagaggtatatctcttacaacaccatctatataaagtttaatacctagtaaagaagttataaattggttttgctgaaaaattttcaggctaggatgtagttaactttgagacagagggtgagaatagtgattactgggatgaagggtagtggggttatagagctcaaataatattctatttcttgatgtggtggcagtttcatgagtatatttattttgtgataatccatatacttatatactcactgaaaagtcaaaaaaatttcctggttatttttatacatgtgctttgccatatagacttaagtcattttacgtagtcaacagagttaactgaaactgcattatacatatacttgccttatattttttcataattgcattgctttcaaagttagctgtttcttccataaatcggcccactagtagcatagctcgaccatggattaacatgttcttaccctcaggtggggtttcattttcaggaaaacataattcaacacctttttgaagaacaattagtgcctggtgaacatcaccctaaaagaaaaaaggcaacaataagccttttaatttaaaaacatacttctattttctgcaaaagtattagttcattatgtttttgtacaaatccatttgtaatttcatgtttatcttttacttgcctcttattaaagtaaaattctaaaactgaaacattgcttcatctcattcattcatttactaattaattttataactgcagttggctctctgtagccacaggttccacatcaatggattcaaccaacagtggatagaaaatattaggaatggctgggcacagtggctcatctctgcaattccagtgcttttggatgccaaggcagggggactgcttggggccaggagtttgatactagcctgggcaacatagcaagatcctgtctctacaaaaaatttaaaaattacccaggtgtagtggctcatgcctataattccagctactcgggaggctgagggggaaggatcgcttgagcccaggaattcgcagttacagtgagctatgacacaccactgctctccagcctgggtgacagagcaagatcctctctcttaaaaaaaaaaaaagaaagctaggcatgatggcttatgcttatagcctttgatacaaagttcagggtgaggtgggaggattgcttgagagcaggagtccaaggcatcagtgagctatgatcatgccactgcactccagcctgggcaacagagcaagactctgtctctctcaaaacataaaaatttaaattaaaaaaaaaaagaaatattacaaagaaaaaattaaaaataatatgaataagcaatacaagtataacaactgtttacaaagcatttgcactgtattaggtattataagtagcctagagaagtatacaagaggatgtccgcaggttatatgcaaatactgtgtatgccactttatataaaggacttgagtatccacagattttgttatccatagagaatcctgggaccaatccctccatggatatcaagaaaggactataatcaaagttcagggaattgaagacaatcacaaacaaattaaaatccctgacataaaaaaagttcatagtcacatgagaaaagaaactatgtgaaataaaagcatatttgctaagtgttacaacagaggaatatacatcagcattatacaggatagagaagagagtcccttaaacctacctgaagaatataggaaaatggaggagaactacagtcaggaaaagttatcaacgaagaaaatttgaattaggttttcaagaatgagtagaaatcttcttggcagagaatttagtgaaaggcattctaggtagatggaataataattttaattggaagaaaagcacatagtctgattttagctgaagtttaaagggtttttgagatggtgatgaatgacactgaggaagtaggccaggacttgatcagaaagggatttgtgtagttcctagagttaggcttaatcctaaaggtatgaagaatactttgtaagatttaatctttttgaaggagcaacatgattcgatgtggattttagaaagatcacaaactgcaataacgtatacagggaaatggtgagatcctaaaatggttgttaatattgttagaggaagtaaataataaagtcataagttaaagcagtggaaataaataagagggagaggattcaagagatatttctaaggttgaagaacaaagatttagtctccagctggatgtgaaaagtgaggttgcagaaggaatttaagatgatgtccagatttctgtttttgatggaaggatggaataaagtcttgttcagagaagtaggaaacatgagaggagaaacagatattgagtattaggtaataaattgcattttgaacattttgagtttaaggtattataatacatagactaccactagctcaataaaatgaccaggtactgactaatgcacactgaataaattgctttcccctctcatccaggaaacctctcctgtcctttctcagccaccacaagttggtgtaaccacaaatggcaccaacaatagttgctaagtatcaattccagaacatgctattattattagtaatgcctattactaattctaaactggtgactagcctgaggagaaatttaagtaatagccattaaatctgggttattggccaggcgcggtggctcacgcctgtaatcccagcactttgggtggctgaggcaggtggatcatgaggtcaggagatcgagaccaccctggctaacacggtgaaaccccatctctactaaaaatacaaaaaattagccaggtgtggtggcacacacccgtagtcccagctactcaggaggctgaggcaggagaatcacttgaactcgggaggcagaggttgtagtgagcggagatcgtgccactgcactccagcctgggcaacagagtgagactccggttcaaaataaataaataaataaataaataaaaataaaaaataaatctgggtcataaaccttgcaagtagttccaatgtttaaaaaacccccttcttattactttggctttaatctgaggtctgccgtgaacttctgttcagatgctaggccctttctggctagatcagagctgaatatttacagtaacactggcaagtctacagagagctaattatctgccagcaactaagtgacagagttacattcatttaaccaacatttactgggtcactactatatacaccctgtatacatacataaggtgaaaaattaagaggtcgttttcctcaaggaaaatgtaagatagatgaaaactgaaaaaactccacattcagccttgaaatgggaaggtatctggggactgtagagtaaaaagaacaattacttccaggctatggtagataactaatgaagaaaagtgatagaaaaggaaggttcttaatttggattagttatgttctctcagttggccttttaaggaagtacataattcccgactatatatatatatatatatatatatatatatatatatatatatatatatatatatatatgatgacatttccctggccattaccttggaccagagccactttgccctttccacgtacagttcagcgagtcgtgattcccctgcattaaggagagcattgtaggctgtctggtggtgaccagcctttctagctaccctggcactctgcagccagcattctccaaccatttcattgtaatctggtctaaaggaagtaacaacacattggtgagagagaccattggtaagtgtacacaacaacttaacttaaaacaatttaaatctaggtcataaactttgcaagtagttccaatgttttgaaagcctctgttcccaatacagaaccttcttcatatactatttcaaaggaattaattattaatttgtttaaaaagccttgacttaacttttcttacagtgttctgttttacctattatgaaccttattcttgatttttatcagtaaaaaacatatcccccagatatgtttttaacatcttaaaaaagagaaagaaatggtgtctaaaagtgattcttaagttctaggttcctttcaaccagatagtgtagccctgatcattaaaaatagaaaaatgtagattcagacagaaaattaagaaatacaaacacccccaaataatatccaaataccaaattcaagataagtgacatttttaaaaaaagtagtgtgagaaaccttttgttgaggcttagtaaagccctccggagagccaggataggctccttggctctgtaggaattctgggtcatttctagtcgagctacccagtttagagaatcttcttgagaactgtcacctggagaatgctggaaaagtggtttgatgctatgctccaactcacataacatgtgcaatctgaagatagatagagcctatgttaaaatgttatcatattcagccttattaatctcatatataaagcaagtactttaaatcagaaataaagaatttaaaatacacagttgtctttggtagaactttaatatatccttgctaagtaaataattacatttatatcttttcaaactgaatgtaaacaccaatttatgctggtttatacatttggtgctttagccaggcatggtagcgtgcacctgtactccagctactcaggagactgaggcaggtggatcacttgaactcaggagttcaaggttgcagtgagctatgattatgcctgtgaatagccactgcactccagctcaggtgacatagcaagaccccgtcccttaaaataataaataaataaataaataaataaataaaattaattacattaaacttttaaaataaatatttagggatttgcagtgaatcccaaattcctaattaaactggagaatgatggataaaactaaattcaaatgtatgaaaccaaaatttaccacctaaatgaagataaaagaaaatatggatccattataaaccaacatgaggtatttgcatatattgctggtgctactataagagggcctggcatagcagatgatagtaaaaaattatgaaattaatgtagtttttttctaagagtgatggaaactttgatacattcacactagctttttcccccttgtatgatagtcagtgtctatgattcagtgttcaaggtacaaggatatagctgagtagctacagaacagaattaaactcagtggtccaatctctagtttcattaagatatcaccaaacgggttgatactaaatataatgaattcttctaacttaaaaaaacagtgctatgtagtaaatttcttataccttaattacaatatttagtttatcatttttcctcaggtagaattcatagacctaaaatgttttccaacattttcttcttcacctataaaagttaatattctttctagtaatgtgatgcctatatttttggggggaaatatcaaacacatttctaaatgaaaaggaaagggaaacaacaaataccaagcaccaatgtgccaggtgctatagatgtctatattatatttggttatatagaaagcaaactatgacattacaagaggacaaacataagatatttttattatgtttttcattagtctcatagttgcctttccttaaaaggatgtatgttagaattttaactgtagggtgattgtgaggtaaaaagaatgaaagagctgtctagtgtagctatgcatgaaaccaaactcactatcaattatttactcaaaaaaattttccaatcctgtcaggtgacatttataggccagaaatataaaaatggaaattccaaaatacctcacaatatattcatatcctcgttggtaggagcctctttcaaagcttgcagctgaaagaggtacaatttgttctgctctcactagtttcagtgagtcataaaaagctgtgatatctctttttttggctgataataatagctgtcccagtctgacactccatgttgtagattttccatctgaaaaacaaatgaagagtcaagaaatgtcacggtagctgggtccaagagtcagctttatttcattagataaaatggtcagctgaaatatcaaacaggtggcttcattcctttttttttttttgagacagagtctcactctgtggtccaggatagagggctatggcatgattatagctcactgcagccttgaacttctgggctccagtgatcctcccacctcagtctcctgagtaggtgaacaggcatgagccaccatgcccagctaagttttttaaaaaacatttttgcagagacagtctcagtattttgcccagactggtctagagctcttggcttcaagcaatcctcccaccttggcctcccaaaacactgagattacaggtgtgagccaccatgcccagcctggtttcattctactttgaacaactaaacaaggcaatcataaaacaggctaagatattaagtatgaatgttgctaagttacttaagtctgaatatttatgtcatattaaaaccgctttttttttttttctttgagatggagtctcactctgtcacccaggctggagtgcagtggcgcgatctcagctcactgcaacctccaactcccaggttcaagcaattctcctgcctcagcctcccgagtagttgggactacaggcgcgtgccaccacgcccagctaattttttgtatttttagtagagacggggtttcactgtgttagccaggatggtctcgatctcctgacctcatgatccgcccgcctcagccgcccaaagtgctgggattacaggcgtgagccaccgcacccatcctaaaactgcttatattttaagaagtaattttacctgctgccaaatagttttccaccaaatcccactgtgacaatttccaagctgcttccactctgtacgtgtttaattcatctgtccactcggacctattaaaagaaacccatatcaactaaactttaatttatttaaggtgacattcagagatttttcattggtttacatactctatttattatatttattgaatttgcattatattgtattttgttcttagatataaaataattatctctatccagaaactatccagaaaattttaatctttccatccttcaaaaatattttttcactaattacttctgatacaccatttaaaatgacattcttcaacaaattaaagtgtgccatatattagagcagagttaattcctgaataataactaagcccattgtaaaaatagctgcatgcttaatttgaacaaagagcaaggaagaaaaagagccaactgaacacacataaattcagaggtaagcaattccaataactcagaattctgaattaaatttaagacaaaaatacaggggggccagtggtataacttacggacagttgggaggtatctagaacaataccaagagcaaaagaaagttacaatgatttgtcaatggcataacaaagtatataaaactagctacgtaaaatatatacctatttttaaactactttcagttagtttaaaatttgagtttgcaaaaccagtatgatataggctaattattttgttctaagcattctacttaggtgacattaggatgaccagtgatatttgagatcatgactacacagaaaccgctaggctttcctcatgtttcttttttattaatcatactttctgaatttctgccatatgtttagatcctaggctaggtacaattttccatttaataatctaataacactgcatacagcacatatatatccatattataaataaagtaacagagaggctggaatcaatatcctcaaaagttttccttgctctttttattgtagtaaaaacacataaagaaaagacaacaagtgatctaacaagtttcatttttaaaaattctaaaaatagaagctagaggattccaatttctaaatttatgaccaccaccaaaaacagtttagaataaggctaaagaaatacaactgaaatgtaattttcaaaagtccaattttgaaggactttacaagcttaccatcagacaccaaaatataaaaatttcaggataaaaatctcagtagaattaggcagtatttgttatccaactgtgggataacagattatctatgggatatcagataacaaaggggatgtgtcacacgaagacttatagcaaaaagtacaaatggcaatcaggatcaggctgtgagaatgtatccacataaatgggtacattaaaaagaatgataaatagggcaggcacagtcaatattttaggaaaaatatttgtttaatgcaaacagaaattaccccaagaaaaacatgccccatccataatcatttgcttcaccatgacacagcaccccttcattgaatattgacgcatgcctttttcacaacccaaatcaggaggctctatgtatcccagacccaaagagaagaaaagaggagtctgaatgtgtagtctatgtcaaaaagaaatttgacaccccaatttgagccatgactctcccaaatccctgtaatctatttattcataaagtctctcaactaatctggagaaacatatccacaacatataagcattccttctttacttctgtaaaacttcccttgtgatttcataaattccactactgtgataccatctgaccaacagtgaacttctctgcccttagacattgtaaaatgatagtctttatgaatcacagttttggaacctatacaaacagtacttagaaaaggctggcttcagaatctataaaaagctcaaataaatcaacaagcaaaaaaacaaacaaccccattaaaaagtaggcaaaggacatgagcagacacttctcaaaagaagacatacaagcagccaacaagcatatgaaaacatgctcgtcgtcacaattatttgagaaatgaaaatcaaagccacaatgagataccacctcacactaatcagaatggctactattattattattattttgagacaaagtctccctctgctgcccaggctggagtgcagtggtgcaatctcagctcactgcaacctccatctcccaggttcaagcaattctcctgcctcagtctcccgagtagctgggattacagatgtgcaccatcacgcccagctaatttttgtattattttagtagagatggggttttaccatgttggccaggctggtcttgaactactggcctcaaatgatacacccgccttggcctcccagagtgctgcaattacaggcatgagccaccacacccagcccagaatggctattattaaaaagtcaaaaaagatgtagaaggggctgcagagaaaagagaatacttatacactgttggtgggaatataaattagttcagccactgtggaaggcggtttagagatttcccaaagaactgaaaatagaacacacagcaatcccattactgggtatattcccaaaggaaaataatccattctaccaaaaagatacatacactcgtatgttcattgcagcactattcataatagcaaagacatgaaatcaacctaagtgcccatcaatggtagatgggataaagaaaatgtggcacatatacacaatggaatactatgcagctataaaaaagaataaaatgggagctaaacattgggtacacatggacacaaaaatgggaacaatagacactgcagactacaaggggtgggggagggagggaggcaagagttgaaaaactatcttttgggtactatgctcactacctgggtgatgggttcaattgtatcctaaacctcagtatcacgtaatatgcccttgtcactaacttgcacatgtaccctcagaatctaaaataaaagttgaaaaaaaagagaaagaaaaacttggcttcagagtagtccaaaaacagtggcctgtataatctttgtttaactgagatcccattcccttttgaccagattttactgcccagaatagccatttagagtctggtgaataaatcaaggaatacagctgtcagctctcacagcaaagcagcttcaagagcagtgctaatctccacatttaatctccaaactggaagaactactcagccttaatgttttgccacatacatgtattattttttgtttaatttgattttctacaataaacccaccttctttaggaaaggaaggctgctttcacattcatcaatcatttagggtaaaatcaatgcacacagtctacagtggtattccgtaaatcagtcacaacctctagcacggaaaataagtggtactgatactgtaagcagagcatagatgccctttgaggcccaggaagtcccatctgagcctcaccaatagccagtgggttctagaagttccttgtgttaaagcaaatctaattcaaggatggctctttagacagaagctgttaagtggtagactgactatgaaaaacttgaggaaaaaaaaatgttggtgcttatctccaataccatgaaaacacataaaacatttattactctactaaacattaaattacccaattcactaactaaaaattctccattcagatgcaataacaaaagaaaatcattttataaaatattacctgttagcatgcactccattcacctgagtgataacagtagacagctgaccaagacctaacatggactttactacaccatgataatgaatgatctagaaatttaaaaatatttaaaatagcaattatcacttcaataatagcttggggaccaaaaacagtttaactgatattctttaaaaattactatttaccttattgcccttatttttttattattattattattttaattttttgtagagacagggtcttgccatgttgcccaggctggtctcaaactcctgggctcaagtgatcctcctgcctcagcctcccaaagtgctgggattacaggcatgagccaccatgcccagtcacacctttcttaatttaacaattgatttgcttacttacatggcaggacccccatcaatgtcctaacacatttaaagtaacataaataaatgtagacaacatagaaaatctcagattgaagttattatatttttcaatttggactactttttggttcacatccaatataaaaagtatctaatatctttgatattctgtttaaagattgtcatatttctcacataaacattcaagctcaaaggtcctgatgttttaaatatggatttcgggctttagcactaaaaagttaaagaggattatgtactatcctttaaaatgaaaagaagattgtgaaaaataaagaatttatatattgtgcttctgagaaacatgtcaaatatgacaaaaagcaatatcccaaaattagaaagaatctaaaggcaagattgtaaattaatgattctaaacccctttcccattccaatagacacacagcttattcccattactaactgtaactctgtgattctacaggaccattttagagacgtgcaggtgggtgagtaggtgtataaaatatgaaaatgtttctcaggctatggagaatccctagttctacaaactgatccatggcttacacttttaatagcaaactaaaattatatacattttagagttattaaatgaacattttaatacagatatactccataataaatcttattcatttaggggatttctaaagtcatataaatatagtattggaagggaccttttttttttttgagatagagtttcactcatgttgcccaggctggagtgcaatggtatgatcttggctcactgcaacctccacctcccgggttcaagcaattctcttgcctcagcctcccaagtagctgggattacaggcgctcgccaccacacccagctaattttttgtatttttggtagagacagggtttcactatgttggccaggctagtctcgaactcctgacctcggggaatccacccgtcttggtctcccaaagtgctgggattacaggcatgagccgccgcatccggcctggaaggaatttttaaaatcatctagtaaagtctctaattttatctgttaggaaactcaagcttagagagggttaaatattttccagacactcagtgacactgacagaaacagtattaaaactaaggtttcggctggatgtggtgtggtggcacacgcctgtaatcccagctactcgggaggctgaggcagaattgcttgagcccgggagacagaggttgcagtgagccaagatcatgccactgcactccagcctggccaacagagcgagactctgtctcaaaaacaaaacaaaacaaaacaaaaaaaactaaggtttccagagttcctattcagggctattttcattacagttgcctttcaattattatcttacctggtctggttctagctgaatagccctgtcataacaagcagtggcatccctcagcaagccaaggctttcatgttcaaggatctgttcttttagagatggttctgcctttctaattgcactgactccggccactccatcaggttcatgcatagcagcatacaatttctttgttcaatgattaaaaaacaatcaaaaacaagaaaaaaacacaactggaaataaaactataaaaccacctgtttatattgaaacagcaattttttgagaaatttttcctcaaagtaatagtaagcatttgtttcatggcaaagtcacagtaaaattataaacttatttccaggcattctattccctcaacattcttactccttttaaatacaaatctatatcaatagctgttattgatcataaggtttataaagaacctcaggatcctaaaactgtctagatccaaatgataacatattctgttgagtatagcttataagagttttattgaatttttaaatttttaaaaatgtaaataaccattttaatatattgttattgagatgacttcaagaaaaccaagacagcaatctgggctcaaaggagatattcaagctaaagataaaaatttaggaatcagttagcacaaagacagtctctcacaacatgagaaagaatgggatgatctaggaaatggataaagaagaaaagcagactgacgatagagattagagtttctacatttatcaagaaggaagagctggcaaatgaaacaggagaagtgagataacttggaagaaaactggagaataaaatatcccagaagccatgggagaaaagcaaatgatgtcttaatgagaaaggcatggtcaatgatactgaggttaagaaaatgagggctgggaaaaatttactggatttggtaacatgtggccaccaattttcttagcaagaatagtgtcaacagaaaagaaaaagagaagtcttgttgaaatgggcagagtgaatgagaaacaaagaagtgactgcagtataaagaaactagacaattccttcaaaaactggttgtgaagttccggaaacagagagatgggatgtatctaaaggagaaggtaggatttaccagagcatgtctatatgctccatatactctggttcccaaagagaaattaattacactagagaaagaaggaatatatgaagaagttacatcttgaaattgagaacacaagtagaaagattgaattttgacaggaagaaatccttccttaaaaataacagaagaagccaggcacagtggctcatgcctgtaatcccagcactttgagaggccaaggcaggcagatcacttgaggtcaggaggccagcccaggcaacatggaaaaccccgtctctacaaaaaatacaaaaaattagccaggtgtggtagcagcgcctgtggtcccagctgctcgggaggctgaggtgtgaggatcccttgagcctgggaggtggaggttgcagtgagccgagctcgtgccactgtactccagcctaggtgatagagcaagaccctatctcaaaataaataaataaataaaataacagaagggaagaaaaagaatatggtgcagatgctgtttcatttgcagatttttcctaatgaatcatgaagcaagattgtcagctggaagcagggaaacaaagtgaaggtaagagacagtcatcttgacaaaggggaaagtagccttactagagaaacacagccagcctgaaggtaatgttagagtcctgcagttttaaagatgtttgagatcatgaacttaaactgaaaccagttataacacccactgtgtaatttttctccagctgcttacatggttggagtttgacaaacggagtacaacacagtgggaaaaagacaagaagttgagcatcactctaagggaacgattttaaccatgaaccatagacttaaagctggacaaggaggaacacaaagataggaaggggctaatattcatcttaagactgcaagttactaattttctagttattttatcacactttgctttttgatttgaaaagcccaccaatcttgagctcttatttaattccactgtattcgcctcacctgctcttactttcttttcttccctacacaatcataacatcgcctaaatcattatttcaccagcattttcatgcttgatacctgacataaccggcacttgcccccactaactcactcccaaattcaggaccacaactctcacaaggagaagagtaattccttgaatcatagcccttccaaactcctcctccacaactgccacaggcatttagctaaaattccattgtgaccataacacttccctagttcgcaccctccaagaagtttgggcaacttaaaaagtcttctattatttgtgatctttcctctaccattccaaaaccgacactttactctttggcatataccatgctcttttcaaacactccacagagatgcctctgattataatgtcttgcctccctatactgctcattttttaagacaccatctccaagaagccattcctgacctctggctcatccgcttccatctcccaccctattccacatggatgagttaagtgtccttcctcagggtacatgtgtgttactgtacttaaaatattataccaaattgatgtttatctctccccactaatctataagcttctaagcatagcatataaaacattcaataaaatgaacaacataaacataaaagactggccacattaattttcattattaaattcactatattaacttcagacctgtaaaaatccaagatgttcctgaatattttgcttcttttctgtaataaatgattcaaagtgcattacagctcgtgtgtatgctttggagcgaaaggaagctactgccagagtatcctggggtatgaggtctagaaaacgggttacactctgatagtcttcataatccacagtagatactagatcataaaaaaagttgagtaattaaagacttataagataaaatttaaaagtgtcaatttaagtatttaagttcaatttatttcactaaacaaattaatctgaatatattaggatatcatatttagaatgtaactaacaacagaacaattgttcagagagtcttgctccaactctgccattataacttacctttctttggacagtcatttaatttactgagcctctatttctttacctataaaaggaaaatgttagtacctgtcttgccttccttacaacgttgttggtgaggattaaatatcaatctattattaaattttgaaaagatataatgatgatacaaaagatacaagattagtcattatttttgatgactataaaaaatgattaaatgtagctattttgtagggaaacttcaaaactatggaaataatcttttttaaagtttagaattcattgttatccacctattttttcttggttgccaaaaatacagtatcacctattacaatagaaattgaaagtaatggctgggcatgatggttcacgcctgtaatcccagcactttgggaggccgaggcaggcggatcacaaggttaggagatcgagaccatcccggctaacacggtgaaaccccgtctctactaaaaatacaaaaaaattagccgggcgtggtgacgggtgcctttagtcccagctactcggggggctgaggcaggagaatggcgtgaacctgggaggcggagcttgcagtgagctgagatcacgccactgcactccagcctgggtgacagagcgagactccgtatcaaaaaaaaaaaaaaaaagaaagaaattgaaagtaaaagtgccttcaaagtaaaaccacaagtactttaggataatttttcaagagtgtacaaaaagacaaaaattaaaaacttctaaatgaggacagtctagtttatgaattatttaaaacttctaaattttaatgattcataagtgtgtagaaaacaggcaacaaatttcttcaaaatttaaataaggcagtatattttatttttatttatttacttactttttaaaaaaaattattttgatctcattctcactgaggctgcagtgcagtggcaagatcatagctcactgcagccttcacctcctggacttaagtgatcctgcctcagcctcccgagtagctgggaccataggcatgtgccaccacgcctggccaagttttgtattttttgtaaagatgaagtctcattatgttgcacaggttgatcttgaactcctgagctcaagtgatcctcctgcctcggcctcccaaagtgctaggattacaggtgtgagctaccacacctagcctaaggtagtatattctaaacagattatatttaaaataaggtccttatttccatcaaaatttgtagatgatttcaaattctgattttttttttttttttttttttttttttggagacagggtctcactctgctgcccaggctggagtgcaggggtgtgatcttgtctcaccgtagcctcaatctcacaggctcaagcaatccccacacttcagccttgtgagtaacctaggactacaggtgcacaccaccacacccagctaatttttgtattttttgtagagatgggggtctctacaaaaatgttaaagaaatgttaaaggtattgtacttttgaatcattacaaatgttattcttaaaagctagaattttggccaggcacagtggctcacgtctgtaatcccagcactctgggaggccaaggcaggtggatcgcctgagcgcaggagtttgggaccaccctgggcagtgtggtgaaaccctgtctccattaaaatacaaaaaattagtcgggtatggtggcatgtgcctgtagccccagctactcaggaggctgaggcacaagaatcgcttaagcctgggaggtggaggttgcagtgagccaagatcatgccactgcactccagcttgggctatagagtgagactgtctcagaaaaaaaaaaaaaaaaaaagctactgtcactgaaaatggtgataatagagtgtttggttttacagtaccattttgacatgcagaaataaaaactaacaggctggttgtgctggctcacacctataattccaacactttgggagatcgaggcagatggactgcttgagcccaggagttagagaccagcctggccaacatggtgaagccccgtctctactaaaagtacaaaatattagctgggcatgaggcatgagaatcacttgaacccaggaggtggaagctgcagtgagccaagatcacaccactgcaactccagcctgggcaacagagagagacttagtctcaaaaaaagaaaaaaaaattaaaaaacaaacattcaatagttaaatataaaaatatattaatagccacattccagacaaaaacattctccaagcaggtaattattggcaagtccaggaaatttcagaaaaataataaactattttgcttaacaacaggaaagtatctgcttcaacagaacaagagggagatgctcacaaactgagaattatggaagtgaaggcctctttaaggactgttagatagtttttcaattagcctgaaagcctgaaggaaaaatacttgatgtctgtgagaacagctaaggtataaggccagattataaccatccacttattgccaagaatggaaaaaaaaaaaaggttcaaagaaagtaagaatatccattagtgtgtgatgaatataattcttctcatcaatgcttatatcatagggacaaattagcagttgtcatttttaaatcaagattcttcttagtgaaagttgtaatatcacaggaaaaaaacagtgcaaggtaagatagagcagggtgtagtgtagtaatgcatactaagcatatctggacagctggctagatatcaaacactactagagacaagaaaaataaataaataaaaatagcttctctttaggccatgaaataaataaaattaaaatctcccttgaaatttaaaacttaaatgtgaaaaagattacaaagaatattttccaagtgaagaatgacaaagaacagagtacacacatacacacacacacacacacaaaaactgaggaaacatataatatgttaacagggaggattaggttaataacaatattagcatctcatttatttcacattttataatttatctgttcatcatctcatttattcctcacaataatctcctaagggagataatattaaccccattttggccaggtgtggtggctcacacctgtaatcccagcactttgggaggctgaggtgggtggatctcttgaggccaggagttggagaccagcctggccaacatggtgaaaccccgtctctactaaaaatacaaaaattagctggccatggtggcacacacctgtaatcccagctactcgcaaagctgaggcaggagaactgcttgaacccaggaggtagaggttgcagtgagccaagatcctgtcactgcactccagcctgggcaacagagcaagactccatctcaaaaaaaaattaataaataaaaataaaaatattaaccccattttatacaaagaaaaaataaatatgtgccttgtcgaagtgagagtaagaagagagaaaggtcttattactataaattcactgttttttctcagtgaaaaggccacactattacccattttaaaaatacacaaaacagctgggtgcggtggctcatgcctgtaatcccagcactttgggaggccaaggcagatagatcacctgaggtcaggagttcgagaccagtctggccaatatggcaaaaccctgtctctactaaaaatacacgaaaaaattagctgggtgtggtggtgggcacctgtaatcccaactacttgggaggctgaggcaggagaattgcttgaacccgggaggcagagattgcagtgagccgaggtcacgccactgcactccagcctgggcaacaagagggaaactccatctccaaacaacaacaacaacaataaaaaacatgaagcaaggtattttttaagctagtgcttaaattatagaactgataaagggaagagctaattggtgaatagctaaaaaaaaaaaaaaaaaagaaacagaagtgataactcacccattgagtctaccttatttctgtttgatttgctgtgtggacatttctcagctttcagtgcctgaaatttgtgccttgcccactgtgtgagatggtcaagcatggagaacacagtctgtgtactgagttgacacagatcagatgcaatgtcttgggtatttatggtatgctgatcgtcatgctttagaactgccataatttctgcataaacctatgagaatcatttataattaataataatatctatataataccatttaactattatatgacatctaaagctaaccattctaaggcaaaaattttcaaaagaaaaaacacaattggccaggcatgttggcctgtaatcccagcactttgggaggctgaggcagcccaattgcctgaggtcaagaccagcctggtcaacatggtgaaaccctgtctatactaaaaatacaaaaaaattagccaggcatggtggcacatgtgtgtaatcccagctactcagaaggctgaggcaggagaatcacttgaacctgggaggtggaggttgcagtgagccaagagcatcactgcaccccaacctgggcaacaaagggaggctctgtctcaaaaaaagaaaaggaaaacacaattgatcaataatacattcctctattgttcttatctataattaaatcaatccaaatattagtctaaaaagaaaatatgttaacgactaaagaaaattttaaaaattttaaaatattctagattattcaataaatgataatgaaactttgttaacagtgaaaaaaacttacagtaatatttcacactatatgcaaaattaagttcagagtaattgaagactaaatataaaaacagaaggattaaaagaaaatatagcaaataagttcatgacattagatgaggcatcacataaaaggtttaaaattaataatctataaaagatgtataaattttgcatttacatttaaaatttctgcgtggcaaaatgtgaaaaggttaaaaagaaaatgactaagttggaataatttttgaaaatatgactggcaacaaattggtagctagaatatacatagaacgtctatcaattaaagggatacacacaccaaacaggcaaagatatgtaaatgaacatacatagccatacataggtctacatttcctactaataggtagcctttctaatactaattacattggagaaagtaagtttcacatgttcaaaaaccaagtaagatgatttatctcacctcctgctgatcttcttgattacaacccagtaagacatacaccagaatatgtggaagaagatagatggtcactttgaaatcatgcttcatcataatgctacagcaggtgaaaattttactggcaagatcatgtcgaacctgtaaatgcaaaatgtgtagacagtaacacactttcacatattgattaaatgtcaaagagtagcatgtgagataatttatcacaaacgagtattcatttttaaatttaaaaagttttttaattaattttttaattaaattatttggggttaaagtcaaattttgttatgacttaacttttgatttgctaacactgttgaactcataaaattttaaagagattttttcttcaaatacaaagccaaaaaacaaaaaaaaacccataatattccagagctgaaaatagttaacagtattccacatttcacacattatattttcagtatattcattaaaaaaagaaaatgtcagccgggcatggtggctcacgcctgtaatcccagcactttgggaggccaaggtgggaggatcacgaggtcaagagatcgagaccatcctggccaacatggtgaaacccagtctctacaaaaaaaacacacacaaaaattagctggtatggtggcgggtgcctgtagttccagatactcgggaggctgaggcaggagaaccacttaaacccgggaggcggaggttgcagtgagccgagactgcactccagcctgagtgacagagcgagattccgtctcaaaaaaaaagaaaatgtcttgaagttactaactacgaattagtataatgatattttaaaacactaacagaaatgttaattaaaggtggggcacggtggctcacgcctgtaataccagtactttgaggggcagaggcgggcagatcacctgaggtcaggagatcgagaccatcctggctaacacggtgaaaccccgtctctactaaaaaaatacaaaaaaattagccgggcgtggtggtgggcacctgtaatcccagccacttgggaggctgaggcaggagaatggcatgaacccgggaggcggagcttgcagtgagctgagatcgcgccactgcactccagcctgggcgacagagtgagactctgtctcgaaaaaaaaaaaaaaatacaaagattagccgggtgtgatgactcatgcctgtaatcccagctactcaggaggctgaggcgggagaatcacttgaacccggtaggcggagacttacagtgagccgagatcgcaccactgcactccggctgggtggcaagagcaagactccgtcacaaaaaaaaaaaaaaaaaaaaagaaaggtaaattaaaaacaaaaattgtaaattttaaatatactgtaaacattttcttggaacacagagtaccttttgtctatccagcatgtaaaaatttctcattaaggaaatagaaatatacctgtttttctatgaaaattcattgtaaaaatctttatttttattttagagaaagttcagataatataacttcttttagaaatgctattagagtataatatatctctttattgaatgtctttttattatgtaaaaaactctgacatagcatttacatccttttacatagtattattttacaatataaaaggaataaatgtaattttacacacacattaagaccatagtaattttcttggtaaaacaattacttttcactcagaagctattattagtaactacagagaaattattattctctattagttaacattttcttcaaaaatttctatgattatcagcacaaatacttcaatgattattgtgtgtgctaggcattcagatagatgttctggtttcctttagaatttccattcagttaacaaactgaacagggtttcttacctttgtaataagataacctgcccaagatgctgaccattctgcaaagttactacccaatttacttaagtaaattggcttctttactccagaccaatcggttgacttctgagaactcttgtatctgtaattttgaaaatttgtttattaaaaagataaatccacctgtttagaattttagtaaattacagcaactccttcagttgactacctcagtactgccttgcctttactgcaatctgcttacctttttccagtatccttcttaggggtgaagtaggtcattcttggacacctaaagtacttctaaggatttgagtctgccccctcctcttcctcagatccttccaactctcttcttatataagaaaaacctgttcctttgaagttcaagccacccaggtatactaccattttctactcctcattatgggtaactatgcaacacactgattaccaaactcattgataactttagaacactgctcagggttttctttcttcccagtgttattatcatcctgggtgacttcagtgtctagctggagcacttaatcaagctcagaagtttccaatgactttcttctctacttatcagggctcaggaattatcagggctcccatgctaattcaaagaatttcttcactttgaaatcaattatttagacatctcattgtatggtcatagtttcctaaatttccagttttttcacccagttattccagcacacccattctctcttgttgagatcttctgttccgtgaccctgctaagctctcctgatctatgacacccctgtctctttgcctctttccacaaccatcttagtctgtatggtccttcacttctagcattctcttggtaatatcctctacccactccattgccacactgtcttttccagcggtattcatctgctaacctcccaaccttgaatcagtctaaatatttgtctttactgaaatgatactcaggctactgcactgatacaggaaaatcactaacccacttataagattagtactactatgtattcttagtcttcaaagtcagtgggccgctaaagttacagaattccttctacgttttcattattggctctcttctgttttccagtgattatttcaaaccatcaccaccctcctaaagtcacctacaccaactccattgccactttcagccaatgaggtcatctcctatacctcctacttcacagagtaaaaacaaaatcattgcttcccgcaatgaaatctgtaaacttagctgtgttccatccattattttatctttccctattgcaaaaaaagagatctattccttctaagtataattccctataagggccacggctctcccattccggatgctccttggggtccttactacaccaactatcacttctctctcacattacttcaacatgaccctttctatttgttcctcagcattaacatttaaacatgttcacacagctctcatcttacggctacctgtgtgtaggatttttttgaatggcatgggtttctttcaaatcaccaataaaagcttaggaaataacaaatgccctatacccaaagtcttatacccaaataatatatatatatatatatatatacatatttcactgtattccaagtttctaacagttgaaaaatccaataatctctcagttaaccatcacactaaaccaggagaaaaaattcaaatccctattttgaatcatcacgcgtatagttctctggatgatttttatcaaatttatagtaaacttagctagaaaactactgatactgggatacaagccaggctctgcctagtcataacctgatgttttctcctaaagttatttctatggtgattttgaactgcagttgttctatctggttctaaatttcagtctcccaaatacagccatcctttaatccagatttagtgattatatataaagagcccaaattaaaaaaaaaaaaaacataaagtagggagtataacttaaaggcagcaaaaatatgaatatgcttttaagaaattccatatttccctaggtcctctggagtaaatatcaagcagtccaagctataaaattgagctacaggctaacctggtattttagtttttcatacaaaagggaatcaacgctattgaaaacgcactctatcaacctcttaattttatgtggctccaatttcaataagcagatcccaactaggtaaatctcctaacttccatcattgaggaaccattcgagaggttattctaactgctcaggtataaaagctaaagaccaaaagaatttccattgctttgttaagatctacttttaaaagaccacttaaaagttgcttcctatgaaaaacatgacaagtaggcagaaatgttggcttctacttcttatgaagtatatgatagccaacctcacaaattctccccccaaaaacaaagaacttattaagcaagctaggattgaataagcatttattattgagtgtcaactaaatatcaggcactttgctaagtacttttaatattatctcctttattcctaacaataatcatacaaagtgggtaaaattatccatgttttcaaaattaaaaaattaaaacctggaaatgttaaataacttgcccaagacttcagagctagcaaatgcaaagccaacaatcaaacctaagcctgtgtgactacaaaggtcataaactttccagtagattacagaaattctttgacatctacaggtgctatacaaaatacagactaagaaaatgggggaagtatggagtcctcaaaaatgaaaatccaaattttaactttagtctttaactttactttttaaataatgctaatagtggccaggtgtgatggctcatgcctgcaatcccagcactttgggaagcccagacaggcagatcacttaaggccaggagaccagcctggccaatatgatgaaacttcatctctactaaaaatacaaaaagtagccaggcatggcggtgcacgcctgtaatcccagctacttgggagactgaggcaggagaatcacttgaacccaggaggtagaggctgcagtgagctgataccgcatcactgcactccagcctgggcaacagagtgagactctgtctcaaaaataataataataacagtaataattcttctttaataaggctaataataataatgctaaataatcacttctttaataatgctagtcataagacataaaatgatgtttaaaagatttctaagtataaaaaattatctaggaaataaatatgcatacctctgggcttttataaagactgttagtataagtctaggcactttctaaggttcaaagaagttatttgtccaaagtcaagtatctaatatgcatgtgtacctagggtaccaaaaagtagtttctaaatagaaataatttatagttgtatggatttttttcatataaaatgcttcatgtatttgcatgtcatcttgcatatttcgtcagtcctaacaaagtcatttaaattttttaagagattaaatacatttttttaaaagcagagggtgaaaatatattcatgaggagaaattgggagtaatgaaaatctttaattgggcctactaaaggctttctgactagctttaaactttaaatttctgtattacttatacctatcaaagaattcaactcacattcagcttaaagtatattctttcaatttactaccgaccattgaacttttaaaaaaatcaatccttttaacttcaataaatttatctgaatatttaaagttgtagaatttaacccaatgagcagactgcacttctcatctagacaaattataagcataaatcatagtgaaaaatatacatgaggagatactaaaacacttttaatgttaaaaaactatatcaaaaatcacattaatttttttttttttttccaaacaaagtctcgctctgtcacccaggctgtagtgcaatggcacaatctcggctcactgcaacctctgcctcctgggttcaagtgattctcctgccccagcctcccaagtagctgggattacagatgtgcaccaccacgcccggctaatttttgtatttttagtagagatggcgtttcaccatgttggtcaggctgatctcgaactcctgacctcgtgatccgcccgcctcagcctcccaaagtgctgggattacaggcgtgagccactgcacccggccaaaaaaatcgcattatttttatataattaaaaacaattttatgaaaatacattaaataagcctacatacctggtatttagatgaggttctagtatttcccgaacatgctcaggaaatctcctccacaattggtgacctgggccgttggtctccatctctctacagtcataaatagaaagcaactcctacaaatacatattttacatttgtaagtccacagtgaagcagataacgctttatattcgtcaatgttctacatatcttagttataaaaatacagccataactcattttattgcacttcgctttatttatgcttcatggatgctgttttttttgtctgtttgtttttttagaaatagaaggtttgtggccactatgcatgcagtaaatctatcagtgccattttcccaacaacatatgctcacttcatgtctctatgtcgcatttcggtaattctcaaaatatttcaaactttttcattattactatatctgttatagtgatatatgatcagtgatctttgatgttactgttgtaattgctttggggctccacaaactgtgcccatataagacagtgaacctaatcgataaatgtggtgtgtgttctgaccagccgttccatccccctcactctctttgggacttcatatttccaaagacataagaatattgaaattaggccaattaatgaccctacagtggcctctaagtatacatatgaaaggaggaatcgcacatctctcactttaaatcaaaagctagaaatgactaagcctagtgaagaaggcatgtcaaaaacctagacaagccaaaagctaggtgtcttgcacctaacagccaagtataaatgcaaagaaaaagttcttgaaggaaattaaaagtgttactccaatgaatacatcaaatataagaaagagaaacagtcttatttctgatatagagaaagttttagtggtctggataaaagatcaaactagccacaacattcccttaagccaaagcctaatccaaagaaaagccctagttctctccaattctatgaaatctgagagaggagaataagttgcagaaaaaaagtttgaagtgatacaactcaaggggcgcttcttaaaaaacaaaaaaaaacccaaaaagtttgaagcaaacagaggttgcttcatgaggtttaaggaaaagaagctgtctctataacataaaagtgtaaggtgaagaagcaactattgatagagaagctgcagcaagttatccagaagatctagctaaaatcattctattctgttggaagaagatgctatccaggactttcacagctagagaggagaagtcaatgcctggcttcaaagcttcaaaggacaggttaataactctcttgttaagggctaatgcaattggtgactttaaattgaagccaatgctcattgacgattccatacatcctagggctgttaggaattaggctaaatctaaatatatgcgtctactatatacccataaaaattgaaaattagaacaataaaagtaaaaaaaatttaaaaataaaaaattatgtgaaatctactctgcctgtgctctataaatgcagcaacaaagcctgaatgacaacacatctgtttacagcatggtttactgaatattttaagctcactgttgagacctactggtcacaataaaagattcctttccaaatattactgctcattgacaatgtacctgtcacctgggagctctgatggagctatacaaggatattaatgttgttttcgtgcctgctaacacaacatccattttgcagcccgtgtatcaaggggtaattttgactttcaagttttattacttaagaaatacattttataaggttatagcggccacagatagtaattcctctgatggatctgggcagagtaaactgaaaaccttctggaaagaattcactattctagatatcattaagaacgttcatgattcatgagaagtcaaaatatctatcaacattaacaggagtttgaaagaagttgattccaacccctcctggataactctgagaggctcaaaatttcagtggaggaagtaactagagatgtgataaaaacagcaagaaaactagagttagaagtggagcctgaagataggactgaattactgccttctcatgataaaacctgaatggacgaggagttgctttttataagcaaagaaagtggtttctggagatggaatctactgtggttccactcaaaatgctgtgaacactgttcaggtgacaacgaaggatttagaacattacataaacttagttgattaagcagtggcaaggtttgagaggactcattcaaattttgaaagaagttctactgtggggaaaatggtatcaaacagcatcacaggctacagagaaacctttcatgaaaggcaactgatgtggcaaacttcgttgtctgatttttttaagaaattgccacagccattccaaccttcagcaaccaccacggtaattaatcagcatcatcaacattgaggcaaaatcttccaccagcaaaaccattatgacttgcgaaggctcagaagatggttagcattttttagtaacaaagtattttttaaataaaggcatttacattggtttttagacataatgctattgcacacctgacagactatagtatagtgtaaacataatgttaatatgcactgggaaactgaagaattcatgtaacttgctttatagagatacttgctttattgtggtggtctggaactgaacccctactatctctgagttatgcttgtacatagaaaaataaacagaattttatagttttagagctgtgaacatccttaggacatttatttcaatgcctagaatgatttaagtaactcatttaagtcacaaagctgaggcagtagtatatatttgtatatacatacaaaaattttgaaagtaactatacctataataattggttaagaggtatgcttctgtactctaaaatgtttatcatgaacttgtataactttgataaaagtgagaattaaaacaaaaaggagtttcacaagtatagaatttacaacgttcttatttgaattaaacaatttaaagccagtaatgactatatccactcttacctgaatggcataggcagctgaatcttgagctcggctattatcagcatacgcaaggtaagctcttgttagctccatcaataatccataggcaaagcttgaatcttctactccagtctcaatcagaaaaaaaaaaaagaaaattccaggataactgctataaattttcttaggtgtactgctttttccatggtgaatttaacttaactgcgtaagtgaatttaacttagacaaaggaaaagacagtgaggttcaaactaagtttggtatcaagactacaatataatctgtagctaaaaagccaaaatgtaaagctttttaggctatttctaaggtgtacaaaaaattattcaacttttgcatatctctgacaatttgcattgtttgttttttaacccttaaaaagcaaaatgtaggccaggcatggtggctaatggctctaattccagcattctgggaggccaaggagagcggatcatgaggtcaggagttcaagaccagactggccaatatggtgaaagcccatctctactaaaaatacaaaaattagccaggcgtggtggtgcacgcctgtaatcccagctactcgggaggctgaggcaggacaatcgcttgaatccaggaggcagaggttgcagtaagccaagatcgcaccactgcactccagcctgggtgacagagcgagactccgtccaaaaaaaaacacaaaatgtatacatagcatctcctacgttgcattctgtagagcccaagagtcatctgagaacctctaaggaataattttaatatacgcatatagtataactcttggagatatagtcttagagattcacaatgcacacagatacattaaaagtcacattttttttaaaaggtcacatttaattttgttctatatggagttcccaaactcatttgactacaaaacattactactgtaatatcctggaaactagttatccatggaaacactagcaataatgtttaaaaagtaatatttaaataattgattaggctttaagtattgtcattattatattaggaagctttatttacaagaatataacaccctagatggggttcaaactttattgcttttggctaaaggtttctgcaatagtaaaagaaataaactcagaagttaactgattgtctggttctaggtgaagcttttattaaggataagctgaatagttctttgtaaatgaaatatataaacctcaataggacagagaactcttttgtcattccaaatttccactacttaccacaaatgtaaaatcttttccttgagtttcagttgttgagaaatctaatcgacctggatctatcgcccccaattcccctaaacattccccacagagcaaccgagcttgagagtttgcatcttggcaacctttcaaaagcactgtcaccaactgtgagataataggttctactgtttcactgtctgttgcatactttatcagtttttcctaaaataaaagtagaaagaaaatttatacgtaatttctacaaactagtatgttttcctgagctaggaagcttaaaaatattaaggaatatctaacataaatattgacaaaattaaatttctgtatctgcaattttttcagctagtttttgatgagttcacataatatagttcaacaatatgtcctgtacaattagaatcattaaatgtctgaaagtctttgatcattaatccattaaacaagcagttactgtgcattttatcaatatacaaaaaatcagtaaaacaagtcttaacaagttcacagtctaagaggaaaacagacaaataactaaaatatcatatgatatgtacaataacaaatatacttgtacggcaaagaagcaatgaataagaaaaaacacagagtaacttttaaaggacagtggacagatatttcagtagataagtggaggagcaactattaggttaaaacaagaagtttgaaaagtgtataacaactagtaaagaaggaaaaaagatataaaaaagggttctgtgaggatggaaaagagggaggaagaaagaggtagcctaatgataaatatgtcaattcaaatagtcttttttcagctatctcttcaggatgctgtaatgaataaaatgttaagtaagaagaaacaattctcaagccagtgaagatttagaccttgcacttgtgtgatcactttaaagctacttcatttatattattttctttctagcacaagtcaagtgtataggagcatctcaaactccatgttagaactgtaatgagtaatacaaattactgtaatacatttcaaaagaaaaacgaaaagacatttaatcttatccagaatcttcaatagctgatttcttaaataacattacaggttaattcagctgtaaagaccgcctccccacccccacacatacacaccctggtaatcagttaaaagtaaaactcagataagaagtgtcactttttatcatatactaaatgtccatatgtacttgggtctatttctagacctcctattgtttcccactggtctggttattcatatactagttacctctttgttataactgtagtggctacaaagtatattaatgtttggttgggctactatattctcataacctttttttttacagggggagtttactagctattttttacatgttttatttttccatatgagcattattataaacctcctacagttaaaaaaaaaacaactttggtgacattttcattgggattgcattccattaattaacctaaggagaactgaaatcgttataacatcaacctacccaataataagggattgatatagcttaggtatctgtccattccaaatctcatattgaaatgtgacccccagtgttggaggtgagatctggtggcaggtgtttgggtcacatgggtggatccctcatgaatggcttggtgccatccctgtgataataagtgagttctttctctattagttcaggtgtgagctggactccattagttcaagtgataactggttatttgagagtatggcactcctcccattgctttcttgctccctctctcaccatgtgatatgccaactccccttcccctttggctatgagtaaaggctcaggcttgctgaaaccctcaccagaagcagatgctggcaccatgcttcttgtataggttgcagaaccataagccaaataaacctcttctttttaataaattacccagcctcagggtaatttactataattcctttacagcaaagcaaacagactaaaacagtgatggtttccatttagttaaatctattacccttttgtgtctttcagaagcattttaaaatttttcttttgttggtgtatgcatttcttgttaagtttatactcaactatattgttttcctgttgctattgtaaatggggtattccaaaaaaatttctacctagttaccacttgtcatatgaaaattattaatttttatgttaattttatatcccctattttactgaattcatctgtggtcaagttagttttatcagtaattctctataatttccgaagtatattagcataagaaatggagataattttacatcttttccaattcttatgtctctgattatcatatcatctgtaaatatagttttacatcttttccaacttttatgtctgattgcttttttccctaaattccttagccaatacctccaagtgaacgctaaatagtgcagataataggaaaccttgctttcagtgggaatgtttcttgtttcccattaagtatgtgtatatatgtactatgtatatatatacatagtacatatataaacatgcatacatatatgtacacatatacattaagataatattcatcaatttctgttttcttgagtgttttcatttgaagtaggtgatgaaatgtgtcaaagtctattcggcatctatggaaataatagcatgattttctctttagatctattaatatagtgaattacattcgtggattgctaagtattaaccatctttgcaatactggaataaaatgcaactggtcatggggtattgtgggtttgtttttgtttttttttttttgagacagggtcccgctctgttgccctggctggaatgcagtggcatgatcttggctcactgcagcctcaaactccccaggccaaggtgatcctcccacctcaacctccaagtagcttggactttaggcatgtgccaccatgcctggctaatttttgtattttttgtagagatggggtcttgctatattgctcaggctggtctcgaacccttgggctcaagcaatccatctgccttggcctcccaaagtgttgggattacaggcatgagccactacacccagcatggggtgttttcttaatgtgaaattgatttgtttgataatatttcatttataaatttttacactgatattaatatgataatctttaattttttgtttcatgctatcttttttcggtctactgaacactgttatatattgccgcttttttaaaaatggaagttttctttcatttcctatactccaggacaatttaaacaccactgagactatttagtttgtgaaaatttgatttaaaaatccccttatctgggcctggtgctttcctatggatgaagttcttttataatattctctatttctcctacagaaactaatcttttaagctttctatttcagctagagttcattttgatacactatatattccaggaaaagtatacatgtttacaaatttatttgtgtaaaagggtacaaagtagtctcttgtgatttttaaataccttctatgtttcaacagtttattatttacatatttgacatttaccaatttcgctagttttttgctagcatttttactcattaattaattttactgctttctgttctctatatttctgcttttatttttattattttcttcctgtactatcttttcttaaatagttttaataaaatatttgtttcacatactataaaattaactcttctaaggtgtacaaatgaatggtctttagtatattcacaagttttagtataatgaagtatatcacaagtgcaaccatcacttctatttaatttcagaacatttttaccatctcaaaaggaatctgtacccatcagcaatcactccccatttcccccaaacctcctaaccctaggcaaccattaatctactttctatctctatggatctgtttattcaagaataccaaaggttgccagcaaaccaccagaagctctcaaaaggaaccaaccctgccaccaccttgatctcaaacttctagcccatgggagctgtgagacaataaatttctgtttctgttgtttaaagtcattcagtttgtagtactttgttatagcagccctagcaaactaacacaaagatccaactaatacaataatcaatttttatgaatgttctatctgctctttaaagtatgcttctattatcaaggtgtaacgtctgacatatattcacaatagctactttattatgttatttagatcttctacgtatttatctactaacttattttatactgagaataacatggtagtctcctctgattgagtttctatatatatcttcttaagcttcttattttggctttatcaaggtggctggtgtgttatttggagcatattcataactattaaatcttccttatgaattatggcattaagcattaaaaagtatccattttggtcatatttaatgcttttcagcttcagttctattttgtttggtggcagaatgagaattcctgctttcttatactttccacttatctggataatttttgcttatccctttatttttggcctttctgaatcactttaggtacgtatcttgcatgtggtagagagttgtttcttactttgtaagccaatttgtaaattttttaattttaaggttgttcacacttattaatgtgactcagatgcttggctacaattctgtcagattttttattataatacaatggattataattataatacagtatactataattagtgctttcttccctctatcctgtttcgtgtttaaaaaatcatttatttgggtaaggatgacagtttatacttttgttctggaattatcatatatatatatatatatatatatattttttttttttttttttttttgaggcagagtctcactgtgtcacccaggctggagtgcagtggcgcaatctcggctcactgcaacctctgcctcccgggttcaagcgattctcctgcttcagcctcctgagcagctgggattacaggtgcgccatcatgcctggttaatttttgtatttttagtagagacagcgtttcaccatgttggtcaggctggtcttgaactcctgacctcgtgatctgcctgccttggcctcccaaagtgctgggattacaggcgtgagctaccgtgcccagcctatccaatatattaatacctttaatattaattaaaggtgaaatattatttaccttaaaggtaaaataaaaattaaggtaattttttgaaatacctacactccctcttttccttatttgactttctataactagtttgccggtgtaaaatggtatattttgacttccagttattgcctatgcaacaattactgagcttatcttacttactccttactctcccccttctctcatttaaaaaaattgcattatttctagtttattagaatataacatttacatataattatcccacacttgccctattgttgttttagtcttatatatttcgttaaatacataaacagtaaccatcagaccttttgccaaagtctgcccagtcatctcttgacttaatgaagctcatcctctaatacatctcttaggaagggatcacttgtgaaaaccatattacttcaattcttgtaggtttaaaaccgtgttctcatacatgatactctaaggacagcttgactctttcttgactcatactttatgacattttttgacattttaaaaaaatgctgctattttctaggcccactctgtacattcctactgagaattctgataccaatctacttttttttctccttgcaagtaattttttgaaaaaaaattttttggccaggaagctttgaagactttttattattaaagtctaggatatgtctcagagttaattatcctgggtcaattttctccaggatacaagtcttttcaatatgtagattaggtcttttatttccagaaagctttcttggattataattttaaatattaattctgttctcttgttttggttttattcttcagagacatcaattatttgcaggtgaaatctttgccaatcttccatttcaactactttttctttttactcctttttactcctttatctattttactcctttatctcatttttcttctgttttttatacctttattcaatgccccttgctaaatgtttagtcaaatatattctcccctgtagttcttgtaatttaatcttcatttcaatttctttcctaagttcaatcaccctcgtttcatcttggtttttatttctcttgttttttaaatttttcatgcaactttttttatatctgaaaatgattgtttaaaatattcaattaaagttatactgctaagttcaatcttcttccatgttatggttggttttgaggaggaactgtcatcaattcacagactttattttcattttctatttttgtcttacaggaaccttgcatacatatattttttctacacatattgtgaaatttctaaactagaaaaccctccataacagctatctgcagtaagcattctgtagtggcttcaggatttctctttcatgagtatccacgtcagcatagtgaagtgcagttttcttcatgaatagcttttttttctttttctggtagcagggggaggatttggttcatctctgattttgtacatttcttttacttctgcaggacccttaaaattctccctcttactttcttctttctgtttatgccatagtctctgaagagtgcctctcctctcctcttcttttactactcccaagaaactgattttcagagactacaaacgttgggcatactttcaagtaccttccctgtagccagtagtctgacataccacatcctggacttattttcagtaatgttgcacttaagagtatgactctctttctgttggtgattttctctttgctccatcaattcttagttcctattcttcattttcttctttttttatacagtctcatcagaacgtacccgctctcaacaccatacaaggttaagatatgagctccacagatatctctgttagttacaagtaatttgaagttcataatattctgtctcaaagttctgttgaaggtgtaaattatgtgtggtttcaattgctctgcttgacactctttatgatatttcaggggctacacagaaattcagatgtaggcatccaccattatcctaagacaacctgaaagtctctagcagttttattttattttattttattttatttttattattatactttaagttttagggtacttgtacacaacgtgcaggtttgttacatatgtatacatgtgccatgttggtgtgctgcacccattaactcgtcatttaacattaggtatatctcctaatgctatccctcccccagcccctcaccccacaacaggccccagtgtgtgatgttccccttcctgtgtccatgtgttctcattgttcaattcccaccaatgagtgagaacatgcggtgtttcgttttttgtccttgaaatagtttgctgagaatgatggtttccagcttcatccatgtccctacaaaggacatgaactcatccttttttatggctgcatagtattccatggggtatatgtgccacattttcttaattcagtctatcattcttggacatttgggttggttccaagtctttgctattgtgaatagtgctgcaataaacatatgtgtgcatgtgtctttatagcagcatgttttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttccccacatcctctccagcacctgttgtttcctgactttttaatgatcaccattctaactggtgtgagatggtatctcattgtggttttgatttgcatttctctgatggccagtgaggatgagcattttttcatgtgttttttggctgcataaatgtcttcttttgagaagtgccctgcttcggctcatgctcggtgggctgcacccactgtcctgcacccactgtctgacactccccagtgagatgaacccggtacctcagttggaaatgcagaaatcacccatcttctgcgtcactcacgctgggagctgtagactggagctgttcctatttggccatcttggctccacctcccagttttattttcaatagcctcttctcttatgtgtaaacgttagtaaatgtcattttattagaattctgcattgccataaaagtttattttggcttcttacaaagttatctttttgggattttatcaaatggattcctgactagtatcaatcttcagaaaccaattatatggtttcttaatttgatctctagtctgacttttctacatagaaatcattttctgccatccactgagcttagaagtcttctattccttcaaaaatatatattcctccttaaaaataagtagaaggtgtcatctcttcaatgtcaatgactgtctgggactacccatcagtacagggcttttgcagggtcattccataaaaaatagttaagtatctaatgctataccagcgatcatcttattaactttcctatcaccacctcttggaatttgctttgttgctacattacacccaatcatttgtttagccactcctaccacaacttcaggtgtatttttaaataaaaacctcctttcaatccactcttaaagtatcttttcctctccctgtggctaaattttaaattctaaaacagaatcttttgcatctgttgtctcatggactcttaagagtactgactacaaagactctggcctctcatcctcttatcttatgccagtttcatgctctggtggtattcctgtaggttcaaccaacttgtagagctgcactgtccaatacaatagctactatccacatgtggctatttaaatttaaattaggccaggtagagtggctcacacctgtaataccagtactcccagaggcccaggcaaggggactgcatgaggccaggagttcaagaccagcctgggcaacatagcaagaccccatctcttaaaaaaaaaaattaggtgagcatggtggcacacacctgtaatcttagctactcaggaggctgaagtgggagaattgcttgagcccaggagtttcaggctgcagggagctatcatcacacccctgtactggagagaccctgcctctaaaagtaaataagtaaataaatttaaattagcaaaattaaatagaattaaaaattctgttactcagaacataatgtttgagcatatatttcaagtgctcaagagagccacatgtggctagtggctactgctgaagagtatagatatagaatattttcatcctcacagaaaggtcctttggacagtactattggaagtcttaattcaattgtattcaactttaatgctatcttcttgccacagttgggaaaaaacccatttccttctctctttattcctaggtgttttgggccagtgcctgctggagtatggttaggaagacgtgtttctggatctttattcttttcttacctcctcatggatcttccaatcttccttgcctttagtttttcttaccagcctgccataaatttatccagttatagatgctaaactacattaaatacttactttaaaaaaatcccataataatatacggctattatatcttaatcagagtactcaagactcctacaagtacacttcccttcttattctgtctaggtaatctattagcattggggctttacattgaaggaatcctgtaaggaagttgccacatatgatttatcttctgtgatccaggaggcaaagtgaggcagctgcagctttccttaagactgtaagaaatcttcttgaattctcagatttagttatttatatctaggaagtgatgattgaggtgaagtttccttatgttagacaatgactgtgccatctgcttggaaataacctaaactagaaaacctctatgcaaagaggagaaaacctttgtgattcataaatctctgtattaaattaaaaggctaaaagtcctttgagttacctgaaaaccaggtaaaggtatggggctaggggcaagcacagggtagtttcattgtagtttagagcaggaatagaggctgtaacgttgataatgcacatctatagtcaggaaggcacaacacttaacctagaggagattcaaggctcctcccctctgttgggatcatctccacactggctgctacccacattggttatacaaactcactgccccagaaaaatgtgctcattaccatcacgtatatcttttgtcctaagtaagtgcttgcttctattaatggaaggaaatataacccttccattatagaatggtaatcccaaaattcatgagggtcttaggctctcatatcttaccatatgggttctagatatgcaaaaatgagtaattccgttaaattttttccaatttattcatatacagtgatctggtattttaaataccagttctcactatcatcaagtttagggataatctacattatgttgccaaagaaaagaataaagttcactcaccccttgaaaaagtaaacttaaagatttagcttcattaaaactaacgttaattcagtcaaaatgtacaatagtaaaattgctgacatttcatatgacatatatccataggaaatatgtgagaagacttacataaactgctgctgtattatacaattatatacatgtttacttacgaagatgcagtaacctaaaatataaccatcaaatcatgatccttcaaaaacaacaaaaactgcaaatccctaagattcaagctcaaagggcatctcatggattcctaattctcagtcagatctgataattcaggtaaaataaaaatttcttctttcactaaatctcaaacaaaaatgtcattttgtcatcttttctttaagcctccaatctttctttgttatacatttttaattatatcatattagcatacctgatttttatacaaggtttccttcaagcttgtaagagcatgaatacgaacatcgacattttcatgttgaatggccttcatagagagctgaagagttgtctgaagatcagtgctctcagaggtctcctatatacaaagcacagagagacagaacttattaatcaactattttaacaaccatttccaaaggcctgaattctctatatagttaccattaaactataccaaaccaattttttaaagtaatgaaatttccattccttcctttgtacagcacaaatcatttttagtaattctgagggaaagggatttcattgtaaaactgttagacctggagaaaaattttatcccaactaagtaagaatttacttctctaaaataagtacttcttgacaggaagtacaagtttcccttaatttacaaagggctacataatagctttgaaccaggtctatggattatataggtaattcaattcctttcactacccaaggtgacacctaaggtcaggtgtcccactttctacccagaagttctatgaaatcaccactaacatcttcataattttagagagctcactaagatttaagatgctggaattataaattattccccttctaaatctcaggaatcattcacatctgacatttctatatcatggtttgtagcacaacaaaactagaatcatcccacagctttcctttcttctcttagggtgtgccgctgtggtagcgcttctttttgggacaataagtaaggacactttggtctgggtagtaaaggcataagaattgtattttttgctctctgttctatctaatggtgttacatatttaatctaaatgctaaaacttccctccaaaagtcatggattcatggtagcattatctactcaccaggaattagctatcagaataggactatattatccctagatatgatcctaaaggatctttatttcatgtattggaacttgggaacaattctgtattaatgatctcctaaaccacaaattaaaaattaaatacctttctgtattcctggagaacggcttttatcttttttaattctggatgatcaggtaaaaaatatatttcatgaagaaaatcttgcacagcatccctaatagttagttggaataaaaagaattatttgccaagaatatgaatactaaaaaaatgtaaagtaaaagttgaaactaaggccaatttaattcataattaaaagtgctagttgattactgagctgcaaagtattttctaactatgtctaagatgctcagctaaattattagtggaaaatgaccaaagctatgaaaatcactctataatagtgctacaataaaccatgcttctcagcatacaaacccatatatacagtcccttcctcttcaagctgggctgagtgtgtgacttgctttagcaaatagactgtggcagaagatatactgtgccaatttggggcctgttaaaaatgcctgcaagtttccatttgtgtgttctggagagccctgagtcactacgtaagaagtgttgccaccaacatggacagaccgtggtacagagagacagactgtgagactacacggaatgagagagggcccagcccagtctacctgccccctgaatgtggccacatcagtgaccacttgtaagaccagtagaactgaccagctgagcacagtccagattgcaaaattatgagcaaataaaaatgctcattgttttaagatactaggttttggagtgatttggaatgtagcaatagacagacaaagactacctcaatatacaaattatcatgaagaattatagaaaaaaatacataaataatccttgtcagggctataatttttaatttccttctaatataataaatgctctaatctttctgggtccaaatataagcatttctaaatcctagtcttcattaactcatgcaataaatatatattaaataactactatgtgctactacatgctaagcactctgctagtcactggggatggaacaataaacaaagccaaagtagtgccttcattcagcaagcttaaggtcttctatcttgcagcatgatcataactcactgcagcctcaaactcctgggttcaaacaatcttcctgcctcagcctgcagtagctaggattacaggctctttttgcttttttttttttaaatgtttctgtattttttgtagagatgaggttctcactatgttgcccaggctcctggcctcaagcaatcctccagccttgtcctcccaaagtattggtattgttggcatgagccaccatgcctggtcaggatttttcttatgattatgagaaaggtagagaaatgacacttctgcaataaacagcaaagacatgactatgtacaaaaaaatttaaaaggtacttgaaaagtagtcccaaaatctaaattagtgattttgttgttttatcatgcacaaaatataaaaatatcaaaaataaaagtattttaactaaataaaaacacattaacttttccttcttctatgatttctccctcattagacagttactgcaactgactaaagggaccagcaatagcatatgggtgagtaggtaaataagtagtacttcaatcccaacttttcacaagcaaaggaatgattatatacaacattaagtaaaatcacagaaaaaaaattaaatatataaaaagacatcccagtctaaaaagcagcctgaatcaaaaatacaaatgggaaagaataatgcatgttctgtcaatagtaatccacactggctatagcctaatgcctgttttgaaaaattatgggggaagatagtaagaaatagtctgtggccacatttttagaaagccttcaatatcaagctaagcaatttggaatttatcaattaggaaatggagaatctcagaatgcctttgtatgctggaatgacaccaataaagagatatttttaaaacacagttctagtaacaatatcaagaaaagtgatgaaagcttaaaggaagagaggctggttcaaagcttaacgcaatgaggtaataagggtttcaactaaggtaagctgcagaaagtaggtatctctcctaacctttctcatgctattcaactatctgccttttgactgtgaaaagaaaggtaaattaggttacacatttacagaattaatgaaaagtaatttttaactggtgacctattagtgagctttggaaataattataatagaagcaatgccacaactgaaatagcatcatttcaatatgtaattacatgccaattacttttgtttattgataaaccctgaaattcaaaaaagtgacagtttccacattaccatcagtaattttgagacataaaaatacagtttaaaaagttattattttactattaatttcagttacaatacctgttttcaattatgaggtagtggaagatagctgcagtttctttaggctggatgtgtataagaggtaacaaagctactattacatgactgagaagggagcccagacaagcatgatccaggcagcgaacaaagcagtcccaagctctatgtgaaaaaacaaatagaaatgaagtccaattacttttattatttgtaaagctctatcaatcagtaattagttgaagacacatgatatatacaaacaatagattaaaaggcagctttaaacatggaataaagatcagtgctatatattcaaataaagtgatgtccaaattatgtgaagtcaaaaaagcaaggtgaaaaacagtgtttggggcagaattaataataaaaaaaaagtatgtgtgtgtgcatttacttattcttttacagagggtggatatacaaaaattaataaaaatagatatctgtagaggtcgaaattggaatctagatttctgactataatttgttacacagatttgaatttgggactatgcaaatgttttatataacttttaaattaaataaaatagagggaaaaagcaacccttaaaagttttaaagaaactgaaacaagtgaacctaactaaatgttaaattggtagcacatgcacacagaaaataagtacttcacgtgattctaaaacctattctttataaaaattttctagtagctacattcacttaagacttagaagcaatgacagtaggcccaaagagtgcctatgcttggaattaatctgggctcaaaggaaccagagccaggtttccttgaagaaatcactaattttgagtcagaggcaggaaatgttcaagataagcccaggtcatcttgtcatgccagaaagcagagaatctataagagattaatagaggtcatatcaaaactcatagatgccaacttgaagggatttctacttgcttaagatgggacaatttcagcaataaaaaaggatagtgactttaatggataaaaaataatcaaacttataaaaatctacgttatcaaaatgatattaaaaaaacttcactggaggttgctacagcacaaacctatattcctaaattgattaactaaagggaaatattcaagtatttatgaactgctttatatgaactatggttgttttgcttttaaagacaaggtcctgctatgttgcccaggctagactcaaactcctggcctcaaatgatccttccacctcagcttcctaagcagctgggactacagatacgcacaatcatgcccggctagccaaattttatgaggaattttgttttaagaagaatcccacctagtaaatacagaaggaataataaaattagaaaatcattatttcatcaactgcaatgaaataatggacttaggcaatgatcattaattaatgctaaaatcatcagatgaaagattagtggggaattttataataaagggattcaggttgataaaacctactgtctaatcttaccattactaaaagtggacaaccagatattattatgtggctcatactgtgccacaagagaagcacaaagcctcacctatgaggtatgttatcataataaattgaacctaaatctaatcaagcatctatatctaagtacccatttatagaaaagacagggaggaaagaaaaaatagagggaaaagttaaattagctattcgccaaatccaacatcctaaaatcttaacagcctaaaataagtaaaatgtgtgagtagagaatttaagggatgaggctgtttacaagagacacttaaggagccaggcaaccaaatacacatatgtaaacttcatttatagtctaattcaagaaactatgatacatacaaacatctctggaaaaacatctctgatacatacaaacatctctggtcatatacaacataatatatacaatgtctttgggaaaaatacctttgagacaactggaggaaatgtgactaaggactgagttttagattagatatttctattaatcctgctaagtataataattcatgaaggttattttttaaatgtcctcatccgttagatacatctaaagtatttacaagcacaatgataagattctgggatcttctctaaaataccccaaccaacaatcaaaaaggtagaagtggattaaaaaaaactagcaatgttgataactgctaaagttgggaaataggtatgtaggttcattgataactcttctatttcccagtatgttaaaagacttccatagtaaaatgttttaaaagaagtaaatatgttctattttaaatacaaataaatagtctttctaccttatttattatttgaacccaatttccctcaaagagataagaattcaagttagtgctactggaaaatgcaaaaaaaaaaaaaattaataaactcaggcagtcatttacctgcaacacaattcaggaaaatcatccttgaatcgaaggccagttctcagtgtggtcatcatcttcaccctcacagaactgacatgtttgggtcccattaacttcatcaaagacatcaaactgttcaaggcctatagagttaagtagtgcttcagagtaaagcttataaacatgctgccagaagcagatgagccctaaggacaagtgcttcccacccagtatcagggtgtcatctattctcagataatacaaaagattgaataaatgttggccagtttgttttgtccaattgcttatgtcttatgtggtaattataaatttgaaaaatacaagttgagttcttttttgttttttcccttgaaggtgatttgttattttagcccagtattcatctagaacagtacaatttctaatttattaaaggtataatgcatattgtttaatttctttcatatctatcccaaactgccatacacatatataaaacaaactgaattaaaatcatttaaatttgagaccatataacaatttttgtagtaaatggaatacttcctagtaatcagtagttaaggaaatttttgtcctaatgatattaaattcaagatgtcctgaatttagtaaaacaaataattaatgatacactcagaaaatgaaacacatgaaaaacacagaaccagacctgttatcagcagctccagtttataatgaaggggtaaagaaactctggtcgactttatatgccaaaacattttagttatttatggtttacaagacaaactgtagttttcttagattcaaggtgattctctcccttagaatagcaattggggaaacaataggaaagaagccatgtagatggaatagtagttggttgggggattgaatttactagttgacaccaaaagaacaggcattggttgctgaaatttgcaaaatttaatatggtaacatatgtctttcttggctccttaataaaaaaaaaaggaggggagagtatacactgaaataaaagcttccattcgtaggtgttttttgtttgtttttattgtaatcttactgactgcagaggtggaaagcaacagaaagagaaattttatcaatatctaaaattttactccaatttataggacgaaaatttccaacggtggccaactgttgcagcagtcataatgaaacttcactgtggcacaagcatttaaacataaagttgctttacattataataacctaagatttctggtgttcaaaaacaccatgagccatgacccacaccagaccaatctaaaccaaggagactcaatgatgcaacttttgtttgagctttcagtgattgctagtctctctcttcaaatgctggactagatgttgtgatgacgtgagcttgaagccattgaggtcattaactggctcttaagtacagagccaacccagatgaatctgagccaaaagactgactctgagaacttttttgagtccaaaatcaagttatgcctaaagctacatcatccttacgcttttagtaacacagccacaagttccttttagtcactttgggttgggtgttctatccctcctaaactaaagaaatgaaacgaatacaattccaatttttagactcccaaaaaacgtatatgagttcttcagcaatagagaatgtcatatttggttatttctcatctttgaatgtttgtagctagatgcagaatttatctatattctgtatgaattctatcttagcactctggaactatcaccacttaccattttcttatcttcaatgccaacactagagctcagtaactgcatgttaaaaaaagccaaaatgcccaacaatttgggttgtaaataatcagcctaagaaataaaaacagataatatgtaagctttatacagattgaatttcttaagttgacattttaattatttaattaatgtcatttatattttacctaactagattagcatattagaaataaacacttggttaattaagtttctccaaaagcatatatcttcacatgtagtatttaaagaaacatgtagtatttaaaggaatgatttatagtcaccacgaaaaaatatgattaaacagtacagtacaatgagaaaatgatgagttttttaatcatggagtgaactggggtgggatcctcaggatctaattcatgtcgggatgtggggtggagaggaaaagaagaaagaaaagaatagagaaagacaagggactgcccttattctatgacatttagagctatggtagaaaagtacgattaaggaaaaggtattctaccagaataatgatctgacataggggataatatccctggaagtaacaggggaaaagaggcacaagaccatgggcatcaaaagttgcagactagatatcatcatccatgacgctttaggtttcctgaagtaaacagagttccttccttagttccttccttccttccttcctccctccgtccctcttttcctccctccctccgtccatcccttcttcctccctcctttcctccctccctccgtccgtcctttcttcctccctcctttcctccctccctccttcccttccattcctccctcctttgcttccttcctccctctttctctttctttcttcctcttttacttaaacagggttccttccttccttcctccctccctccctctttctttttctttctttcctcctcttttttcttagagttccttccttcctttctatttctttctttcctcctttctctctcttttttcttttctctcctcttcttttcttcctctctcgacagggtctctgtcacctaggctgaagtgtagtggcacaatcacgactcactgcagcctcaacctcctagactcaagcaatcctcccagctcagcctcctgagtacctgtgactacaggcacgcaccacctcgcccagctaattttttgtattttttgtagagatggagtttcgccatgttgcccaggctggtctcaaactcctgggctcaagcaatcctcctgctttggcctctcagagtgctgggatttcaggtgtaagccactgtgctcggccaagttaatactttcttaagagaaggtcctggaggagagggcatgggctttaagtcagccaaatctaggtttgaatcttaattttgacacttcctaatgtgtgatcttctataagttacttaattcttccaagtttgtaaaatgtgaataataaaaccacctactgcatagagttgttgtaaaggctaaataagataccatttattggctaggtgtggtggctcacgcctataatcccagcaatttgggaggctgaggcaggtggattacatgagctcagaagtttgagaccagcctgggtaacatggcaaaaccccatctctacaaaaaaaattagccaagcatggtggcatgcacctgtggtcccagctactcaggaggctgaggtgggaagattgcttaagcgctggaggcagaggttgcagtgggctgagattgcaccactgcagtccagcctgggtgacagagcaaaatcctgcctccaaaaaaaaaaaaaaaaaaaaaaaaaaaagataccattcactaagaacttagtatatagctaagtattaaatcaatttgttcatattactacaaactgagaatgtgaccagtctgtaaagaagaatattcttttgtttcatgtctttatgtacaggcagaagaaaggagcaaaaaaaaaaaaaaaaaaaaatgagctgggaatgagtagcaactaaagcattttgaactccataagaaagttgcactgcttgatgttgaggcatctgatttaggtatcttcaggttccatgcattaccaagaaaagggtaggagggtgtgtgctaccatataatagagaggagtgaggtatcctacaagtctctccagattagatgtcaggataaatctttatcttgcctagcacaggaaatcatctggtttttaaaatctaaaattgcattttgttctgcaaacttctgatttaggttgagactcaactttggcatggtaagccacaattcactaattgtatggttctagcctatgttgcttaaataaaaagcagataaggatcacacaatctctgtcaacattccaatattaaagttcttgcactcagacaaacaattatttgactttatctacctaccaatatattatctatcaccaaatacttattatgtatgcctagaatcctatactgggtacaggtgtacaagataagcagagtcattctctctcattagcttacaaggtagactagcatgaatggaagacactaaataagtagtaagtatgtaaacaaagttgtgataatgctataagaaaataaacacaatcctgtgatagacaagaaatgtggtaagggagtcgagacagggtactcaggaaactcttgaaatctaaagaatgagaaagatccaggagattattccaagcagagagaccatccagggcctaggtctcgaagcaggaaaaagtttggcatgtttaagaaacacaaaggaaaccatgttgaaatatagggagaaaggaagaaaagagttgtaccatgtgagagtagaaaggtaggcagatcatgtatgccttacagattttattttatgttaagggcaatgaaaaccattgaaggaatttaatcaggggaacgatatgagtttgtaaaaagagcactccaaaggctgtgtaaataattaattgtagagagggaagaatgaaaggacagaaccattaggagatgttcacagctgtcccaagaaagatgatcattatttgtgtaagggtggtggtggcagaaatgaaaagatatattttggagagacttgataggatttgctcattaattataaaaggataaaggaaatggagggctcacgaatgcttctcaggttttgtctcatgcaactggtagatagcggtaccattactgagatgggaaagactgggagaaaaacagattagaaagggaaaataaagatttctaatgaacatattatatttggaattgtttgagatgcttataagacatgagagtagagatgatgaaaaggtgaatatctgtttgccatcttctgtcatcctcaggtccattctctgccgccttctgccctgctccgtacctgggacactgaccggactgcattacttaggatcccttaccctctggctttccactgaattcagtcagcaggaaataccactagaacagagggtaggaggagagagtatggtattcatatttcctgctctgtctgtgttttgaggtagttctggcagtggctatgttcctctacaatgagaggacccccctcatggttctggctctcaatcaggttctagtaacactatttcttcccctttcccagaactaaggggggcattaagttttctgtggtttgtagtacctgggttccttaacattccttgctggttcccttaaccttgccatgtcactaaaagtagcccctttgttaaactatttctgtgtaaatgtttgtgtgtatgccatctgtttcctcccaggacctaacctataaaaccaagctcagaggcagtctggactgaaatttcaactaaaaattatcaaaatgtaactcatattaaagaaaaagatcaaagaagatcattaaaggagagaatgatgactgagaaaaaagagccagttacatagtcctgagttattctaacatttagaggataaagtagataatttacagggaaaaagccagtaaagaagcctaaatatgagtgaacagtgaagcaaaaaagaaaatcaagacaatgtggtatcacagatgccacgcaggaaagaatggccaattgtattgaatgatactgaaaggttgaataagataggacagagaagtgactatgagatttaatagcccagaagactgttggtgatcctgacaaaaggaatttcatggaatagtgagaaaagagccagactagaatgggaaatgagaaaccagagataaaaatctctcttaatgaacttatgtctagtattccattattggaatggtaagcttgtagaagttatttatatcctactgctcaaggtcatcaccaaagtctgatttttcacaaaaaaaatttgcaacctctggcataaatgggttaaaatattttgccaacagtcctttaagtctgttacaagaataagggcagttgaaagaaaaaataataatttaattctgtggatttacatatttttttaagatagataaacagtaaagtgatttcaaatacaaatttatggtagggaaagatttaaaatagagaacatatttccaaacttcccttctatccaataatggattaaactacagttagaattgaaaagtttcatttgttgacctaaggaaagagtagtcggaggggcagggtgagaggagagctacaaacatattctaatatacatgtaatttaaaagtagtagagaaaaataaacttcaacatttttattcagtgaaaaaataaaatctactaaaaacacttaaaagtccacatttttcaatgctaatatatgttgttaatgccctaaatatgtaaatatgtaaacaaagttgtgataatgctataagaaaataaacgtgatctcgtgttcatgatcttgtgcatgtgaccacgtgatttaaatcagccttttcaaaataaaaataccaacttaaaatttaaacaaatggctagcagccagaaaatgaccaaaaatatgatttcttcaattttataattaagctgcaaaaggaagaaaaacaaacaaaaaaacctcatagaacatattccttaccatcagttcaggtgatatgatatctctcgggccctgatatggatcatcactggatgcaaatgaggcaagtattgacaaaccattaaaaacctgttgatagtgttctccaatacgcagcaataattcattatgcaatccttggaaatcttgtctcaacaggctccccagttcaatttctgtttcattctaacccaaagacatgttaaaaaaaatttttttcttcatactaatatcctggaaataagtatactgattttaacatgctattagtacatcaggagctctagcccagatgacaggatttattaaaggtattaagaaaaggcattggaaaagattctaatcttattctatcctggtaggtctcccatggattatatgtaatgaagagaagtgatccaactttatttagaaataaaatattaaaaagcaagtcctagttttctctaaggtcttataatatcatcaactcattattggggacacacaaccctgggaggaaatgtagtatagtggcttatagcagtctttctgttcagattgctttagtttaaattctagctgtcatttatcagatatgctgacttggacaagttacctaatctaacctcactctgccttagttccttatctatgaaacaaaacaaaaaaatagtacctttggctgggcgtgttggttcacacctgtaattccagcactttgggaggccaaggcaggtggatcacttgcagccaggagttggacaccagcctggccaacatggtgaaaccccacctctactaaaaatacaaaaattagccaggcctggtggcagacacctgtaatcccagctactcaggaggctaaggcaggagaatcgcttgaacccaggaggtggaggttgcagtgagccgagatcgtgccactgcactccagcctgggctacagagcaaaactcccatcacaaaaaaaaaaaaaaaaaattaagagtacctttatctcattgggtaactgtgaggattgcatgaaatgatccatatcaattgtttagctcaatttctgacatgtattaaatactccataaatacttattactatcattctatctccacaatatacagtcgaataatactttctcaagatgaataaatacatttgatattcactaactctcgtggaaagagatgtgctgctggcatatattatgaaacaaattaagtaaattaacatcagagaaaacagtaaagttatatgcatatttctcatagttttcctgttcccatgtagtttcatattcctcagagatattttgttaatatgacaccaaaaaaaagaagcacaggttataattttaaatgtaaaaactaccaaaaacctggaccaaattgtaatcagaacaccaagtaactaaaatatagacattatactacatttgaaggtgattgcctcttcctatggatataattaagtgtgtatcatcagtcaacttataactccaatcaactgaaaagtactataatgaaataggctgagaacctctcccatgaaaggatgcctatcatatcccattatggtgaaatgatcaaagaaaacaaaaggagaattctatttaatatgctctcaggacaaagattatttaacataacaacatttaaacttacattcttctaggataggctataatttactcaccctctttcctagaagaatgttacatctttcctataatgctaatttatataaaaaagtaaaatatatagaaatattcaattaccttcagataatgaagggcacgttctaattcatctttggaacaagaacagaccaaatgagaaaaaatatatttgaagttgtttattaaaatctctctacgattgacatttaattgttttcctaaagttcgaatgagagcagaagctgcagggcttgctttggcagcaagatcaggtagtagaacttgtaatgtcctctgaaaaagaatgcaacaattaccaaaaagtacatttgtctgggtgaaaaaaatattcacataagctatgtgcaaaaatatttttaaatgccacacatatttggagtccactccatactataaaatatgtaatagtagatcatttataccactataattttatactttattattccaacaccttagaagcagaaatgatcatattagactttgaattgccaacggaacaaatcatagcaccaaagacataagggctcaaatagctaactgaattgattagcattattcaattagtattaacttttcaggacagctaaccataaagaacaatgactcaaatccacttaaacttaagttttacagcataagcaataatctcatatcaaagtcaaaatctagaatggaatgaacaaaatactgaattgcaaacctcaagtgaactatatgttgcaacttacagtaagaaaacgattaagatcaggaaagtcgaaaacgttggcaatttcagacaacgtatttaaagccatttctctctggtgagccacatcttgttttcgcacgtcagcattctggcatggagtattcggaagtgctgtcatctgactagagtgaagggattctaccaaaaactagagcaaaaaccattttattgtgagttttcacacaaagaagaaattttaactaatactttttaagccaccatagagggcagtatcaaatagtattctacattatctgaattggtccattcaatttttataacaaccttaatgaggtagactatgtcataatctgcctttcacagatgacataatcagacttagttaaaaaacttgaatatcatgctaaggattataccacaaataaattcagtattttagcataacctaacttttcagccattaattgaatatatttaaaacaaagtgtcatataacataatatcaaggtgtaaaacagtttactatcactaaaaagtctatacaccattataagatgatttccttcctccctcatttataacctgtatcttcagaccaatatcctaaaatataaaaatggcaagatttcagttatagtaaataaactataaacaaaatacatcgtttttgacaataattttttttttttaaagacagagtcttgctctgtcactcaggctggaatgcagaggtgcgatcttggctcactgcaaccgccacctcctgggttcaggcgattcttctgcctcagcctcctgagtagctgggattacagatgcccgccccatgcccggttaatttttgtatttttagtagacatggggtttcaccatgctagcaaggctggtctcaaactcctgacctcaggtgatgcgcccaccttggcctcccaaagtgctgagattacaggtgtgagtcaccacgcccagccttaacaataattttttaaagcaagcacaatgctttctttttaaaaccaggcacagtggctcatgacagtaatcccagcactttcagaggcagaagtgggaggatcatttggggccaggagttagagagcagcctgggcaaaatagggctgctctctctaaaaccccatctctacagataaataaataaaaattagctaggtgtggtggtgcacacctgtagtcccagctactcaagaggctaaagtgggaggatctctaagcccaggagttagaggtttcagtgagttatgatcacaccattccatgtcactgtatgctgcctggacaacagagtgaaatttggtctctaagaaatgtttaaaataaaaaagaaaataaaacttttaaaaagcaagcaaatggaacagattagagaactcagaaataagatgacacacctacaaccatccgatctttaacaaacctgacaaaaacaagcaacagggaaaggactctctatttaataaatggtgctgggagaactgactagccatatgcagaaaattaaaactggaccccttcctcacaccatatacaaaaattaactcaagatggattaaagacttaaatgtaaaactcaaaactataaaaactctagaagaaaatctaggcaatacctcaggctataggcacaggcaaagatttcatcacaaaaacaccaaaagcaatttcaacaaagcaaaaattgacaaataggatctatttaaactcaagagcttctgcacagcaaaataaactatcatcacagtggacagacaacctacagaataggagaaaatgtttgcaatctattcatctgacagaggtctaatatccagagtctacaaagaacttaaacaaatttacaagaaaaaaacaaaagtgggcaaaggacataaacagactcttctccaaagaagacatacatgcagccagccaacgaacatgaaaaaaagctcaacatcactgatcaaaactacaatgagataccatctcacgccagcagaatggctattattaaaaagtcaaaaaacagatactggcaaggtttccgagaaaagggaatgcttttataccgttggtgggagtctaaattagttaaaccattgtggaagacagtgtggcaactcctcaaagacctagaggcagaaataccatttgacccagcaatcccactactgggtatatacccaaaggaatataaaaaggaatataaatcattctatagtaaagatacatgcacatgtaggttcactgcagcaccatttacaatagcaaagttggccaggtgcagtggctcatgcctgtaatcctagcactttgggaggctgagacgggtggattgcttgagatcaggagttcaagaccaacttggccaacatggtgaaacctcatctctactaaaaatacaaaaattagccaggcatggtggcaggcacctataataccagttacttgggaggctgaggcaggagaatcacgtgaacctgggaggtgaaggttgcagtgaactgagattgcaccattgcactccagcctggacaacagagcaatactccatctcaaaaaaaaaaaaaaaaaagcaaagtcatggagttaacctaaatgcccatcaatgacagactggatgaagaaaatatggtacatatacaccatggaatactatacagccataaaaaggaacaagatcatgtcctttgcagggacatgaatggaattggaagccattatcctcagcaaactaacacaggaacagaaaaccaaacaccacaagttctcacttataagtaggagctgaatgatgagaacacatggacacatggggggaacaacacacactggggcctgtaaggggggtgggggaagggagagtatcagaaataatagttaatgcatgctgggcttatacctaggtgatgagatgacctgtgcagcaaaccaccacgacacgtttacctatgtagcaaacctctacatgctgcaatatacccctgaacttaaaatataaattgaagaaaaaagaaaagcaagcaaaataaaacatgtataaatattcttcttttttgtaactcttaaaaagtactgctgttgcctatagtccagacaaacgctgactcttacctgacagatgggtttcttatactggctgaaaaaactttgcagtttaacacttttagctgcaaccagagctctaatttctgtgtatgctgctccagagacagatgctgacttggataacaaacaatgcaataagtgtaagagtgcaaatggtaccaaatctccttttgcggccctaaaattaaaaacaacatacatatgaatacacaaacacacacacacacacacacacacatacacacacatatgtatctccaatatcccagaaacaaacggaaatctacaaataaattcatgttgactcacattttgtctataatatcacaaatatcatatcaccatttttaacagcaagcaaataaaaatggagaatggccaaaataaataaggaagaacacaaatgctgccaagtataccttccaatatcccctgttgtaagaatcaaggtatccttcagctcattatttcttgatatttgggcatgtgtatatgcttccttcattcttaagacaaaaagctagaacaataaaattaactggttaaagaaatttttagagctaggttgacgtaaactcaaatgttaaaaacaaaaattatcaacctcctttataaatccatcttcagagtccaaggattccaatatgtgcttgatatttccactaaaagccactctaacatctttgtctggatcttccattaaatttaataaagttccaagaactgcttttacatctgtttcatcttctctaaaatcaagatgcttacaaagatgatgtagattatctatgaaagctgaaggacaagagtatacaatacctaatttaacatattaaatgtcaaggttgtactgtaaaaatattgtcaacaaataatatgccatgaagaatcctaagttctcttataatgtcaatgtttcatatttaagtatgtatagcacacagaattttaggaaattaaaatggatacttataaattaaaattactttatatttaataaatgtcactttttttttttgatatagggtcttgctctgtcacccaggctggagtgcagtggcatgatcacggctcactgcagcatgcagccctgacctcccaggttcaagtgatcctcccacctcagcctcccaagtagctgggaccacaggcatgcaccaccatgcctggctaatttttgtattttttgtagagatggggcttcaccatgttgcccagactggtctcgaacacctgagctcaggcaatccgcctgtctcggcctcccgaagtgctggtgttaaaggagcgaaccactgcactcagcctataaataatttaaatctaaaataatttccagaattgttataaaataacaagtctctttcagattttgtagaccattatatgttaccaagataaacttaaaaacacattgcaggccaggagtggtgactcatacctgtaatcccaacactctgggaggccaaggtgggaggatcacttgaagctaggagttcaaagaccagcctgggcaacaaagtgagatccctctctacaaaaaatttaaaaattagctgggtgtagtggcacatactatggttccagctactcaagaggctgaggtgggaggatcacttgagcctgggagatcaaggatgcagactgcagtgagccatgattgcgccactgcactctagcctgggtgacagagcaagaccctgtctcttaaaaaaaaaaaaagaaagaagaaaggccgggcatggtggctcatgcctgtaaccccagcactttggggggacagagtgggtagattacctgaggtcaggagttggagactagcctgaccaacatggtgaaaccctgtctctactaaaaatgcaaaaatttgccaggcctggtggcacacgcctgtaatcccagctactccggaggctggggcaggagaatcgtctgaacccaggaggcagaggttgcagtgagccaagatggcgccattgtacttcagcctgggcaacaagagcaaaactccgtctcggggaaaaaaaaaaaaagaaaaaaagaaaagcacatttctcaaggggatcttagctttattgttaaccttacattacaagatttagggagtactttctattgctttcaatagaaagtttctattgaaacttcagaacaagtttcaacttactacctaaacaaatggatcttctaagtatttgtataaatctcatacttcataaaaatttatactccattaccactggaaagtggccaagaagatacactctatagtcctcagttgggcaaagtaatttaactatttgaagttctcaaggtccaaggttgtaacagggggcacattaagacgatctctggtatcactaaagaagataatctaatattgaatcttacaatattgaaacaaccatcaggtatgccccatttaggctgtcaaatcacaagagtattcgaaaaatcccaaaatcacctctcctaccagttttgtgatgcgatctaataccagttatcccatttataactaatcaatactgagcactgaatctataaagcatgtaacttcctgtaatttttcaaggcttcagtctaattcttttactgatttgaaaagcagagcttaaataggttttaaagtattaaataagtcataatcactcaccaagttttactggactaggtattttttttttcagtaggaaaaggaatggcttgcagacagaagcttttagttgagaagatgaacattcatgttgagaagtggctttcaagttcctacagaagaggtccacatgtccgtgttcagagaaaggttctgttaaagaacttgtcagataaaacatgccgtgaagagtacagacaagttgaccaagtatagaagcaaattctttcttgacaatgtcagaatcatctttgactttatctctggggaaaaaaaagaaaaagtactaaactttcttgcctaattttgtggtctaaatagtcttgcttaatttgggacaaaagtactggtaaaacaaagcctagaaggaaaaaatgttaaattctaaaactaaaagcaacatttgctttacatattcaacaataaacacaaccctgcatacatagccagacaattatgatctttccaatagagtgatatattcaaattaaaatcttagtacatacataagaatcttgggaactctgttacaagaattctgctgctgcaataagataaaaaatccactaacacaactagcccggattacttcatgggagctctgcagggcccagttgtaaactgctgttctccactcaaggaatattcttcttggaaacagagtcagaagaaacacacatcgtgattgtgcctgtggtgctgaaaaaattaagtctattaaacaagatttctactaatgttaattttatgtatacacatatacatatatataagtaaagtaacatttgtgtatacatatatataaataaaagtcaagtaacacttaaaatacatttaatacctaatttaattaaaagctccttttcagaaaataaagcaagtgcactgaaaaaggtctatacacaaccttactaaataatcaaggaaatgcaaattgaaaatcatacctaccagataggaaaaagaaaaaatttaagatacttaactccatgacattttttattttctagatagcaaaaattttaaagtcagctaagtgtcagtgaggatgtggaactcatactctgctaacaggagtgtaaactggtgtatctttggagaacaatacagcagaatagaggtgaagatgtgcaaactctataacccaacaatactactcctaggtaggtaaaaacgttaaaataatgcttctcaaactttaatatggatatgaatcacctatcttgttaaaatgcagattctgatcagtaggtctgggtggagcataagattccccatttctttctttctctctctttttttttaatgtgctctttcagcagaatcaaagacgctccatttctaacaagtccctaaatggtggcgatgctactggtctgtggagcatacttttcaaacagcaaggacttagaatgactaaagaatcatttataaaaatattcatttaaatgttgcttgtaattgtgaaaagttggaaacaacttgattgtccaccaataggaggtctgatagtgtccatccaaatttggctactatttggaagtttaaataaaaactagagttacccatatcaccatggataagtctcataaagatagtgttgatcaacaaaatgtaagctgtaagaagcaaaacaatttcttatattatttataaataaatacatatatagtaaaagtaatagaacattcaacagaacaatcaacaccaaattcagaacagtagtaatctctggggaaaaaaatgaggggaatgaaatcatagagggacaaaggcttccatcatatctctaatagcccaggctggagtgcaggggtgcaatcttggctcactgaaacctctgcctcctgggttcaagagattcttgtatctcagcctccctagtagctgggactacaggcgtgagccaccatgcctggctaatttttgtatttttagaagagatgaggttttgccatgttggccaggctggtctcaagctcctgacctcaagagatccgcatgccttggcctcccaaagtgctgggattacaggcgtgagccaccgtgcctggcctaatgtttctatttcttaaactgagaagttggtataagaatttttggtatattgttcttctttttaaaatatttctcaaatacttcctaattttattaaatgaagataatgatatgtaaggacacattgcaaatgttttacaaaaagaaaggaaatgggatatgtggggcaggcttttatgtgttactttttatgtatctaacccccttctgaactattaaaaatgtacctgctcttttaattattgaaaaaaatataaataagtcttagaagtcctatatagagatgagttaaaacaaaccacacaaggccaggcatggtggctcacgcctgtaatcctagcactttagaaggctggggcaggtggatcacttgaggtcaggagttcgagaccagcctggctaacatggtgaaaccccgcctctactaaaaatataagaattagctgggtatggtggtgcgcacctgtaatcctagctactcaggaggctgaggcaggaaaattgcttgaacctgaagacggaggttgcagcaagccgagattgcgccactgcactccagcatgggcgacagagtaagactccgtctcaaaaataaataaataaataaataaataaataaataaatagatagatagatagatagatagataaataaaacaaaccacacacacattcttgtgagcacttacaatagctatctgaaatcctacagcttaatgttagaagattagcggcaaatgtggtcaactttaaacagccatcatcagaatgggaataaatccatggaagtgagagcataccacataaatcttccaggatatgatcttcaaatgaactgtttactacagaagcacaaaataagtcattaattataacttttccttaatcatatctcttttaaataaaaataaagacatttgaaatactatcataatgatcattggataagcagaaattcttaacacagagatctataaacgatggtctgaggtctgtgaacccaaagaaattaaatgtgactttataaaaacatgttatctatgcctgttttaaagaagaatcacggcattcctcaaactcccaaattaaaaaactttgaagttataaataatttctattgactaaagaatcaaaatattatgcacataaattggcaactcagaacttctattattgacaaatttaatagaactgaaatcaggaaaaaacttctgagtattccaaacacgcacttaggcttcaggcaaaaaagaaagcatatttctatactgattatctttaaaggttattctgatctgttgctaatttgtactcaccttgcatataaatcaaagcatcataaattttcaccaccttatcaatggttgcctccaggtccagtttctgaacagattctaacaaacttctacagctcttaagcacttttgtgtaaaaatccaatgacatccaagttatcactacagaaggtttcttcttggatttatgttgacagtccttgaaagtacggctgcagtaagtacattttgttaaaaacattggaattaagatgaattttgttatagtcaaacataaaattgtagtaaagccaaaagaaattgtgagtacgaaatttatctataacaatttaaagtaaacatgcaaatcaagtaatatgttattactattttaagttgaatctatttatgtcagcttaaatcacccttaggatttgggaaccaaatgactttgggagcctgaggtgggaggatcacttgagcccaggagtttgagaccagccgggccaatatagggaaacccatctctacaaaaaaaattttttctaaattagggtgtggcggcacatgcctatagttccagctacatgggaggctcacttgagccccggatagagatcaaggctgtagtgagccatgatcatgccactgtgcaccagcctgggagacaaagcgagaccctgtcttcaacagccaaacactgggttttgagttgtacacaaatgtgttctggtactttctaatcatgtgtccccaggaaagtcagttttggcttcagacaaaaaagagcctcagtttctctgagtgtcagtttctaatttttaaaataggcataatagcctttaccttacaggactattgtaaatattaactaagatatatacagtgcttagcaccgtacctagcatttgactcaatagaaaataaatttattaactacttcagtgaaaagtttgtgttctaaggttacatgagtcaagtgaataatgagtaaacagtaaatccaagttcattacaggaaacccaaccccaagaaacaagaagtttgttttaccagttcatgttttgatgagaacaatgaacagtacacagagcagtcagttgtaagacaacagcaattccttctaacatctcaataacaggattctttaggccactgtattcaagggaaatctgaagggattcagctttctgtttcagtgcactccataatatgctcttttggttcatgtccacatgtttaattctataattatgaatatagtagagagatattcatatgcaatataaatttggttaaaacatgaaacatatttagaataaaacatactatgtaatatcaactattcaaaaaaattttttttttttgtgagacagagtctcactctgtctcccaggctggagtgcagtggcgccatctcggctcactgcaagctccgcctcccgggttcacgccattctcctgcctcagcctcccgagtagctgggactacaggcgccaaccaccacgcttggctaattttttgtatttttagtagagacagggtttcaccgtgttagccaggatgatctcgatcttctgacctcgtgatctgcccgcctcggcctcccaaagtgctgggattacaggcgtgagccaccgcgcccagcctgaaatttatactaagatttaaaacaattaaaacaatgttcagaagtaactgaaatatggcaacttagccactttataaaaaatagttggttaatgttttaaaaattgctaatagatgcacagtctcaaagatttttcacatattaaaaagttaaattagataagcatataaaaacatgcaaagtaactatatttaaccatgaaatgttttatactactaaccgtctacaataattataaaaatattttaagcactcccttggctacatttagaaagatgttctttgtgtatttaaatcaaagcacttaactaaagctgatttttaaaagtgaacaaagttttatttaatggctaaatacaaactgaatgaaggtcatcatactcctcagtctgttttggtgctcttttagaagggtttagagacgagctgagacgacgccttttgggtgatattccatcactattactgctgaggttttcctgttgagtttggcattgaatctcctcaatgatttccatactttccattttcaaagctgcataaagtgggcccaacaagtactgagaaaataaaaaataatttccagaaatattccttagaaaatatatttatattattcataggcagcaagaatgtattagatgttaggtgttttctagtgaaactacttttagagtctcataaagcaaaataaacatctaaattgatctatattatttaagtctatatatagactatggttctatagtcttagaaggtttaaacaaatccttctctctacatcctgtttttcctcttaccaaaatgctataaattttaattcccttataaaaaattctgtaagggaattaccaactttcttcatgtaactttaatccagcaagattaataaactaaaatatttaatcaagttactgcatctctgatgattttattgtattacctgactcccacagtccaaatagaaaaaagcgcataatttggcatgattaatcattcataggttttctaaaagtgattgattataacttgtcagacacataatctgattgaccaaagcttctgcaattaagttggtaactgcccccttttaattaataatgcaacaaatacatttacacttcacagattctacttagaaacattctactccattggcagttcattaccaacttaatgaacaaatccttctgaaatcaaagtaaaagtccataatagtgagccagactacactatgaaaatcattatgttccaaatataaattactattaaagatattctattttcttattattacattttgcacatatgtatacaattaaatgatgaacaaaatacatacttaactagtaacctgaaaaattacttacctctgcatctacctcaattccaagcacatccaaaagagctttacaaatatttctcacatagaccttcctgacttgtaaagcagattcatacccagctggcacaaatttaaggaaatactgcagtaaatggcacaaagctgcttttagcaaatcagacttaagccgcatgagcacaccgtcttcaaacatgacacagagtttttccagcagcatatttaaatagacaggttcaatatttctataagcttctgcttcaaagggaaatagtgtctttatcagctttgataatggctcttcatagagtttcaattggtcagtatccatttctacaaggtgttttaataattccaaaaatgagctgaaaaaagtgctagctggttgtgctggtagtcctccaagctgaaaaagttctgttaaaaagctaattgctagggatttaatttttggactaccatactctagcagaacacaacctatctgccaaagtaagagttcttgccttctaaaaaacacaattgcaataatacgagtaagaaccattaataaagtgacttcaataaattctaaattttgcatactcatcaactgcaaaggagctgattgtaaatatcccatgtgttcatctaattgacttaaaaatcggctcatgaccactggccattccacagcatgacccatcacatttcttctatggaggtaaaccaagtcttcaaaaagttgtaataattcttttgtgagtaccccaaaaatagcaggactcttgcttttaaaaagaaataataatgaacagatgacttcacagattttcttgtgtaacaaatgacaggagggagttgctgcaatccgcagaagtctcgttatgatccaattactgaattctttgaaataaacaaaaaagatattaaataaacaagtatatccgaagtgctaattcatttgctaaatccttgacgattgacttttaaagaataaacttcactaacaagagtgtaaaacattctcttcacaatggaaacataatagtttagaacacaggcatacccagttttattgcacgttgcagatactgcatttgtcacaaattgaaggttgtggtaactctgcatcaagcaagtgtatcagtgccatttttccaatagcatgtggtcacttcatgtctctgtatcacattttggtaattctcaaaatatttcaaacattttcattattatcgtatctgttatggtgatctgtgatcagtgacgtttgatgttactattgtaattgtttggagctgtcatgaaccacaccgatataaggtggcaaacttaatggataaatgtatgtgttctgacccaccgaccagcagttccccatctctctccctctccttgtgtctccctattccctgagacacagtattgaaattaggttaattaataacccttacaatggcctctatgtgttcaaatgaaaggaagagtcacacatctctcacttcaaatcaaaagctagaaatgattaagcctactgaggaaggcatgttgaaagccaagacaagttgaaagctaggcctctttcaccaaacaaccaacttgttaaaacaaagaaaaagtttttggaggaaattaaaagtactactccactgaacgcaccattgatgagaaagtgaaacagccttattgctggtatggagaaagtttttgtactctgaatagaagatcaaatcgttaaaagatgaggaaatttccagtaggaaaaaaagaagatcaaaccagccacaacattcccttaagccaaagcctaatccagagaaaggccctcaacatcaaggcaagacactccaccagcacaaatattacaacttgttgaaggatgatataatcgttagcattttttagtaataaagtatttttaattagggtacatacattgttttttagacataatgctattccacacttaaggtacaacgtaaacataacttttatatgcactgggaaaccaaaaaattcatgtgacttactttattgcaatattcactttattgtagtggtctggaactgaacccacaatatttctgaggtatgcctgtaacaactttggagtcagacaggcaaggtcctagctttccacttactagttgtataaacttttcatttctctgaacctctgtaatttcatgtataaggagaataatgctatctatgttatgggttactgtgaggaccaaataagaaaatgcacatgaaatactcagcacagttccaaagtaaaataaatgttcaataaagggtagctattgtcattctttcaactaaaatttgagtggtgactctgtctcaggtacacaagaataaatcagtcatagtcctgtcctcatgaatctcacagtacagtttcttgagctttttgactgcaacaaagaaataacattttatatcatgacccagtacatatacatgcattttatttaaatatttaaaacaaaaggttcattaaatagtacttactcttattacatacaatgtactataatattttctttttttttttcttgagacaggttctcactctgttacccaggctggagtgcaacggcatggtcttagctcactgcaatctctgcctcccaggctaaagcaattagtgtgcctcagccttccaagtagcttgtaccacaggcatgtgccaccatgttcagctaatgtttttctgttttgttttggtttggtttggtttggttttggtagagacaggattttgccatgttgcctaggctggtctcgaactcccaaagtgctgggattacaggcgtgagacatcgtgcccagcctatgatattttctagtttatttcatcttgttttaaatgctgataattgcctaatttcataacccactagtgggttatgacctgtagtttaaaaactactgtaggaaagaatatagacaaaccaatgattagagcacagtttaatagcctctatgatagatgaaatgcagaacacttagtactaagagagaataaaggaataaccaagccagttctaagcagttagaagtagtgctcagaaaaaaacttcttggaggacatgctatcaaagttgagttaaagtttgaacaaaaaattttaaaatactttatccattatacaaaaaaaatgtttattttgcatctctttatgaagacaccaatgaagggacaaaagtagtaggtgcaataaagaataagcctagagaaaagcttcaatatatagaatagcggtcagcaaactttttttaaaggaccagatagtaatatttttggcttgagtgcccaagttgcctttgtagtagtcacagacaataagtaaaagaatgagcatggctgtgttctaataaaactttgtttacaaaaactgaagccaggcacagtagcatgtgcctatggtcccaggtatgcaggaggctgaggcaggaggatcccttgagtctaccagttcaagaccagcctgggcaacatagcgagaccctgtcttatttaaaaaaaaaaaaaaaaaaaaaaaaaggaaacaaaacaaaacaccaaaactttgttcacaaaaacaggcagccaccctgtggactacagcttgccaagctctgatctagaagaaagagattaccaaaaacagaaaaaagaaaaccatgccaaagtgttcaatggcaaataaacaaatttgattatttctaagtacctagtatacaatactaaaaagaaaacaataaggatatgtgaaggaaaaataaccattaccattttgctccttcaatttatagcaaagctgacccaaaaaagtataatcctgtacatgtaatatttcagaagagcagtaaaaggaggattttatagaacagatggcaagtgaatgcatgaataacagcacttaccaatacaactgcctttggcctcatggcttccactcacatttacaaacataagtggggaggatttcatgatatgctggatgaaatcaagcaacatcacggaggttggctgagagtcagttttctttacaagttctacagcaactaaaacaataagattcattttaaagagtcatgacaaattaaacaatggtccttttgttaagaaaccagactgtgggccaggcaaggtgcctcactcctgtaacccctgtactttgggaggctgaagtgggcggatcacctgagcccaggaactcaagaccagcctggataagatgtcaagatcccgtctctacaaaaaaaatttttcttaaaattagctgggagtggtagtgtgcctatagtcccagctactcagggggctgaggctggaggattcccttgagcccagaagttcaaggcagtagtgagctacgatcacactattgcactccagcctggaacaaagcaagactctgtctcttaaaattaaaaaaaaaaaaacaaaaagtggggtgggggtggggaaccagactttggtgaccagaattatatccagcacagcactcaacaacattcaagctaaattgatggggctaaacactacagtcttttttttttttgagacacagtctcactctgttgcccaggctggagtgtagtggtgtgatcttggctcactgcaacctgtgcctccggggtacaagtgattcttctgcctcagcctcctgagtagctaggactacaggtgtgtgccaccacacccagctaattttggtatttttagtagagacagggtttcgtcatgttggccaggctggtctcaaactcctgacctcaggtgatccacccacctcggcctcccaaagtgttgggattacaggcgtgagccaccgtgcccagccaacactacagtcttatctaattttaaatgtttaaaaatcacatgcattcctctaccatacatctatttatcaaacatgtacttcaggaataatatgccaggcaatgctaaaatctaaggattaaaaaaaagttctcacaatccagtggggcgccaaacaaaccaactaataattataatacaatatggtaacagcactaatccagaataaggagaaacaggtatctgggaggacactgtgaaggaaatgattcctagatgaggagttggtcagagaggggaagggcaagtagtctaaacggagggaatatgaatacgatacaaaaacacatcttgtaagtattcagtagtcctttgttatttttcagcaacccatcattttactgattgaaaaagaaaggattaatggctagtctaagtcataaaatctgcgccaaatttggaatccaaattataaaccctgagcctaatgccattttatattatccctcccatgtaatttcaacagatatgacaaatgtgacaccatcttgccaggttggtaatattctgtctagcagattggcacaaacaggcaataattgattcagtaactcacataatcctataatctcctataggcacaggcatgaacctacttaaagagtaacttacttaaagaggtttttttgggtggcatttgctattagtctaccactggcataacagctaaccaaaatagggtccacatgattggtactggacaaatatttttacatataatatccaatattaaagaactcatagcaagcagtagaaaatctagataacaaacaggaaaagagaattattttaaaagcctaattcaaattttgtaacaagcaataagcaatactgattaacaaataacttgcttgaaaatagtaactatcataaatactccatatctaaaactacatggagaaaatgctactataatttatacatggaaaagaaaagtctaatttataaagtttatataagaaataattggtttcttaccaacatttacatctgtaagtatccggtcaatgaattgacacagaatttgtcttggcttctgtacaactgtattatattcctctggtgtggcactaaaatacaaattaaaagcttttaatccttaaagtgactcagtttcatttgcaaaaaaaatttctctaaagtagaactcatcaaatgtgttcagtgtcaatgttgatattcacagtattcttctgtttaaaaattgaaaagaaaatctgaatatgttaccaacttacaagaaaaaaaagaatatgctaagtaatactaaagagatccaatcagcaaagcctagacctgaacttctcaatatggtggccactagctacaagtaactagggagaacttgaaatgtgattagtacaaattgaaatgtgctattgatggcagtggcagcccagttggagcggtgaggaaggtggtgctagggctgctctctccagggcgctagtgggcagaagccccgcccccttctgaggtgcaagacaggtggaagccccgcccccttccgagttgcagggtcgggagcccagccatcctgggtgcagctgcagccgcccaaccacggctgcaaacccaggcatccctgctctttccagggccgggaaggccccctgccctcacagacttggaaatgcctgctcccgctgcctggcctctccccgctcccggcacccacaccaatttcggagcaaagttgtgggggagcccaggtgttgtcaggaccaggccgcgtgtgcatgtgctcaggacggcactgacacaccagccccctgctgcctcatctccctctggactttgggcaggccaagcggtaggctgagggcagctcaatatgggcctgcaggcgcccctcggcacgaacagcctcggtgtagtgggtggcaggttgatggcagcaggaagtaggctcctgggaggaaaggggtgggtccccagtgaagacccaccttcaagccaggaacagcttgaagcctggaagcctggctgccagttacacggaccacagcgagaacttagggtgctttttccaggcccacccatgactgcctatggaccaattagcattcacttcctcccttctgaagcacataaaaactaaatttttggtggaacgctaatacccttttccacagtggctgtaccattgtacactcccacctgcagtggacaagggttccaatttctccacatcttcaccaacacacgttattttctgggtgtttttttattattattttattttccccttttggcgacagggtctaaccctgttgcccaggttactgtgcagtggtgcacccataactcactgcagcctcaacctcccagcctcaggagatcctcccacctcagcctcctgagtagctggcaccacaggtgcatgtcaccacacccagctaattttttgtattttttgtagagacagggtttcaccacgttgcccaggctggtctcaatctcctgggctcaagcgatctgcctgctttgacctcccaaagtgctgggattgtaggcatgagtcaccatgcccaactgtgttttttttttgtgggattttttttgttttttggttttttttgagacagagtcttgctctgtcaccaggctggagtgcagtggcatgatctcaactcactgcaacctctgtctcccgggttcaagcaattctcctgcctcagcctctcaagtagctggtactacaggcatgcaccaccatgcctggctaattttttgtattttagtagagatggggttttaccatgttggccaggatggtctcaatctcctgacctcgtgatccgcctgcctcagcctcccaaagtgctgggattacaggcatcagccaacatgcccagccccaactgtttttttattaatagctatcataatgggtgtgaaacagtatcctgtggttttgatttgcatctccctaatgattagtaattgtgagcatcttctcatgtgcttatttgtccatttgtatatcttctttggagaaatgtctattcaagttctttttctgtttttcatcaggttatatttgttgttaagctgtaggagttcttaatatattctagatattaaactccttatcagacatatgatttgcaaatattttctccagttccatgggttgccttttcactctattgatactgccctttgatgcacaaagtttttaattttgatgaattccaatttatctgtttattttgctgcctgtgctttgtgtcatatcaaagaaatcattgccaaatccagtgtcataatgttttccctctatgttcccttatttttatttatttatttactttttgagacagagtttcactcttgttgcccaggctggagtgcaatggcgcgatctcagctcaccgcaacctccgcctcctgggttcaagcgattctcctgcctcagcctcctgagtagctgcgattacaagcatgtaccaccacgcctggctaattttgtatatttttagtagagacagggtttctccatgttggtcaggctagtctggaactcctgacctcaggtgatccacccatcttggcctcccaaagtgctgggattataggtgtgagccaccatgcccggccccctctatgttcacttctaagagtttcatagttttagttcttatgtttaggtatttgtatgccttttggacttttaaaattttcctgtagcagtaaagagagaagccagattgcaaggggctgaaaatctaatgaaatgtgaatactgagaatagcgggttctttccaaagcttgatcatgaaatgaagagaagtagagttggtgataactaaagaactgtatgagatcaagagggctttgttttgtttctcccttataatggaaagacctaagcaaccaattcttgagatgtgactcctcttcttggaaccagatataagtaaaaagacaatccttggacaggagggtaactctttcataaacatagaaagaatggatgggtacagacgcaaataatttaataaattcaaaaggcaagtaaaacaagatcctctgcttcaaagaactcagaatagttgctggggagaggagaggaatgcacttaaataatcaaaagcggccgggcatggtggctcacgcctgtaatacgagcattttgggaggctaaggcaggcggatcatgaggtcagtagatctaaaccatcccggctaacatggtgaaaccccatctctgctgaaaacacaaaaatcagctgggtgtggtggcgggcgcctgtagtcccagctgctcaggaggctgaggcaggagaatcgcttgaatctgggaggcggagattgcagtgagtcgagatcgcgccactgtactccagcctgggcgacagagcgagactcagtctcaataaataaataaataaataaataaataaataaataaataaataatcaaaagcaagtatcatgtacacccaaagcagggaatgattaactctacctagaggattcacagtgggttatgtgtgagtgattagcaaagtccatcacttctgacaaaacaacttagggtgtagtaagacagttacttataaataatagcatatatttcatatatgtcacaatttatttctatatagcactgtaaaatgttcatacattttccccacttattatctcaaatagtggtaaaagaaaaagagtgaatttttttctttttctgatacagagtctcgctctgtcggccagggtgaagtgcagttagtggcacgatcttggctcactgcaacctccgccacccgggctcaagcaattctcctgcctcagcctcccaagtagctaggattacaggcgtgtgccaccacacccagctaatttttgtatttttagtagagacggggtttcaccatgttggccaggctggctcgaactcctgacctcaggtaatccgcccgcctcagcctcccaaagtgctgagattacaggcgtgagccaccgcacccggccctttttcttttttttttcttttgagacggagtctcgctctgtcgcccaggctggagcgcagtggtgtgatctcggctcactgcaacctccgcctcgcagcttcaagtgattctcctgcctcagcctcccgagtagctgggactacaggcacgtgccaccacgcccggctaattttttgtatttttagtagagacggggttgcaccatgttagccaggatggtttcgatttactgacctcatgatccatccgcctcggtctcccaaagtgctgggattatcggcgtgagccaccacgcccggcctgactttttttttttttttttttttttttttgattattcaaaccacaaagtccaatcctaattgattacatataggatcaatagcatttacagctaataaatgccataaaagaactgatactggtcgggcatggtagctcatgcctgtaatcccagtgctttgggagtccaaggtgggcagactgcttgagctcaggagtttgagaccagcctgagcaacatgatgaaaccctgtctctacaaaagaaatagaaaaatgagcaggtatagagacacacacctgtagtccccagctactcaggaggctgaggtgggaggatcgcttgagcctgggaggctacagtgagccaagattgtgtcactgcactccagcctcggtgacaaaaccagacccctgtctccaaaaaatagaaaagaaaaaaaagaactgttctctggtcctggtacatagtagacatttaaagaaaaaaaaacaactcttcaatgaatgaatggttcataagaaccttcctgaattttgtggtttcttcattcctaatgtacagccttctggacctatggaatatttacctattccctgccactagactataagctcctacaggtggcagactgtgctttatttctctctgcatgtcctaaagtgccattagaccgtaagctcttataggagagaaaatgcattttatttctttttgcctctgctacatcacctagaacttgcttaatagaaaaacttactgaaattaacaaatgtttttaagtaacataaactctagacacaaagaatcaaagggccaggcgtggtggctcatgcctgtaatcacagcactttgggaggctgagacggactgatcacttcaggtcaggagttccagatcaggctgcccaacatggtgaaaccctttctctactaaaagatagaaaaattagccaggcgtggtggtgggcgcctataatcctagttacttgggaagctgtggcactgaggcaggagaatcgctgggacatggaggtggaggttgcagtgagccaagatcgcaccactgcactccagcctggatgacagagtgagacttcatctcaaaaaaaaaaaaaaaaaaaagcaagtttgtatatgctactaaataaagtccttaaaaaaaaaaaagaatcaaagaacaagtagttacatttgcatatgaaagcaaaacaacttagtgctatgtatcttatttaaatcagcgctggccaatagaaatataacgtaagccataattttgttattttctggtagccacattaagaaaagaaacaggaaaaaaacaattgatcctaacaatatatctgaaatattaggtgaatgtgtaatcgatataaaaattattcatgagatcttttacattcttttttctggtactaagtctttgaaacccactgtgtatcttatatttacagcacatctcaatttagactagccgcatgtgaggtggtcaatggtcacatttggctagtggctaccatagtatagggcatcacaaatttaacaaaaaattcaaaatctgtaattacaaggtaacatgaattgttttagacaaagtcaggagacattatgataaaccacagtaatttcacaagtatcatttaaaaatgtgaacaaagaggaacatgggaagaggagccaggattgtgggtagtggtcagagtttcttacaaagtttcattttgtaaagattatgtactcatgtattatttgtgtaatttttaaaaatcagttttagaaaaatgtaaattgattaccattcattagatctactatcagaagaaagaaacttggccgggcgtggtggctcatgtctgtaatcccagcactttgggaggctgaggtgggcggatcacttgagcccaggagtttgagaccagcctgggcaacatggtgaaaccccgtctacaaaaatacaaaaattagccaggcatggtggcacacacctgtagtcccagctacttgggaggctgaggtgggaggatcgcttgaccccaggaggcagaggttgcagtgagacatgttcatgctattgaactccagcctgagcaacaggtgagccagtctcaaaaaaaaaaaaaaaaaaagaaaaaagaaagaaaactcacaggagtgagcacttcttattttgtgacttctaccctggaactgagctaagagggtataacttttcaaaagcatactataaaatttgagtattaatgtaagtattatataaagcttaggcacctcctctgaggtaagcatcaaataccaggataaccaagacagaatgcacctgccctaaaataatttgcagattaaaggacaaacaagaggtaattatggttaagaactgacaggcccaagaaagaacacaaagggacactcagccctgagcagggccctgtcagtcatggcttccttaacgaggtgatacaaaactgactccctaagggacaaggcagtgaaataagggtaagagggagggtagtccaagcactggaaactgtaagaggctctatgtggctaaagcctttagagatgcagctgaagagggaagataaggttaaatttcaaaggactggctaagtagtttggattttacactgaaggcaatgtgtaagcactgaaggattttaaggaagtaaaaattaagcaagttttaaaaaacttgcttatttccctgtttaaaagattccaatggtttcccatcacacaataaaatctcactcctttttctagcctccaaggtgctgaaggatgtggcccttgcctacccctccctgtttaactcataccactcccctctttactccctgtgctccagccttcttactatccttttaaaagtaggctcattcagccttggcatggtggctgaggtgggtgcatcacttgaggtcaggagttggagacaacctgtgcaacatggtaaaaccccatcttcactaacaatataaaaattagctcggtggtgcaagcctgtagtcccagctacaggaaagggaggctgagacaggaaaatcgcttgaacccgggaggcagaggttgcagtgagcagagatcacgccactggagagggcgagactccgtctcaaaaaaaaaaaaaaaaaagcaggctcattcccacttatgggcctttgtacttcctattccatcccagattcacgtgactagcttctttacaccatcaaatctcctctagtggctaatgctgctgctcctcagaacctcctccacatcccactgttccatttaacattttaatagcaactatcacatttgaaaatgtcttacaactacaaagcaatctcaagtaggaaaatcagagaaggtgattctgaaatgacatctaaatgaaaccatccagtgttcagatagaaggaacagcaaacgattaaaggcaggaacagccttggtatcctggagaaacaaggtcagtatcactagagtaaagtaagcaaaagagggataaaaggtgatgaagtcagaggcaggctgagccagattatgtagaaccttagaggccttggtaaggagtttggattttatactgattttaagtgtgctggaatgtcaaaggacggttttgtgcaggggaacttacaatatgactaatagatgaaaaatcactttactgagtggaaaatctattataagtaggtaaaagtagaaatggaaagatcaactaaggttactgtaatagttcaggtaagaaattctggtggtagcagtggagacagtgagaagtgttagattctagatgtatcttaaacatatggttgtcagaactaacttatggattattaagcgacaagggaaaaaaaccaaggatgactcctaggcttttggttggcatatttacgataacacaggagaaggaacaaattcaagggcgcagtaaatcaggcgttctgctttggatatgttaattttcacttcccagtgtggatgttgagtaagcaacctaatatatatctccgatctagaaatataaatttgggagttatcagcatatggatgacatttaaagccatgagattaggtaagattacttgggaagacagcacagattaaaagagggccaaggacatagactgaaagcacatgtgaaaatagttaagaatgacttctagatttccagtttggagaactaagtgaatatggtgccatgtactgagatatctctacttcaatgaataagagaaaaataatttttttaatttaaaaaaagaaagcttgtgaaagctaggacatgtggggaatttgtattggatattctgaaccttaactacacataggacactcagtgaaactaccagtatacagtaaatatacaattctatagaagacatgatttggagaaacatattagtagtcatcaaatagcagattatagttgaaggcaggagagtggaaaggtcatttagcaagattatgcagagcagactgctaatagcaaaaaaacaataggacaaaatttatctgagggactgaggaagagcagcccataaattagaacactaatatctttttttttcagtagtctaattgccatagtcaattaagaggaaacattttggaagaaaaggccttgaaagcttgaatctgaaacctagctctgttatctgctagctgtgcctttggttcttcaacttctctgtccctttttcttaaacagtggtaacacttgtttcattctatgtcatggatatactatgaaaattgattagcttttttgattcaagtagttgtaatgaaaaagccatgacaattaaaaactattagacaactctctgtgggtcagtttttctattctttctcttggaatagctacaaataaatgaaaggtaacataaactctactgatgaaaccgactatatataatccaagaaccaattatttttattaacaggactcacggaggaagacagaagagggaagagaagtattaaccagttaattctactttaaagcaaagtggcaaaaatatactcagcttcacaatgagcctgaaagatgaaatttgtaaaccaacttcctacaatgatcacttttcttcctcttcttttagagaggtagaggttattttataaactaaacacaaagtatacttgccacagataagtggaaaaaattcacacactcaaaaatagtgatgcagttacgacaagaatggtcccttcatttatccttttattcatatattgagactagattatttggatggccaaccagtggaaatgaacacaactgcgctgcaaaaagaaagagaagtagctatcccattggcttaatgtcagctttgactttgtgtggaaagttttcaaacagtttaagaaattgggaagcagttattccaaatgataatttaactgcggtagcagcacaagcttatttatttcttgttcgcagtagtgtagaattaaaacaaacaaagcaaaacaagctctaccgagtctttaggcctggttcagggaagcctgcctgtgtattgaagaggtgtgagagccatcaacacctctccctccttgtggtaagatactggttttcatgaggtttacagacaacatgcatttgcaaatgaaatattaaattgtctccaaattttggcaacactctgtgcacgctgagattttgtggacccaggggtctatctctccaatttctgactaaaataacggatcgggaactggacgatcaatacgagggaggtcacatcttcagtatgtactatgacttcacttcaaagaaaaaaactgccttttccagcaagtgatgtcacttgcagaaaatgagaagcggtgattttctttcaagggcagtttggggacaaaatgtaaggctaaaaaccaattcctccacgagtgatcacaaagaacagaaactgatgggtcaagtccctcgtctaaggaaaaagattttcgagaagaaaatgagtgtagaaaagtgaccagaaagcgatcagcagggactcttcctccagctgcaggaagcaaactctcgatcggggtgagtggtaaaccagggccggcagacgcctctctcccccacggaccggcttcccgcaggtttgtggcgactgccccatgtgctatcaacgggcactctgagggagaagcgcccaaatcagccacggagcatctccacaagggccgcagcgggggcttaggggatcccagccatagcgcagcaggggaggggagagcacgtgaaacccaagccggaatcagcggaggaggatgcaggacccaggctgggcctagccctacctgcccagctcccgcagggcggggatcatggaagccagctccaggccatgttcccccatgctgaggctgcgaggcactagtcaaccacgccaacgcgggttcccggcgtctccaaagctaccgctgccggaagagcgcggcgcccgacggagccgtgtggaggccaaaactcctcccggaa
